US007960114B2

(12) United States Patent
Seigneuric et al.

(10) Patent No.: US 7,960,114 B2
(45) Date of Patent: Jun. 14, 2011

(54) GENE SIGNATURE OF EARLY HYPOXIA TO PREDICT PATIENT SURVIVAL (75) Inventors: Renaud G. Seigneuric, Crimolois (FR); Maud H. W. Starmans, Heerlen (NL); Glenn Fung, Madison, WI (US); Balaji Krishnapuram, King of Prussia, PA (US); Dimitry S. A. Nuyten, Branford, CT (US); Arie van Erk, Eindhoven (NL); Michael Gaston Magagnin, Riemst (BE); Kasper M. Rouschop, Wijnandsrade (NL); Sriram Krishnan, Exton, PA (US); R. Bharat Rao, Berwyn, PA (US); Christoffel Theodorus Anthonius Evelo, Geleen (NL); Adrian Campbell Begg, Amsterdam (NL); Bradly G. Wouters, Toronto (CA); Philippe Lambin, Genappe-Bousval (BE)

(73) Assignee: Siemens Medical Solutions USA, Inc., Malvern, PA (US)

( * ) Notice: Subject to any disclaimer, the term of this patent is extended or adjusted under 35 U.S.C. 154(b) by 140 days.

(21) Appl. No.: 12/113,373

(22) Filed: May 1, 2008

(65) Prior Publication Data
US 2009/0130096 A1 May 21, 2009

Related U.S. Application Data (60) Provisional application No. 60/915,531, filed on May 2, 2007.

(51) Int. Cl.
*C12Q 1/68* (2006.01)
(52) U.S. Cl. .......................................................... 435/6
(58) Field of Classification Search ........................ None
See application file for complete search history.

(56) References Cited

U.S. PATENT DOCUMENTS

| 7,421,417 B2 | 9/2008 | Mangasarian et al. |
| 2007/0021918 A1 | 1/2007 | Natsoulis et al. |

FOREIGN PATENT DOCUMENTS

| WO | 2006/119593 A | 11/2006 |
| WO | 2008/037700 A | 4/2008 |
| WO | 2008/094678 A | 8/2008 |

OTHER PUBLICATIONS

NCBI, "UniGene entry Hs.596783 has been retired," printed Mar. 2010, one page.*
Sorlie et al (PNAS, 2001, 98:10869-10874).*
Chi et al (PLoS medicine, Mar. 2006, 3:395-409).*
Sorlie et al, 2001, Supplemental Figure 5.*
Sorlie et al, 2001, Supplemental Figure 7.*
Sorlie et al, 2001, Supplemental Figure 8.*
Tockman et al (Cancer Res., 1992, 52:2711s-2718s).*
Bi, J., Bennett, K., Embrechts, M., Breneman, C. & Song, M. "Dimensionality reduction via sparse support vector machines" Journal of Machine Learning Research 3, 1229-1243 (2003).
David G. Kleinbaum and J. Klein, "Statistics for Biology and Health—A Self-Learning Text", Springer, Second Edition, 2003; pp. 45-82.
Span et al., "Carbonic anhydrase-9 expression levels and prognosis in human breast cancer: Association with treatment outcome", British Journal of Cancer, vol. 89, No. 2, Jul. 21, 2003, pp. 271-276.
Trastour et al., "HIF-1 alpha and CA IX staining in invasive breast carcinomas: Prognosis and treatment outcome", International Journal of Cancer, John Wiley & Sons, Inc, US, Switzerland, Germany, vol. 120, No. 7, Apr. 1, 2007, pp. 1451-1458.
Lal et al., "Transcriptional response to hypoxia in human tumors", Journal of the National Cancer Institute (Bethesda), vol. 93, No. 17, Sep. 5, 2001, pp. 1337-1343.
Wang et al., "Gene selection for microarray data analysis using principal component analysis", Statistics in Medicine, vol. 24, No. 13, Jul. 2005, pp. 2069-2087.
Maokuan et al.", Unlabeled data classification via support vector machines and k-means clustering", Computer Graphics, Imaging and Visualization, 2004, CGIV 2004, Proceedings International Conference on Penang, Malaysia, Jul. 26-29, 2004, IEEE, Piscataway, NJ Jul. 26, 2004, pp. 183-186.
Ataman et al., "Learning to rank by maximizing AUC with linear programming", IJCNN '06, International Joint Conference on Neural Networks, IEEE, Piscataway, NJ, 2006, pp. 123-129.
Starmans et al., "Proliferation and 'invasiveness' gene-expression signatures predict survival of surgically treated non-small-cell lung cancer: D6-03", Journal of Thoracic Oncology, Suppl. 4, vol. 2, No. 8, Aug. 2007, p. S407.
Rosenwald et al., "The proliferation gene expression signature is a quantitative integrator of oncogenic events that predicts survival in mantle cell lymphoma", Cancer Cell, vol. 3, No. 2, Feb. 1, 2003, pp. 185-197.
Whitfield et al., "Common markers of proliferation", Nature Reviews, Cancer Feb. 2006, vol. 6, No. 2, pp. 99-106.
Sotiriou et al., "Comprehensive molecular analysis of several prognostic signatures using molecular indices related to hallmarks of breast cancer: proliferation index appears to be the most significant component of all signatures", Breast Cancer Research and Treatment, vol. 100, No. Suppl. 1, 2006, p. S86.
Desmedt et al., "Proliferation—The most prominent predictor of clinical outcome in breast cancer", Cell Cycle, vol. 5, No. 19, Aug. 1, 2006, pp. 2198-2202.
Rhodes et al., "Large-scale meta-analysis of cancer microarray data identifies common transcriptional profiles of neoplastic transformation and progression", Proceedings of the National Academy of Sciences of USA, National Academy of Science, Washington, DC, vol. 101, No. 25, Jun. 22, 2004, pp. 9309-9314.
International Search Report including Notification of Transmittal of the International Search Report, International Search Report, and Written Opinion of the International Searching Authority.

(Continued)

*Primary Examiner* — Laura B Goddard
(74) *Attorney, Agent, or Firm* — Joshua B. Ryan (57) ABSTRACT

The present invention provides methods and compositions for predicting patient responses to cancer treatment using hypoxia gene signatures. These methods can comprise measuring in a biological sample from a patient the levels of gene expression of a group of the genes designated herein. The present invention also provides for microarrays that can detect expression from a group of genes.

2 Claims, 2 Drawing Sheets

OTHER PUBLICATIONS

Smith, "Neuroprotection against hypoxia-ischemia by insulin-like growth factor-I (IGF-I)", Investigational Drugs Journal; Dec. 2003; vol. 6, No. 12, pp. 1173-1177.

Klein et al., "Statistics for Biology and Health—A Self-Learning Text", Springer, Second Edition, 2003; pp. 45-82.

Bild, A.H., et al., "Linking Oncogenic Pathways with Therapeutic Opportunities", Nat. Rev. Cancer, 2006; 6 (9): 735-41.

Fan, JB, et al., "Highly parallel genomic assays", Nat Rev Genet 2006;7:632-44.

Quackenbush, J., "Microarray Analysis and Tumor Classification", N. Eng. J. of Med., 2006; 354(23): 2463-72.

Han, Z, et al., "Signal transduction network motifs and biological memory", J Theor Biol 2007;246:755-61.

Hood, L, et al., "Systems biology and new technologies enable predictive medicine", Science 2004;306:640-3.

Chang, H.Y., et al., "Gene Expression Signature of Fibroblast Serum Response Predicts Human Cancer Progression: Similarities Between Tumors and Wounds", PLoS Biol., 2004; 2(2):E7.

Chi, J.T., et al., "Gene Expression Programs in Response to Hypoxia: Cell Type Specificity and Prognostic Significance in Human Cancers", PLoS Med., 2006; 3(3):E47.

Palsson, B., "The challenges of in silico biology", Nat Biotechnol 2000;18:1147-50.

Perou, CM, et al., "Molecular portraits of human breast tumours", Nature 2000;406:747-52.

Chang HY, et al., "Robustness, scalability, and integration of a wound-response gene expression signature in predicting breast cancer survival" Proc Natl Acad Sci U S A 2005;102(10):3738-43.

Seigneuric, R, et al., "Impact of supervised gene signatures of early hypoxia on patient survival", Rad. Oncol 2007.

van de Vijver MJ, et al., "A gene-expression signature as a predictor of survival in breast cancer", N Engl. J Med 2002; 347(25):1999-2009.

Semenza, GL., "Targeting HIF-1 for cancer therapy", Nat Rev Cancer 2003;3:721-32.

Vogelstein, B., et al., "Surfing the p53 network", Nature 2000;408:307-10.

West, M, et al., "Embracing the complexity of genomic data for personalized medicine", Genome Res 2006;16:559-66.

Ramaswamy, S, et al., "Multiclass cancer diagnosis using tumor gene expression signatures", Proc Natl Acad Sci U S A 2001;98:15149-54.

Wouters, BG., et al., "Targeting hypoxia tolerance in cancer", Drug Resist Updat 2004;7:25-40.

I. Guyon, et al., "Gene selection for cancer classification using support vector machines", Machine Learning 2002;46,1-3, 389-422.

M. Schmidt, et al., "Fast optimization methods for L1 regularization: A comparatve study and two new approaches" To be published in the ECML 2007 proceedings (http://pages.cs.wisc.edu/~gfung/GeneralL1/).

S. Agarwal, et al., "Leaning to Rank", Procedings of the NIPS 2005 workshop. 2005.

G. Fung, et al., "Learning rankins via convex hull separations", NIPS 18 2006.

R. Rosales, et al., "Learning sparse metrics via linear programming", Procedings of the 2006 conference on Knowledge Discovery and Data Mining (KDD 2006). 2006.

Miller LD, et al., "An expression signature for p53 status in human breast cancer predicts mutation status, transcriptional effects, and patient survival", Proc Natl. Acad. Sci. U S A 2005; 102(38):13550-5.

Fung, G., et al., "Reducing a biomarkers list via mathematical programming: application to gene signatures to detect time-dependent hypoxia in cancer".

Bussink, J., et al., "Microenvironmental transformations by VEGF- and EGF-receptor inhibition and potential implications for responsiveness to radiotherapy", Radiother. Oncol., 2007; 82: 10-7.

Chung, C.H., et al., "Molecular portraits and the family tree of cancer", Net. Genet., 2002; 32 Suppl.: 533-40.

van 't Veer LJ, et al., "Gene expression profiling predicts clinical outcome of breast cancer", Nature 2002; 415(6871):530-6.

Denko, N.C., et al., "Investigating hypoxic tumor physiology through gene expression patterns", Oncogene, 2003; 22: 5907-14.

Eisen, et al., "Cluster analysis and display of genome-wide expression patterns", Proc. Natl. Acad. Sci. USA, 1998; 95:14863-8.

Eriksen, et al., "Tumour hypoxia—a characteristic feature with a complex molecular background", Radiother. Oncol., 2006; 81:119-21.

Huang, et al., "Gene expression phenotypes of oncogenic signaling pathways", Cell Cycle, 2003; 2:415-7.

Iyer, et al., "The transcriptional program in the response of human fibroblasts to serum", Science, 1999: 283:83-7.

Kietzmann, et al., "Signaling cross-talk between hypoxia and glucose via hypoxia-inducible factor 1 and glucose response elements", Biochem. Pharmacol., 2002; 64:903-11.

Koritzinsky, et al., "The hypoxic proteome is influenced by gene-specific changes in mRNA translation", Radiother. Oncol., 2005; 76:177-86.

Riedemann, et al., "IGF1R signaling and its inhibition", Endocr. Relat. Cancer, 2006; 13 Suppl.:S33-43.

Sjogren, et al., "The p53 gene in breast cancer" prognostic value of complementary DNA sequencing versus immunohistochemistry, J. of Natl. Cancer Inst., 1996; 88:173-82.

Sorenson, et al., "Influence of oxygen concentration and pH on expression of hypoxia induced genes", Radiother. Oncol., 2005; 76:187-93.

Troost, et al., Imaging hypoxia after oxygenation-modification: comparing [18F]FMISO autoradiography with pimonidazole immunohistochemistry in human xenograft tumors, Radiother. Oncol., 2006; 80:157-64.

Vaupel, P., "The role of hypoxia-induced factors in tumor progression", Oncologist, 2004; 9 Suppl. 5:10-7.

* cited by examiner

GENE SIGNATURE OF EARLY HYPOXIA TO PREDICT PATIENT SURVIVAL

CROSS-REFERENCE TO RELATED APPLICATION

The present patent document claims the benefit of the filing date under 35 U.S.C. §119(e) of Provisional U.S. Patent Application Ser. No. 60/915,531, filed May 2, 2007, which is hereby incorporated by reference.

BACKGROUND

Field of the Invention

Maintenance of physiological oxygen concentrations is a highly dynamic process vital to many aspects of cell biology. Lack of oxygen (hypoxia) is a frequently encountered situation in solid tumors and is associated with increased radiotherapy and chemotherapy resistance, malignancy and poor prognosis (2, 8, 18, 19, 22, and 23). Hypoxia is known to be highly heterogeneous within tumors in terms of its spatial distribution, severity and kinetics. Hypoxia arises through different mechanisms associated primarily with limits in oxygen diffusion (chronic hypoxia) and blood perfusion (acute hypoxia). In addition, hypoxia regulates several different cellular pathways that have unique activation kinetics and sensitivity to oxygen concentration. As a consequence, hypoxia regulated gene expression is complex and displays large temporal characteristics.

With DNA microarrays, it is now possible to monitor the expression of several tens of thousands of genes at once. In oncology, this ability is exploited to extract lists of genes (or gene signatures) rather than to rely on a few clinical variables for diagnosis (5, 14) or prognosis. For the latter, these gene sets include those derived from clinical data, in which correlation with a supervised classifier identifies the clinical group with a better or worse prognosis (13, 20, 21). More recently, in vitro derived gene sets have been described containing genes associated with a particular phenotype hypothesized to be clinically important (1, 3, 4, 9). This allows an unbiased test of such a hypothesis, by applying the in vitro derived signature to a separate patient microarray study. This latter type of study recently demonstrated that a gene signature for hypoxia could act as a prognostic factor in a range of different tumor types. In this latter study, Chi et al. (4) also measured the temporal gene expression programs under hypoxia for several primary cell lines in vitro. The Chi et al. dataset might be used to extract hypoxic gene signatures that reflect differences between slow and fast hypoxia kinetic responses and their contribution to prognosis because of the large dependency of hypoxic gene expression on time. In view of the above, it is apparent that there exists a need for improved hypoxic gene signatures for the identification, diagnosis, and treatment of cancer.

SUMMARY

In one aspect, the present invention provides for methods for predicting patient response to cancer treatment comprising measuring in a biological sample from a patient the levels of gene expression of a plurality of genes selected from the groups consisting of Group A, B, and C, defined below: a. Group A: Genes corresponding to transcripts associated with the Unigene ID Nos. Hs.592692, Hs.633514, Hs.127126, Hs.334587, Hs.648626, Hs.646346, Hs.584803, Hs.567495, Hs.651126, Hs.478746, Hs.72550, Hs.154276, Hs.233568, Hs.106861, Hs.414-418, Hs.593565, Hs.235116, Hs.554791, Hs.226780, Hs.525549, Hs.536158, Hs.438-489, Hs.643279, Hs.189772, Hs.78977, Hs.155983, Hs.612872, Hs.435933, Hs.489603, Hs.128959, Hs.335205, Hs.146406, Hs.596783, Hs.512973, Hs.461030, Hs.149983, Hs.464137, Hs.292524, Hs.283749, Hs.287362, Hs.492203, Hs.250693, Hs.593232, Hs.590575, Hs.428214, Hs.523847, Hs.533712, Hs.44067, Hs.647072, Hs.606472, Hs.149032, Hs.436705, Hs.631539, Hs.529353, Hs.592020, Hs.642938, Hs.631930, Hs.148907, Hs.160556, Hs.126891, Hs.124011, Hs.524828, Hs.4779, Hs.612872, Hs.233240, Hs.445030, Hs.460, Hs.112432, Hs.544738, Hs.530941, Hs.180903, Hs.76364, Hs.43627, Hs.643599, Hs.125038, Hs.131342, Hs.512767, Hs.631974, Hs.112873, and Hs.6217; b. Group B: Genes corresponding to transcripts associated with the Unigene ID Nos. Hs.72550, Hs.528299, Hs.510078, Hs.633514, Hs.602706, Hs.642877, Hs.593232, Hs.596783, Hs.441113, Hs.149983, Hs.94542, Hs.154276, Hs.189772, Hs.112432, Hs.643599, Hs.126774, Hs.146406, Hs.463838, Hs.523847, Hs.46700, Hs.55131, Hs.558396, Hs.148907, Hs.643920, Hs.160556, Hs.562083, Hs.515383, Hs.513430, Hs.155983, Hs.590575, Hs.632226, Hs.165607, Hs.514033, Hs.632447, Hs.89603, and Hs.434961; and c. Group C: Genes corresponding to transcripts associated with the Unigene ID Nos. Hs.72550, Hs.633514, Hs.593232, Hs.596783, Hs.149983, Hs.154276, Hs.189772, Hs.112432, Hs.643599, Hs.146406, Hs.523847, Hs.148907, Hs.160556, Hs.155983, and Hs.590575; and creating a signature score from said levels of gene expression; and correlating the signature score with a predicted response to cancer treatment.

In certain embodiments, the levels of gene expression are measured by determining the levels of expression of a group of polynucleotide sequences selected from the group consisting of: d. the sequences SEQ ID NOS: 1-80; e. the sequences SEQ ID NOS: 11, 81, 82, 2, 83, 84, 43, 33, 85, 36, 86, 12, 24, 68, 74, 87, 32, 88, 46, 89, 90, 91, 58, 92, 59, 93, 94, 95, 26, 44, 96, 97, 98, 99, 100, and 101; and f. the sequences SEQ ID NOS: 11, 2, 43, 33, 36, 12, 24, 68, 74, 32, 46, 58, 59, 26, and 44. In particular embodiments, the cancer is breast, renal, or lung cancer. In certain embodiments, the measuring of the levels of gene expression is carried out on RNA from said biological sample. The biological sample in particular embodiments is from a tumor, a cancerous tissue, a pre-cancerous tissue, a biopsy, a tissue, lymph node, a surgical excision, blood, serum, urine, an organ, or saliva. The treatment of the cancer may comprise radiotherapy, fractionated radiotherapy, chemotherapy, or chemo-radiotherapy in particular embodiments.

In a second aspect, the present invention provides for microarrays comprising: a solid substrate and a plurality of nucleic acid probes capable of detecting the levels of gene expression of a plurality of genes selected from the groups consisting of Group A, B, and C, defined below: a. Group A: Genes corresponding to transcripts associated with the Unigene ID Nos. Hs.592692, Hs.633514, Hs.127126, Hs.334587, Hs.648626, Hs.646346, Hs.584803, Hs.567495, Hs.651126, Hs.478746, Hs.72550, Hs.154276, Hs.233568, Hs.106861, Hs.414-418, Hs.593565, Hs.235116, Hs.554791, Hs.226780, Hs.525549, Hs.536158, Hs.438-489, Hs.643279, Hs.189772, Hs.78977, Hs.155983, Hs.612872, Hs.435933, Hs.489603, Hs.128959, Hs.335205, Hs.146406, Hs.596783, Hs.512973, Hs.461030, Hs.149983, Hs.464137, Hs.292524, Hs.283749, Hs.287362, Hs.492203, Hs.250693, Hs.593232, Hs.590575, Hs.428214, Hs.523847, Hs.533712, Hs.44067, Hs.647072, Hs.606472, Hs.149032, Hs.436705, Hs.631539, Hs.529353, Hs.592020, Hs.642938, Hs.631930, Hs.148907, Hs.160556, Hs.126891, Hs.124011, Hs.524828, Hs.4779, Hs.612872, Hs.233240, Hs.445030, Hs.460, Hs.112432, Hs.544738, Hs.530941, Hs.180903, Hs.76364, Hs.43627, Hs.643599, Hs.125038, Hs.131342, Hs.512767, Hs.631974, Hs.112873, and Hs.6217; b. Group B: Genes corresponding to transcripts associated with the Unigene ID Nos. Hs.72550, Hs.528299, Hs.510078, Hs.633514, Hs.602706, Hs.642877, Hs.593232, Hs.596783, Hs.441113, Hs.149983, Hs.94542, Hs.154276, Hs.189772, Hs.112432, Hs.643599, Hs.126774, Hs.146406, Hs.463838, Hs.523847, Hs.46700, Hs.55131, Hs.558396, Hs.148907, Hs.643920, Hs.160556, Hs.562083, Hs.515383, Hs.513430, Hs.155983, Hs.590575, Hs.632226, Hs.165607, Hs.514033, Hs.632447, Hs.89603, and Hs.434961; and c. Group C: Genes corresponding to transcripts associated with the Unigene ID Nos. Hs.72550, Hs.633514, Hs.593232, Hs.596783, Hs.149983, Hs.154276, Hs.189772, Hs.112432, Hs.643599, Hs.146406, Hs.523847, Hs.148907, Hs.160556, Hs.155983, and Hs.590575. In particular embodiments, the microarray contains a plurality of nucleic acid probes are capable of detecting the expression of a group of sequences selected from the group consisting of: d. the sequences SEQ ID NOS: 1-80; e. the sequences SEQ ID NOS: 11, 81, 82, 2, 83, 84, 43, 33, 85, 36, 86, 12, 24, 68, 74, 87, 32, 88, 46, 89, 90, 91, 58, 92, 59, 93, 94, 95, 26, 44, 96, 97, 98, 99, 100, and 101; and f. the sequences SEQ ID NOS: 11, 2, 43, 33, 36, 12, 24, 68, 74, 32, 46, 58, 59, 26, and 44. In particular embodiments, the plurality of probes comprise DNA sequences. The plurality of probes are capable of hybridizing to the sequences of at least one of the groups (d)-(f) under the hybridization conditions of 6×SSC at 65° C., in certain embodiments. In certain embodiments, the plurality of probes comprise from about 15 to 50 base pairs of DNA.

In a third aspect, the present invention provides for kits comprising a microarray comprising a plurality of nucleic acid probes capable of detecting the expression of a group of sequences selected from the group consisting of: groups (d)-(f) described above; and directions for us of the kit.

In a fourth aspect, the present invention provides for methods of treating cancer comprising measuring in a biological sample from a patient the levels of gene expression of a plurality of genes selected from the groups consisting of Group A, B, and C, defined below: a. Group A: Genes corresponding to transcripts associated with the Unigene ID Nos. Hs.592692, Hs.633514, Hs.127126, Hs.334587, Hs.648626, Hs.646346, Hs.584803, Hs.567495, Hs.651126, Hs.478746, Hs.72550, Hs.154276, Hs.233568, Hs.106861, Hs.414-418, Hs.593565, Hs.235116, Hs.554791, Hs.226780, Hs.525549, Hs.536158, Hs.438-489, Hs.643279, Hs.189772, Hs.78977, Hs.155983, Hs.612872, Hs.435933, Hs.489603, Hs.128959, Hs.335205, Hs.146406, Hs.596783, Hs.512973, Hs.461030, Hs.149983, Hs.464137, Hs.292524, Hs.283749, Hs.287362, Hs.492203, Hs.250693, Hs.593232, Hs.590575, Hs.428214, Hs.523847, Hs.533712, Hs.44067, Hs.647072, Hs.606472, Hs.149032, Hs.436705, Hs.631539, Hs.529353, Hs.592020, Hs.642938, Hs.631930, Hs.148907, Hs.160556, Hs.126891, Hs.124011, Hs.524828, Hs.4779, Hs.612872, Hs.233240, Hs.445030, Hs.460, Hs.112432, Hs.544738, Hs.530941, Hs.180903, Hs.76364, Hs.43627, Hs.643599, Hs.125038, Hs.131342, Hs.512767, Hs.631974, Hs.112873, and Hs.6217; b. Group B: Genes corresponding to transcripts associated with the Unigene ID Nos. Hs.72550, Hs.528299, Hs.510078, Hs.633514, Hs.602706, Hs.642877, Hs.593232, Hs.596783, Hs.441113, Hs.149983, Hs.94542, Hs.154276, Hs.189772, Hs.112432, Hs.643599, Hs.126774, Hs.146406, Hs.463838, Hs.523847, Hs.46700, Hs.55131, Hs.558396, Hs.148907, Hs.643920, Hs.160556, Hs.562083, Hs.515383, Hs.513430, Hs.155983, Hs.590575, Hs.632226, Hs.165607, Hs.514033, Hs.632447, Hs.89603, and Hs.434961; and c. Group C: Genes corresponding to transcripts associated with the Unigene ID Nos. Hs.72550, Hs.633514, Hs.593232, Hs.596783, Hs.149983, Hs.154276, Hs.189772, Hs.112432, Hs.643599, Hs.146406, Hs.523847, Hs.148907, Hs.160556, Hs.155983, and Hs.590575; and administering a therapeutically effective amount of one or more cancer treatment agents selected from the group consisting of: cancer chemotherapeutic agents and radiation; or performing surgery on the patient; or a combination thereof. In further embodiments, the levels of gene expression are measured by determining the levels of expression of a group of polynucleotide sequences selected from the group consisting of groups (d)-(f) described above.

In certain embodiments, the one or more cancer treatment agents are selected from the group consisting of: paclitaxel, docetaxel, imatinib mesylate, sunitinib malate, cisplatin, etoposide, vinblastine, methotrexate, adriamycin, cyclophosphamide, doxorubicin, daunomycin, 5-fluoruracil, vincristine, endostatin, angiostatin, bevacizumab, and rituximab. In another embodiment, the one or more cancer treatment agents is radiation. In particular embodiments, the cancer being treated is breast, renal, or lung cancer. In certain embodiments, the methods of treatment comprise surgery.

Further objects, features and advantages of this invention will become readily apparent to persons skilled in the art after a review of the following description, with reference to the drawings and claims that are appended to and form a part of this specification.

BRIEF DESCRIPTION OF THE DRAWINGS

FIG. 1 depicts Kaplan-Meier survival curves for disease specific survival (follow-up to 12 years) and p-values for different gene signatures. For the groups in A, B, C and (left-hand top and bottom panels), the group with the low expression is the top curve, the group with the high expression is the bottom curve. For the groups in C (right-hand top panel and right-hand bottom panel), the group with the high expression is the top curve, the group with the low expression is the bottom curve. Panel A is the (A) Chi signature (8). Panel B are the early hypoxia (under 0 or 2%), signatures. Panel (C) are the late signatures. A signature score was calculated for each patient in the different datasets. These scores were used to cluster the patients in two groups, one with low expression and one with high expression of the signature. Kaplan-Meier survival curves for the two groups were compared. Patients with tumors with a high proliferation signature score had worse outcomes than those with tumors with a low proliferation signature score.

DETAILED DESCRIPTION

Figure 1A:
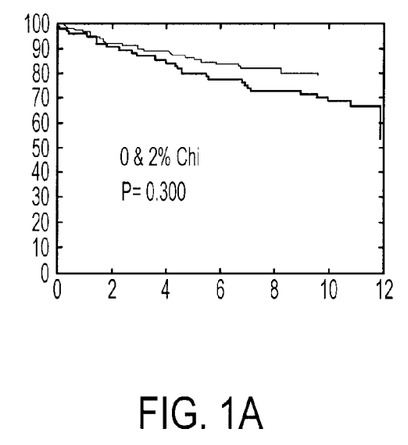
Figure 1B:
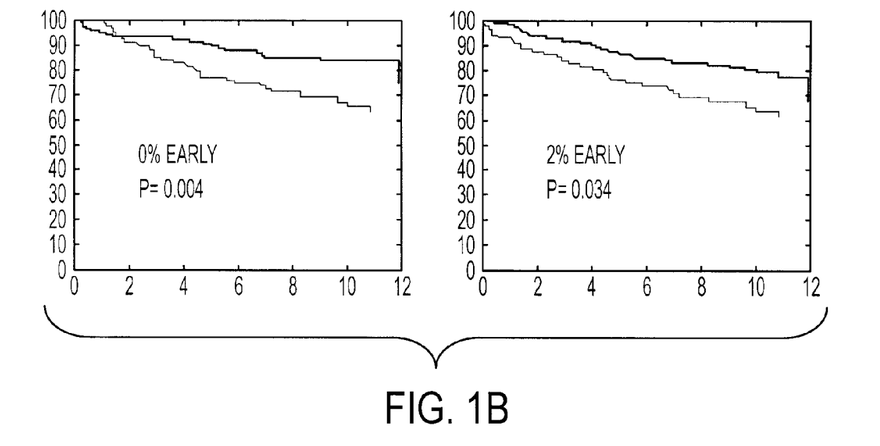
Figure 1C:
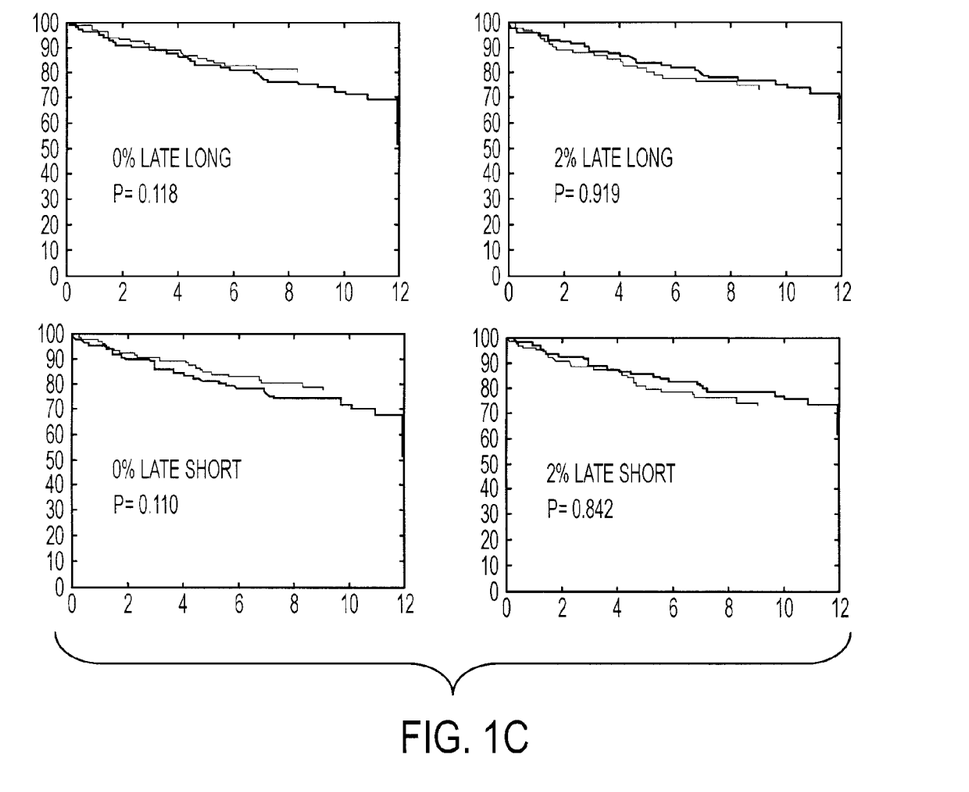

Hypoxia is a common feature of solid tumors associated with therapy resistance, increased malignancy and poor prognosis. Several approaches have been developed with the hope of identifying patients harboring hypoxic tumors including the use of microarray based gene signatures. However, studies to date have largely ignored the strong time dependency of hypoxia regulated gene expression. It is hypothesized that use of time-dependent patterns of gene expression during hypoxia would enable development of superior prognostic expression signatures.

The present invention provides methods and compositions for predicting patient response to cancer treatment using gene signatures. The methods typically involve measuring in a biological sample from a patient the levels of gene expression of a group of the genes corresponding to transcripts associated with a particular groups of Unigene ID Nos. In particular embodiments, the Unigene ID Nos. are selected from groups (a)-(c) as set out above. One Unigene ID No. may have multiple transcripts associated with it. Examples of a DNA sequence associated with each Unigene ID No. of groups (a) may be found in Table 2A as SEQ ID NOS. 1-80.

To examine the levels of gene expression of one or more sequences or Unigene ID Nos., a biological sample of a patient that is suffering from a cancer or who has yet to be diagnosed with cancer is typically assayed. A "biological sample" includes a sample from a tumor, cancerous tissue, pre-cancerous tissue, biopsy, tissue, lymph node, surgical excision, blood, serum, urine, organ, saliva, etc. obtained from a patient suffering from a cancer or who has yet to be diagnosed with cancer.

The biological sample is then typically assayed from the presence of one or more gene expression products such as RNA, cDNA, cRNA, protein, etc.

In one embodiment, mRNA from a biological sample is directly used in determining the levels of expression of a group of genes. In one particular embodiment, RNA is obtained from a biological sample. The RNA is then transformed into cDNA (complementary DNA) copy using methods known in the art. In particular embodiments, the cDNA is labeled with a fluorescent label or other detectable label. The cDNA is then hybridized to a substrate containing a plurality of probes of interest. A probe of interest typically hybridizes under stringent hybridization conditions to at least one DNA sequence of a gene signature. In certain embodiments, the plurality of probes are capable of hybridizing to the sequences of at least one of the group of DNA sequences of groups (d)-(f) under the hybridization conditions of 6×SSC (0.9 M NaCl, 0.09 M sodium citrate, pH 7.4) at 65° C. The probes may comprise nucleic acids. An example of a nucleic acid is DNA. The term "nucleic acid" refers to deoxyribonucleotides or ribonucleotides and polymers thereof. The term encompasses nucleic acids containing known nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs include, without limitation, phosphorothioates, phosphoramidates, methyl phosphonates, chiral-methyl phosphonates, peptide-nucleic acids (PNAs).

In certain cases, the probes will be from about 15 to about 50 base pairs in length. The amount of cDNA hybridization can be measured by assaying for the presence of the detectable label, such as a fluorophore. The quantification of the hybridization signal can be used to generate a score for a particular sequence or set of sequences in the gene signature for a particular patient or plurality of patients.

The term "detectable label" refers to a moiety that is attached through covalent or non-covalent means to an entity being measured or a probe. A "detectable label" can be a radioactive moiety, a fluorescent moiety, a chemiluminescent moiety, etc. The term "fluorescent label" refers to label that accepts radiant energy of one wavelength and emits radiant energy of a second wavelength. The presence of a detectable label may be assayed using methods known in the art that are appropriate to detect a particular label, such as spectrophotometric means (e.g., a spectrophotometer), radiometric means (e.g., scintillation counter), fluorometer, luminometer, etc.

Included within the scope of the invention are DNA microarrays containing a plurality of sequences that hybridize under stringent hybridization conditions to one or more of the gene sequences in a gene signature. An example of a substrate containing one or more probes of interest is a plurality of DNA probes that are affixed to a substrate. In certain embodiments, the substrate may comprise one or more materials such as gel, nitrocellulose, nylon, quartz, glass, metal, silica based materials, silica, resins, polymers, etc., or combinations thereof. Typically, the DNA probes comprise about 10-50 bp of contiguous DNA. In certain embodiments, the DNA probes are from about 20 to about 50 bp of contiguous DNA. In certain embodiments, the present invention relates to kits which comprising a microarray directions for its use. The kit may comprise a container which comprises one or more microarrays and directions for their use.

The biological sample may also be analyzed for gene expression of one or more genes in a signature using methods that can detect nucleic acids including, but not limited to, PCR (polymerase chain reaction); RT-PCT (reverse transcriptase-polymerase chain reaction); quantitative PCR, etc.

In certain embodiments, the levels of gene expression are measured by detecting the protein expression products of the genes or DNA sequences. The levels of protein products may be measured using methods known in the art including the use of antibodies which specifically bind to a particular protein. These antibodies, including polyclonal or monoclonal antibodies, may be produced using methods that are known in the art. These antibodies may also be coupled to a solid substrate to form an antibody chip or antibody microarray. Antibody or protein microarrays may be made using methods that are known in the art.

Once the levels of gene expression have been measured then a signature score is created. Examples of how to create a signature score are described herein. The signature score is then correlated with a predicted response to cancer treatment. Typically, a Kaplan-Meier curve may be generated to determine if the signature score is associated with a higher or lower survival rate. In particular embodiments, a positive or negative numerical weight may be assigned to a sequence or Unigene ID No. in the creation of a signature score. If the signature score is associated with a lower survival rate, then aggressive cancer treatment may be indicated. If the signature score is associated with a higher survival rate then less aggressive cancer treatment may be indicated.

The treatment of cancer in certain embodiments, involves measuring the levels of gene expression of a group of Unigene ID Nos. selected from the group consisting of groups (a)-(c). The method of treatment typically further comprises administering a therapeutically effective amount of one or more cancer treatment agents selected from the group consisting of: cancer chemotherapeutic agents and radiation. The treatment of cancer may also comprise surgery or surgical procedures. The treatment of cancer may further comprise surgery and administering a therapeutically effective amount of one or more cancer treatment agents selected from the group consisting of: cancer chemotherapeutic agents and radiation. The term "administering" refers to the method of contacting a compound with a subject. Modes of "administering" may include but are not limited to, methods that involve contacting the cancer chemotherapeutic agents intravenously, intraperitoneally, intranasally, transdermally, topically, via implantation, subcutaneously, parentally, intramuscularly, orally, systemically, and via adsorption. The term "treatment" includes the acute or prophylactic diminishment or alleviation of at least one symptom or characteristic associated or caused by the cancer being treated. For example, treatment can include diminishment of several symptoms of a cancer or complete eradication of a cancer. The phrase "therapeutically effective amount" means an amount of a cancer chemotherapeutic agent, or a pharmaceutically acceptable salt thereof, that is sufficient to inhibit, halt, or allow an improvement in the cancer being treated when administered alone or in conjunction with another pharmaceutical agent or treatment in a particular subject or subject population. For example in a human a therapeutically effective amount can be determined experimentally in a clinical setting, for the particular disease and subject being treated. It should be appreciated that determination of proper dosage forms, dosage amounts and routes of administration is within the level of ordinary skill in the pharmaceutical and medical arts.

It is within the purview of the skill medical practitioner to select an appropriate therapeutic regimen. Therapeutic regimens may be comprised of the use of cancer chemotherapeutic agents and/or radiation. A cancer chemotherapeutic agent is a chemical or biological agent (e.g., antibody, protein, RNA, DNA, etc.) that retards, slows, or stops the growth of cancer or is approved to treat cancer by the U.S. Food and Drug Administration. Examples of cancer chemotherapeutic agents include, but are not limited to: paclitaxel, docetaxel, imatinib mesylate, sunitinib malate, cisplatin, etoposide, vinblastine, methotrexate, adriamycin, cyclophosphamide, doxorubicin, daunomycin, 5-fluoruracil, vincristine, endostatin, angiostatin, bevacizumab, and rituximab. Another example of a cancer treatment agent is radiation. Thus, the cancer treatment may comprise radiotherapy, fractionated radiotherapy, chemotherapy, or chemo-radiotherapy (a combination of one or more chemotherapeutic agents and radiation). The cancer may be any type of cancer. In certain embodiments, the cancer is breast, renal, or lung cancer. Examples of cancer include, but are not limited to: small cell lung cancer, squamous cell lung carcinoma, glioma, breast cancer, prostate cancer, ovarian cancer, cervical cancer, gliobastoma, endometrial carcinoma, heptocellular carcinoma, colon cancer, lung cancer, melanoma, renal cell carcinoma, renal cancer, thyroid carcinoma, squamous cell lung carcinoma, leukemia, cell lymphoma, and lymphoproliferative disorders.

EXAMPLES

Material and Methods

Using published data from the microarray study of Chi et al. (4) gene signatures were extracted correlating with induction during either early or late hypoxic exposure. Gene signatures were derived from in vitro exposed human mammary epithelial cell line (HMEC) under 0% or 2% oxygen. Gene signatures correlating with early and late upregulation were tested by means of Kaplan-Meier survival, univariate, and multivariate analysis on a patient dataset with primary breast cancer treated conventionally (surgery plus on indication radiotherapy and systemic therapy).

Results

Two early hypoxia gene signatures extracted from 0 and 2% hypoxia showed significant prognostic power (log-rank test: p=0.004 at 0%, and p=0.034 at 2%) in contrast to the late hypoxia signatures. Both early gene signatures were linked to the insulin pathway. From the multivariate Cox-regression analysis the early hypoxia signature (p=0.254) was found to be the fourth best prognostic factor after lymph node status (p=0.002), tumor size (p=0.016) and Elston grade (p=0.111). On this data set it indeed provided more information than ER (estrogen receptor) status or p53 status.

Conclusions

The hypoxic stress elicits a wide panel of temporal responses corresponding to different biological pathways. Early hypoxia signatures were shown to have a significant prognostic power. These data suggest that gene signatures identified from in vitro experiments could contribute to individualized medicine.

Material and Methods

Data Set

The starting material was the data set provided by the study of Chi et al. which represents, one of the largest set of time series under hypoxia with 2.4 million of gene expression measurements. Four normal cell lines were used: human coronary artery endothelial cells (ECs), smooth muscle cells (SMCs), human mammary epithelial cells (HMECs), and renal proximal tubule epithelial cells (RPTECs 1 and 2) under 2 oxygen concentrations (less than 0.02% (referred to herein as "0%), and 2%). Using cDNA microarrays of 42,000 reporters, gene expression was monitored under hypoxia resulting in 10 time series with at most 6 time points for each. After Chi et al. filtered for noise and intensity, the time series of the remaining 4,333 reporters was plotted (data now shown)). SM and HMEC both had the longest time series. i.e., six time points: 0, 1, 3, 6, 12, and 24 hours of hypoxia, each for two oxygen concentrations (less than 0.02% (referred to herein as "0%), and 2%). The absence of early time points did not allow for the inclusion of the other cell lines. As also found by Chi et al. it was not possible to clearly define differential expression for the SM cell line due to a low range of expression between up and down regulation. The following analysis thus focuses only on the 2 time series provided for the HMEC cell line: one with an oxygen concentration less than 0.02% (HMEC0), the other under 2% (HMEC2).

A batch query was made with SOURCE to translate the 4,333 CLONEIDs into UniGenes (last accession: February 2007, Build 199). A reporter (probe) was removed if at least one of the following criteria was met: no UniGene identifier was found (328 such reporters); one reporter corresponded to multiple UniGene identifiers (257 such reporters); the Gene Symbol was corresponding to mitochondria (28 such reporters); or the UniGene was not for human (1 such reporter).

For each time series independently, the remaining 3,719 reporters were further filtered out if at least 1 time point was missing. For HMEC0 this resulted in a time series of 1,196 reporters represented by 1,082 unique genes. For the HMEC2 series, it consisted of 1,047 reporters representing 955 unique genes.

Gene Expression Profiling

Extraction of genes with an up-regulation in early time points was assessed in a supervised way. A Pearson correlation was selected as a similarity distance to select profiles based on their time-dependent shape but regardless of their magnitude changes (i.e., an early low or an early high up-regulation are found to be equivalent in these conditions). A curve of interest representing the pattern of gene expression as a function of time was user-defined as a sequence of zeros and ones. The time points 1, 3, and 6 hours were considered early time points in the hypoxia response whereas 12 and 24 hours were reckoned late time points. The curve of interest for selecting genes with an early up-regulation that return back to basal level for late time points was thus set to be 0-111-00. This template was used to select each gene whose temporal profile was similar to this a priori determined pattern of expression. A filtering step was included to require at least a 2 fold induction (with respect to expression under control condition). This procedure was run for each cell line independently. A correlation coefficient of 0.6 was selected to provide gene lists of manageable sizes.

The early hypoxia signature (curve of interest: 0-111-00 for control-early-late time points) was compared to a late hypoxia pattern with a curve of interest being 0-000-11, meaning that gene expression had to be constant and equal to control value during the 3 early time points, then up-regulated at 12 and 24 hours of hypoxia. For each time series, three types of gene signature were derived: early hypoxia; late hypoxia (matching the correlation coefficient (long version); and late hypoxia matching the number of reporters (short version)).

Statistical Analyses

The gene expression based signatures extracted in vitro were evaluated in vivo on a large cancer study providing microarray data (accession number GSE3494). Clinical annotations for its 251 patients (a subset of the Uppsala cohort) with primary breast cancer (Table 1) treated with surgery plus on indication adjuvant radiotherapy and sytemic therapy (13, 16). Expression data was log-transformed and multiple reporters for the same gene symbol were averaged. Depending on the overall expression of the genes selected in the signature, a patient was assigned to either the high expression or the low expression group. Outcome in the two groups was analyzed and compared by the Kaplan-Meier method. Log-rank tests were computed to assess survival differences between the two groups. Univariate and multivariate Cox regression analyses were run with SPSS (SPSS. Chicago. IL.) including all the clinical variables and the early signature under 0%. A machine learning approach was also used to assess the impact of the early signature. It was composed of (1) a feature selection (by leave-one-out cross-validation) followed by (2) a validation stage consisting of a bootstrapping procedure (resampling with replacement) where a randomly picked 70% of the data was used for training and the remaining 30% of the data was used for testing. This procedure was repeated 100 times and the means and standard deviations of the results were reported. Also, multivariate models representing all the possible variable combinations ($2^8-1=255$) were tested and the top 5 performing models were retained.

Results

Correlating genes with a predefined pattern of interest was used to derive early hypoxia gene signatures from the HMEC cell lines under 0% and 2% oxygen. The genes reaching a correlation with the required temporal profile greater than 0.6 and a 2-fold induction or more were selected (Table 2). Results from log-rank tests on the Miller data set were reported in Table 3.

HMEC0%

This number of reporters correlating with early induction (early hypoxia gene signature) following exposure to 0% oxygen was equal to 80 (79 unique UniGenes) (see Table 2A) (signature (a)). For the same level of correlation, 241 reporters (210 unique UniGenes) were found for the late hypoxic signature (late long hypoxic Signature). For comparison, the required correlation was also increased to reduce the number of reporters to match a size similar to the early signature. This late short hypoxic signature contained 74 reporters (70 unique UniGenes) (see Table 2B). Of these three signatures, only the early hypoxia signature was significant on the breast cancer data set (p=0.004 for difference in survival). Surprisingly, the late signatures were not significant and showed no evidence of splitting the patients Into different prognostic groups (p=0.118. p=0.110 for the long and short versions respectively).

HMEC2%

Under 2% oxygen, the number of selected reporters was smaller than under 0% oxygen. The early gene signature contained 36 reporters (36 unique UniGenes) (see Table 2C) (signature (b)) exhibiting an upregulation within the first hours (1-3-6 hours) following hypoxia exposure. The late long hypoxia signature derived with a correlation threshold of 0.6 was made of 169 reporters (147 unique UniGenes). For the short version, the correlation threshold was raised to yield a size comparable to the early one. It was composed of 34 reporters (32 UniGenes) (see Table 2D). Similarly to the results under 0%, the early hypoxia signature was the only significant signature (p=0.034) while the long and short versions of the late hypoxia signature were not (p-value of 0.919 and 0.842 respectively).

Combination of Signatures (0% Oxygen and 2% Oxygen)

Time series without missing data HMEC under 0% oxygen (1,082 UniGenes) and 2% oxygen (955 UniGenes) had a large overlap: 793 UniGenes. Comparing the 2 early signatures revealed a small overlap (15 UniGenes) (see Table 2E) (signature (c)). This core HMEC response was also tested and had a p-value of 0.005 (log-rank test). The overlap between the 2 long late signatures showed an overlap of 93 UniGenes. This core signature for late response was tested and found to be not significant (p=0.240) on the breast cancer dataset.

In order to link the genes from the early signatures to biological functions, Gene Ontologies analyses were ran with Ingenuity Pathways Analysis (Ingenuity Systems, Redwood City, Calif.). The results provided for the top functions are shown in Table 4. For both early signatures, only 2 top functions were found. The genes selected for enrichment ('focus genes') are listed and mainly involved in proliferation, cell cycle, and cancer. For the core early response (intersection of 0 and 2% oxygen), the top function was related to amino acid metabolism.

Prognostic Power of the Early Signature (HMEC0)

A univariate Cox regression analysis was run for the early signature (HMECO) on the Miller data set with all the variables provided and the early hypoxia score. The signature score was found to be significant (p-value<0.05), while progesterone receptor ("PgR") status, estrogen receptor ("ER") status and age were not.

From the multivariate analysis (with a stepbackward feature selection procedure), the early hypoxia signature (p=0.254) was found to be the fourth best prognostic factor after lymph node status (p=0.002), tumor size (p=0.016) and Elston grade (p=0.111). On this data set, it indeed provided more information than ER status or p53 status (both individually and when combined with other variables) for instance.

A multivariate analysis with a machine learning-based feature selection approach was also run. Providing all the variables to the algorithm (but age and the early signature score) gave an Area Under the Curve ("AUC") of 62.3 with a standard deviation (std) of 0.07. Repeating the same analysis but adding age only gave an AUC of 62.2 with a std of 0.07. When age and the signature score were added together, the AUC was 62.5 (std of 0.07). When only the signature score was added, the AUC was 66.1 (std of 0.06). From the hundred runs computed for each analysis, a t-test was performed between the six variables and the signature score versus the six variables and the age. A p-value of 4.8e−6 suggested that age is less effective than the signature score on this data set.

It is also important to note that when all possible variable combinations were considered for training a multivariate model, four out of the top five performing combinations included the signature score.

Discussion

Early Hypoxia

The impact of the early response to hypoxia which with the exception of a few studies (e.g., (12)) is rarely investigated by means of microarrays. Due to potential differences arising for different oxygen concentrations, the 2 time series were treated independently. Both early hypoxia signatures were significant (p<0.01 at 0% oxygen; p<0.05 at 2% oxygen) whereas none of the late signatures were. A signature of the 15 common UniGenes (13 symbols) found in the 2 early signatures was also tested and found to be significant (p=0.005) (See Table 2E).

Ingenuity Pathways Analysis identified genes within this list including ACACA; AMH; BACH1; CCT2 (related to growth and apoptosis) and IFI6 in Cancer, Tumor Morphology, and Amino Acid Metabolism (Table 4). Focusing on the early signature at 0% oxygen (p=0.004) with Ingenuity Pathways Analysis revealed a significant contribution of IGF1R (from the canonical insulin pathway); TERT (Telomerase reverse transcriptase); AMH; COL6A3; and ACACA in apoptosis, growth, and proliferation. CCNH (from the estrogen receptor pathway) as well as transcription factors ATF3 and BACH1 were also identified. The early signature may reflect activation of the Unfolded Protein Response (ATF3 for instance), which is known to be activated rapidly in response to hypoxia. Cross-talk between oxygen and glucose metabolism via HIF1 have been reported (11, 15) as well as the protective role of IGF1 against cell degeneration in animal models after stroke such as hypoxia-ischemia (17).

Late Hypoxia

The late signatures (0% oxygen and 2% oxygen) were found to be very similar to the Chi signature, with an overlap for each one greater than 40% (and up to 70% with their short versions). The biological theme of the late signatures is also typical of a hypoxic response (6), with genes encoding proteins involved in the hypoxia pathway and angiogenesis (ANGPTL4, CA9, DDIT4, EGLN3, EGFR, HK2, HIG2, LOX); cell proliferation and apoptosis (BNIP3L, NDRG1, MXI1); glucose transport (many members of the solute carrier family including GLUT1); metabolism (ENO1, PGK1) and adrenomedullin (ADM). Similar to the four derived late hypoxia signatures, the Chi signature was found to be not significant in this data set. This suggests that late signatures are very similar to the Chi signature not only in gene content but also in terms of prognostic power.

Unsupervised and Supervised Hypoxia Signatures

Cluster analysis (7) is a commonly used technique (3, 10) to assess shared functions and common regulation in an unbiased way since the algorithm does not require user-defined (i.e. supervised) assumptions on the numbers nor type of clusters to be found. The underlying idea is that genes with a similar expression pattern are likely to also be involved in the same regulatory process (referred to as 'guilt by association'). This approach was used by Chi et al. to group temporal gene expression under hypoxia. From HMECs and RPTECs, one cluster of global up-regulated genes was then selected after visual inspection to form the 'epithelial cell hypoxia genes' or so-called Chi signature. The gene content of the early hypoxia signatures had virtually no overlap with the Chi signature: 2 UniGenes at 0% oxygen (Hs.149032, PIK3R4 and Hs.283749, RNASE4), and only 1 at 2% oxygen (Hs.94542, ALKBH1). This suggested that the early signatures are very different from the Chi signature.

Although external changes in milieu (e.g., hypoxia) are sensed very rapidly by the cell, large changes at the transcriptional level occur mostly after several hours. A supervised method was developed to extract a handful of genes involved in the early hypoxic response (i.e., from 1-6 hours of hypoxia). Overlap was seldom found between the early and the late signatures: only one UniGene at 0% oxygen (Hs.106861, NSD1), and none under 2% oxygen. It shows that early signatures are different from late signatures (including the Chi signature) both in gene content and in patients they select.

All early hypoxia signatures whether extracted under 0% oxygen, 2% oxygen or their overlap were found significant on the Miller data set. Focusing on the former for multivariate analyses confirmed its prognostic power. At this moment it is unclear why the early hypoxic signatures provide superior prognostic information in this dataset. It may reflect differential activation of hypoxia response pathways, but may also select patients with more aggressive tumors (more metastasis), resistance to treatment or both. Additional methods are currently being investigated to validate our early gene signatures such as in vitro experiments with RNAi to selectively downregulate gene products (e.g., TERT or IGF1R) or by further testing the gene signature on independent clinical data sets with distinct clinical features. This retrospective study could be useful In the field of radiotherapy and oncology by suggesting the need for a prospective clinical study providing clinical data together with microarray data and an independent measure of hypoxia (by Eppendorf electrodes or immunochemistry staining for instance).

CONCLUSION

This analysis shows that, consistently with our hypothesis, the early and late hypoxia responses are very different at the transcription level. In a relatively old cohort of patients with primary breast cancer treated by locoregional therapy and systemic adjuvant therapy, it was shown that early hypoxia signatures, but not late hypoxia responses, could correlate with survival differences. It suggests that gene signatures can provide a mean to select patients for individualized therapy.

TABLE 1

Clinical information for the 251 patients composing the validation set

| Characteristic | |
|---|---|
| No. of patients | 251 |
| Age - years | 62.1 ± 13.9 |
| Tumor stage - no. of patients (%) | |
| Stage I | 67 (26.7) |
| Stage II | 128 (51.0) |
| Stage III | 54 (21.5) |
| Tumor size - mm | 22.4 ± 12.5 |
| ER (estrogen receptor) status - no. of patients (%) | |
| positive | 213 (84.9) |
| negative | 34 (13.5) |
| Lymph node status - no. of patients (%) | |
| positive | 84 (33.5) |
| negative | 158 (62.9) |
| Progesterone receptor status - no. of patients (%) | |
| positive | 190 (75.7) |
| negative | 61 (24.3) |
| p53 status - no. of patients (%) | |
| positive | 58 (23.1) |
| negative | 193 (76.9) |

TABLE 2A

Early 0%

| # | UniGene | Symbol | corr. | max |
|---|---|---|---|---|
| 1 | Hs.592692 | | 0.95 | 1.59 |
| 2 | Hs.633514 | TIMP2 | 0.92 | 3.49 |
| 3 | Hs.127126 | CPEB4 | 0.91 | 1.80 |

TABLE 2A-continued

Early 0%

| # | UniGene | Symbol | corr. | max |
|---|---------|--------|-------|-----|
| 4 | Hs.334587 | RBPMS | 0.90 | 1.35 |
| 5 | Hs.648626 |  | 0.89 | 1.09 |
| 6 | Hs.646346 | GAS6 | 0.87 | 1.65 |
| 7 | Hs.584803 | ST3GAL1 | 0.87 | 1.45 |
| 8 | Hs.567495 | TRNT1 | 0.85 | 1.80 |
| 9 | Hs.651126 | DUSP3 | 0.85 | 1.50 |
| 10 | Hs.478746 | CENTB2 | 0.84 | 2.60 |
| 11 | Hs.72550 | HMMR | 0.83 | 1.81 |
| 12 | Hs.154276 | BACH1 | 0.83 | 1.18 |
| 13 | Hs.233568 | HIST1H2AL | 0.82 | 2.15 |
| 14 | Hs.106861 | NSD1 | 0.81 | 1.51 |
| 15 | Hs.414418 | BET1L | 0.80 | 3.41 |
| 16 | Hs.593565 |  | 0.80 | 4.08 |
| 17 | Hs.235116 | GRK6 | 0.79 | 1.94 |
| 18 | Hs.554791 | TP53I11 | 0.79 | 1.65 |
| 19 | Hs.226780 | OSTM1 | 0.79 | 1.86 |
| 20 | Hs.525549 | BTBD7 | 0.79 | 2.68 |
| 21 | Hs.536158 | PARG | 0.79 | 2.83 |
| 22 | Hs.438489 | ATP5S | 0.79 | 1.12 |
| 23 | Hs.643279 | EIF4EBP2 | 0.79 | 2.96 |
| 24 | Hs.189772 | CCT2 | 0.77 | 3.24 |
| 25 | Hs.78977 | PCSK1 | 0.76 | 2.18 |
| 26 | Hs.155983 | JMJD2A | 0.76 | 2.03 |
| 27 | Hs.612872 | TTLL5 | 0.76 | 2.23 |
| 28 | Hs.435933 | PHF10 | 0.76 | 1.55 |
| 29 | Hs.489603 | ATXN7L1 | 0.76 | 3.60 |
| 30 | Hs.128959 | PCF11 | 0.75 | 3.40 |
| 31 | Hs.335205 | SSH2 | 0.74 | 2.84 |
| 32 | Hs.146406 | NIT1 | 0.74 | 1.81 |
| 33 | Hs.596783 |  | 0.73 | 1.14 |
| 34 | Hs.512973 | PTPLAD1 | 0.73 | 1.71 |
| 35 | Hs.461030 | GFOD2 | 0.73 | 1.99 |
| 36 | Hs.149983 | PEX14 | 0.73 | 4.49 |
| 37 | Hs.464137 | ACOX1 | 0.73 | 2.21 |
| 38 | Hs.292524 | CCNH | 0.72 | 3.27 |
| 39 | Hs.283749 | RNASE4 | 0.71 | 1.74 |
| 40 | Hs.287362 | TLE3 | 0.71 | 4.38 |
| 41 | Hs.492203 | TERT | 0.71 | 1.20 |
| 42 | Hs.250693 | ZNF117 | 0.71 | 1.04 |
| 43 | Hs.593232 |  | 0.70 | 3.15 |
| 44 | Hs.590575 | GRM3 | 0.70 | 3.26 |
| 45 | Hs.428214 | MAML2 | 0.70 | 3.13 |
| 46 | Hs.523847 | IFI6 | 0.70 | 4.68 |
| 47 | Hs.533712 | RBM4 | 0.70 | 2.29 |
| 48 | Hs.44067 | C12orf53 | 0.69 | 1.69 |
| 49 | Hs.647072 | PRKAG2 | 0.68 | 1.59 |
| 50 | Hs.606472 |  | 0.68 | 3.93 |
| 51 | Hs.149032 | PIK3R4 | 0.68 | 1.21 |
| 52 | Hs.436705 | KIAA1219 | 0.68 | 2.10 |
| 53 | Hs.631539 | RAB4B | 0.67 | 2.42 |
| 54 | Hs.529353 | ACSS1 | 0.67 | 2.55 |
| 55 | Hs.592020 | IGF1R | 0.67 | 4.02 |
| 56 | Hs.642938 | IGFBP1 | 0.67 | 1.63 |
| 57 | Hs.631930 | LOC646450 | 0.67 | 2.42 |
| 58 | Hs.148907 | SLC5A12 | 0.66 | 5.14 |
| 59 | Hs.160556 | ACACA | 0.65 | 1.63 |
| 60 | Hs.126891 | IL22RA2 | 0.64 | 1.63 |
| 61 | Hs.124011 |  | 0.64 | 1.70 |
| 62 | Hs.524828 | ZNF664 | 0.64 | 3.12 |
| 63 | Hs.4779 | GATAD2B | 0.64 | 2.28 |
| 64 | Hs.612872 | TTLL5 | 0.63 | 1.63 |
| 65 | Hs.233240 | COL6A3 | 0.63 | 1.19 |
| 66 | Hs.445030 | RHOBTB3 | 0.63 | 3.76 |
| 67 | Hs.460 | ATF3 | 0.63 | 1.79 |
| 68 | Hs.112432 | AMH | 0.63 | 2.24 |
| 69 | Hs.544738 | LY86 | 0.63 | 3.32 |
| 70 | Hs.530941 | C12orf30 | 0.63 | 3.66 |
| 71 | Hs.180903 | NCAPH2 | 0.63 | 1.81 |
| 72 | Hs.76364 | AIF1 | 0.62 | 3.06 |
| 73 | Hs.43627 | SOX12 | 0.62 | 6.59 |
| 74 | Hs.643599 | PAPPA | 0.62 | 1.96 |
| 75 | Hs.125038 | FAM92A1 | 0.61 | 1.82 |
| 76 | Hs.131342 | CCL26 | 0.61 | 2.59 |
| 77 | Hs.512767 | DKFZP761H17 | 0.61 | 2.67 |
| 78 | Hs.631974 | LOC728488 | 0.60 | 1.31 |
| 79 | Hs.112873 | IGSF11 | 0.60 | 1.65 |
| 80 | Hs.6217 |  | 0.60 | 1.93 |

TABLE 2B

Late 0% short

| SEQ ID NO: | UniGene | Symbol | corr. | max |
|---|---------|--------|-------|-----|
| 102 | Hs.102267 | LOX | 1.00 | 1.26 |
| 103 | Hs.435051 | CDKN2D | 1.00 | 1.16 |
| 104 | Hs.520819 | INSIG1 | 0.99 | 2.18 |
| 105 | Hs.380906 | MYADM | 0.98 | 1.56 |
| 106 | Hs.102267 | LOX | 0.98 | 2.38 |
| 107 | Hs.523012 | DDIT4 | 0.98 | 1.69 |
| 108 | Hs.465870 | KEAP1 | 0.97 | 1.42 |
| 109 | Hs.649390 |  | 0.97 | 1.20 |
| 110 | Hs.173381 | DPYSL2 | 0.97 | 2.70 |
| 111 | Hs.287659 | STRBP | 0.97 | 2.70 |
| 112 | Hs.131433 | ADAMTS13 | 0.97 | 3.65 |
| 113 | Hs.443976 | CEP250 | 0.97 | 1.52 |
| 114 | Hs.235782 | SLCO4A1 | 0.96 | 2.24 |
| 115 | Hs.405662 | CRABP2 | 0.96 | 1.33 |
| 116 | Hs.34871 | ZFHX1B | 0.96 | 2.58 |
| 117 | Hs.269722 | TCBA1 | 0.96 | 1.65 |
| 118 | Hs.540696 | SLC6A8 | 0.96 | 3.26 |
| 119 | Hs.644065 | TSC22D2 | 0.96 | 1.43 |
| 120 | Hs.129003 |  | 0.95 | 2.49 |
| 121 | Hs.502116 | NAV2 | 0.95 | 2.02 |
| 122 | Hs.511915 | ENO2 | 0.95 | 4.10 |
| 123 | Hs.530381 | PIM3 | 0.95 | 2.03 |
| 124 | Hs.497822 | DUSP10 | 0.95 | 2.26 |
| 125 | Hs.379821 | FAM83A | 0.95 | 1.36 |
| 126 | Hs.96996 | HNRPAO | 0.95 | 2.50 |
| 127 | Hs.26010 | PFKP | 0.94 | 1.56 |
| 128 | Hs.75093 | PLOD1 | 0.94 | 2.01 |
| 129 | Hs.525704 | JUN | 0.93 | 2.15 |
| 130 | Hs.446240 | PRKCBP1 | 0.93 | 1.44 |
| 131 | Hs.89387 | CASC2 | 0.93 | 1.96 |
| 132 | Hs.288232 | SERINC5 | 0.93 | 1.03 |
| 133 | Hs.533887 | SMEK1 | 0.93 | 1.39 |
| 134 | Hs.78771 | PGK1 | 0.93 | 2.41 |
| 135 | Hs.108106 | UHRF1 | 0.93 | 1.46 |
| 136 | Hs.644649 |  | 0.93 | 3.49 |
| 137 | Hs.445402 | PCTK3 | 0.93 | 3.23 |
| 138 | Hs.535297 | ARID5B | 0.93 | 2.73 |
| 139 | Hs.515032 | MKNK2 | 0.92 | 2.76 |
| 140 | Hs.422113 | ZNF511 | 0.92 | 1.80 |
| 141 | Hs.133350 | CNOT2 | 0.92 | 2.65 |
| 142 | Hs.146688 | PTGES | 0.92 | 1.15 |
| 143 | Hs.460355 | PRKCB1 | 0.92 | 2.79 |
| 144 | Hs.369520 | SYTL2 | 0.92 | 4.32 |
| 145 | Hs.647120 | MLL3 | 0.92 | 4.44 |
| 146 | Hs.517145 | ENO1 | 0.92 | 1.62 |
| 147 | Hs.533782 | KRT8 | 0.91 | 1.83 |
| 148 | Hs.21681 | GPR75 | 0.91 | 1.55 |
| 149 | Hs.458513 | PPP1R3B | 0.91 | 2.57 |
| 150 | Hs.643452 | DGCR8 | 0.91 | 2.82 |
| 151 | Hs.591443 | RAVER2 | 0.91 | 1.14 |
| 152 | Hs.433146 | SLC6A10P | 0.91 | 3.62 |
| 153 | Hs.429879 | EHHADH | 0.91 | 4.21 |
| 154 | Hs.9613 | ANGPTL4 | 0.91 | 4.95 |
| 155 | Hs.494529 | FANCC | 0.91 | 1.94 |
| 156 | Hs.523012 | DDIT4 | 0.91 | 2.14 |
| 157 | Hs.97858 | KIF1B | 0.90 | 2.55 |
| 158 | Hs.581355 | EIF4E3 | 0.90 | 3.84 |
| 159 | Hs.530904 | CSRP2 | 0.90 | 1.32 |
| 160 | Hs.159430 | FNDC3B | 0.90 | 1.73 |
| 161 | Hs.435667 | USP34 | 0.90 | 1.93 |
| 162 | Hs.505172 | LOC645619 | 0.90 | 1.93 |
| 163 | Hs.446017 | WSB1 | 0.90 | 2.09 |
| 164 | Hs.470633 | PDK1 | 0.89 | 2.22 |
| 165 | Hs.501023 | MXI1 | 0.89 | 4.06 |

TABLE 2B-continued

Late 0% short

| SEQ ID NO: | UniGene | Symbol | corr. | max |
|---|---|---|---|---|
| 166 | Hs.501023 | MXI1 | 0.89 | 1.92 |
| 167 | Hs.46423 | HIST1H4C | 0.89 | 1.75 |
| 168 | Hs.433146 | SLC6A10P | 0.89 | 3.61 |
| 169 | Hs.591849 | C8orf4 | 0.89 | 2.18 |
| 170 | Hs.159195 | DOCK1 | 0.89 | 3.02 |
| 171 | Hs.372914 | NDRG1 | 0.89 | 5.68 |
| 172 | Hs.8004 | KALRN | 0.89 | 2.67 |
| 173 | Hs.523789 | TncRNA | 0.89 | 2.14 |
| 174 | Hs.634882 | ARL6IP1 | 0.88 | 2.39 |
| 175 | Hs.585433 | KIRREL | 0.88 | 2.60 |

TABLE 2C

Early 2%

| SEQ ID NO: | UniGene | Symbol | corr. | max |
|---|---|---|---|---|
| 11 | Hs.72550 | HMMR | 0.90 | 2.39 |
| 81 | Hs.528299 | HTATIP | 0.90 | 1.84 |
| 82 | Hs.510078 | SGK | 0.86 | 1.58 |
| 2 | Hs.633514 | TIMP2 | 0.86 | 3.83 |
| 83 | Hs.602706 | LOC645591 | 0.86 | 1.63 |
| 84 | Hs.642877 | MALAT1 | 0.85 | 2.46 |
| 43 | Hs.593232 |  | 0.84 | 3.25 |
| 33 | Hs.596783 |  | 0.82 | 1.59 |
| 85 | Hs.441113 | MAGEA6 | 0.80 | 1.06 |
| 36 | Hs.149983 | PEX14 | 0.79 | 4.42 |
| 86 | Hs.94542 | ALKBH1 | 0.79 | 1.18 |
| 12 | Hs.154276 | BACH1 | 0.77 | 2.12 |
| 24 | Hs.189772 | CCT2 | 0.77 | 4.09 |
| 68 | Hs.112432 | AMH | 0.76 | 2.54 |
| 74 | Hs.643599 | PAPPA | 0.74 | 1.51 |
| 87 | Hs.126774 | DTL | 0.74 | 1.76 |
| 32 | Hs.146406 | NIT1 | 0.73 | 2.04 |
| 88 | Hs.463838 | LOC440459 | 0.73 | 1.25 |
| 46 | Hs.523847 | IFI6 | 0.72 | 4.45 |
| 89 | Hs.46700 | ING1 | 0.72 | 1.08 |
| 90 | Hs.55131 | C3orf23 | 0.71 | 1.21 |
| 91 | Hs.558396 | SCD | 0.70 | 1.64 |
| 58 | Hs.148907 | SLC5A12 | 0.70 | 4.49 |
| 92 | Hs.643920 | C1GALT1C1 | 0.69 | 2.17 |
| 59 | Hs.160556 | ACACA | 0.67 | 1.78 |
| 93 | Hs.562083 | ICMT | 0.66 | 2.27 |
| 94 | Hs.515383 | LOC644242 | 0.66 | 4.93 |
| 95 | Hs.513430 | CDR2 | 0.65 | 2.10 |
| 26 | Hs.155983 | JMJD2A | 0.63 | 2.71 |
| 44 | Hs.590575 | GRM3 | 0.62 | 3.65 |
| 96 | Hs.632226 | ITGB4 | 0.62 | 1.49 |
| 97 | Hs.165607 | FLJ25416 | 0.62 | 1.02 |
| 98 | Hs.514033 | SPAG5 | 0.61 | 1.92 |
| 99 | Hs.632447 | WDR42A | 0.61 | 1.87 |
| 100 | Hs.89603 | MUC1 | 0.60 | 2.11 |
| 101 | Hs.434961 | ATXN1 | 0.60 | 2.34 |

TABLE 2D

Late 2% short

| SEQ ID NO: | UniGene | Symbol | corr. | max |
|---|---|---|---|---|
| 176 | Hs.446017 | WSB1 | 1.00 | 1.77 |
| 177 | Hs.370365 | HK1 | 1.00 | 1.13 |
| 178 | Hs.520819 | INSIG1 | 0.97 | 1.51 |
| 179 | Hs.405662 | CRABP2 | 0.96 | 2.02 |
| 180 | Hs.173705 | LOC401152 | 0.94 | 2.24 |
| 181 | Hs.644649 |  | 0.94 | 2.91 |
| 182 | Hs.446017 | WSB1 | 0.94 | 1.32 |
| 183 | Hs.511915 | ENO2 | 0.94 | 3.18 |
| 184 | Hs.474935 | SEMA4B | 0.94 | 2.40 |
| 185 | Hs.497822 | DUSP10 | 0.94 | 2.06 |
| 186 | Hs.335614 | SEC14L2 | 0.93 | 2.59 |

TABLE 2D-continued

Late 2% short

| SEQ ID NO: | UniGene | Symbol | corr. | max |
|---|---|---|---|---|
| 187 | Hs.102267 | LOX | 0.93 | 2.47 |
| 188 | Hs.287659 | STRBP | 0.93 | 1.78 |
| 189 | Hs.502116 | NAV2 | 0.91 | 1.82 |
| 190 | Hs.581021 | SIRPA | 0.91 | 1.08 |
| 191 | Hs.403933 | FBXO32 | 0.91 | 2.85 |
| 192 | Hs.500047 | P4HA1 | 0.91 | 2.97 |
| 193 | Hs.540696 | SLC6A8 | 0.90 | 2.43 |
| 194 | Hs.2795 | LDHA | 0.89 | 1.38 |
| 195 | Hs.9613 | ANGPTL4 | 0.89 | 3.64 |
| 196 | Hs.535297 | ARID5B | 0.89 | 2.28 |
| 197 | Hs.173381 | DPYSL2 | 0.89 | 2.19 |
| 198 | Hs.429879 | EHHADH | 0.89 | 2.88 |
| 199 | Hs.425144 | MTMR11 | 0.89 | 1.74 |
| 200 | Hs.98643 | RAP2B | 0.89 | 1.44 |
| 201 | Hs.34871 | ZFHX1B | 0.88 | 2.08 |
| 202 | Hs.591140 | FOXK2 | 0.88 | 2.09 |
| 203 | Hs.581355 | EIF4E3 | 0.87 | 2.15 |
| 204 | Hs.155247 | ALDOC | 0.87 | 1.38 |
| 205 | Hs.501023 | MXI1 | 0.87 | 2.77 |
| 206 | Hs.536075 |  | 0.87 | 1.41 |
| 207 | Hs.102267 | LOX | 0.86 | 1.79 |
| 208 | Hs.132513 | HSD17B12 | 0.86 | 3.51 |
| 209 | Hs.132342 | LPIN2 | 0.86 | 1.87 |

TABLE 2E

| SEQ ID NO: | UniGene | Symbol | corr. | max |
|---|---|---|---|---|
| 11 | Hs.72550 | HMMR | 0.90 | 2.39 |
| 2 | Hs.633514 | TIMP2 | 0.86 | 3.83 |
| 43 | Hs.593232 |  | 0.84 | 3.25 |
| 33 | Hs.596783 |  | 0.82 | 1.59 |
| 36 | Hs.149983 | PEX14 | 0.79 | 4.42 |
| 12 | Hs.154276 | BACH1 | 0.77 | 2.12 |
| 24 | Hs.189772 | CCT2 | 0.77 | 4.09 |
| 68 | Hs.112432 | AMH | 0.76 | 2.54 |
| 74 | Hs.643599 | PAPPA | 0.74 | 1.51 |
| 32 | Hs.146406 | NIT1 | 0.73 | 2.04 |
| 46 | Hs.523847 | IFI6 | 0.72 | 4.45 |
| 58 | Hs.148907 | SLC5A12 | 0.70 | 4.49 |
| 59 | Hs.160556 | ACACA | 0.67 | 1.78 |
| 26 | Hs.155983 | JMJD2A | 0.63 | 2.71 |
| 44 | Hs.590575 | GRM3 | 0.62 | 3.65 |

TABLE 3

Validation of the early hypoxia gene Signatures: statistical differences between Kaplan-Meier survival curves were assessed by computed mean p-values obtained from log-rank tests at 5 and 10 years. For each signature. its type, correlation coefficient (not applicable for the Chi study), number of reporters and number of unique UniGene cluster IDs are also given.

| Oxygen Concentration (%) | Hypoxia type | Corr. coeff. | # reporters | # unique Unigenes | p-value |
|---|---|---|---|---|---|
| 0 | early | 0.6 | 80 | 79 | 0.004 |
| 0 | late | 0.6 | 241 | 210 | 0.118 |
| 0 | late | 0.88 | 74 | 70 | 0.110 |
| 2 | early | 0.6 | 36 | 36 | 0.034 |
| 2 | late | 0.6 | 169 | 147 | 0.919 |
| 2 | late | 0.86 | 34 | 32 | 0.842 |
| 0&2 | Chi et al. | n.a. | 253 | 171 | 0.300 |
| 0&2 | early | 0.6 | 15 | 15 | 0.005 |
| 0&2 | Late | 0.6 | 93 | 93 | 0.240 |

TABLE 4

Gene Ontology provided by Ingenuity for the early signatures. For each one, the top 2 functions which correspond to the highest scores are shown, as well as the genes contributing to the score. The top function of early genes overlapping between 0% and 2% are also given.

| Oxygen Conc. | Top functions | Score | Focus Genes | Gene Symbols |
|---|---|---|---|---|
| 0% | Cellular Growth and Proliferation, Cellular Development, Connective Tissue Development and Function | 27 | 14 | AIF1, ATF3, BACH1, CCL26, COL6A3, GATAD2B, GRK6, IL22RA2, PARG, PCSK1, PEX14, PIK3R4, TERT, TP53I11 |
| 0% | Cellular Function and Maintenance, Cancer, Cell Cycle | 25 | 13 | ACACA, ACOX1, ACSS1, AMH, CCNH, CCT2, GRM3, HMMR, IFI6, IGF1R, LY86, PTPLAD1, TLE3 |
| 2% | Cellular Function and Maintenance, Cell Cycle, Cancer | 27 | 12 | ACACA, AMH, BACH1, CDR2, HTATIP, IFI6, ING1, ITGB4, PEX14, SCD, SGK, SPAG5 |
| 2% | Cellular Movement, Connective Tissue Development and Function, Cancer | 9 | 5 | CCT2, GRM3, HMMR, ICMT, MUC1 |
| 0% and 2% | Cancer, Tumor Morphology, Amino Acid Metabolism | 11 | 5 | ACACA, AMH, BACH1, CCT2, IFI6 |

REFERENCES (1) Bild et al. Linking oncogenic pathways with therapeutic opportunities. Nat Rev Cancer 2006:6:735-41.

(2) Bussink et al. Microenvironmental transformations by VEGF- and EGF-receptor inhibition and potential implications for responsiveness to radiotherapy. Radiother Oncol 2007:82: I0-7.

(3) Chang et al. Gene expression signature of fibroblast serum response predicts human cancer progression: similarities between tumors and wounds. PLoS Biol 2004:2:E7.

(4) Chi et al. Gene expression programs in response to hypoxia: cell type specificity and prognostic significance in human cancers. PLoS Med 2006:3:e47.

(5) Chung et al. Molecular portraits and the family tree or cancer. Nat Genet 2002; 32 Suppl: 533-40.

(6) Denko et al. Investigating hypoxic tumor physiology through gene expression patterns. Oncogene 2003:22:5907-14.

(7) Eisen et al. Cluster analysis and display or genome-wide expression patterns. Proc Natl Acad Sci USA 1998:95: 14863-8.

(8) Eriksen et al. Tumour hypoxia—a characteristic feature with a complex molecular background. Radiother Oncol 2006:81: 119-21.

(9) Huang et al. Gene expression phenotypes of oncogenic signaling pathways. Cell Cycle 2003; 2:415-7.

(10) Iyer et al. The transcriptional program in the response of human fibroblasts to serum. Science 1999:283:83-7.

(11) Kietzmann. et al. Signaling cross-talk between hypoxia and glucose via hypoxia-inducible factor 1 and glucose response elements. Biochem Phannacol 2002:64:903-11.

(12) Koritzinsky et al. The hypoxic proteome is influenced by gene-specific changes in mRNA translation. Radiother Oncol 2005:76: 177-86.

(13) Miller et al. An expression signature for p53 status in human breast cancer predicts mutation status, transcriptional effects, and patient survival. Proc Natl Acad Sci USA 2005:102:13550-5.

(14) Ramaswamy et al. Multiclass cancer diagnosis using tumor gene expression signatures. Proc Natl Acad Sci USA 200 I:98: 15149-54.

(15) Riedemann et al. IGF1R signalling and its inhibition. Endocr Relat Cancer 2006:13 Suppl I:S33-43.

(16) Sjogren et al. The p53 gene in breast cancer: prognostic value of complementary DNA sequencing versus immunohistochemistry. J Natl Cancer Inst 1996; 88: 173-82.

(17) Smith. Neuroprotection against hypoxia-ischemia by insulin-like growth factor-I (IGF-I). IDrugs 2003:6:1173-7.

(18) Sorensen et al. Influence or oxygen concentration and pH on expression of hypoxia induced genes. Radiother Oncol 2005:76: 187-93.

(19) Troost et al. Imaging hypoxia after oxygenation-modification: comparing [18F]FMISO autoradiography with pimonidazole immunohistochemistry in human xenograft tumors. Radiother Oncol 2006:80: 157-64.

(20) van't Veer et al. Gene expression profiling predicts clinical outcome of breast cancer. Nature 2002; 415: 530-6.

(21) van de Vijver et al. A gene-expression signature as a predictor of survival in breast cancer. N Engl J Med 2002: 347: 1999-2009.

(22) Vaupel. The role of hypoxia-induced factors in tumor progression. Oncologist 2004:9 Suppl 5: I0-7.

(23) Wouters et al. Targeting hypoxia tolerance in cancer. Drug Resist Update 2004:7:25-10.

As a person skilled in the art will readily appreciate, the above description is meant as an illustration of implementation of the principles this invention. This description is not intended to limit the scope or application of this invention in that the invention is susceptible to modification, variation and change, without departing from spirit of this invention, as defined in the following claims.

SEQUENCE LISTING (209 sequences)

SEQ ID NO: 1 - DNA, 1970 bp, Homo sapiens
aagggcaaaataaagtagatttaaccaagtgccaggtggaattcaaaaaacacattcttccagataaattctacctttatggtatggatttgaaagtactttgcaggaaaacagtcagtactctttaaaaagggactgcagggctgggtgtagtggctcacacctgtaatcccagcactttgggaggccaaggcaggtgggtcacttgaggccaggagtttgagaccagcctgaccaacatggcaaaaccccatctctactaaaatacaaaaattagctgggcatgatggtgcactcctgtaatcccagctacttggtaggctgaagcatgagaattgcttaaacctgggaggcagaggttgcagtaagccaagatcatgccactgcactccagcctgggcaacagagtaagactctgtctcaataaataaataagaaaataaaacggaactgcagtgctaacagtaatttatacatttttaaatgttctgagtatgttttgactgggctagtgtaacaatatactaccctgaaagtgcagttttgattgttgttggtgtctttgggtcaggaaagtgaactgtgccaagaagtatttttcagtgacatgaatggattcctgttaatgcaattgactgagagattgtgcttacgctttcttaactgacaaaaagaggctttgtccaacatcagaattgttgaaactggtgctgttttctgttgcactgggattctgatgatctgggattttccctccttggcacagtaaacaccatgactgtctttattgagaatgtcgtcacagtcctttagtgatagattagttagacccatggttgcaatacctttatctccccaaagaaaataatcaaaagaaagcacaaaagctaccctgtttgcagaatatttcactgacattgatttgtcattaattctaccagagctgacctcattcaggcttgatagaaacaggttcctatgtttagggcagatccctagcctctcgctcacagtgagtctgcatgtcctagattctggttattgctggagcatccattaaagtctaccaaactcaggacagaagaagatagcagtggatttgtaaaaatttttagtttataaattacagtcattggggaaacactagtaaggtcatgtgatcttttggaccaggattttctctctgtcttctctctgggtgtgtgtgtgtgtatgtacagaagggctaccaggaagtgtcaaccatgttagattttctgtagtcttccagaaacagtgcagcccatacaacaggaatcttaattttcctcacagcaaatataacaggatggaacagttagtgttttgttttcacaagtgtccaccactccatctgccctgcatggagagggctctctcactgctagatctaggctgagccatctggaaggatcaaagggtgtgggagtatcaccccctctcaggctgcagaaggtctcgagggtggcgtcacagcaggatttccgccttctgcattgcactgcacagccccatggaacatgaggcacttgaggccttgcttcttggagcctctggggagcagagtaggtcactgccctctgggagtgttttgcagtagttttgtaaatgtgttgctacatagtcaagttcctttgtggcaaagaaatattttgttttgatattaggagccagcccatgtaatgcctctcaggcttgcttgcttagaagaaaaaagtcaccctttgtggtttttaagaaaaaaattctgtgcagatctgttcctcctcctgctccttcccttttctctacatacagtgctcattggaggctcctgctaaaccttcttaaccagagaaataataggtatttgttagacctgagtgtacatttcacatgttatccttcacatatttctcattttcatctagtactttcttaatgcctttgttggagtccgcatcctcatcttt

SEQ ID NO: 2 - DNA, 72414 bp, Homo sapiens
cgcagcaaacacatccgtagaaggcagcgcggccgccgagaaccgcagcgccgctcgcccgccgccccccaccccgccgccccgcccggcgaattgcgccccgcgcccctcccctcgcgcccccgagacaaagaggagagaaagtttgcgcggccgagcggggcaggtgaggagggtgagccgcgcgggaggggcccgcctcggccccggctcagcccccgcccgcgcccccagcccgccgccgcgagcagcgcccggaccccccagcggcggcccccgcccgcccagccccccggcccgccatgggcgccgcggcccgcaccctgcggctggcgctcggcctcctgctgctggcgacgctgcttcgcccggccgacgcctgcagctgctccccggtgcacccgcaacaggcgttttgcaatgcagatgtaggtaaggagcggcgaccccagcccccgcgcggggccccacctcccccgcgaccccgagggttcgcagacgccccgcccgcccgccgctggccgagggaccccagcgcccgcctcctggtccctcggcgccttctcgaatcctgcaagtggacgcccagagccgactttctttcccccctccctcctctccctttctttccctctctttgccgagatgcgtctcaacctcaaaattccaccgaaattccgccgcagctccagccccaggaaagggagccagtttggcttttggcaggcggcgcgccctgggatgccagcgctgggggcggggagcgtgggggacacggcgtgggggcggggggctggaggactggggaccccaggaagaaactttcgcagataaggtgggagttgggcttctctgggcttggggctgggtggggaagggcttctctgctggggcttctcccaccagccccatttgggggctccccgatcaagccagggtgggatggaagcccgccctacccgaggcaggttccacaggcccagaggggcaggtgaaaaagccggtggcgtctcctggcgtggctccttgcttgcgccctgcccaggaggccctgcaaactggctgggcagggaccgggacccccgaatgttccgctttttcgggacgtccacaaaagctggagactttggtgaccggacccggcacgtgggactgtgctgctgctcagattccccagcaaatacccatgacctccggactcctagcccccaaaagacaggcgccatggagggaggcaggaggggcccagttatttgttctgatccatggagggggaggaccagcagaaatgggaggaacccgctggctcgaagtttccaccctggtcctgcacctcaagcctctgcagccctggtgctggtcagcatggttttcctggggcaagtctggctacacggcaggtggtctcggagccccctgccctccttccttcttatgtctgagtctcagtcgagtgacctgtccagggcagatggagcaaggcgggggccccctcacctgcccagagtggaggtgggactttctgtttctcctgctgtcagccacgcccttcccataccccgcccacggcttcttgccccaccccggttagccctaggagctgcgtgcccagctggggaagttttcagttgcaccaatctattgagatcacaggtctcaggtggctcaggccacctgggcggaaggcttggtgtgtgcctgtgtcagtttccacaaaacccagtttgggggaaatgaggtcttttctccagtttagccttggtgctcagcaagatttgtgggtgaaggagaggttcctttgatgagggagccataatgggcctttctctgggggtccacgaggagtgcaggcctgtccaggctccttggctcaccagcacgtgctggggcaggatgtagccaaggcccagaaggaggctgtggataaaaggacctgggagttggatttgtaggagttgggccttgggacccctccccctcccgcccccccccccaccccgccccacacacacactcctcagctgtgtgggagaatgtccaggcagccactctgtccttgcttggcataagttaaggcggccactgagctgggagctgtttctgcgtggggtgtggatccaggatggcagagggtggagggctgcagtgcgtgcctcccgcctccttcatgctcagcgcagcactctcctcttctgggttgcctggcatttgtgtctaaatctttgcatcaaaatcatcctgtagctaaaacttttcaccccatcccggctcagaggcccagtcagatgccagagttgcactgcagagctcagggcattcgcttcctgtggccgctgtgacaaactaccacaaatgggagggcttaaaagaacaggaatcgattctctgtagctcaggaggccagaagtctgaaaaggtgtccacagagccagttccttctgggggctgtgagggagaatctcttccaggcctctctccttgatgttgcttggttccattttcaaggaacacatcacttccatttccgcctgtcttcacatggccttctctcgtgtgtctctgtgtccaaatttccctgttctttttttttggagagcaggctggagtgcaatggcgcaatctcggctcgctgcagcctccgcctcctgggttcgagcaattctcctgcctcagcctcccaagtagctggggttacaggcacctgccaccacacccggctaattttttgtatttttagtagagacaggaattcgccatgttggccaggctggtctcgaactcctggcctcaggtgatccgcctgcctcagcctcccaaagtgctgggattataggcgtgagccaccgcgcccggccaaattgccctgttcttctaaggacagcagccattggatttagggcccaccctaatccagtatgacttcatcttgatagatcaacaaatactctatttccaaataaggtcatattcataggatctgactagatgtgcatttgaggggggacgtaattcagcccatacaccaggctgccttctcttattcccagtcaccctttccgtgctcaaccaacttgggataaacaacccaggacatcccagggtagggtcccggaacaaatcccacagggacgacagcggcctgtctattctccagtgttcgattctcctcgaagcgatgcaggtttgtgactttctcagcaatggttccccattctggctcagagcagaattgcctggaagattcttaaagattgctcaggtctaggtccctttgcagatacagagggtcttgctcagacttcggcttttgcagttttaaaaggcccacaggtgatttaaccagggctgtgacccaggggtctcagaaagggggtacagtggaggttaataaaggctggcttgttatgtggcaagctggctccttttactcttggctgcatgcagccttgttaaatggcttggtgtctacaagaggcaattggcttaagaaacagtcagatttctgtctgcccggctgaggatttctgggaggtatctccctagcagctcttgcagttggtaggaccggaactgtggtcggcaaagataattcatgatgaggtggtgatgtttaggataagggatggtaagaggtgacctgatttcttcctggaaggccccaggtccttgtcctttccagcaaggccagcacaaacgggaagcattttgtgtctcagttacagtactgttcaaatgcgctgctggcccggctccctctcacccagtgaaatccttcacatctactgccagcctgcacagctacagggatctggctggaaattagctttgggctcaccattcaggcagtcccatgcctggagccacttagccagctgagctacttggcagactcgggctgcttgggcccgtttctggactcaagggtaaagccaggagctctctggatgcagagaataaaacctctcctctggcttgggtggcagtacctaaggccacacattatcctagaagacctctgcgatgacatcttcctcacatgttcccacctccagaaactgtcctctgcaaatcccccgaggagctccagctccagctagagaggggtccacaaccaagagggggaacaactgctattttctggggtgaacagccaagggtgacctggttcctgggggacacagtgacagggaccagacagatagtaggggccaccccagaaaacacacagcacgcagtcaaaaatggctctgtcttcaggacacgtgctcaggaaaagcaacacagcatcagattcatgtgagctgggtcaggccttccatgcgagggggcggcgtggcgctttttaaagaaactgttggcaactcgttgtgcgaagtatgtgatcgatctgtattgtcagttttgttcatcttgattttcatattgggcttgtctgtgtttcaacaagcaattatggagtggctgcctctgcccccggggatgtaagggagaagcaagacattgtccctgtggtgggggatgcagggggtggtacatcttggcaccaggcggtgtggaagggggttcctgctgcccggcgtggtgagcaggcctcccctcctcaactgcccaggtgtggtataaagtcagtccactcagtgtggtttcggtaaataattaacaacagataaactttcgaaataaccaaaattcaggagtaatcatgtgacaatgtgaaatgcatttgcaagatgtgaggatagaaggccccatggtaggttgaggagggagctgtggggagaactgaggctcttcggcttggttttgaacagcgtccttggagggacaggatctgtcaggggagtcactgacccctgaattactggcagctcccaaggcagggggactggaagagcagggagagctgtgcacagcctggaggtatggcaggtgctggaaggagctctctggacaacacacgtttctccctatctgggatctgaggacagtgccagcctcagagcctctcgggcctcccctatttgcacccttctgggggtgcagagccacgtacgcagtcctggcctgtcgtttgtgagctgcaggtgggcttgggtactgcctccctcctccctgctgtcgcagccaggttgctaggtagatgccactggtgtgggctgagaggttcagactctgtggcgacatctgagcacatggagaacagggcatagatgactcctgggagactgagaggcgcgggcagccgtctccagtcctgatgcagaaccactgactcgatgcagtgggggtcgtgtgtaggggtgaacgtcttgggttcggaaacaacaaagaggtctgcccgaggcttcccaggcagctgcgaggagggatgcaacagcagggaggaggagataagaaggaagcaaagacaggcagacgtggcagtggcaggggcaggaggggtgcatgccctggacactctctctgtcccccggtgcacgcacaggctcacaaaccagggacggagggcaagtggctgcatggctaggatggtcttcttttctttttcttttttttcgagatggagtctcactctgtctccaggctggagtgcagtggcgctatcttggctcactgcaagctccgcctcccgggttcacgccattctcctgcctcagcctcccgagtagctgggactacaggtgcccgccaccatgcccggctaatttttttgaatttttattagagacggggtttcaccgtgttagccgggatggtctcgatctcctgacctcgtgatccgcccacctcggcctcccaaagtgttgagattacaggcttgagccaccgcacccagcagatggtctttttcaagaggggagggcagagtgaagaaatcaaggtaagggagggtgaagaagccgcatctggaggacggcactggggaccgtaacccctggtcatttagcggcagcagggtggggtgtgcacaggtgttctaagccaagggaccaactgccccaggaaaggtgagagttctgggtacagagtaggccaaagaggagcctggggattcagggggacccacaaggagattggggccaaatgtcacggctctggcttgtcatgtgacatctgcattccatcccgggacccacgcagccaccaaagatgttctggctgtggaatgacagcgggcgttgcccagggagcctggtagaaggcagccgcctaactccgcgtgctggagcgggcctgggggtggcactggagtttcaggactctccaggtgctgctgccgcccgccaaagttggcatagaccagtcgtctccggaggggtgcccagtacagcctcggtgctaagaatgttatgaatagttagcatatggattcagagttgtactccaaatataatttttttttttttttttgagacggagtcttgctgtgtcacccaggctggagtgcagtggtgcaatcacagatcactgcagcttcaatttcctggcccaagcgattctcccacctcagtctcccaagcagccaccacgcccagctaatttttttaattttttgtagagatggggtttcgccatgttgcccaggctggtctcgaactcctgagctcaagtgatctgcccaccttggcctcccaaagtgctgggattacagatgtgagccacggtgcccggcctatatatacttttttaatgaatatctgatattgtgagtgcttggccaaggttttgtttttgttgcccgtgggtctgaacagaaagtgtggaggctgaccacctcagtgtcggggggtggagtaagcaggcagatgagctgccctgagattgctgggaggagggaaggcgggcagacccagacttcccaatggagagatggtcaggagcatggatgtctcagagtggcaggcaggatgaagctggtgtccccaggacctcccagggcccacctgcctggacccctgcagcctgtgccctgacgccctggtgccctcgtgcatttgctgggacgtggctgtgcagcggcagagggaagggcacagagaccccgccccgatgattcccaccttacaactgagggctgagctactccccagtcagccaggtcagactggagcccagggaaagcttccggagccccagcaagtcaggttgagagtgtgtttacgctaagaagcaaattgaggaacagtctttataaaagaggggtcctaacccagagtgtgtgaacacccagccagagataggcctggcgggtttgggggtggtcacaagcccggaaactgtaagtgaagttgtgtgtgtgtgtgtgtgtgtgtgtgtgtgtgtgtttgtgtgtgcacgcgtacgtgttttttttgtggacagtggcagccgccaacttctcaaaggtgcctgtggccctccaaacgtcaagtcactgccatttaaaaggagtctttttataggtttcgagtcttctgtttcttgtgagtatctgcctagtctcggagctgagcgatggtaacgatcttgcctttctctcctcttccaccctcattctgcactcggccgccctgggcagccaggatccgctcagacactaccaccacgaggggagtccgaggcagacctgtaaccagctctggggaaaggatgccatcagtgtcctttggcctcctagctggtctcagggatggctccaaagacctgggaggttctgtggttgtcttccatggggaagacgtccttggtagacggcagctgctctttgatctcaaactctgatcacagctggaccacacatggcctgagggaactccagacctcaccagttaggaagggcctggtgtctatgtcttagatacctgcttcttacagaatttattcacttaagtgtttttatattttgttttacaatagaatttgggtgcctaccgtacacagaaatactatggcaagtgtgtcaaggaattatttagttttctgagacggagttttgctctgtcgcccaggctggaatgcagtggtgcgatcttggctcactgcaacctccgcctcccgggttcaagcaattctcctgcctcagcctcccgagtagctgggattacaggtgtgtgctgccatgcccagctaatttttgtatttttttttttttttttttttgagacggagtctcgctctgtcgcccaggctggagtgcagtggcgggatctcggctcactgcaagctccgcctcctgggttcacgccattctcctgcctcagcctcccaagtagctgggactacaggcgcccgccactacgcccggctaattttttgtatttttagtagagacggggtttcaccctgtcggccaggctggtctcaaactccaaagccatggtgcccatcttcaaggaagtgagcgcaggaatgcgaagatcatcttgcaggctgcacctcttgctagagactcttaccgaggttaggacactgttgagattgtgggccctgaggggtggatcttatcagagctaagataagccccgaggaaaggtcctggggtgggtatggggagcccagggtggctgtggtagagagtgtaccacagggggacagagtcattagaacaaagtatggccaggcttgagcccaggtggagcagcaaagcctggaggcccggcagtgggacctggcagtgggactccggggaaggctttatggcccctgcactgggggagagggggcagacaggagggggatgacactgaggaggaaggtggtgttgagaggctcgcagttaccaggggagcagagctcccacctgcactggggaagacccaggagatggaaggcaggccctgagcggggccatgggtcgcgggcagacacaggagatgcctctggagcttgacccagtgcctgggagccagatgccctctaacctggtcaggagctcaggcgggtagaggtctctgttgagttctgctggaatctggtgaccagaaagtctcggcgagagggatttgagctagaacttcagcagacagtggaaattgtgtaacggggccttggagggaacaggaaacggagcattgagggggaagggagccagcagtagcgaggggaactgacattcatagcaaacagggtgagcgggggtcaaatgctggccccagattgagtccagcagagcgatccgggacaggtggcctctctctgcccccacttccacacctccaaaaaggagaggcgaatttcctgcctcccaggaagctctcggagctagtgggggacaccagctctttctgcatcaaaccctggctctccctgtctttgtgttcttgttcctccccaccccgccctgagggaggcctgggagcagccagggaggtgaatcatgacatggtgataatgactatggcaacaataacagctggcagaggtgccaagggcttggaggtatgttcttgctcttcactagtgtcaacccatttccttccctatcctcatccccattgtacagacgatccaacggaggcacaggcccactaaggaacctgctcagggttagctggctaggaaatagcagagtaaaagaagagatggtttttaggccgggcacggtggaatcatgcctggaatcccagcacttggggaggccgaggcatgtggatcgcctgaggtcgggagttcaagaccagccttgccaacatggtgaaactccatgtctactaaaaataaaaaaattagctgggcgtggtggtgcacgcctgtaatcccagctactcgggaggctgaggcatgagaatcgcttgaacctgggaagcagaggttgcagtgagccgacatcgcaccactgcactcctgcctgggtgacagagtgagactctgtctcaaaaaaaaaaagaagaaaaaaagagagagagacggcttttaaaaggaggtacatcaacagaatggtgctgattcagactgatactggcttggggatgaatggtctaggctgtggagctgggctgaagctctacaggtgacggatggagccactgaggagggagaggagctcctgaggctggccttgttcatgaggtttgcctgtctgctggagataagctaaatcaattaatctttctccctgccgcaacagagtgagcagacatttcaaatgatattacagatttgtgtttatgacctagaaaaatgttcagagcacagtactttcaaaagcccagactgggccggttgcagtgactcacgcctgtaatcccagcactttgggaggctgaggtgggtggatcacctgaggtcaggagtttgagaccagcctggccaacatcatgaaaccccatctctactaaaaatacaaaaattagctgggcgtggtggcgggcacctgtaatcccagctactcagtaggctgaggcaggagaatcacttgaacccgggaggcggaggttgcagtgagccgagatcgtgccactgcatgccagcctgggcaacagagcaagactccgtctcaaaaaaaaaaaaagaaaaagcccagactggccaggcgcggtggcttacacctgtaatcccagcactttgggaggctgaggcgggaggatcacttgagcccaggagttccagatcagcctaggcaacatagcaagacctcatctctacataaaataaattaaaattttaaaaattagccaggggtggtggcacgtgcctgtagtcccacctactcgggaggctgaagtgagaggatcactggagcccaggagtttgaggctgcagtgagctatggttgtaccagcctgggggacagagcaagactctgtctataaagaaaaaaaaaacagcttggctgggtgcagtagctcatccctgtaatcccagtgctttgggaggccaaggtgggtggatcacctgaggtcaggagttcgagaccagcctggccaacatcatgaaaccccatctctactaaaaatacaaaaattagccgggcatggtggcgggtgcctgtaatcccagctattcaagaggctgaggcaggagaatcacttgaacccaggaggtggaggttgcagtgagccgagatcgggccaccgtactccatccagcctgggagacagagcgagactccatctcaaataaataaataaataaataaataaataaataaatgaatagccaaaatttcgaaggcagatgaatgccaataatgttctcaagaagcaataaaacattgggttataacctgtgcctctgaggactcaaggggaagtcaggcaggccccagccagcgttagtcgcagctgcctgctctcccaggtcagcccttgcaccctcgcagaggaagccgtcccttccgcctctctccatcataaagaaaacttctctgtctctccattcacgtcccaaatgccttctaactttaaaataattacacaactatatgtgttaatcatggaaaagacacttaagcaaaaagcaagaaaaatcatcctgattgtatccattgcctagaatttttttttttttttttttttccccgagacagagtttcgctccgtggcccaggctggagtgcagtggtgcaatcttggttcgctgcaacctccgcctcctgggtttaagcaattctcctgcctcagcctccagagtagctgggattacaggtgtgagccactgtgcccggcctatgttttttgtttttttttgttgttgtttttctgagacaggttcttgctctgtcacccaggctggagtaaagtggcatgatcatggctcactgcagcctcagcctcctgggcttaagcagtcctcctacctcagcttctcaagtagctggaactatgggaccataccagcacacccagctaatttttacattttttgtcgagacgaggttttgccacgttgcccagtctggtcttgaacgcctgggctcaagccgtcttcccacctcggcctcccaaagcactgggattacaagcgtgaaccactgcacccagcctgcttttgagctgctttattgagatgtaattcacataccatgaggtcactcctctaaagtgcacagttcagcggtttgagtacattcacagagccgcacagccatcatctctaattttgcagcttccagagtagggcctcaacgtgggttcacgtgatgtttccccagatagactcaggtcaaacgctgttgttagagccctgcagagccgcgggtctcagcccttgttggtatggcgaggtcctgtagccggcagtcggcctcccaaaatgttgttggctttttccagcggttggcaaactagacccactgctgggctgatggcctgttgttgtaaatatttttttttctttttgccaccacacccggctaatttttgtatttttagtagagacagggtttcactatgttggccaggctggtctggaactcccaacctcaggtgatctgcccgcctcggcctcccaaagtactgggattacaggcttgtgccacggtgcctggcctagtgcaaataaagttttattggaacacagccacgcccactggtaaggccaaacccacgtggcttttgtgctataacaacagagttgaatggcggtgatcaaggactgtatgggcctcaaagtctaaattacttaccagctggctgttcatagaaaccttttcggatccccagcctaagtcatcgcaggctgatggcacaggtctgggcttcccagtccttgtgtggctggctcctctctccccggattgcctgttccctgctttccagaagcaagcaggtggcctgggaagaagtggaacctgcagggtgtcattctccaagccgatgctgaagatgcaatgccttcacccgcctcttctgtgctcttcatcgcacgggtgggctagagcagggaagatggactttcaggctggagcctggctttctgtggtgggatgttctgtgggtaccgagacccccttactgcatcttcagggacagaatctggcttgggttgagagtttatttggccctttctgatctgtaatcgggagagattgattgagctttcctgacacagacgtggcaaagcaaactggcagtggggcaggctttgccaaggctcgtcatggtagcggaggcctggacagagcacccgccaacagctgctgcttaaccaaggacagaatgaggaaatggacatttcagagaaaagaggcgacatgaaaagtattggagaaaagagcctgggctttggagtcaagtgggactggttctgaatcccgactgtgtgcctctctgagccttggtttcctcttctgtaaaagcaagatcagactcttcagtgtggtgccatgggagattcatattttttttttgagacagagtctcactctgttgtccaggctggagtgcagtggcacaatcttggctcactgcatcctctgtctcccggcttcaagcaattctcctgcctcagcctccccagtagctgggatttcaggcgtgtgccaccatgcccagttcaatttttttttttttttttttggtgtgtttttagtagagatagggtttcaccatgttggcctggctggtcttgaactcctgacctcaagtgatccacccgccatggcctcccaaagtattgggattataggcgtgagccaccacaccctgccaagattaaatttttgatgagtgagtcaaatggaggccaggtggggtggctcatgcctgtaatctcagcacttttggaggccaaggtgggcggatcacttgaggtcaggaatttgaaacaagcctggccaacatggcgaaaccccatctctactaaaaatatttttaaaattagctgggcatggtggcgggtacctgtaatcccagctactcgggaggctgaggcaggagaatcacttgaacccaggcggaggttgcagtgagctgagatcacgccactgcactccagcgtgggtgacagagtgagactctgtctcaaaaaacaaaaaacaaaaaacaaaaacaacaaaagcactggaggggctcaatagttagttagtttgtcctagacccttctagaatgttgagatcctggacagtgcttctgagaaacctgcagtctctgtccaaggagcccttaaggaagaaaggcaggagtgtggggcaggaagaccagcttcccctttccattccacacggctggctcgcaatattctgtttctcctgcgacagcctggttcctccctgctccccagctcgcctctgccaccattcttccctcagtccagatcaagagttcaagggacggggacagatgatcagaaaggcccagctcaggcaaggaaggggagaaaagggaactcgtatatgcggtgggtgggaatggaaagtagtacagtcactatggtggaggttcctcaaaaaactacaaatagaacggccatatgatccagcagtcccacgactgggcatttatccaaaggaaagggaatcagtgcatcagagagacacctgcacccccatggtcctggcagcactgttcacaatagccaagatatggaatcaacctcagtgtccaacaacagatgaatggctaaagaatgaaatagtatttcattgtggatgttggtacatctacacaatgaaatactactcagccataaaacagaatgaaatcttgtcatttgcagcaacatgaatggaactggaagacgttaagtgaaataagccaggaacagaaagttaaacatggcatgttctcactcatatgggaaagctaaaaaaaagaaaagttgatctcatcgaagtcaaaagtagaacagagaatactagagtctgggaagggttgggggaggagagagggagagatttgttaaaggatacaaaattacagctagataggaggaatgagttatagtgttccatgtcactgttggattaatgtaattaacaataggccaggcggtggcccacacctttaatcccaacactttgggaggccaaggtgggcggatcacctgaggccaggagtttgagaccagcctggccaaaatggtgaaaccttgtctctactaaaaatataaaaattagccaggcctggtggtgtgtacctgtgatcccagttactcaggaggctgaggcaggagaatcgcttgaacccgggaggtggaggttgcagcgagccgagatcacgccaccacactctagcctgggctacagagcgagactccgtgtctcaaaaaaaaaaaaaagaaaaagaaattaacaaaagtatattgtatagtttcagatagctcggaggacattgaatgttcctaccacaaagaaagaaatgcttgagatgatggctgtgctaattaccctgatctgatcactatacattgtatgtatctaaacatcactatatatgccataaatattacaattatgtgtccattaaaaataaaggcccagcccagctcacataaggacggcaggtgtgttccttaaagcatcacaccgggtcccagtactagacggacactccgcctccggttgtgtgactctgccttttctgtgccctagttccctgtttgctccagctagttgagaatccacactgcctgggtcacagtgcccggcctgggtcccgtaatgttgtggggggcggggggtggaataagggagaaagccaggagtgccagcaaggccggctacttggagtgtcggtagcatgacgctgcacgtctagagcatgtacagaaacccgatgagacccgagccttacggtgaccctaggtacagaggacgtttgtcaccactgggtctctctaacactgggaaggtgacataatccgtttgcccacggtcacacgggcagctgggggtccagctgcaccatggccaggcctctggcaccaggtgatggggtacggggtgcttcagtgacacagcacttgacgtgacatgagggagaaaggactgggtgggggggtcattcgtgggcttcaggtccggggggattattatgctcagaaggcatgtgctgacactgtggcaggagagctctggggacaggtgggctccttgatttatcttttttttttttaaagagatgagggtcttgctctgtcgcccaggctggagtgcagtggcgtgatcctagctcactgtagctttaaccacctgggctcaagcagtcctcccacttcagcctcccgagtagctgggattgcaggtgtgtgccaccacgcttggctaatttttaaaattacttttgtgtttagaaaccagatcttgctatgttgcccagtctggtctcgaactcctgggttcaagtgatcctctcatctcagcctcccaaagtgctaagatttcaggcatgagccactgcacctgacctacctactgttttggggcaaaggcttagatggacacgcacacacatgactctcctgggcttctggttcagcactttctcttctgggggtgctcctctcatttcatcctcaatcctgagctgaccccagaagccaaggaccagcctgcccagcccaggcagaaactgagtatgccaagaggaatggggtcagggtggagctgggatgagcattgctggcctgactctcccttgtgaggtcttgtccacttggcccagttggctccagggcagggaataaaggaacagtctgtggtggtcttcccttctgtgcactagttctggaaagcagggataaaacaaccaggcaaatgcataaaaatactgtcgagggcttttcagcacaaaggacttcacatcttccttatttacaaaggctctgcgggggaggtgaggcaggtgtttggatggggagcagccgatgacttgcccaaggtcacccacagagtggcagtgccaggaatccaaggggaatgatcctggctcgagtctctgggaagaagattagatttcacagctttggatttaacatcactttgctccttttggccaagaggcatgttgtcctcagaaggccttggtgacaggtatattttgccttaatttgagtagtttagaggcatggaagggcattttggcagcagtgatcaaggactttaaaaataagtcttccctttgatcaggcagccctatatcttggagtttttctgagagaaataatttaggacacatggaagtatttagctgaaggatattcatctccgtcttgcttatcttacggaaacgttagaaacacctatatatacagtagcaggggcgtggttaaataaatcacagcatcagatgctctgcagacatcacatggtatagctttttcttttcttttttgtttttgagacagtgtctcgctttgtcacccaggctggagtgcagtggtgcgatctccactcgctgcaacctctgctccctgggctgaagcaatcctcccacctcagcctcccaagtagctgggaccacagacacacaccactatgcccagctaagtttttgtatttttagtacagatggggtttcgccatgttgttcaggccggtctcaaactcctgagctcaagtgatcctcccacctcggcctcccagagtgccgggactacagacgtgagccaccacacctggccagaacgtttggacacatgaggggacattagactttctttggcaagggtgtattttccagttgctctagaatgaacatgaattccatgggtgcacctgttttactggacttcgctatattgtgctctgcagatactgcgttttcatgaattgaatatcacggctggctcaactctgagtctatcggtgccatttttttctcacatcacgtgttcacttcatgtgtttgtgtcccattttaataattcttgcaatatttcaaactttttcattattatcatacctgttatggtgatctgtgatcagtggtctttggcgttactgttgtaattgttttggggcaccatgaactgtgcccacatgagatggcaaagttaattgatccatgttgtctgtgttcagacgactccaccaactggccgactggcggcttctggtctctctctctctgcctaggcctccctctttcctgagacacaacaatattgaaattaggccaattaattaccctataatgggactgggcgtggggactcatgcctgtaattccagcactttgggaggctgaggcgggaggatcaccttgaggccaggagttcgagaccagcctgggcaacacgacaagaccccatctccacaaaaaattaaagaacttagctgggtgtggtggcacatgcctgtagtcctagctactcaggaggctgaggcgggaggatcacttgagcctgagagttctaggctgcagtgagccgagatcacaccattgcattcaagcttgacagacagagcgagacgtctcttactttaaatcaaaagctaggagtgattaagcttagtgaggaaggcgtgttgaaagccaaggtaggctgacagctaggccttttgtgccaaacagccaagttgtgaatgtgaaggaaattaaaaaatgctactccaggtgatcacacaaataataagaaagtgggcctgccggccagacacggtggctcacgcctgtaatcccagcactttgggaggctgaggcggggggatcacctgaggtcaggagttcaagaccagcctggccaacatggtaaaaccccgtctctaccaaaaatacaaaaattagccaggtgtggtggcgcaggcctgtaatcccagctactcgggaggctgaggcacaagaatcgcgtgaacccgggagatggaggttgcagtgagccgagatcgcaccactgtactccagcctgggcaacagagcgagactctgtctcaaaaaaaataataaaaataaaaaagaaaaggaaaaaaaagaaattgccacagccaaccccaatcttcagcaaccaccaccctgatcagtcagcagccatcaacatggaggcaagaccctccaccagcaaaaagactggactcactaggtcgagatgattgttagcattttcaagcaataaaatatttttatttttatttttatttcttcaagttttgggtttttcttttttttgaggcaggaccttgctctgtcactcaggctggagtgcagtggcatgatcttagctcactgcagcctcgaacttctgggcttaagccatcctcctgcctcagcctcctgagtagctgggactgcaggtacgcaccactatgcctggctatttttagttttttatagaggtaggatctcactgtgttgcctggctggtctgaaactcctggggtcaagccatctacctgccttggcttcctaaagtgctgggatgacaggcgtgagccactgccccggccaataaagtatttgtaaattaaggtatgtgcattgataagacataatgttattgcacacttactgggctactgtacaatgtaaacataacatttatatttgggaatatatattggtttgggaaaccaaaagagtcatgtgactcactttatttcaatattcactttattatgattctgtgggaactcaacccgcagtatgtctgaggtctgcctgtacctgtaatttttaaaagctagcatttgctaatatgtggttctaattgcagtcaacaatagtatggacccagactctcaaggctgagttggccttaggccagtagtgaatcccatgccagagagaacatttagcagggcggattaatccagaggatggggctgccttctagagcttgccaaggcagcgtcaggagagcccaggcttgagagagatgtcctcagtccagaaaagacctgacgagcacttggcagtcgtgctggacattctgcaagggccatcgaaggcctagcgtgccatcctgttggtccccatgctatttcctcctcactagaacctctccccttgctttagaatgggcgtcaaggccacgctgagaggataaaagatgtagggatcttctccgaggaagaagcatatagaagattttgtatctatgggtccgtattagggtttcccagagaaacagaaccaataggctccatccagctgcgtaagatgggatttatgtgggaattgactcatgcaagtatgaaggctgggaggtcctggaatctgctgtctgtgagctggagcagcagggtcactggtgcagtaatgcagcctgagtctcaaagcctgagaagcggggtggccactggggtaagtcctggagcccaaaggcctgaggcccaggagctctgaggtccaaggcagaaagaaggtggatgtcccagctctctctctttttttttttgagatggagtctcactttgttgctcaggttggagttcagtggtgcgatttcggctcactgcaaccttcacttccctggttcaagcgattctcctgccttagcctcctgagtagctgggactgtaggtgtgcgccaccacgcccgggtcatttttgtatttttagtagagatggggtttcaccatgttggcctggtctcaaactcttgagctcaggtgatccacctgcctcggcctcccaaagtgctgggattacaggcgtgagccaccgcgcccagcctggatgtcccagctcttgcagagggagggtttgcctgcctctgcctctgtctctttgttctgtccgggctttcaacagattgagtgatggtgccccacctggcgaggagggatcttcttactcagtcccccggttcagatgccagtctcttcccagagccacccagaaatcacgttttcccagctatctgagcatcccttagcccgtcaagctgacataaaatgaatcatcaagggctgcgaagatggactccaaaagtgggcgggggtaggggggtggtggtggactgtgatcgagaacattcctgcagggagaatgcctcccttccctgagtcagggaccagataacctttccagggtccttccagcccaggacaaagggctttgtctcaggttcagctctcctgagaattcatcctccccgagatttggacacctcagccgaattcctgctgtttaccttcttctctcaagaaacaacaacctgaggattgttgctttcacttcttcggacccaaatcatgatttcccagccacatttctcagttgtcaaatttgtggaggatgctggaagcttctagtgagttgcttacagatgatccaactggcggcttactaaaacatatcttgggctgggggcggtggctcgtgcctataatcctagcactttgggaggtcgaggcaggggaatcgcttgaggtcaggagttcaagacccgcctagccaacatggtaaaaccccgtctctgctaaaacacacacacacacacataaattagctgggcatggtggcatgcacctgtagtcccagctactcagaaagctgaggcactagaatccctgaacccgggaggcagaggttgcagtgagccgagattgcgccaccgtactccagcctgggcaacagagcaagactgtctaaaaaacaaacaaaaaacatatcttgacaatgccagtcatcactttaccacagaccttaagatgccaaccacccagactaggtcaggggcccccatttccagcagctactcctgcttcctggaaaccccctgcaccggccagactcccccagtgtcccatgttcatccccagcctcgccctgccagcttccctcgcccatccttctgatcaaactgtctgtggggaactagccctcaaacgaggccaagtacgtgtggcttctcctcctgtgtgggcaggtggttgacgggattctttcttcccccgcctccagtgggtttcagtttaacgatggctttctggagctgtttagaagcgtgaacagatgctgtccctacaggagaagggatggcaggcgttgtcaggaaccctgaccttgaagtgtacctccttaatggcctgacagctcagagagaatgacaccctgggaggtctccatgcagccagctggggacaaaaagatgtcctctgcctggtatggccacgagcatttgtacattgcactgtccttgttcacccacacctccttaaacagtgccttcaggtgcccccatggctcccggctgcttgagccaaatctttatgattgatcccctaacctacacgcttgccccctggctggctcacagctgtccctgacctcacccctgccatgatgtcacagctcaacagctctgctgttcccatggcaacagcctgctatgagtagccagccagggcagaggccgggctgcaggtggaggcggggaagcgattccggccacctttggtcagtgggcccctgagaccactgcggggctgaggctctctgtgtctgttcccatctgtggtgagggtggggttctttccatgcccagctgtttagcgaggctcccaagagggccccggagagtgggccaaggaggggctccaagccgtgggttcgcaaggccagcggcaaagtccctgcaccacggggctccccacaggcagtgtgatgggaaggagagtgagggaagctggtgggactgggttggagatgaatatggttgttggaggagttgggctggggggtcttcaggaagcaggaacacctgctgggattggggacccctgacctaggctgggtgcttaggatcttgaggtttgcagggaagcggtaatggacgctgtcgaggtatgtttagtgagccaccggttgcatcagctgtaagccccccacgtggggagctggcgtctcagctgggagtttggaggtcagtctgcctcagtgtctgtctctgtgaagctggtcaaggggaggcctgagcccgagcttgcccccagaggctgcctgcccaaccatctccaccctggagagctgacccagcccaggatatggatacacacagattcatgagctgtggccccagtattcgggtggaaaagcctgctgtgggcctagccaggactcattctaacgtgacccacccctgccccaggtgatgctaacacagccagtccaaaacccagtgcaggctgggcatggtggctcatgcctggaatcccagcactttgggaggccgaggcgagtggatcacctgaggtcaggagtttgtaaccagtctgaccaatatggtgaatccccgtctctactaaaaatacaaaaattagctgggtgtggtggcgtgcgcctgtagtcccagctacttgggaaggctgagacaggagaattgcttgaacccggaaggtggaggttgcagtaagctgagatcgcaccactgcactccagcctgggcaacatagtgaaaccaaaacccagtgcagtggcttgggacccccgtccccccgccaccactgggacgtggctaagagttggggagaagagggcgaaaaccaagcctctggcagcacacagcgtgtcatggagggtatttttagaggctagaactcagagaaacggagttaaaaatgtttctgatgtttgttttatctgggcttggttcggatgcctccagtgatgggcgtctcactacctacaaagtcagcccagtgatttcaagacagccctggagacagtgcttcctgccctcctgtcagcttctgcctccctgtaatgtgttctgggtggtctagctcagtcatctggagacacacacagtaagtaccacccctcttccccaagcatttcaggtgcttctcgtggtgacaagcactggcatctctgtagatgggtgctgctgttgttatcatccccatcctaaagagcaaactgaggcacccagagtgaagtcgcttggcctaggtcacatagtactcttaagcaccatactctgccattctagacttttctatcctttgcaaacacccttgccccacctcacctcctttggcttttcttcctaggacctttggtcagtgggcccctcctgaccaaaggagttcattctcctcctggactccaagcctgcggcctcttctccccgtccttaccgccctcctcctctcccgagaactgtccaggaagacacacctctccctcgttcagatttgctccttgttcttcagcccgtgcatctcctttaggtcttgaacagttctggacaggtttattcctgatcatttcatcacggttttattgattttgaaactttatcccgtgacatgatcaaattggccatttctagagcacaggcacttcgtagctgttgaccatcatttagctccacgtctgcccgtcggttcctcgtgcgtggaatccagcaccacgtgggtgtctctgccgagctctcggcatttcctgagccctcccggaagccagactctgttctcggcgcttcacacgggccgtctcgtctgatgctgtggcgtcctgcagggtgggaacgggcggtgcccgtggacgtggcgctgtgcctgccggcgtcctgggcaccacagcgttgccgcttgcccactgcctcctagcatggccaggtgaggtcgggctggctgggctgcaccattcgctcgcatgttagaggcgtttctgttcactcaggggacagtcacgttggcccttctggtggcccagcgtcttttgtcccctgtgctgctccacacacccacctctgtacttgcatagttggatttagggacccacatataagttttagatgtgttcccattacctttttttatcttgtaagatttggccagttgtgcaagctgttaaaaacctctaggctagagtctagcaacaattttccacctcccccaagggttatctgtatccggggatgcccacagctttgaattgataaggtcaggtgtgaaagctcaggcagtggtcctgtggaagagcccaccaccacctcggactctacttactttattaaaaaacacatttttttttttttttgaaatggagtcttgctctgttgcctaggctagagtacagtggtgcgatcttggctcactgcaacctccgcctcctgggttcaagtgattctcctgcctcagcctcctgagtagctgggattacaggcatataccaccacacctggctaattttttgtatttagtagagacgaggtttcaccacgttggtcaggctggtctcgaactcctgtcgtgaggtgatccagccacctcagcctcccaaagtgctgggattacaggcgtgagccaccgcgcccggccaaaaaaaccacaattttaataagcttgtttgtgtggctgctgtcagacagttatgaccagggaagggaggacacaggaagctctaaaaaggcgacttaaaaaacccaaattgcattctggggtcacttagtttatgggacctctgttctttacattttaaaagccctcgagggatttcctatattatcatcccaaagacaatccaaaatttcccccaaagaaggtcaaattacatattctacgtaggcgccttagacagagaaatgtctaactttccatatgaaagggtaagctctaattatatggaaatgttctctctctggccgatgccagctaacggagcccttctatagctatttttatgtttcaaagacaaagcgcttgactatgtggcccgggtgctgggcttctggagaaagggaagagcattctctttgttcccttggagggttggggcatcctgggggagtgggaacgaggcctgggctggggacatgcgggtaggatggggaagggggtgtgtccatgtcacgaggaacctgcatgagcacattccaggcgctgctgggtgtggggcatttgggaatggccaggagctctaccacccctgtctggtgtgcagcgttccaggctagggtggctcccaggggagccagggcgagctgcttgaccgttctcaagcctctaggcccagagattgccaggctttggcagggcagctggtgaactggctgcattcctgggcccctcccgcaggggctgggataggatctgtcaggggtgaggcccaggaatctaccccttcaccagcagctcagctgattatgatgcacgtggctgcgggttgcactcagagacttgctggtgtggacagcagggaatcacatgggggatgctgaaatgtaacccaggtctctcagttagacagcgctgggctgcagtgcgggagaggacggggtgcaggcctgggggtcgggggcagagaggctgattgggaggcttttaagggcctcaggtgagagatgatcagggctgagctgctggcaggggaggaaggcagagcaagatgcagcttcctggaagagatggtttgccagggccgcagtactccaagcgtggtcccccagatggcagcatcagcatccctgggagcgctttagagatgcagagtctggcgggcgtgggggctcacacccggaatcccagcactttagagatgcagagtctggcgggtgcgggggctcatgcctggaatcccagcactttgggaggccaaggcgggcagatcacttgaggtcaggagtttgagaccagcctggccggcatggtgaaaccctatctctactaaaaatacaaaaattagccaggcatggtggcgcgtgcctatagtcccagctacttgggaggctgaggcaagagaattgcatgaacccaggagggggaggttgcagtgagctgagattgcaccactgcactccagcctgggcaacagagcaagactccgtctcaaaaaagaaaaaagaaaagaaaaagaaatgcagagtcttgggccccacccagactattgaatcagagcctaactgttaacaagattcaagcagcaccatggccaggtctcacccttctgtgcatgttgacaaatcaagtacttgagcagaaagaagatggggatgatcgacgtgatgaactcagaggcaccaaccgtggtgtcctgggtcgatgcacacagaatgcacgcaggccccttgcaggccttcccacccttcagaagctcagcacacctgtcagggtcacaggagggccagggaggtcagaggtcacgtgaggccaagcacagtccaagcagagtctccttgtgctgtggaagtggtttccagctctgacctccctgggcagcaggctaggagcctggatcaggggcctgcctgctcggcccggaatccctgctgccctgattacgagctatgtggccttaggcaagttacttaacctctctgagtctcaatttccctgtcagattgtgcggataggaataggcctcacctcctatggtgaggcggtgagatggagagaggtgtacgtgaaatgccggaagagtatgaaaccctgcgggtctgcgtgctgatcagtgtgatgtctggattcaaacccagctcctccgtgtaagctgggaaagttattcagcctctctgagcttttgtttctttttgtgagctcagaggggaaatcaaggagagctggaggcggcagggacaaggttgcatccgatggtgtcatgggggaaatcaattcctgaatgatggagccagctgtgattttctggactttatcccaaagacctctgcccagatgttttaagtttgtacccatttccgtgtctccaggaaaaccgacacagcagccccgctggctcctttcacagtcaccctctggatcatgttgcagtgactctagccaagggtatggcctgtgtcgtgtctgttacaggccgaggtgggaagaaaaggttgtccctgtatctggaggggccagttcatgccttgaggaggagagaggcactctgggtcctgccattgtcctcagggatggccatgcttgccattgtcccacgtgtctgttcgggggggtccttctcctggggatacaacgtctgccgcgttgatttttgggtgtctaagtgtaccgggctagtatcacattgagagtcacccactgtgggtggattcacccattcccgtcatggtgcctggggctccagcagcctcgtcacaacacagcctggtagttggagggtctgagcctttgttacaaccgccctgacttagccgcaggactatgcacctggtggggactggggtgggcggccactctctcacaggcccaccccaaggctctagatgggcacgtgcattgttcaaatgccgtcataccttgggggtgcgagggggcagcgtgaggcagacgagagaggcggaggtctcacagtgaaccacaggatctggtatcctgcagccggggtgcaggcctgactgtggagcccccattctgggcgcctcacactccctatgactgtgatgcttgccccccgccccccgatgccacaggagtgcacagcaggcctggagtctccttcggagggggtgaggaggccggcggggggcgggggggtgctgtctgtgggccctggcacttccacgctgcctgggtggagggtccctgggtgaggtctgccttggctgaaaagctgtctgagcggccgcccagggaaaggcgagctgcttggacgtcattctcaagctgtaggccagaggttgcctgactttggtgagaatcgctgggaatctggtggccaagcacattcctgggcccaggtgctgggatcggatcggtctggggtggagctgccatgggctggctcctgcgctggggccacggggctgtagagagcaagagaggagaatgggcccagtgtccactccgctctgtgggaggccctggtgccgtccggaggccagattggtgtccactcgccttccttctgctgctccgagcgcggcttctgcggaggggggagctgtggtttctctgagtggttgaaggcagccagcagaaggcaggcttgtcagctcggggtggcaggaccagagggcagcaggggagtagaaaacaccaaagcagcccaggatgctcagaacactcagaggatgtggaggacagaggagcgccaggacccctgccccttctagaatattctaagcaaccagagagggcaggtgcctctgggaggggagctgtagcgagggccctgattggaaccatggctgtcttcattggcaagtgtcctgccaagggcacccgacgtcctgtctggcagggctggagagacactgggctgcctggagatcagcctgggcatcacaggcagaggcaggcatcccagcaggctgtgcaacaggtgaacggctgtttctccttggtcatcttgggctcagctaaggctctgttgctttccctgccagtgcctgcacaagtccacgtgagaccctgccctctgcctcaagttagtaagtggggagggtctcagaggggagagcaaggagagctggggtagcggggacgaggttgcatctgatggtgtcagagcggggatcgattcctgaaggatggagctggctgcaattttctagacttatcccaaagatctctgcccaaatgtgttaagtttttacccgtttgcgtgtctccaggaaaactgacgctgcttcattgggatgcccacgccagtggggctggcacggggtgcactgaggtcattgaacgggctgggggcacttccagagcagggaagacttgtccaggttttactaattgttggttgacaaggggtgtgagccaacggctcttggcacagaaatagactgtgaaccttggggcctccaggcaccttccgagacacacagaggggcattcacagcagccccgacctcaccacacctaattggacatccctgtggccgttcctggtggtctttggtgtctgaggccaactcctccatgtgagctgggaaagttattcaacctctctgagctttggtttctttttgtggactcaggccttctcttggttatagacctaggagtggaatctctgggtcatagggtaagtctgtgtttccctttttaagaaactgccagactgttttccaaagtggctgcaccattttccattcccaccagcagcgtgcacagggttccaattcctccccctccttcctcactgacagttgctattgtctgtctttttgacgacagccgttggagtggatgtgaggtggcaggacactgcagggtcagtgtgcatttctctaaagaccgctgccgttgaacatgtttttatgtgctgtattagccacacatctatgttctttggtgaaatatctatttaaatctgttgctgatttttatttttatttatttatttttgagacagaatctcactctgtcatccaggctggagtgcaatggtgcaatctcagctcattgcaacctctgcctcccagatacaagcaattctcctgccttagcttcccgagtagctgggattataggtgcgtaccaccacacccggctaatttttgtatttttagtagagacggggtttcaccatgttggttaggctgctttcgaactcctgacctcaagtgatccgcccgcctcagcctcccagtgtgctgggattacaggtgtgagctgccacacctgtccttcttttgctgattttcaaatgggattatttgccatcttactgggtagtaagaggtgttcatatgttctggattcaagtcttctgttggatatatgatttgcaaatatttccttccagtccgtaccttgtattttcactttacttatggtaccttttgaagcacaaaggttttttttttcttttaattttgatgatgttcagcttatccgtttctttgtttattggttgtgcttttggtgttgtatctaagaaatctttgcctgactcaaggtcatgaatatacacctacgttttcttctaagcgtttatagttgtagatgaaggtctatgatccattgtgagttaatttttgtatatagggtgagataaggctgtgaattcccattttttgcctgtggatatccaactgtgccagcatcatttgttgaaaaacaaaaaaactattctttccccacattaaattgccgtggcacctttgtcaaaaatctcaatcattgcattgaagggcccagctttctctctccctttctctcttgatcatcatggtggttggcagatctggctaaatataatattaaccactattctaattgtgtgatctgatttaccaagaggtgcaaggacctcccactagaagacttaagtcaaagccagctgcagtgtgaccacctgaggttggtcaaaggtgctggggttcgtccaagcagcagagggcctgtctctgccacttaccagctgtgtgatctgggttaagcatcttcatctctgcctgcctcagtttccctgtctgtgaaccggggggggtaggagcttcgtatctcaaaggattactgtaaaaaagatgaacggatacatgcccagtgctcagaggggagcctgcacggttaatgttagctgtaatgtagatgcagtattttctgactcctgcaactacatgtgacttcagctgcaactacgtttgactccaaaggcttagcctggttccacatagactaagatgaaagaagggaaggagcagtggagggggactccatatcgactgtggctgtcccttagcctttcctgcagctcacagatctggctgtttctggcatcagctacccgtggcaacagacacaatcccgtactgttttggtgtaaatgcccctcctttcctaggaaggcctgccaaagcatgggtcccttcctgatgccaaagagacctggaagagtccttctctgatcattataaaaggaaagagctgggagtcatgaagagagagctaacaccagcttctcctcctctctggtttctactggattcaagtatcagacttgcatgcacacatacatacctgcatgccccacacggacacatacacatacacacaccgacatgcacacagaggcacacacagacatgcatacatacacacacctgtacacccccctgtacacacagatgtgcaggcatgtgcacagaaacataaacagatgtgcacacgcacacacccctgcgcgcacacacccctgcacacacaccgctatgcacacacacccctgcacacacagccccacgcacacacccctgcacacacacccctatgcacacacacccctgcatacacacccctgcacacacactcctacacacccctgcacacacacccctgcacacacatgcatggagacacacacacccttgcacatacacccctgcacacacacccttgcccgcacacccctacacacacacccctgcacacacactcctacacacacatgcacacacacccctgcacacacatgcacacacatccttgcacacacccctgcacacacatgtatgcacacacacccctgcacacacatgtacgcacacacacccctgcacacacatgtgcatgtgcacacacccacacacacccctgcacacgcgtgcacacactcctgcacacacacatgcttggcaggctcctccctgccccgtctcttcctcctttcctttacgatcaattctccctccagaggcccagacttcctcttttacttccacctgctcttctcaatatttgtttccaagggctgccctttgtgcccctccatccctacctgaatcctaacccttgccctttgggtgggattgtcagtctcggcactactgacatctctggccaggttattcactgtcttgggcagccctcctgtgcagtgtggggtattcagcagcctccctcgcctccacccagctgcaggcccggagcacctcctccctgcatttgtgacaatagaaaatgtttccagacattgccaatgtcccctgggaaacaacaccacactctgttcaaaacagctgccctacaggctcttgtcaaaagtgtacaggacagaaattgggaggctgagagtgggccctggtgggcacgggtcaagagagcttggaggggcacattttgcagcctgtcctcacagtgagaatcccgtgtgcttgtctccagggctttgctcactctcctgggagcgatctggaaagctgcacttgtgctcccttcctcgtaggtttgctgtggaacgttgtggcttctgtggctcctcaggcccgggggcgccccttgaaccctccactcttggctccaagcaccttccctgggaagctgtatctgctgggttcgcagacaggaacagaaacatggatggagccatgtggctgagcctctgtcctgataacgaagacctgctttggaggaaaaagcacaaattgctacaagcccggggcaaaggcgatctcgctctgcagagaagagcggatgccaagctgtggaaaaactaccagctccagcgcttggctgaggagttgaggagagggtatcaggaggcacagcacctgcacgtcggtggcctggacaggctgcagtcagcacgtctgttgggctggggaggaggacgggccagggaaaatgagcctgactcgcaggggcccatccagcgaagatcagccaggcccccgagggccaaggagaagcatagagcagcccttagtgaagagaggagttgcagggaagagttgggccagcaacaccccaggcactccaggccccggaagacagcagcgagtccagagaaaccacagactacaaaagccacgggtcggatgaattctcacctggccccgcctgagaagagaaagggaaggccagaaccttcgaccaagtctgggggtggccgctgtgccatccatcctcggaggagcaaaggggcggacctagaaaggtcaaacccactcgtggctgctgtgggagaaatcgggcttgtggaggaaaaagagaaaggaacagctcgggcggggaggaggcaactgggaaagggggcagtttgctttgttccagccctgaccagtcgctctcagggacagagtctggaggggaagctgagagacctcgggcagctgtggccagctgattccagctgcagaagggaagccgtgtccccagcatctcagtgcacgctccgggagaagaacaagtggcagaaagagctggagttggcctttgaagagttgtttaatataaacagaaagctgaaaaaacacctgtgcttgtacctggcactgaagcccaggatggaccagagacctggggaagggcatgccttctcagagatgcaagagtgtggcgctgggaccccaagagggaagaaaatggcagacccagagatgctgcctgccggggaacccaggagcccagcagaggaggaggcgcagcaggcagcgtccaagaccgacttgaaaacgttcatgggcaaggcccagaaccaaaaatatcagggcacggtcaagcccacgtttagaaatggaagtcaaacattgtctcccgaggcaggtatatttatcaacaaagaggactcattattgtatagcactgaatctggacaagagacccccaaactgggcacgctggcagagggctcccttcagctccaccttcaagaccaggcagacagagtgggctcgacggcatccaggcaaaggcagaaagcagagatggagcagagaagacaaaaacaactggaatcgcttgaacaaatggaacacccagatatgagcttggaaatccactacaaagctgagctagaaaaagagaggagggagcaaagaagagctcgactggcccatctgaagtcctcctccacgagagcccaggaaagggagagaggatctgagctcagcaccacttccccatcgggcaccagcctcgccgacgacgaccggcacagtcagatgatccgagaccagcagcagcagatcttacagcaaaacaggttgcacaagcagtttcttgaagaagcccggaaatgcttgcgggagtttcagaacatatgctaaatgcgagaggcccacccggggtaaatacatcactgataatggtgctgccagcactggtacccgggtctctaagatctgtgtttgcgtcattgcctcagagactattaggcctctttaaaatgggcaatctggggccgggtgcagtggcgcacgcctgtaatcccagcactttgggaggccgaggtcggcctcaggatcacctgaggtcaggagtttgagaccagcctggccaacatggcgaaaccccgtttttactaaaaatataaaaattagctgggtgtgatggcatgtgcctgtaacctcagctactcaggaaattgaggcaggagaatcacttgaacctgggaggcggaggttgcagtgagtcgagattgcaccactgtactccagcctgggtgacagagtgagactcgtctcaaaaaaaaaaaaaaaaagcaatctgtcattataccgtcctccagggcacattccctcacagggactctttccctaatcttgcctttattgattgattgattgattgagacggagtcttgctctgttgcccaggctagagtgcagtggtgcagtctcgactcagtacctctgtctcctgggcttaagcaattctcctgcctcagcctcccgagtagctgggattataggcgcctgccaccatgcctggctaattttttgtatttttaatagacacagggtttcaccatgttggctaggctggtcttgaactcctgatctcgtgatccgcctgccttggcctcccaaagtgctgggattacagacttgagccaccgcgcctggcctagtcttgcctttaaaacgaagtcccttttgggaaaccacctatatacaaaaataggaacccgtgtgggtttcagtgggtgtgtctagcccatgtgctgtggatgcatctcccagagccgatcatgtcactacattccagcctgggtgacagtctgttttcaggggccacaggcacagatggagactccaggtcatttaagcccttcagatgttttagccaaataaacactggcctttcaggggcacccaaggtcagacgggcacaatttcaggagatagatcacttagtgcttagccaaggctgagacattaacggagattgaaccaaagctaaaacctcttagtctttcaaagtcacaacaaaaccaacattgtttaaatagcacgtcgcttaatacattcttataactttaagagaaaagagagtagacggaaaagagaagacaagccaccctcgccccgctgggtgattccctctggggctggcaagggtgtcggcacctgggtgtttgatcagtttcctccccgctagctttgccactgacctggcatccaccagagccatggagacctcacactgggtagcttctcttctgccaattgcagtcttagggacaggcacagggatcaacatactttttctgcaaagagccagagagtaaatattttagcctttgccagctgtgcagcccccgtggtaattacccagctctactgcagctgctcagaagcagccacagatgagatgtaaatgaaagggcgtggccaggttccaatgagactctacaaaaataggtggtgagcggcatctgccctttgtgccatagtttgctgatccctgtactaggatggtttcagagtctgtctctctccctcccttccaacaacctcagatacattgacttagatcaaccaatctttgttcatgacacattagtatcattggtccacgaatggccttacttatgtatattttgtagacaatataatgaagtaccatgagcccatcacccagacccaagacccagaatattcactacctgtgcgctacctcccttttccatccccctgctgcctccttggacatatacctgctgatggctcacacctacaatcccaacattttgggaagccagcgcaggaggatcacttgagcccaggaattcgagaccagcgtgggcaacatggggagaccctatcctacaaaaaataaaaaattagctgagcatagcggcctgcacctacagtcccagctactcgtgaggctgaggcaagaggttcatttgagccccagagactgaggccgcacagggagctgtgatcacgccactgccagcctgggtgacagagcgagaccctgtctcagaaacaaaaagatactggacgcggtggctcacacctgtaatcccagcacgttgggaggccaaggcgggcggattgcttgaggtcaggagtttgagaacagcctggtcaacactgtgaaacgctgtctctactaaaaatacaaaaaattagccgggcgtggtggtggcatctgtaatcccagctactcaggaggctgaggcaggagaattgcttgaatccgggaggtggaggttgcagtgagccaagattgcgccactgcactccagcctgggtgtcagagcgagactccatctcaaaaaaggaaaaaaaaaaaaaagaaacaaaaagatatatacctgctgaacttggggtttagccctccctatctttatccatatatgtatgctaaacatagtgtttagttttacttggttttgaactttataaaaaggatattatgtggagtcttttgaaagctaggttttttggcctcggcacggttactgaattcatccacatcacacaaacgcctcttactcattttcactgcagcatatcctcatcgcgtgtatgagcttctttccaggatcatagcttctccagtttcgtgcttgtttccaaaaagaggactatatctctgatgcatttgaatcaaaggaccgggtgtcaaaaagtgcttttggcacagctgggatgtaggtgtgggaaagatcccgtttattgctctttttttttttttcctatttttttttttttccccagaaaaagattgacctgctcttataaaatatttaatttacaaatatgaggctgggcgcgtttgctcatacctgtaatcccagcactgtgagaggccgaggcaggtggatcacttgaggtcatgagttcgaggccagcctggccaacagggtgaaaccccgtctctactaaaaatacggaaattagccgggcgtggcggcgcgcacttgtagtcccagctattcgggaggctgaggcaggagaatcgcttgaacccaggaggcggaggttgcagtgagctgagatcatgccactgcactccagcctggggacagagggagactccatctcaaaataaataaataaatttacagatatgagtcctagacactgtcccagtcactagagatgagcagtgagccacacacatggaaccacaggactcccgttctggtggaggacgcagatgatgagtgagtaaaagctggaactatggctgtgcaggacaaggtgctcagtgggaccccaagtgcacgcctctgagaaactcaagccggacttccctggcgaatgcgaagctcgtggaaccaacaagcgttacgctcatttggacggggcgggagtagcatcccacaagactcttttgtttttgcttttgggttctttaatcattagtagcttaggtctctgttgtctgtggctttctgcttcaggccaagtagaggaaattcgaggctgggcatggtggctcacacctgtaatcccagcactctgggaggccaaagcaggtggatggcttgagcccaggaatatgagaccagcctgggcaacatagtgagattgtgtctctataaaaacaaaaagtagccaggcatactggcgtgcacctatagttccagctactagggaggctgaggtgggatgatctcttgaacctgggaggtcgaggctgcagtgagctgtgattgcgccgctgcactccagcttcagtgacagagaccctgtcttagggggaaaaaaaaagaagaagaaaattttgatcttagcctggtttctttctatcctctgcttccagaatgtcatgggctagggttgcaaagccactccacaatttgctataggctcaacatgattaagaaggaaactgggggtcaggagggctgctgtttttcaaaagccacatagatttctcggggtggggtgtcaccgtgctcctgctgtttctgcacttgccttgtgcccagctattttttgcacacggagacctggagcgtagccgcctgtcagtgtagcatcacctctgtctgagagggcagagagggtgttatggcatgactgagttaaaagccatggccacaatggggcccaaacattgagtagccgaggtcttcctgccttagcctggaagccacagtctgatgggggaaccagcctgcctttgagtgggttatttttgtttccattttcaaaggtagcatttgtgacccatgtgttctaggtgaggaatcgccccttcttgaccacacgagctaaaactaggcgtggagacgggcagcaagacagtgtggagggtgactcatctctgcccggacggtcacacctgcactgtcccctggcagcaggaccagacacccggccctttcccacctgtcctgcagaaggctaaggggacagggtggttctttaactagggcattggtgtgggcactaaaacagccctccaggatgtccacacccaaaaccatggccctccagtgattcttacggagatgtcatgagtaactttccatcccagggcctggcagtgcctgtgttcccctccccccttggtcaccttggcacagctggactgcggtagaaagggctgtggagcagcctccagcttcccctggctcaccccgtcccatgcctccacccagagcctccaccaggagctggtgagagccctactgccggggttggagccctggctctgccatttgccagcagctaggtgacctgggcagagtgttaaggtttctgcacttcctccaaggcctggccctccacctcctgcccctcacacccctcacacccctcacacccagcttccagcatctctcttcccaccacctctcttccggacacaagtgcacagggcctgccccctgccttgcgagcctaaatcctccccgaagtgccaggcacctcatagggctatgttggcgggctcaggggtgccccctggactcacaccccagcccttgcccagccttcatttgactgtaaaacaagggatggagccacccggaagggtgtggggctcctgaggtttccagagagcactgccatgccagcagcggtgaggatcccagatgtggtggccgtgttcaccttcatcctaaggcacttccaggtaccccgcacggttctcctgctccgaacactttgcaccttctagagctctgctctggtttggtgcttctgcccccacccttgggggacagattccgtgttcgcgcctcactctgcatttgctggaaccttcgtcctccggccccatctttgctccctgccttgtgggtccttctccccaaaccacagggacccaggaaggcctccgtggctgagcagtggtgcgtgggtcgccctgttggtccgtgaggcttggacggggagcagcagcgttgcttgtgctttctgccgaggtcagctgtccatgggctgaggggggccagcagggtctggcaggtgctacctgttcacctcctggcctgctcccccccaacctgctggccagttgggctttggatgtgaccccaccctgagagctgccctggggcgtccatcttctctccgcacaaatctcccttccccttcaagccctgtgtgaccaggatctccgacacataagacaaaaggaaatagggtttttagagtggacgggtgggtagagcaccctccctgacctgtggtcattcttccagttcgtgcaaatggcaagggggttatatcgagatctccaagaagacacggggcggagggctggggtgcagcctgcacttgcagctgctgtgacagcccaggccaagtcctccagctggagacggggctacacagatgcacaccccccaggacaagcttagggagtctgggggcgccgctcagcatggggcttgtttgggaagctgtgctgaggaggaagggaaaggggagtggggacctcagcccccctgctttcattctttcctgggtgtgtggaccctgggattccagccttcatgtccttcatgtccctgtttctgtctcctgagaaatgcagcaagtcaggctcagcccacaggccacatgaccctgggtccgacgaacagccagggctcaaagacagtcagtgccaatgagcctgaagcctgggcccggacctcacgttcgtccccaaaaatggatcggcttgggaggaacagtgccctgcccacctcgcgctgtcgcagccccccagcaacagtgcgaggagagaatctgctgctgcccctggctccggagttgtcaccctggccccctgctcatctgttgtaggggggcgggttgcagggatgggtaggggtttcctcggtgcctctccaggctccctctgcctcctgccctgcacggtcctgctcctgtccctgctccggctctggcttagggtttgcagggctgagcttggctgttccgtgggtcttgacggagaaaatgcagagctgcacttccctccacaaagccgcactgttctcagcaaatcctcccggggtctggtgcattgttttcaagtgattcagcagcacgtgaatgggaagggccgagccggaggctctggcatgagacctgctggcccaccagggaaagggagggcagcgggacgtgggccccgaggtcctcccagagctgcagagggagggggcagggccctggggttggggagggcggcaggaaggctgggcagagagggcggctttgctctgcgtggctgaggtgctctgatagatgctgtttcccaagaggagccaaaacgaatgggcaggaagtgagatgggagagctggtctccatggagacgggcacccagtggccagcagctcacgtgcactagaatctcaggcagccggggagggagcattccctggggcggcagggcctggagcacccccaggtgcccgctggcaggcggtgtggccccggctgaggctgcgcttctgttccctgatctctgttgtgcaccctgttaccttctctgccccaccctcctccgcaccctccccaacaaaatatcttttctgagtagttgtcattccaggcgtttttcaccctggcctgagtcatgctggccaagtcctctgtcctcaccctggatgtcacggtcccgccctgcaccagggctgcaagtcaccactgagggtggacctggggcctctctgtcccagccacccacaaactctcaaggtcagagtctggaaagggaggtggtgccccatgtcttcacttccggtgtctacaccctcaactggggacggatgtccagtgtgctcctatggtgccccctctgctgaggtctttcctgcttcccagaaggccccgttgctggcttccgggggccgaggaggttggaggacctgagggtgggtctggcctccacagcagctgcagggcgggaagagcctggttcctgcccagcaccacagggctgtttttaattaccaagtcacggccctcttttctgctcatttccctaaaaggagtgaatttggaggaggtctgccgcacccgctgaccaaaaggggctggcatgaaggggccgaggaagggcagagcccagtgcccgggggagaccctctgactgcccaccaagggcacccggctgtgtcacttgaggccagaggctgaaggtgagctggaccagctaaccctcactgtcacctcacaacacttgtgacacttcctggctgctcagccttgccccgtgcccctgggcagttccgttgggagaggcgtggcctccaaacctagaggactagagcaggtctggggtccttgtgagcacagccccttcctggatcaccgtctgccatccctggtggcgtttgtggccacttctgctgctccagctggcgaggtcggccccatcctgctaaaagaaggaggtgctgcccgaatggagagcttccatgtttctaagctgtctttactgtgatcctgaagcccaacgagattagttacacacaaacatttagggatcccacagcgatctgagagcagggccatgaaaaatagtcatttattacagcagttgcagggcagggccacagctgtgttactggacatctgtcctgagctgagggtgtagacaccagaagtggggaaagtgggcttcacctcccttttcagactctgatcttgtgggtggctggggcagaggggcccctggtacaccctcagctggcgctttagacatattaatcaaaatggtcaggccgggccaggtggctcacgcctgtaatcccagcactctgggaggccaagatgggtggatcacgtgaggtcaggagttcaagaccagcctggccaacatggtgaaaccccatctctactaaaaatacacaaaataaaaatcagccgggcatggtggcgggcacctgtaatcccagctactccagaggctgaggcaggagaatcgcttgaacccaggaggccgaggttgcagtgagccaacgtcgtgccattgcattccagcctgggcgacaagagcgaaactctatctcaaaaaaaaaagaggatatggagcccctgccaggttgaccagccatatggtgtcattacatccacccaaaagggacaagagactctcatccccaatggcaacgccaagttatagttacagatgttagcaagggcgttactaactgtgtgatttgagggtgtggacattggcactcatggcaccccacttttctggagagtttagacaaggcgtggaacgtcacagtcctttcccagtgaaagaacaaagctgagtccacctgcaactgccattggatcctccccaggagtaagtggaggttgggtttcatccgggagagaaaatggtttctttgataattcctctgaaatgactggcatgtaattccacccagagccaaatgaaccaaatgacgctcagaagacgtctgcggctccggcctgcagttaccgcgtttgcgtctacgcagtgtggagtcctccagggctggcccctgggatgcatgcagtggccactggtcttcattgccactgtgggtgctctgggctgactctgacccagctgcagcatcagaatgccccccacccactagtgatgtgggccagtagggtctttggcacatgtgtgaagcccccacccgactcccaggaatgacccatgttgagaacatggggaccccttggcgttctccgctgggccataagcaggacaggacagaggggaaggaggcgctttccctgccagtgctggtcctatgggcgcccctccccaggtgaaagctggagcctgcagaagagggtggacggctgggaggggccagtgccctccagtgatactgagcaaaccctcccagtccgagtcagtgtgcacacaaggtgcagatgatcgggccgggttttgactttgtatttagcagccgaatgtgtttctgagtcccagggatccctgcacctcgtctgggcagacaggtgactttgagggacagtgggccaccttctcccgctgcctgagcacgtcccgtagccgagacaggcgctatgctgttacagtgtgtggagtgccccggggagaggctgtgagtggtctagacgttgggtgttgatatccaccggtttgcctgtcccaaacttgggcctgggagcccggcagagtggctcaagtggaaaatgttctatatggtatatttatacatatagcatgtgggattcctccagcgagcagttgggcccctggcaagataataaagagaattcaatgagtgtggaataagtacatttcttacaggcaattttctttttctttcaaaggcagggtctggttctttcacccaggaccgaggtgcagtggtgcattcatagctcactgcagccttgaacatctagttcatacaattctcctgagtagctgggactataggcagatgccaccacgcccagctaatttttgtttttttttgtttttgttttttgtattttgttttttatagatgaggtattgctatgttgctcaggctggtcttgaactcctagcttcaagcaacccatccaccttggcctcccaagtgctgggattacaagtgtgagccactgcacccggcctttcgaggcaattttcttttggggtctgtctccctcccccaattgtgggcatggcttgttcttattttccgcaggaacttccatagtacttctgtggacacaggaggattggaaagatgttggtgggtgtatgaaggggacgtgaggacgcaggacccacgtgttgatggcagcagaggggacaccgaggagagagaacaagggaggaccgtgccacagaagccgtggcgtctctgcctggggctggcgtggttggagtctgtggagagtgccgcccctccggccagcccttggccctggcacatgctggtgacaccaggttctccagcaagcccccttcactgtctgctcccctccgagagcagcagcagccggtccggcctctgatggttttccaggggcggttgtgactgtcgaagtctgaccgtagcccatcctctttggatcgtctcccgcgaccttggttttccgcccacccggttcttttccgtccccactctggcgggtgcgctcgggattgtttttgcaggggggaagtgacatcatatggtgtcctgggctggaggggtgggggtggggaccctgcagttgcgtgtgctttgaattcagccgacggttgtacattccagtagccggcatctggcggtgaattcatcagccagtgtatcacccttgatctcaaacccagatgttgtgttcacagcagaagggaaagaaggaaaaacgaaatctgagacgcccagggagaggccgtggtttctgggctcagggcagttagaacgagagtctttataaagactccccctctcgcagctgcctctggctccttggggaaggggcagaggagcagagcagcccctctcgggggcatggacaggagatgggctgacacccaccccagtgcctaacaccaggcccagcacccagtaggtgttcagtaaacgtgtctgtgccacaattttcatttcttcccagattccttatgtctcttcgctttccccagccctgttcttcacatggcctgggactcggagaggccctccctcttttgaagtggcctgctttcccctacagaactggtggtccatcctggagctcagagtgcggaccattgccattggcatggaaatgtattccggagagctctctctccctcctcctctgtccaccactgggcattggaaactctccttctctgtgttcctatccatcgtctgtcatcttgcctggattggatgctcctcccaggcaaggcctgctgtatgcaggattcaccctgtaccctctcttcacctgctgtcacctctgggcaacaacccccgacaggtacccgctgctctgagcaggtcagcggtgcagatcccgctatgccaactggtgtgcaccgatcagagctgtcagctggcccctctccttcatgtctgcggcgtgctggtgctttggggaaggttgccgtggaactggtccttctttgcctctcttgattcccattttccttctttcatgtaatttctcattttgcaaagtgggggaggaggtgcccacccccaatttaaagggaccctgaagaatctgaattctgttccccaggggcagactaaagcagcccaggggagatggagatgccctcaggctctgctcctccaggcccctcacccccacttccctgcccctcacccccacttccctgcaggcatctggcggcctcctcgccagttcactttctagtcctaaccccacgtggctaccctggacccttgatttgaccagcctcctcttttctgacactttaaagaaggaaagtgtgtaatctgcagcccccaggcaaagctagcacgctgggaagctgcatcaaatcgagagtctgtggcctgctgaccaggaccgggtctgtgtacctgagtggcatgatgccaccgtcccaatccctcacccacgggagcgggagaattcgccctgcttgtctatgcgatgctcgtggtcctgaactgtacacgcattagttcccgggcaccgcagcctccacaccagcccctctaacagtcaccacgaccttgtgaagtgtcaagactgttgtcatcgtctctgtcttaggtgtgaacaactgtggctcagtgaagtcaaggagcttctcaaagatcacgcagccatccaggggtgaatgcaggatctctgtctcttgctgcctccttcaaataagtgcccagctgccacctgggagccttaggcgtttttgtaagagaacagcatgtgaacctcaatgcccatggtaggatgcaacattttggccgttttgaagtaatctttgcttattttctgaactccagtgacatgcttgttgagtgcctattgtgcgttaagcattgtgcggcttagtggaccattgaaaggcagctccaaggccgggcgcggtagctcatgcctgtaatcccagcacgttgggaggccgaggcaggcggatcacgaggtcaggagttcaagaccatcctggccagcatggtgaaaccccgtctctactaaaataaatacaaaaaattagccgggcatggtggcgcgtgcctgtaatcccagctacttgggaggctgaggcaggagaattgcttgaacccaggaggcggaggttgcagtgggccaagattgcaccattgcactccagcctggatgacagagctagactccatctcaaaaaaaaaaaaaagaaagaaagaaaagaaaagcagctccagaaatttccaaaataacatacagaattcagcagactgtaataaaggccggcttgctgctcctactggaactgttgattcctttggattctgctggcttgctttttttccttttctttcttttctttttttaaaagacggagtctcactctgttgcccaggctggagtgcagtggcatgatctcagctcactgcaactttcacctcctgggttcaagcgattctcctgcctcagcctcccaagtggctgggatttttgtattttttgtagagatggggtttcaccatgttggctaggctggtctcaaactcctgacctcaagtgatccgcccgcctcggcctcccgaagtgctgggattataggagtgagccaccgtgcctggccctggtttgcttgtgagctggtgactctgctacatgaagagcaaactttgaccaagttaatctggcacattgactaatttgcataaacatttttggtgcagcattgtcgtaaggtatatagattaggcagggagcaagagagccaaggacaaactgcacctgggccaccagcccaaagttgtcagcgtcatctcagctccatctggcaaagagttagtgagcaccaactgttctgcagtcagaatctagcctcaacctgttaggacctcccagggccctgagcagacaggtgtgcaggaactgacagcaggatggaaaagagatggggaatataccaagtgctgcagaaggacaggatttcccagaggaagacagaaaagggctattttagctgggtcttgaagaatgaagaaaagttctccaggcagagaggggagatggcatttggggcggaagaaacttgcctgttcaggctgggtgtggtggctcacacctgtaatcccagcactttgggaggccaaagtgggcggatcacttgaggtcaggagttcgagaccagcctggccaacatgctaaaaccctgtctctactaaaaataccaaaaaaaaaaaaaattagcctggcaaggtggcagttacctgtaaccccagctactcaggaggctgaggcaggagaattgcttgaacctgggaggtggaggttgcagtgagctgagatcaagccattgcactccagcctgggtgacaaaagtgaaactccgtctcaaaaaaatatatatggtaattagccaggcatggtggtgcccacctgtaatcccagctacctgggaagctaaggcaggagagtcatttgaacctgggagatggctgagattgcgccactgcactccagcctagcaggggtggggatgacagagcaagactctgtctaaaaaaaaaagaaagaaagaaacttgtctgttcagaggtgtggatgcacctgggcgtgttcagggcagacaagtattatgaagtggtagaatagtgggagcatgggtggggggtgttgggcacagcagctgaggcccctggctgacttcaggttgcaaaggcgctcatattttaggggagggcagggggcagccaaggatgatgtttgagcagaaacgaacgtgaataaaaaaagacagctggttgcggtggatgagaggatggttaggagggcactggaaatagggggccgtcagggcaaagccgtctgttctggagtggcctgccgggagacatttcctagatgtggcttttcaggatgaggcatggattagcctgggaaacaggaacctgtggccttggccagtcatgactcagctccaacagaagaagaaagaagaaaggggtttgtgcccaggcgaggcagtggggctgtggtgtgggactctgatgccagcctgggatccagagagcattggtggggcccagggggatggacacagatggagcacccacacgcctgagcctccttgcccctgtgggaagagacagccctgcctaaggggttctaagagatttgagccgaccacgtggggtggggctggggctggggctaggaggctgcctggagcctggcgtggtctgctccttacctctctgttttgctcatatccaccgtaacataacacttacccagagtgaccctgaagagctgagtttgggagggcaaagcttttaaagccattaaaacagaccatgtcaccaactaatggccttgaaattaagaaagggagggctctacccaaccctgcccaagtgacagcatgaactactgatctgcttgtcctcaggttaccaggagtggaacagaatcctggcttaattgctaggagaaagccctgtgttgcatggcctgtcagcaacctcaggctccagaatattctggaattgccccagcccagcctcttccccaactcctttctgtttggttggggcttagttgggatcctctttccttctgtttgtccttcctcagcatctgtcccttgggtctgccagctgtgcctgccgatgtctcctttgggtgaaacttcctgcccctgcccctgttgtgcccctgatagactctgtgttactgtaaagaatcacccaggctgggcgcagtggctcacgcctgtaatctcagcactttgggaggccgaagcaggtggatcatttgaagtcaggagttcgagaacagcctggccaacatgatgaaaccctgtctctactaaaaatacaaaaattaaggttgggcactgtagctcatgcctataatcccagcactttgggaggctgaggcaggtggatcacctgaggtcaggagctcaagaccagcctggccaacatggcgaaacgctttctctactaaaaatacaaaaattagctgggtgtggtggcagctgcctataatcagagctacttgagaagctgaggcaggagaatttcttgaacccaggaggcagaagttgcagtgagccaagatcatgccactgcactctagcctggacgacagagtgagactccgtctgaaaaaaaaaaaaaattaaccgggcgtggtgacagacgcctgtaatcccagctacttgagaggctgaggcaggagaatcacttgaacctgggagatagaggttgcagtgagccaaaacggtgccactgcactccagcctgggcaacagcgcgagactccatctcaataacaacaacaacaaaaattactcatagaacattttccaggtcaggaaagatgagaagagctggatagacctttccagatgtaagacccccaaagctaaatatgccgggtacgtttaaggcccctttaaggtggataactccccctctgccctcagcccagaaaagcttgtttccaataggccgtggctggagggtggggaaatgtcccatccttcgcggaatgtgtgggattgtgggtcagttccatggggtacctgcttgccccagccaccagtgagtacccactggagagaaggaaaaaaaaagccaaaagcactcaagcatgatatcaacagatgagcttcagtcaaatcaatgactgcctcccactgttacagaaactgccttggtcacaagggactctgggcttctggcttgggcccctgtcaacaaagaagggattcttgttgaagaatcgtggaaggaggaggaggaggctgggcatcatctctcagcctggaggaggagacgccatgccgggggctgggatcaccatgccccttgcccgtctcgcaccttgctgctgtctgtaaccccccagcacctcccgcaggcctggacgtcttatccctctccttagccccaggagcgtgtttcaggaactctcctcacctctgtgtcttgtgttttgcagtgatcagggccaaagcggtcagtgagaaggaagtggactctggaaacgacatttatggcaaccctatcaagaggatccagtatgagatcaagcagataaaggtaatagtggctgccggcatcccgggctgcactgtgggcacagctgtggggtgttggggttggcagagagcctgggtccctggaacacgatctggccacctgtggactagagcagaggatgaggtcatcaagctgcaaatagatccgatttcccttaatcctcgaatgcctgaaaagttgtgtggagatgacatgctccccacaaattcaattccttcagaaacctgtccgggcgttgcggctcacacctgtaatcccagcacttcgggaggccgaggtgggcggatcacttgagctcaggagttcaagaccagtctgggcaacatggtgaaaatccatctctacaaaaaaccagccaggcatggtagcgcccacctgtggtcccagctattcgggaggctgaggtgggagaatcgcttaagcccaggaggcagaggttgcagtgagacatctcaccactgtattccagcctgggtgacagagtgagagcttgtattaaaaaaaaaaaaaaaaaatatgtggcagggagggcagggagggcagggcctggcctggggcaggagaggtgatgctattgtcattgacagtaactaacatggtctgtaagagagacgaaaattcatgtcgcaggtggagggacagccgtgtgatatggtggtagttgtagtcatcgatatttaattttgtcattaaaaataaaaagtaaaccaggcacagtgtctcatgagtatagtcccaggtgagtggatcacctgaagtcaggagttcaagaccagcctggccaacatggagaaaccccatgtatctactaaaaatacaaaaattagctgggcgtggtggcgagtgcctgtgatcccagctacttgggaggctgaggcaggagaacacttaaacctgggaggcagaggttgccgtgagctgagattgcaccactgcattccagcctgtgcgacaagagcgaaactccatctcaaaaaaagaaaaaaaaaaaagtagctgaaaatcaatgttatcagaaggtcagtggaatgcttcatcatcacatgtatgtcagtttaaggggatgacctagtctctcagtgcctgagtctctttctttacgaagcaggaaagaggatctgctcttacgacctcataaaggggtcgtgaaaaggccagtgccagtgcccaggaaatgcttttagccttttggcaaatgatgtcatttagtacagcatcaacataacctttcctggtacaagctggagtgtcactctcaagccatttgtcatgacatcaggcatgcttccattccatttgggtttgcttattgaaactcttcggggggaaaaaaacagcctccctgagtgctgagaaaatgccattcttcacctgggcagcaggtgcgttcctgaaaggctgtgagtaaatcacatgttgagaaagcaaactcttctggcccatggagttatgtcctaattcctgaggtgcctctctgctctcattgccatcaagtagacaatatttgaccaaaattcctggaaatataggttgggtggagtgacttatgcctgtaatcccagaactttgggaggccgaggcaggaggattgcttgagctcaggagtttgagaccagcctgggtaatagagcgagacctcgtctctgctaattaaaaaaaaaaaaaagccaagcatggtggcatgcgcctatagtcccagctactcgggaggctgaggtgggaggatcacttgagcctgggaagttgaggttgcagccccagcctgagcaacagagtgagaccctatctcaaaaaaataaaaaattcctggaaatatgcaaaagtcatggtccttcatggtggtccagagtcacgtggaggtacaaaagcccctccccatagattcagaaatgacctctttggggtggggggtgagggaacagaggtgttgtctgaggatgtcatgctccagatgacagtctttttttttttttttgagatggagtcttgctgtctcccaggctggagcgcagtggcacgatcatggctcactgcaagctccgcctcctgggttcacgccattctcctgcctcagcctcccgagtagctgggactacaggcgcccgccaccacgcccagctaaatttctgtatttttagtagagacagggtttcaccatgttagccaggatggtgtcgatcttctgacctcgtgatctgcctgcctcggcctcccaaagtgctgggattactggtgtgagccacttcgcccggcacagatgagtcttgtgctcacctgctgtgatctgccacactaaaagttgagtgactccaaagaatcactttgctataagaagtctttttcttttctttttttttttttttttttttgacggagtcttactctgtcatacaggtaggagtacagtggcgccatctcagctcactgcaacctccacctcgcaggttcaagcgattctcctgcctcagcctcccacatagctgggattacaggcgcttgccaccatgctcagctaatttttgtatttttagtagaaacagggttttgctacgttggccaggctggtctcaaactcctgacctcaagcgacctgcccacctcagcctcccaaagtgctgggactacagccatgagccctgagcccagctggaacggtcttttcctaacccatgtatttgcacttcctggtcctcttgggtgctggctgtaccccagctacaggttgtgccgcccagggtgttctggatgggaacggaattcaccaactgtgtggcctccctctgcttacatgtcctcctccttgtctttccagatgttcaaagggcctgagaaggatatagagtttatctacacggccccctcctcggcagtgtgtggggtctcgctggacgttggaggaaagaaggaatatctcattgcaggtgtgtatgagtggggccatcagccggaggctggcacagaagtggggctgttcctagacgcggtccagggctcgtttcccaggctcggggggtggggaggcggagtagctgaggaacagtgaggcagggtacggagccctctcggccacttcccgtcagagaatgctagtgaatgttcactacctgccaatttcctgggaaatttgagattggtggacaaaaaaaagggagcatttttgccttttgttcctaaaagggaggcgagtgcgggatgctggagacatgcagggcagagaaaccctttctgccgtcgggagggccaaaagctcgcgtaacatctgtggatactatgcacgagacctgcttgacttattcattcatctgtctcctttttttattgtggtaaaataatacgtaacaaaatgtagccatgttaattaaccattttctttctttctttctttctttctttctttttttttgagacagagtgtcgctctgtcgcccaggctggagtgcagtggtgcgatcttggcttactgcaacctccacctcctgggttcaagcgattctcctgcctcagcctcccgagtagttgggattacaggcacacgccaccacgcccagctaatttttgtatttttagtagagatggggttctaccgtgttggtcaggctggtctcgaactcctgacctcaggtgatccacccacctcggcctcccaaagtggcaggattacaggcgcgagccaccgcgcccggccaaccattttcaagtgtacacttcagtggcattagatacattcgctattgtgcaaccatcaccaccatctgtctccacatcttcccaaaccaaaactccgtccccgttaaacactaactcccccttctctcttcctcagccttggcccacctccattttactttctgtctctgtggatttgactactccaggggcctcacatgggtggaaccctgcagtgtttgtcctctctgtctggcttatttcagtagcatcatgttttcaaggttcgttcacgttacagcatacatcagaatttccttactcttttttttgtttttgagacagagtctcgctctatttcccaggctggggtgcaatggcactatctcggctcactgcaacctccgcttcccaggttcaagcgattctcctgcctcagcctctcaagtagctgggattataggcacacgccaccacacctggctaatttttttttgtatttttagtacagacagggtttcaccacgttgaccaggctggtctccaacttctgacctcaggtgatccgcccacctcagcctcccaaagtgttgggattacaggcgtgagccaccacacccggcccaaaatgtccttactttttaaggatgaataatatttcattgtatgaatgtagcacattttgtttattgttgcatctctttgtttatagttttttggtttgttttttttttttttgagacaaagtcttgctctgtttcccaggctggagtgcgatcatgactcactgcaacctcgatctcctggggtcaagtgatcctctcgcctcagcctcccaaagtgctgagatcaactacaggtgtgtgccaccacacccagctaatttttttattttttggtaaagaagtctcaccatgttgcccaggctggtcttgaactccgaggctcaagcaatcctcctgcctcagcctcccaaagtactgggattataggcgtgagccactgtgcccagcctatatttttattcctaagtaaaattattttcccttacttccttctacggcctcctctgcttgcccagctaggctgaaccacaggaggccaggacaggattctcaatctcagcactattaacatttggggatggaccattctttgttgtgggggcctaccttatgcattataggatattcagctgcatccctggcccccaccctctacatgccacagcacccgctccagtcgcggggtctctggacattgccacatgtgcccaggggaggtggggtagattgcccctgcttgagaaccactgggctcaaagagctttctgcagtgatggaagcggtctctgcaccatccagtccagcagcccccagccttgtggctcatgagcacccgagatatggctagtgcagccgaggagctgcattttaaattttatttcatttcaagtaattttagtataaatgtaaacagccacatgtggccggcagccgcagtctagcatggcactgactcagccagttaaggaacattattcccctcctccctggggaagtaggaatctgatcacaaacttaagaaaaaaagaatagacaaggcctggtgcagtggctcatggctgtaatcccagcaatgtaggaggctgaggcgggcggattgcttgaggtcaggagttcaagaccagccttgccaacatggtaaaaccctgtctgtactaaaaatacaaaaattagctgggcgtggtggcaagtgcctgtagtcccagctactcaggaggctgaggcatgagaatcatttgaacccaggaggcagagattgcagcaagctgagatcacgccactgtactccagcctgggtgactgagcaagaccccatctcacaaaaaaaaaagagaaaagaaagaagagacaagacaattcccctagcctggtactatagtttgttccaaaaggcaactgtaatcataaacatatactccaaatccaaatatccatgattgggggattttcttctggtttaggtgacatgtacttttttcccttctaaaaatcaatgtgtgcttagtgagcacctgttaggtgcccagccccgtgttagagacaatgggagattcccacggtgagatccttggctctggtcatcatggagcacacagatgttccgaatggggagactggaaaagaaagaaaatagattttgcttgtggagaattgtgaatagtaagtgaatgcttagaaggtgcaaaaggggccgggcgaggtggctcacgcctgtaatcctagcactttgggaggccgagacgggcagatcatgaggtcaggagattgagaccatcctggctaacacagtgaaaccccgtttccactgaaaatacaaaaaaaaaattagccgggcgtggtggcgggcgcctgtagtcccagctactcaagaggctgaggcaggagaatggcgtgaacccgggaggcggaacttgtagtgagccgagatcgtgccactgcactccagtctgggcgacagagtgagactccatctcaaaaaaaaaaaaaaaaaaagaaggtacaaaaggaagagagactctcacaggtccaagggtctagacagacttgctgctggaagaaggtggtgtccttgcctatggatggggaggaggtcattgcagggaggaagatgcagggctgtgagttgggcagggaagactcctgttatctccccttgggtaagatcttccctcccttccttaacatgctcacagctcctgctttgctgggtatctcggtcatcaagacttctatccctctccttggggataataggagacttcccccccttttaagatgcatttctggacttcctaaaatgttttattatgagcacttttcttattctcattccaagacagagtctccctctgttgcccaggctggaatgcagtggtgtgatcttggctcacagcaacctctgcctcctgggcaattctcgtgcctcagccacccaagtagctgggattacagatgtgtgcccccatacctggctaatttttgtatttttagtagatacggggtttcaccatgttggccaggctggtcttgaactcctgacttcaggtgatctgcccgcctaggccttccaaagtgctgggattacaggcgtgagccaccgcgcccggcctacaattcagtggttttagtatgtcacagagttctgcaaccatcactacagtcaaaaagaaatcctgtattcttgagctattaccctcctgactcccctccccctcccccagccctaagcagccactggtatacttcccgtctctatagatttctctatgctgggctttcctgggaacggaatcatacgtgtgaccctgtgtaaccggcttctttcgtgtttccaagggtcatccatgttacagtgtgtatcagaatttcattcctttctatgactgagtattccactgtatggatagaccacgttttgtttatccggtcatcatttgatgtgcatttgggttgttgccaccgtttggccattgtgacaaatactgcaatgaacattggtgtgtgagattttgcagggacctgttctcatttttcctgggtgtatccctggcagtggaattggtggggtcgggggtggggaggggttgggtgactttaggtttaaccatttgaggagctggcagaccgttttccaaagcagctgcaccattttacacgcccagtattatctatgatttttacaataagaaaaaaaaaatcaaatggagaagggtagagggacaaaaaccacctgtggtgcaaagatcttaccagctaactaatgccctcaaaaaaaacacagaggaggcaggagagctggggtggccgcacagcacgcacggtggcgcgtggcagaggcatggtctgcagtgtggcattcgggggctgctgcagctgtgcacagaacagagcacgggaggaaatttcccagcgtgtcagcatctgctgtgtctccttttcagttctttcctgtattaaacctttaaaattatggcatttattacgtttgtcatcagaaaaataaaatctggagagacaagaaaggagacagaatcccccgtggtgcagggaacttacttccagttttctgcatcctgtttgttcctatccacagggaacagcctttaaagtaagtcccagccgtcccagctcagtttcgtcacactgccctctaggggctttctggccaaactgcagcgctgcggaaggactcttgggtgcaaaagtgaccttggtctgagccagcaccggtgtccaaacatacccagctgaatcctcgcccatgctgaagctctctgtttgtttttgtttttgttcgagatggagtctctctctgttgcccaggctggagtgcagtggcacaatctcgggtcactgcaatctctgcctcccgggttcaagcagttctcctgcctcagcctcccaagtagctgggattacaggtgcccaacaccacgcccagctaattttttttttttttttttgagacagagtttctgtcttgttgcccaggctggagtgcaatggcgtggtctcaactcaccacaacctctgcctcccgggttcaagtgattctcctgcctcagccttccgagtagcagggattacaggcatgtgccaccacgcctggctaattttgtatttttagtagagacgggatttctctgtgttggccaggctggtctcgaactcctgacctcaggtgatccgcccacctcggcctcccaaagtgctgggattacaggtgtgagccaccgcacctgggcggcattaagtacattcacagtgttgtgtaactatcactatctatttctagaagtttttcatcatcccaaactgaaactctctccccattaaccaataattccctgttcctctgtttgcccagcccctgacaaccacctttctacttcgtctccatgaatttgcccattctagacacctcgtacaggtagagtcatacctccttccatagctgaagcattgcacttagcataatgtcctcaagttcatccatgttgtagcatgggtcagattttattttattttatttatttatgagacggaggcaacaaagcccaggctggagtgcagtggcgcgatcttggctcactgcaacttccgccccccaggttcaagcaattttcctgcctcagcctcctgagtagctgaggttacaggcatgcaccaccacgcccagctaatttttgtatttttttagtagagacggggtttcatcatgttggtcaggctggtcttgaactcctgacctcaggtgatccgcctgccttggcttcccaaagtgctgagattacaggcttgaaccactgcacccggctggtagattttatttctttttatgtgcatacattttaaagtttccaaaatatgtaatactcttctaagttgaattctatatatgttttcaaattgttaacatttccattaactttttaactcagatactacttagtatctcaaggaggaggcacgaggttttgatgaggacacagaactaaaggtgccaagtgcaaacagtttattgcataaagaaaataaggaaatgggctgaccatagtggctcacacctgtaatcctagcattttgggaggctgaggcaggaggatggcttcaggttaggagttcaagatcagcctggacgatatagcaagaccctatctctacaaaacaggaagggaggaaggaaggaaggaaggaagggagggaggaagggggagggaggcatggaggaagggaggaagggaaggagggagggagtgaagggagtcagggagagagggagagaggcagggaagaaaggagggagggaagaagaaggaaggaaggaaggaaagaagagatgagctgggtgtggtcatgtgcacctgtagtcctagctacttgggaggctgaggcaggaagatctcttgagctcaggcatttgaggctgcagtgagctaggactgcaccactgcactctagcccaggtggcagggcgggaccctgtctctgttttagaagagaaaaagataacgactaagtgtcatgaaaagatgtgaagaaatacaatgagatgcccgagtgaaggctctgaaaacacctgctcgagttcgaatgtgtgctctgacacctgactcgttaatgtccttggccaagtaactttacctgtctgtgcctcccatgccgatccgtacatgggggatgatgacagtagtatctgccccacgaggggttgttgagaggatgaaagtgggagtaggagaccagaaatgatgatcacagagatgctggttatcttggtcaggccccactcaagggtagctgataattttatgtcttacactggagatgacagtgacccatacacgcagcacagcactgcatgaaaagctggtgagtcgatacagagagtcatactgaaggtctaaggagggctagggtagcctgtagcagaatgagcgtgaaggctctgctgaaagggcattgctccctggacctgtggcgggatcctcggtagaaagctgacattgaaagattttgaagagctttagttaaaaagttaaaaacagcccagcgcagtggctgacgcctgtgatcccagcactttgagaggctgaggcgagtggatcatgaggtcaggagattgagaccatcctggctaacacagtgaaatcccgtctctactaaaaatacaaaaaattagccaggcatggtggcgggcgcctgcagtcccagctacttgggaggctggggcaggagaatcacttgaacccgggaggcggaagttgcagtgagccaagattgtgccactgcactctagcctgggcgacagagcaagactgtccccccacccaaaaaaaataaataaaaaataaaaataaaccaatgttggcaaggctatggagtaaagggaacgcttaggaacgcttatgcgctgttggtgggaatgtaaacgagttcacccactgtggggcacactttgtagatttctcaaagaactgagaaagcaactagcatttgacccagcaatcccactgctgggtgtatacccaaaggaaaataaatcgttcaacggcactgcgcccgtatgttcattaccgcactatctgcaatagcaaagacacagaatcaacccaagtgctcatcaatggtgacttggataaagaaatgtggtgtatatatactacggaatactacgcagccgtgaaaaggagggaaatcatgtcctttgcagccacatgagtgcagctggaaaccattatcctaagggaactagtgcaaaaacagaaaaccaaataccacatgttctcacttaaaagtgggagctaaacattgggtacacatggtcataaaaatgtgaacaagagacactggggaatacaaggaggtgggagggaggaagcaggataagggctgaaaaaattctacctattgggcgctatgcccactacctgggcgatggatccgttcatatgccaaacctcagggacacacaatatacccatgtaacaaatctgcacatggacttcctgtttctaaaaatcaacaaagattgtgagacctgcccagtggccagctggctgtgtatcttctccaccaatgaggctgcattacttcatcctcctctccctgggagggggagcaggggtgaagctgttaatggccacagtggctgactcacctcatggcgagaggaacctctctcatctgacttctttcccagccttggtcagatgactccacattgaatctggcatttatttcccgaggcaggaacctagatccagtttgcctcgagtcaggatagaccctttatccaggggctaaccagaaatcacagggcacagtgaaccactcagctctggctggctgtggccagtgagtgaccgcatggcctgagcgggccacctcctcctggaccgatgactcagtctcacgtgtcgagtcgggcaccaggagactcatacagagttggccctgtaattttcttctacattcctcttctccaaaaggaaaaataaacatacaacccttcgttacaaattttaattcccggttttctgtaacccagactcatgcctcgcttttctcggagacagacataagtagaacatcgctgcagatgctcacggtgtgtacacccaaccaagtcttaatcagaccagaggcggtcctctcttcacatttatacatgacagccacgttcatgttagcccaataactaggaccattgaaaagatacaattttttggctgggcgcagtggatcacttgaagtcaggagttcaagaccagcccagccaacatggtgaaaccgtgtctctactaaaaaatacaaagattagccatgggtggtggcgcatacctgtaatcccaattttttgggaggctaaggcaggagaatgcttgaacctgggaggcagaggttccagtgagtcgagatggcaccgctgcactccagcctcggtgacagagcaagactccgtctccaaaaaaaaaaaaaagaaaaaatacaattttcacttcatctcttcttcctgccattgcttacctcctgaggaagccagaattggtggtaaaaggccaaaagagaagatggcaggaaaaggcagaatgtgaagcatatcattagaacaagcacgggtgtgtctcatcagtaaacttattgagcaattactatgtgcagggaactgtggaaacaaaagggttaagacacagcccttactctctatacgtactctctgattaaggagcgagatgcagaagaaaggcaaatctaatagaaagtgggagttaatgctggtcaagtgatacatacagtggaaatcaccatagaagctgggaagccaggatagagcttcagcctgtctgtagtggcaggtgcccaggctggacagggaaggggctgcggtatacctgtatgggcgccaaatgccagaatcaaccaggatacaggaatgggttcctttccatctgtctgttttgctccttcctgatctattctgaactcacagaaaatagctataggtctagtggggaaagttatatatctaattttgattttttttttttttgagacggagtcttgctctgttgcccaggctggagtgcaatggcgcgatcttggctctttgtaacttccacctcccgggttcaagcgattctcctgcctcagcctcctgagtagctgggattacaggcatgcaccaccacccccagctaattcttatatttttagtagagacggggtttcaccgtgttggccaggttggtctcgaactcctgacctcaagtgatctgcccaccctggcctcctaaagtgctgggattacaggtgtgagccaccatgcccagctagttttgaattgtttaaggccacccaaacatttaccttatgaagttataggatttggaataaatgttacaggagtaattctactttctcatcctgttcctcacctggaatgtcacataagtctaaacggagaaaaggacccgaagataaaggaacagctagaacaggaagtgcgagcataagaattcaaacccagggagctggcacaatgagtgccccgtgcccaggacaatggaggccacttgtgtctgcttggagccccaggcaagccatccacatttccatggcacaggggtgcagtcgatgagctgcattagtccttcgctgggctgtgtttctattagtggatcctctgaggctggtgctgtgcctgagatcattaagtcagatgcgctgaaactttgtcaaacaaaagtgcttagggcacagcctgaggctctgtctgcttctcaaggaattgcccatcagtctctgccaggcgtgggtgctcatcactgacacctgtgtctcttcacaaggggctgttgtagcaggagggatgaggttttttttgtttttgtttttgttttttttgttttgaagacagagtcttactctgtcacccaggctggagtgcagtggcttgatcttgactcactgcaacctccacctcctgggttcaagtgattctcctgcctcagcctcctgagtagctgggactacaggcacccgccaccacacccggctaattttttgtattttttttattttatgtatttatttgagatggagttttgctcttgtcactgaggctggaatgtagtggcatgacctcttctcgctgtaacctctgcccactgggttcaagcgattctcctgcctcagcctcccgagtagctgggattacaggtacccacgaccatgcccagctaatttttgtatgtgtagtagagacggggtttcaccatgttggccagactagtcgcaaatgcctgacctcgagtgatgtccctacctcagcctcccaaagtactgggattacagccatgagccaccatgccctgcctgaaagattagtttttattttatttattttttatttattttcttttttgagatggagtctgtctctgtcgcccaggctggagtgcagtttgcaatctcggctcactgcaacctccacctcccgggttcaagcgatcctcctgcctcagtctcctgagtagctgggattacaggcatgcatcaccacgcctggctatttctttttgtatttttagtagagacggggtttcgccatgttggccaggctggtctcgaactcctgacctcaagtgatccgcccacctcagcctcccaaagtgctaggattacaggcatgagccatcgcacctggcctgagggatgagtttttaaatgacttccatagctgtcattaggttctgtcagccactggaacacactgctttgttcttttcctcctgcttgtaaaacgccaaggctattgccaatgtagtatcttcagcaaaggaaggaggcagctgagtcaggagccggaagtacagaaagaagccacagctcatcatgcctgatgaagggaattcagagcagattcctaattttcaaaaattccatgctttggctcttcataatggaaaaatgcagaattataagtttaaactcaaatgggagaagcacctgtgaattaatattttgtgaaaaacaaaacaggaaacaatataatctacatactgcatgacgttttatgtgtgaagatgcacatagaagagaatattggccgggcgcagtggctcacacctgtaatcccagcactttgggaagtcaaggtgggaggatcacttaagctcagttcaagaccagcctgggcaacatggtgaaacatcgtctctatcctttttttagaataaaatttaatttaaaagaatattggggccaggcgtggtggctcatgcctataatcctaacactttgggaggccaaagtgggggtattgcttgagcgcagaagtttaagaccagcctgagtaacatagcaagaccctgtttctacaaaaaaaaatataaaaaattagcagggtgtagtggttcacacctatagtcccagctattcaggagactgagacgggaggatcgcttgagcttgggaggtcaaggctgcagtgagctatgatcataccattgcactctggcctgagcgacagagcaagactgtctcaaaatcaatagtggaatattggaaggaaatacatcaaaatattagctgtgggtaatgaaagtagggaatttttttcttttcttttttttttttagactgagtctcgctctgtcgcccaggcccaggctggagtgcagtggcaccaactcggctcactgcaacctccgcctcccgggttcacgccattctcctacctcagcctcctgagtagctgggactacaggtgcccgccagcacgcctggctaattttttgtatttttagtagagacgggggtttcaccgtgttagccaggatggtctcgatctcctgaccttgtgatccacctgccgcggcctcccaaagtgctgggattacaggcatgagccaccgcccctggccaggaagttttttctttgtttccaatgtttaagtttctgtcagtgaacatgcattatggctttctttttttttccactttttatttttttgagacggagtcttgctgtgtcacccaggctggagttcagtggcgcgatctcggctcactgcaacttccgcctctggggtgcaagagcgattctcctgcctcagcctcccaagtagctgggattacaggcgtgtgacaccacacccggctaattttttgtattttagtagagagggggtttcatcacgttggccaggctggtcttgaactcctggcctcaagagatccacccgcctcagcctcccaaagtgctgggattacaggagtgagccaccgtgcctggccacccactgtgttttaactcagaatagacagtgcacaggattgttgcaacgaaatcccagcgcccctgcgccgggtggaggagctgggcaggaggaggacttttccctctccctgagctcggtgatccccgtctctccgcaggaaaggccgagggggacggcaagatgcacatcaccctctgtgacttcatcgtgccctgggacaccctgagcaccacccagaagaagagcctgaaccacaggtaccagatgggctgcgagtgcaaggtaagcaggtcctgcctctgctggagcatcgcctcctcccagtgtctccagatggacggcagggattttgatccctggctttccaggacccgttaatccccggctcctgatctaagaccaggctctgggaaggtagagtcatcccaagagtaaggctgtctggctggggacagagcctttgacccctggtccctggagagccctgaggcacatctctgacaggggatgtctggaggccgggcgctgcggctcacgcctgtaatcccggcactttgggaggccgagataggtgggtcacttgaggtcgggagttggaaatcagcctcaccaacatggcgaaaccctgtctctacaaaaatacaaaaattagccaggtgaggtggtgcacgcctgtgatcccagcaacttgggaggatgaggcttaagaattgcttgaatgtgggaggtggaggttgcagtgagttgagatcacaccactgcaccccagcctgggttgacagagtgagactctgtcccaaaaaaaaaagagggagatgtctggaaggctaggagatttgagagtaagagcatgaattcagctctgttacctgtagcttccagaaaaaggagctgtatggggagagagaatatggtcccatggagaattttctacaaatgtgcaagtgcaaacgcctgtgtggcttatgagaaggcactgcaggccttacgctgtttccaacattcccgacattttcacacctgggttggtgtctatgtggggtctgtgtgttgagaatacctgaacacctgctcctcttaaaatgagcccggaggttgtgccaggcacagctggagcagtgcagcgcctagatgtggctgtggaaggtgagattaccgcctccagggctcccaggctggctcctaccctgtgggctcctagcaccctatccccaccctccctgcaggaagcatggctgagtgctgggcacctcccaccctgggtcactcccagtgagtctgggaccaggagactctggtgaggctgtggggattggccttccctggggagctgcctggggctgccctccctcctgacggcccccagccccttctccgcatgttcaaaacaggaattctgaactcatagtctccagccacacgtatgttaagcgaaactcctctgtgcccagcatgaaatcaaaagcaagtttttcctttttctttccacggtggtgaaggcggtcatcctcttgtagcctagggttccttggccaaattgctagttgccgatgacctcggggctcggcttgcgagcaacactgggctggaatctgtctccaggaaacccaggcccttttattgttgctgtgtcccccagagggcagggccaagctgaggccattctgtcatgctcaggaaggtagaagatggcccaaagggaagcacacctgcagtaggagggggggcagcggtgggcagggcacagcttccctgcaggttagaccccctcgcaggccagctgcctgcccctgcaggaaccgtgggtctcgggagaggctgccatccctgcacatgacaggtaggcacattgccgggttctggacatgcccccagagcagcctctgcccaccccttcctgggtccctgactccgtccccctccgtgtgcccctccccagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccacccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaa

SEQ ID NO: 3 - DNA, 71123 bp, Homo sapiens
aatgttcttaaattattcctgatttttttttaaccaagctgccaagaaaagaacgtattcccctcttagtcctattctaatttttatgtgagtgaatctaaactgctgaggaaaaccatatgtgattgttaaattatatatatctatatttttactccgcgcaaggcttattcttctacatccatagatgcttgagaagctctgtttttgtcattcatgtacattttcctttggaaaaagaaagcgcctattttactaaccaaagacttgatttttaccctcttcatttttattccctcctaaaaataagcccaattggatccaagtcaatgttttaagagatttttttaagagttgttttttctttcagagaccagaattccaaatcagaacaatttaaggtgataagctgcgatctttgagctagctataaataagacatttcaagcaagcaagcaaacaacttaaatttggggtagaggaaaaaaaaggcgtgagacatcaggttgtcattttttattgtgagattctgctcctaaagataataaatgggggattacgggtttggagtgctagtgcaaagcaatactgggaataaatctgcttttccagtcagattccatccacatctgcagcctccacaccatcaccaaaatgccacccccagccctgctgcttttataaataataacacagctgccaatggcagcagtgctgggtcagcttggctttttcctgctccagctacccataacattcaggatgagatcttggggtcagaaaaagcaaaaagtcagcaacaggaacagcaagaccccttagaaaagcagcagctttccccaagtccaggtcaggaagctggaatactgcctgaaacagagaaggcaaaatcagaagaaaatcaaggggacaattcttcggaaaatggcaatgggaaggagaaaataaggatcgaatctccagtgttgacagggtttgattatcaagaagccactgggctaggtacttcaacccaacccttgacatctagcgcatcgtctcttactggtttcagtaactggtcagcagcgatagcgccttcctcctctacaataatcaatgaagatgcaagtttctttcaccagggaggggtccctgctgcttcggctaataacggtgctctgttgtttcaaaatttcccccatcatgtcagccctggctttggaggcagcttctctcctcagatcgggcctctctcacagcaccacccacatcaccctcatttccagcatcatcacagccagcatcagcagcaaaggaggtctcctgccagtccccatcccccacccttcacacatagaaatgctgcttttaaccagctgcctcatttggcgaataatcttaacaaacccccctctccgtggagcagctaccagagtccgtcaccaacaccctcctcttcctggagcccgggcggtggtggatatggtggctggggaggttcccaaggccgagatcaccgcagagggctgaatggtggaataacgcccctgaactccatctcgcctttgaagaaaaattttgcaagcaatcatattcagctccagaagtatgctcgccccagctctgcctttgcacctaaatcctggatggaagatagcttgaacagggctgacaacatttttccttttccggtaagattatgttccattaatagattaggatgaataaggaaatagcatggtgtaatatctatgtaactagagtttgaagtgcccgtattcacatcagagcttttcttagagagaaaatgaatcaataaccagactttattttagcaggagtgtaattggaacaaaatattcagctgtttctttggcagttttctaaattgtagccttaatcttgtcatagataattatgaatacctggtagctggtgatgtagtaattattaactataatacctttcttgcctgacatgagaatcagggtcagttttttccctatttagatgagaataaataatatatagatataaatatatttcattgcagaaactattgaatgttttctgaagtaactatataactaaacaaatttcttttgacactataaggtagtgattcactgaaaaccagctattgaattacagttttctcactggttggttgcattttaaacctggaaactctctgaaccttgtaggtctgaacagcctgaattgatggacttggcaattcctcttaaacctctgcaaattttggcctacctttcatcagtaaggactatctagtgagagaaatgatctaaatgttttcttcatccccatttatttttgaacactgtgaaactgttcatctcagagtgactctttatgcctttcacccgtttgtttattttccaatgttaacattgaagatgtagataattaaaccattcctaaaaatagatccaggcaaagatcatttgtctttcttgctaccagaatatctttattctggcaagagtcattgatgtttttgaattaatgagcagcaagttaggttgatatgaactagataaagggaatttcataggtggttgaacgtcagatgctccactaaatgtatatactttgagggtatgattatatgtgtttaggaaatttataaggggtaagaatctagcattgaatctagttttcccaacaacctcacaagatgagttctgttattatccccattttacagatgcagaaattgaatatgagaaatatataataacttagccaagggtacacagctggtcagagtacaaattctaagttaaaaaaaaaaacaaacccaaggattgaaaatatgtatacatacatgtgtgcacgtacacatgtgctacagctagagggttactttagaaatatttctgcaaaggctgaaacagattatagaatcattgcactgttcccaaatacgatgttagccctagcagaattatctgttttaattagtaattgactgagagggaggggaagtttgctaagagaaccctatgtcattcctttcctaaggattcaggtgcagtgcatcttaaaatatgtgggtatatttagttttcgacttctaaaaacgatttttttttttttttgcctatcaaaaagctgttggcatttgctttaaagggtttcagttgttaaaaccaaagatcaattactgtgctttagtggtcaagtaaaaaggctgtttaagacattgacaatcccatgaagtctatttttaaaaagttgcctttgatattcctttgaacataaatttaaagaaaatttaatgcaaagataagttttatgaattattcttatattgctaatttaaaaattgtaagttaacattcagtacattttaactggattaagatttggctcagaactaaatacacctttttttcttattttgctactatatgctgacacagtgaatttatgtggcctcacagtttggttcccattctcagcttactgacttttgttaagattgctttaggaaaaatgaaaagttcagacaatgaataaaatatacatatatgcacattaatattttttcctattgggctaatagagtgtgtgttatgtgtgaaatctttttgaacagtttctttggagattaagttgatttatgaaataatagttagactaagattgatactaaaatatattgttagaaactaactcttcccttagaactgctgtcttttatattgattatgggaaaaggatggtcagtgtacctgactttcaaatatggtaagattcaaaagtaaattgttaattctgctcctcatccccaccatttgtagctctgtgtgtgtgtgtgtgtgtgtgtgtgtgtgtgtgtgtgtgagagagagagagagagagcacacgcacacatgtatgaggagagagctagcagtggggtgatttgaaagtcacaagagaaataaatgatttgaaaaaaatctctatgacaagaaactcctaattgggttttgaaaaagtctaaagaagtaagtaaactgaccactgtgattcttacttaaatggatacagttctttttgctttttaaaaaccaataattcttgtgaattagttatttttgagaaaaagtatcattttaagttggtataagtaacttggttaaatttgtcttatttaaatttataacttgcaggcacgtgcctgtaatcccagctacttgggaggctgaggcagaaggattgcatgagcccaggagtttgggaccaacttgggcaacatagtgagacccccgtctcaaaaaaaaataatttataacttaaacactattaattttaggaaagaaattttatagatattagcacttcaatttaattactattaaaataattcctttcttctgcaatatttctcacaggggaaaaaaaaagaataaaaagaattccttaggcgtgatagagagatcttgaaacttaccacagacattaaggatagtgcttacatgggtacattataataatggtattcaatcaaaggccagcacgttattgttatattgaaaggaaataatttacctgaagtgtaactgatattaggcaatgtttattttaatttgaaatgaaccagaatgatttttacgtttgtttactcaggtttgggtacatataatgaattaaaattaataaccttttaaattcataatcctcccccccaataactgataggggaagacattttatttggaggatttttgtatattaaaaggtgtttctaagttatttttgcttagcttaaagcttcattacatgaattcagagggcatcactcaaatcctgattttgtttgtttgtttcttttaagacagggtctcgctttgtcactcaggctggagtgcagtggcataatcacagctcactgcagccttgacctccctgggctcaagagatcctcctgcctcagcttccccagtagctgggactacaggcacatactactatgcccggctaatttttgtatttttttgtagagacagggtttcaccatgttgtccaggctggtttcaaactcctgggctcaaataatccactcgcagtgctgagattgcaggtgtgagccaccgtgcctgactgaaatcctgtttttagacacagctaaagtaatatgcatataataatagctaacatgtggcggggtgcggtagctgacgcctgtaatcccagcactttgggaggctgaagtgggcggatcacttgaggtcaagagttcaagaccagcttggccaacatggtgaaaccctgtctctactaaaaatacaaaaattagctgggcgtggtggtgggtgcctgtaatcccagctactccagaggctgaggcaggagaatcgcttgatcccaggaggtggaggttgcagtgagctgagatcatgccactgcaccctagcctgggggacagagtgagactccgactcaaaaaaaaaaaaaaaaaaatctaacatgcctcctgtgttctaaatgttttacatgtattgattcatttaattcactcaacaatcctatgaagcagaaattattattatttttattcacagacaagatttggctcttaatcattatactacagtgcctcttcacataatgataatatggcagggggatagtgggtgcaggtggggctggaagggagagtgcctcccagacgcatgtaagatgagaggaaaaaattttacagtgatacatgatgatcaaaggctgattgtagatagagtattgaaaggggaaaataattgagtatacttgtttatcaactttaaatgttaaacttagataatattttggtcaatgcttttgttttaaattttgagcacatgttatataccaggcactgggctaggtgctttcaaatatgttatttcacttcctatgtgggatttctcagccctgtgacatttggttttattgtcccaatttcaaaatgaaggtccatattcatgtgactacaggcatgattggacccttacagtaaggaaaaaaaaaatcctgtcttaccaaacatatcttagaattctgacatccaaagcagataatatattggggcacctgccaataattatatttgagtatagcatttctttggaggggtgcctggatcttctatccttacaggaaagtaaaggagaattacttagtatatgtgctgacaccctcttaactacagctcaattatgttgccgctttcattagctaagagtcaggtaggaaggaaaaagacaaaatcagtatgtcacaaagactatcctaaaacttgtttgatagggaaacaagtgtctagatcctcaaaattatatactgcatcttatatttgcaaacagaacactgctggagtgcttcagttctaaaagtcatggtggattattaaaattgtctaataggcaacctcattacattttcttgtttcttaatacagtatcgttccaagaaggatctttgcataggaaacattttctttgacttagaaggggagaaatcagttttttcaactgtaaattgtgggtcggatggttctagatctagcagaactgacatattggaaaaatcttcctctttgtagaaggctttttaactaggttagatagcttttctgatgaaattaaaactaattccagggtagagtttttttctttttctttttctatcttcagagaagccatcttcagagaagccatggaatatgatcagcacattgttccaacacctttcaggaaaaacctgtttatcgcaagcctaataaatgtggttgttgctggttgcaactagaaagatgctacttagctcatgagtttaagtttttgaaagtcatcgttgttggtgttcataagaaagaaatggggaacctagtttttaaattaacatatgcctaggtttgaatttgacagtttcagtttattttccttatgactttctctattttgctaggaggaaaataagcttgataattcgctgtcatattttttcagcgctgtattgtacctcagtttttggtctcatctcacataagataatgtgaataatgtgcttctctttaaggcagagagcctataatgtgagcattttaactttttgtgacaaaattcattttattttatgtttaattgttcaaagttgccttgcagaaattaaaagtatgttttaccatgataaatttagagcaatatattttttaaaattcaaatttattggagattcccatccattttttctcaccgcattttatcttattgaaacagaatgagttccacctttaagttttcaaaaaatacttagtagatagaaagataaagttgttgatactattttcaatcagtttctgaaggtgaaaagtgaacaattattgagaaaggctattttgtgagcccaaaaatgtagagtgaagcataggctgtggactcagacttaagtttgactctgaatttgaatgtaattatttactatatgaagctgttgtaaaaataaataaaatgcatatataaagctttaaaaattttgtctctaaactctaatgagcagtgtgaccttgagtaaatcttttaaattccagaagaaaataccgtatcaagaaaataataactggccgggcatggtgggtcacacctgtgatcctagtactttgggaggccgaggtggacggatcacttgagcccaggaatttgagaccaggcctgggcaacatggtcagaccccatctctagaaaaaatacaaaacactttttctaaaatatgataatacctaacagtgaagggtaatgtgaggcaccttatgtatgtggccatattaggttgattaactttttaaatttaaaatatggctttcttatattgaataaagttatgaaattagttacaaatatagcttgtgttactgtgaaatattttagtcatgcttatcttgctatatatgctttattgaataagctatagatgcaaccccagacagataaaatatttagcagaattatcaattttctcgaagagaagttttctaattaaatataagcttaaactttcattagcattgacagcctgtttctttcaggattttgaaagattttggccacagttgttttattaagaactttagaacatgtgattgcttttgcatacattaaaggagactacattttaatggagaatttatgatttttcagtaagagatatgaaagggtgccatagatttgaattgagaatagtttggcttttatcctggaatcaagagtttttaaaaaatattttaatgtatttagcacacatttattggagcacctactatgttatggactaagcacaggactgtcataaaaaatgaatcagtaacatggtttgtaatgtatttttgacctgtgctaatctttgagtaagactgaacatgcatttttttctcttaaatattataaacaaattatcaactagcccaatagtttcattttaatctataaattgtttaatcattaaggcaaactaacattcaattttagctataacaaaaaattgtataaatggcatttccaaacttttttattaacgtagtcattaatgtgtttataaatatatgcttatatttggaaattttaaatttttagaaaattataatgtttttggaaaaatatttggaaagtgtaattatcaattataaatacacactcgtataagttaccgtatgtttatatataacatgtgctgatttacattctatgacaaaatggtaccacaaaaggcaaactttaacttggatagcagaattctggtcctgttacatgccaaagaaaaactccatcagctacctataggtgctcattcatgtttacaaatggaattattcaagttcaaagctttaagctgtacaagcgcattttatattgtaggttattttggttgggcaatttctatttgctaaagatttatcagatatattctaatcattttttagtagaccaaaactaagttataattagttcctcagtattatatattttaaatctatatttattttaaaataccatgtaacaatttaaataatagttcttccaggtattcttgaggaatgcatctagtcaataggatcatggtactagtcagtaaaatagttgctgccattttattgtctatgagaccttaaaaaaataaaaatataagaacgtgactcagaatattcacatactctgaaaaaatgttattagaaaactatctcagttaatggaagtcagatctgggttccagatatggctcggccattcattagctatgtgacctaggcaagctacagcaccttctgggtcctttattttctcatttcttttgtctggtatttttgaggataaaatgaaatatgtctaatatttggcttctagaagattctattgttttaagaaagcaactcatcaaacagaaatattaagtcaaagttttattcaaaatatagcacaatttcttaaaatctgaaaacccgtgtgtaactggtgtgtgataatttgaacttaattttattttttgagacaaggtctcattctgttgcccagactagagtgcagtagcgcgatcttggttcacagcaaccaccacctcctgggtttaagcaattctcgtgcctcagcctctccagtagctgggactacaggcatgtgccaccaggcccatctaatttttgtaccttttagttcaccatgttggccaggctggtctcgaactcttgacctcaggtgatccgctcgctttggcctccggaagtgctgggattataggcgtgagccaccgcacctggcctgaacttaattttaaataaataaaatacaattcctaaagtcactatacttaaataatggtgggactgaggctagatgacacactgattttcttgaacactgctgaaagtgaccaactggtgatattttttttctctcttggtaaagcaccccctgacccatgtcttcttaaatttttattatggaaaaatttaaatatattccatggtagacagaatagtctagtgaactcccatgtatgtgtcacctggcttcaacaattatcagctcctggacaatcttgtttcatctatacccttaatcctctctctccccatttgtattattttgaagcaattgcttcatatcatattatttcatctgtaaatggttcagtatgtgtctctagaggagtctttaagagaaaacattaaaatttttttcaagttgtttttttaaagaagggtagtgagaaactgaagcaaggcccacatttctgttgtacctgctcagtctgtttcactgctcaacctggtgccaatagtggtggaccactgttggcttcatcttctctttctgtaacatagaaaaataagagatccagttaaagcacccaaataccagctagtgattcgaaatttgggaggagagtataccgttttcctcccttcatcttatcctttctctaggttcacacttctgtggacttgtgggcaagacctctgaaaggaaagatgagtgagagaacaggacaggactgagcttttatggttgctgtcttttttgtttttctgttttttaagaggaatgtagaggtttggggtcccttgcagacttttagactgcatcaactttttacatttcttgcttgctttcagtgcacaaatgtttgatgcttttgaagggccatgggctgaggatgcttagctatggcaaacgtgatacttctgctcctgaagtgcactggccagtgacctcctctttgtgcttgagtgttgaggagtgccttctgcccaggagattctggagaactgtggatgggggtcggggggtgttgtgagagtctggaaatgtggaggctgggcacaagctgccttttgagatcactgtcaaggctcacagaagagatgtcgagggttacaagacataagcttcagtttaggaataaaggttgtgcattggccaggtgtggtggctcacgcctgtaatcccagcactgcgagaggctgaggtgggcggatcacctgaggtcgggagttcgagaccagcctgaccaatatggagaaaccccatctctactaaaaatacaaaattagcctggtgtggtggcgggcgcctgtagtcccagctattctggaggctgaggcagaataatcacttgaacccaggaggcagaggttgcagtgagccgagatcgcgccattgcactccagcctggacaacaacagcggaactctgtctcaaaaaaaaaaaaagttgtacattagggtggacccctctccctgctgacgccggaccctgctcagacctagcagacatggagaacaggaactctaacagccagttgaggtctaaataacttcattcctcaaggctgagtgttagtattgtttacctgctttccttgaactaatgacttcttgccctgaatagtttattagggagaagtcttatactgatagttttggggtcataggtttgaacatattttgattatctctatgaaaacaggttatagaaaatagcacagaatcactgacttattcagatacaaccgatatctaatttaaaatgtgagtttcatgctttttttcattgcaccatagaaggggcagagaaatgtttattgaatgagttcactaaccgccatgctttgtgctcctgctgcccatataccttatctcactggcttttcactacagatttataagggaggtgctattatcctcgttttgctgatgaaattaaggttcaatgatattgcagcatcaagatcacttgcttagtatgtttgatacttagtatcacaagtatcaaagcttgtgatagattttaattatttctctctgctaggcaagattagtatgaacaaattgtcaagaagaagaaaaggtctattgattcaggaactgactgactaatcaagcctagaatggtcatttggttttttaatacaaataagtgatgacaagaaatgtttatcattttaaggatttataatgctcaaaatgaatgtgatttatttagtaaaggtgcaataaaaaatgttctcagaggctttctggagagatcttatttgtcaattaacatggcaaccaaatggagctgttgatccaaggtaatacactgaagacattcattcatttagttgtagatcataattctattagggaacatgtggtaacctaagatctgttagactctaccttcattacaggagctataatgaaaaagtactgattgaagagggaacttgcaaagaaatatgagatgctgttaaatgtggtccctcctgcttcagataattaccactttaactttaatctctgatgctcgttgtcttcattcaggccacgtatatatagtgaaggatttcatacctggcaggtaataatagagcaaaaattctaggcccaaacaaaacttcacttaaaccacttttcctgaacatctgctctgaagtcagactcgaccacttactgtgtgactttgtagggcaattagttaacttctcctagcttcatttgcctacgatggggaaaataaatgacagtactgacttcatatgatggttgtgaggaactaatatatgtaaatgttatgtaattcatgtaagatgcacaacacagagccaggaggaacatgttagccactttctatatcagtggcgatggctttacggcatgctacaagctgtggatatgaaaatgagtgaagctcatggcgcatggtgatagtataagctctgtcatacagagcttatcactatcttgtgggatgtcagagtgctagggagacataagggaaaagggatttgctgcctgtgtagggatgtgagggtcatttggaagtggaatcttgaaagttgactggatagtccactcttgatgatctgtgaatttacatattatttaattcaagaggaatatttacattttggcaaatcttgaattaaaactcccatagttacctttgattaattatgggctctactggcatctcaaaatttctatttattttggcagctgacacactggcgtacactttcctttcaaaccaaaatattttcccttcccttctttaccagggaaagtttaagccagaaagagaaacttctgtagcctggtacagatatgtagcagtctgagaaatgatgatcacagtaatatatgtttttatagaaatagaatgagtcaagggatagctgaattttggctttggttcttaataatgtggttacattcaattaattaccttttgtgttttagactcagtctagtaatgccaaaacatactagctcaagtataaaaagaagcaataatagagtggtggtggtggtggtgggtagcatgggttatatttagatgagaacatttaaactcagtacagtttttgcctgtgagcacataacctaactgtgaacaccccagcatccaagacaaaaatgtaacatgatgggtgatgtagatctcattctctaatgaaaataagcatacttttaaacaagagtgaaatatttttgagagaaatttgccttgcaggtttctaatcatggggcgttgacagacaatgaatttttccattgctgacaaattttacaagaaaattcatagatgtttaacaaacagcagttactaatattttctgcttattaaaatctgagatcatgctgttaagccataattctataaaagcaagtccaaagggaccagtatatactatgtattttctgatgatgtgacttgataaataggttgaatctgaaggaatgagtaattagcatatcctttgtttagactgtttatcttggcttgtagggcatttgaccagttgtgagagagagaagacatgtcagtagtaaatacctgaatggcagatattccatgtagctgaatgaaaaaaaaaaaaaaaagctatatgcttaagatatggggtatatggatgccagagatagtattttattgtgaaaattcaagcaccaaatttgtattttgtttgttcttaatggtgagccactcacctcttgatgctttttcttaaggaattttgttttggtgaaattgaactttattttaatctttccaaaggtatggaccttagaacttgaaagacagagctgtttcaggttttgagagcaaagcccttctcttcataaggaaatcatacagtagttcctgtagaatatttaagctggactgcatcatagctggccaactaggataaaagctataaagcacacccctaaggatctaatgaagttaacctgttgaatggatttgcttaactccgtggttctcaaagagtaatccctggtgtcatttggaaacttgtcagagatgggaattcttggacacgacccatgctgaatgagactgtggggatggacccagtaatctgtattttaacaagaactccaggtgattctgacgtactctcaagtatgagaaacgctggcttagatcagccatctggatgttaaaaaaaaatggccacaaatgattattttggtctgtggcataattacaatttggttgtttttcctgataggaacagaccagcaggttcacgtgctgcttgtggcagcttctggaatgtcatgaaaagccttgtcattagctatatactgatgtaggtcttcccattttgccctggcaggcagtattattcaggtgtatactaaaaacaagggtcctctctgaaacattcattttgttttgtcagaagcttatttttatcaactttgattttcatagtggtatcataaggtctttcttttagaaattgtcctgtgaagtagagatgacagaaactgaaactaaccagttactgacatgcaactcagtatattaaatataataattaagactacagaatatgatgaggtttaagcattgtgataaagtttgctttgcttagccttgaaaatcattggtgatcttttattttccttcatgattactaagctcacatgttctagagtcagaaggtctgggttcacattctgcctccacttacctaacattgatggaattatttaaatactcgaagcttcagtttcttcatctgtgaagtgggataataactgaacatatctaattgtatcagggttttgtgaagaataaatgaggttatgaatgtaacccataatgttagctgctgatagtaatcctattagtactgttactaccaccagtactcctgtggttagtagataacccagagatgcatttatgatgggtctctaatttgtatgccactctgtcatctcaatggggaaaaggaagataagatttctctttctcttcttatggttttagtacctctgatatatatcatttgtataggtaaaatataaaaggtaatatttgtataagtaaaatataagtaatatttgagtgcctactgtttgccaggcactagccagcatattcataccctcagaacccttagagtgcctcctttattcaaatgtatgtcttaattagtatggttctttgccatgatcattaccctacccaaggaaggatcacttacttggtttatagtaagacttgggtttgaatctgactatgccactaaactatgcagtaaccaatctgtgtagtaaattgtgtaagttttctttagtctcagtttttattattaaaataggagtaataggctgggtacagtagctcatgtctatagtcccagctacttgggaggccgaggccagaggatcactggagcccaggagtttgatgctgtggtgagctgtgattgtgccactgcactccaacttgggcaacagagtgagaccctgtctcagataataataataataataataataataataataataataataataaaaaaatgtaacttagaagatttgaggattaattaagacagtgtttatcaagtacctagaataatatcaggtgcttagtagatgctcaataaagggtaggtctgcttttctaatttctccctttagggtgccaagagaaactggcagtggggttgaaagcaaattgagttgtcagtatcttttgttttataagagattctttaataatctatctgaaagcagcacacttcactcttctgtcccccagcaaattttttaagtagattttttttgaaagaagcttattttatgttttatgtagcataattaaaatgccatgattgtctttttttttttgagatggagtctcgctctaacgccaggctggagtgcaatggtgtgatctcagctcactgcaaccccgcctcccaggttcaaacgattctcctgcctcagcctcccaagtagctggggttacaggcacctgccaccacgcccagctaatttttgtattttttcaccatgttgtgggcaggctggtctcgaactcctgaccttgtgatctgcccacctcggcctcccaaagtgctgggattacaggtgtgagccactgtacccagctgtgattgtccttttaagactctaagtgatcattttcttactaattgatcactgacccttgcctttttgtgggcaaaagtgatggactttgattagtgggcaaaagtggtggactttgattaataaattctcatccttatttttggttcctgccataattgtcataatttaaactgtaaatcttgaaagaacaagacatgttaggatatcaaaaagctagaatacaaatgtattttggagttaggacagggacatcagagatccaatcaaaccactccttttatggaccagaaaagaggtataaaggacgaaagtgcccaagctcataaaatacgacaggcagagttgaagcttcctagtgtctaatgcccattccactcatttatgctaatgttcatgttttggtcattagctcaagttcaatcaagaagagcatcacctaacaaggtttctattttacagttaatctttgggaaatggattctagaaaataggtcagtggttatatttgatccaattaacaatttaaaaaggcaaaattgaagaatgaaatatggaaatcaaagcactcttattcttttgatttgactctttcgttgttgcataggaaaaccagcattgtttgtactgttcttatactttgggtttgtttatctgtgtcccctttatctatttcctaatggtacagacacattttaggatttttttaaattagttgttaaaaatggacagaaaagatcagtgagggagtaaatcaagaatggcaatcttaaaacctgctctgagaacagaatgtttacttgacaaaatatgtggcttttgaactctttgaattaccaaagcatcataaacaaaatgtttgtagtaaactatacttgctaataagtttgggttgtggggaagaatacatattagactaggtttggcaagaatgaagtacttgtgtcatcggaccttataccttgcagcagtctgtggaggcagtttccttctgagtccctgtagagcctgagaatccttctcaaaacaccttgcatctaatagtaccaattgaacaaactttgtgtatttgtatttacttgtcatccctgtattaaactgtaacaaattataggaaaaaattagtatcattactaaaaattagtgtaaaaagggtggagaatttcttttcatttcataaaacattactgaaaatttaaaatttaatttaggattttagttttaatgtactttaccagttagaagtcagcaaaaatctttatgtttcccacaatatgcttggggtgcccatggggcagggtagtgggaggaaagtgtggaatagtttactaaattccattcataataccacatttaaaaacctataggttgccaggcatggtggcttacacctgtaatcccagcactttgggaggccaaggtgggcggatcacaaggtcaagagatcaagaccatcctggccaacatagtgaaaccccgtctatactaaaaatacaaaaattagtggggcgtgatggcacgcacctttagtcccagctactcaggaggctgaggcaggagagtcgcttgaacccgggaggcggaggttgcagtgagcctagatcacgctactgcactccagcctggcaacagagcgagactccgtctcaaaacaacaacaacaacaacaacaacaacaaaacctgtaggtagaaaaacaaaaacaaaaacttacaggtaaaaaggaggcttcttgacttactggaaatagttcttataaaacaaaccaaacaaaaccagtctatattttttatcaattgcttcttttcagtgctcttgtcattcagtgattgcaaaatgcatgttccggaaattcataaggttgcttactctgttagttgcatgaaaaacaacactaaacttaattcctcccctcccccaaaagaaaacatacagctctttagagggaaagggggaaatataaagacaaataaatcttaaggaagtagcagagaatattttaaatgtttaaaaattacatgaaggaatacatccattcattgatttagcaaacatttgcatgctttctacctgccaagacctatgtgaggcagagtaatacagaaatacaggacagtgcttcttaaccagttttacatcatgacacacatagaaaatgataatttttaaacggagatcatctgccaggaagctcctgccacctcaggctcttttggacagtcttgtgggcttaggacatgactgacttggcgcaccatcaccctgttgtggtaggcatactggaaatatttgatgtgagacatagttcctgctcttgggaagctcacagtcagaggacacagccaagtgaacagacaccaggaattattgcctccaagactggtttgtgttggagatggaaatggatggcccttttaaaggtgtggttcattgctgaaatagaacatatccagcaactatagaatgagatagtgtaattttatattaacttctaaacctcaaataatgcctcaagtctacttggcttctgaaagaatatgcaggttttgacttaatttagtgcttgaaatgaggaagtgtaaacacagaacagcttctctcttttgggaatactaaaccttagtctgatcctggccatgtatactcctgcctctctatagatagatcttgttcaggagatgaggataatgaggaaagaatccggtggaagaggtggggcaaagatgttctggagggagtcataccagtttagagcaggatagaatggtaaggcacgtgttcactcttccccatcctcatcctcaccctaaccttcccacccctgggggaaaacttgaaatactgtctcttacctgtaatattagattctacctaaatatactgtccctggactcctcaagttgcagtggtattataaaaccactcagcgcacattactgaatatctgcatgatgagatggggtcaggaggagtggtccctatttcagggaagcagaagaatcatgtggggtaagatgtgttacaaaagcacagaagagaaatgttaggtccatccaaaaaaaataaaaaataaaaatgctctcaagtggaggacatcctctgtcagcttagatgttctagaagttagctaggaaagtagaaaaatgaaggggatacaattaggaggtgatgttttaaaaaataaagtcaaagctttgaatttaaattgtaatgtaaaaggaaatataattgaatagaagttttagaattctgcttgcagattcctttgggatcccctttttctttaatattcttgcagtggcctttgtgtgtttatgtacagtatccttaaggtgggtcagagcatgtattattgctttgtctcagtttaattttaaaatgttttcatctcctactttcaatgtatcaagctaaaccttaattttagttgtctctagtactcttcatcctgaggaatgtcagagcacttgggatgttgtatattttaggattccatacccactcttgaaacgcacttggttaagctaggggtttaggtcagcaatgtaccccacactcttccttccctttaattttaatgcaacaaaatcaagcctaattttgcaagttgagagtaaataagaattgagattttgttttgttttgttttgttttgctttctcatctaaattctaactcttattctaactctgatccttttattctttatttaccagaagtaatgactgggttgtttggggacctaataacacgttgcattgggggcagggagggacagaacatgcttcagcagttctctattgctattctcatccttctccttagagaaagcctcgtgacagtaatgagagcagcttctgtgcttcattattccagatttatttttatgttgggggaagggagagtctacgaaattttttttttttacatgatttttggaaggaaggagattttttttcaactttctatatagattattagttttaaaaacaaatcttcagagaaggcaaatcattaacagtcaagaacaactttgataatatatagagatgaataaatcagtatttttattttcttaaaataagtatataatttatcttggctggatctggtggctcatgcctgtaatcccagcactttgggaggctaggcaggtggatcctttgaggtcgggagttcaagaccagcctggccaacatggtgaaaccccatctctactaaaaatacagaaaattagccgggtttggtggcgggtgcctgtaatcccagctactctggaggctgaggcacaagaattatttgaacccgggaggcagaggttgtagtgagctgagatcgcaccactgtactccagcctggaacagtgtgagactgtgtctcaaaaaaaaaaaaagatttctctcatttttttttttgtatgctttaccatttaatagtcttacaatcattcgatgactatttttaaactttgccttataagaaaatatagctattttgaacagcacatacaggtaccagtctagcagataactagtgggacaagtttggaaagctttgccacgtttttgcaatcttaagtgatgggaaagaattttttttttttacacttatgtaatgttcttaactaatacagaaattcgttttaatggttttggctttctgaataaatgtgatgcttttgttgaaattattgttagaagtcaaatcactctttgctgagccctgtgtacttacttttgtggtttttgatgtttggtgttaataataacatttagtaataatgtgccttacatagagagtaaaattgctactttgtgatctgtgtcccatctaatgaaacttactgtcctcttttatatttaaatgctattttaaaaagtggtttgtggctgtttgtgtctacaggatcgccccaggacattcgacatgcactcactggagagttcactcattgacataatgagagctgaaaatgataccattaaaggtaagtttagaaatatacccaattgatttcagacaatagttttaaatgtgtattaactatttaatctgatacacagtatggcaaatattatggagtcactttgtatgcagtaagttctatcaattttacacatatacctcttgttgttaaaaaatccaacatacttgatgaacctctatagtggagccatcgtgataccaggtaagagtactacgtgagtactaattgccaagaatgggcaattatctcaaagacaccaactacataccttattattattttttttatatctcaggcaataacttctcagtgtcttagttgtttatgtctacctacttatgacagtgattatgtcccaggaacagttcacatgttggtagaatttttgcctactttcatgttttaaaaaataaccaatagtttcaaagttaaaatgaagttctgtagttctcagaatttttttctatgtattatgttaaaaaaaaatactgtttctacatggattctagtctcatgttactgacaagttgtgttatcttgaataagacattctgtttgactaggcctcaatttcttcacctttataaagacgtagaattacccgggtgctttaaaaataaaatgtagatgtctggaccccattccatacatggggtgcgggcttgcatgtttttatttttttttgagacggagtcttgccctgtcgccaggctggagtgcagtggcgtgatcactgcaagctccgcctcccaggctcacgccattctcctgcctcagcctcccgagtagctgggactacaggcgcccactaccacgcccggctcattttttgtatttttagtagagacggggtttcaccgtgttagccaggatggtctcgatctcctgacctaatgatctgcccgcctcggcctcccaaagttattttttaatatctcaggtgatgctaacatgtagccaagaatgaaaattgcaagactagatatttcctaagggcctttcctctgattttgggaaaagtatctcacaaaataaaacatttttctggataaaaatatcagtttattagaaagcaggtttttttttttttttttttttttaagaaacttagaatgtttggtatatttggtcatcccacttaagctgttggctccttcattcattcattcattcattcattcattcagtgattcaatgtttatgacactgctttgtgccagacatagagctttgcactgaggtcaaaggtgacaaggcagcctgttgtttcaactggtgacctgcttagcctagtttccctttgagtttggcttatcatgttactgatgcagaaaaacattttatgtatttttcagtagaccaatagtgataatattgttttaatgaagaaagcttttaggtttctggagagagggaagaaaaataatgtgtaaaaaataggcatccatctgatgtgatacctttgaaataagaatatttggaaggtctttactgagtttctcatggaattctggtggatgactttagtgtagatgcatgctatatagctgtggaaagatgatctcccactcagaattggctttatttttgctactttttagcactctgactttgggtagtcttcagcctcttggaccctttgttttctcttcagaaaaatgaagagtctaaggtgctatttctagcaccagaaaaattgtacactcttaaaaaatagctaaaggaaaaatatgaataaggtctgtgggttgtaccaatgtcaatttcctggttttgtattatagttatgtaaaatgttgccatttgagaacactggataaagggtacatgaggctttctctgtactacttttgcaacttgctgtgaatctataattagcactttgggaggtaaaggagggagaatcacttgagcccaggagtttgagaccagcctgggcaacatggcaagaccctgtctctatataataaagtaatttgaaaaagaaaaaaacacagaccctgtctttatataataaaataattttttttttttttttaaaaagttaaggtctggtgcggtggctcacgcttataatcccagcactttgggaggctgaggtagaggatggctggagcccaggagttcaagaccagtctgggcaagatggtgagacctggtctctacaaacatttaaaaaaaaaaaaaattagccaggcatagcaacccacacctatgttcccagttacatgggacgctgaggcaggaagatcacttgggcccagaaggttgaggctgcagtgagctgtgttcctgctctttaagaccctgtctcaaaaaaaaaaaaaaaaaaaagtatggaaaaagtagttaaagaacatttgtatattcttaatgtgtttaattctttcagcacattttaaaagagcttcccatacactaggtactacagataataagtaattagaaatcattttctaagtgcctatggtttttatcacagaaaatataggttacaaacagcagtggatagaaacaacttgttatgtgacattttaagaagcaagcctctaactaatacttaggttagataaaagagttggcacacattattcttttttttttttttttgagacaagagtcttgctctgttgcacaggctggagtgcagtggcacgatctcagctcactgcaacctttgcctcctgggttcaagcaattctcctgtctcagcctcccaagcagctgggactacaggcgcctgccaccacgcctggctaatttttgtatttttagtagagatggggtttcaccttgttggttgggctggtcttgaactcctagcttcaggtgatccacccaccttggcctcccaaagtgctgggattacaggcgtgagccactgcacctggccagcacacagtattctgatacgattaacaatagaatttccttggccatcagttttagccaggacatctctatcagatttttttcttctaatttgctcaacggataattgtttaaagttctgcctttattctatattctctttttaagttctccttaccaatttttactaaattaagtttctttaagctgatattatagggataatcaaaagttaggtctgatgacaaaataaattaagtctgattgatctaatctgggaacatacagattttgtaaaatagtgatttatagactgcaacgtgatggaatagaaagacagtggcttttggaatcagatctggttaaacggccactctgtcactacagtctgtggtggctgtgaggatgacataatatgatgcagctatagatttcagcgtattgcctaattcatagaagacactaaagaaattacatgtattattactaaacatgtaagtctgctttcatgctcatcaaaaaagccagcttcagtttaagtttaggtgccaatctggcttgagtatattacaggaagcttgtgtgttttttcctacaaagagcagtaaagaattcacagatgagtgcatggatctaaaatgccagattatagttacgcttgttttctttttcaaacaagaccatgacctttgtatcattgtagcctatcactgccaagacattgtttttgctcagggtaacattttatttcttgtcaaactatcttctgatttagatagctattttaggaatactatgcttgattttaacagtggttcattctattgtgaaattttgtttaaaggtaataaagataataaaatttgaataacttaaaaaaacacattgtcattttgaaataggtatctaacacctaccaattcattttgaaaataaataaataaaatactcttctagtgctctgcttccttagaaacagaaaatagaaaattgacattagccaggtgtggtagctcacacctgtaaccctagcactttgggagggccaggtgggtgcatcacctgaggtcaggagttcgagaccagcctggccaacatggtgaaaccccatctctactaaaaacagaaaaattatccgggcgtggtagtgtgcacctgtagtcccagttactccagagggtgaggcaggagaattgcttgaacctggcaggcggaggttgcaatgagccgagatcgggccactgcactccagcctgggcaacagaagagagagactccgtcacaaaaaggaaagagaagaaaattcgtgttaattctgagattagtagagaacagtataccactcagaaaaaaaaattaaaagatttgattgttttagactttacaattcaaagacaactttaataatcttaaaaataatttcataaaaaattatgaatgacctcatttatttttctctttcatttctggttcctcataggtatgcagtttgtgtgtgtatgtgtttaatacggcctaaaattgctacgggaactaccagttgaatctattggtgtggctattattaacttaaattttcaaaagagctagaaaacttaatttgtatttttcattttggaacaaaaaaattcccttactgtaatgcggttaaaaaactttatttttactatcaacaaaatgcttaatagtcctaggaacgttcaagtacagtttttgaatttctttatgaatgtgttattgattccaactggtttgttggaaaacttatttttttttaaacaaatgttcaaaggagtacatagctttcataattcgtattaggtttttttataacttatttttaattgcttttctaagaattttgaggctactatgattttttctatgtacagggatttagctctttgtgcggtggggaaagggttctcctcattccttatctccctgtcctttctctggtcagctggcaagtctggatgttatttttatccgcgaaattgtgtattgccttctccataaccaacaccagtgacaatcctcagaagctcttccccagagaccgaattcattttctttgctgcacactcagtctcataagcttagagcctgagctacaggctgattttgaattttgatctcccaggtggcagcttgtgcattgctacaatattattaggcttatcaagtttttcttcacctggacagaaaactattttattgctgtagatgcctagatgattatttggggaatattgtatcttattgttatgcatgttttttctcgcttatgaaattggtacttgttacttagaaatggagcagcatgaaatagattaaaaccacatgcgagtacatctgttttcagccttctgaagcataggttggacacagtgaaataaagattcatgagttagtattatattcagtgtatagagagacctctgaaaattagggagcctttttttcttttctgtatgtgaagggaataaagagacaaaaatagtgcttaaaaattagacgtcagacagaatataacaatccacagtttcatgatagtggttgagtattttaaattcaatatatgaaaacaatataatattcaatttgcttcatttcactagaaagccaaaatgagacagcaaaattattgagagaacaaaggcaatctacagactgtcaaaacattatagttgttcttcagatatgaaattatgacttagatatcatattattcctttgaatagtgtgaaaatggagtctttttctcttcatattgttgtagaatatatgttgctttcagatttttgaaagaaaggctcaacatatccaccacaattcctctgagtttcaggcatttcaagtacttaatttgaatgtaagcaataatgattgcattcagaaatgcaagttgtttaaagtgccagtcttttacatatccccatggtgcccaggaaacctattgcatatgtagaggaagtagtggaagcatgttatacatcactgcctcacgtgtttcatgcatcgctttattttaagagctatggatctactccaaaaatgctatgtatttaattcctgactgccaaaggtgttgtgaccttgcattttaaaacactttcatattttttcttgctttatctacgtgttaaatttagagacccttccctgactatttttcattgctgtaaatttgtttgaaacaaatgcttaaatgagtgggcaagtgatgattccatctgtgcttcttttctttgttgctaagcaaaagaatttataataacctttctagaagaaaatcatgaaactcaagttgaaagtttagtacacaaagcttgtttcatcagttttataaaagttttttttatatcattgtaagagagtggctgtggggattatttaaattctgtatctttacagttgggatagaatttagtgctacttaaaaatatgtaataaataataggaaaccttaacttttctttcgatacaccattttactaatattcctatattccaaattgcagtcacttagttgacttagagaacacatgttgtatactggtagagaggcattagaacaagtattttatacagatactgactctgtgcaggctgaaatagctctggaaacctgctatgagagttgctaaattttgtcacttatttatttcatatgttataaatttgaagtaatttgggaataaataattttttttcaaaatgaaaggaagtcctactaaaataggttctgttgctttaatattagaatgatttatttcaggtaggaatggtggggagagtatataatttcttacagtatttaacctttttctatttaaattggtttgcctgtggcaaaataagaacagattactggtaccctaacctccaacctttttaaaggattagatggacattttcctttaagggacatttaatggggcagattcaaagtaccataaagaagaagtggataggctgggcgtggtggctcacgcctgtaatcccagggctttgggaggccaaggtgggtggatcaccaggagttcaagaccagcctggccaacatggtgaaacccgtctctactaaaaatgtaaaaattagcagggcgcggtagcgggcgcctgtaatcccagctacttgggaggctgaggcaggagaaccgcttgaacctggcaggcggaggttgcagtgagccaagatcaagccattgcactccagcctgggcgacaagactgaaactccatctcaaagaaataaaaaagaagaagaaatggataacgcaaaccagttaattttactcggatttataatcaaatttctccttccaagtaaattattagtgtgtggtatcaaatgtgtctggcgaattgagggatctttaaatatcattaagtctttaagactcagagtcggccggcagctgcctgcgtgtctggctgaagccttcctgaactaggctggctctttcttgctcggtttggatgataccaagtaattcaaagtagcgtaacaggggagtgacttaagtctcctaagaattagaaagttgccttaattctcaaagcctcataagtaatggaggacgttaaatagcaaagagtataatttaaactgggctacaattaaatgtgtgtgtggctatgtaggaatgaagcgtgtttcttctcctcctgtactctccctctcttgactgcggaaatggaacatcctaaacagtctttctcttgccttggcttagctgtgctgtaggatgggacctgggcttctgtgttgaggtaacttctattgtgaggaagaagagggcgaaattgtgtggcatgatttttttgtatgaaaagtgaagggcctattcttaattttgaacaactgcctgctttctgatttacttttgatccggatttgttggattcctcactgtactgtgtaggttgagcttacaaaggtgtggattttgagcagtgcgattaccccctttcagatttggggttgctgttgtttttgtctttgggtttttataaggcggggagggtaaggggaaatgcctaggaaagaaaatcatgtgatgtatgtgaatgccgacatcgtcataggatcggactgaagcctttctccctctagcctctgaatggaaaccaactcagttcaaactaaatgcatcttgtgcatgggccagatcctcatctgccccgtttacttacataacacatactagtcaatcgaaaatagtgatcctctgccctctacctgccacacattcgtgattgaatatttaacccttgtttttatttggtctgaaaatcaaataagcagttgccacaaagggggaatttgtcttatgtcatccatgatgtgggtccgtaattacttaagcagcccctttatcttaatcctgaacattgaacacaaggaatcctattttgaggccatgaaaatcggttatcgttttattctttgttacctgagtgagaggtgagggtaacggtgggcgagtagatgggggaagtattataatagtaaacttttaatgttattagaaggttaaacatacatttaaaagatttttttaatacataattttttcttttcagttgtagtaaagttcccttataatatggttattatgacttaatattgtttgacatacattcagggcagggatttaactatgtgtggtagataaaaacttagagataaataagaaaacaagcaacaatcaggtaacaaattaacaagtacttttctttaatgttttgctttgtcatattaagttttgtgtacaatttaagcttatgttttaccatctggacaggcaaaaatagtaatctccactcagaaatgaaatcagaatgacaattaagtagtaagattttcagactttgtccacagtttgtcaatgataaatattagggaccttcctactgtaaaaaagagaaggggccccacaatatttatggggatacatgtcattcatgtgccacatctaaattaatagagtgtattgtgcacctttaatagtgtcacttggtttttctgttttccttctataataaaattctatagaggtgactcttgctgtctcatttcctggcagctacaaaaacagcccaaatatctgcttaataaaaaagccctttgttgtctatgaaggtcttaaggctttccttgatcttgttatataatccatgacgatgttatttgctgactttgggggaggggaagaaatgccacctgattcatagttgtcataaaaatatccaagattctctgcatttagtttagcaacaggaacgagggaacagttcacaattgtgccacagaattattacttcccaaaactcctgcatggactttctacctgaatgttgtatgcagttgattcatttatcaactgtatgtgcctggattgtgaatttcttgtttttccccctcacattaccattatccttactaccaaaactaaaaaggaggagagagaaaattctctgaaattgttcttgcttagccctgtacaattagccatacaatttgtaaaaggaatactttttaagaaggtttaaactagtcactacttttcaaatcagacattgagatggtcaggctgcctctgggcttcattattttatctaattgactgattctgaattcagtcctacaccactgcactcagttctaaaagcaaggctttgttttattctgggtattacctggtaaccagtcaattaagaacattagtggaactctgaagggaaagcacttccataatctctttggaatccagttgggttgatgccagttgctgtgtattggaaaagagaaggaggaatcaaccaattagagcccccttttagtgcttgagaaaccaacaataaagagcaagtcttaattctgaagagcagccctgattaattgaaatataaataacttttaaaaatctaacttctgctggctataatattccaaataataaatgtctggcatggttgactaaatagaggtatttaaaccagctgcctgatttctttattgtaatgatcggaagttgttagcatataacagacttttccaaatgttacgaaataaaaggagaagtgttcagggttgtgttcaaacctggtttggccactagtagtgccttagattggtcacttctctctagacctcaatttcctcacctgtaaacggaggggttgaacttaatgatctttacattaccatcagcaattcagtcttacattacaaaactggaggtacagttttatattttaaaactgaaggtttttatggtgtaatgactgaaagtagcccatgaatatcatgtgattctgggtgtggcagtatttcatatggagtagtttgtataagggctataatcagagatcagatttagtcggttgagtgaaggctttgggtctaaactacatcttttctttttgagataggcctaaaaatattatgtttagaaaacagttgtttaaacttggcctcgtgaaatgtttttgttctccatttgtgaaccatgggcctcttcagccatgggaattatttgatagagcctgtgaacccattagtgaccaggcattccagttagatgatagatgtcacttgtgtatgcatgattatcttccaaaagcatgtggatgctgatgtaatgcaattaaaatacatttaaaggtgttgctgagttcatagtagccttctgatattaagatttttttttgtttttgttctgttttacttagggtagagacaggggtaggagtcttcagttattattatggaggaaagcctctctgaaatattttgatcaaagtaggtcttaatagttattacaacagattatgaaatactgctctagagaacttccctaatttttctgctttatactcttgccattagaatgctccttgttacaaaaaagaacataacataaaaaaggaatttaacagaggaaatggtgaggaggaggacagggaggagtgaggaggctactgacgctctcctaaattgtcctctccaccaagtagcattttggagcttcctgacatctgaagccatctttattcctttgtagcagggttaagaatatgggctgctgaggctacatcctgcatgatgccagggggtagagggagccatctgacgagatgggtgcactccgtgttgtataacatggcagttcttgttaggagggggaggcaagtgctactaaagcctctttaagccacatggtttggaagtgtcttatattttagcttctgcttatactccacctccacaaatatttgaacatattcaatgtgccaggtagattgaaggatagttttgatgctgtgctgcatttttccttttcgaggtagacctggacattctgtatgggaagcagcattaaccagtttcaagtgaaagggtgcttacctctgataccatttctcttttattcagtgccccttctgagaattatttgtaacccagatccttacggtaacctgttatgtgagttttgtggtcttcattttacagttgaaaagaattggagatcccaaagatgcaacagcttctgtaaagtcactcagattcctggtacctacaagggtcaatataggaggaacacacagcttctggctcctggttcaatggcctgagtatttattgtgtagcctctgagaaggaaacaaacataagaaaatggaaacatttttgtctagtatgctttgacagagggtaggcattcaatttttttttctctttctctttctttctttcttttttgagacagggtctagctctgttgtccatcctggagtgcagtggcacaatcttggctcactgcagcctccgcctcctgggctcaaacgctcctcccacttcagcctcccaagtagctggaactacaggtgcctgccagtgcacctggctaatttctgtattttttgcagaaatggggctttgccatgttgcctaggctggtctcaaactcctgggctcaagcaattcacctgccttggcctcccaaagtgctgggattacagacatgagccatcatgcctggccaagatttcttaatttcaatttaggagatggtacaaaatttaaaaatctgtattttatcataatctatgaaagattcacacatcacagttggctggtttcatactgaagtgtgccttattgggagtggaaacttttccaagttgacttgttctcttccctgattctgattcaccagatttgccatgggacttaagcatgtgcattcttcatgtgattcagatacacttccttcgcttcccacccccaacttttgcgctgctttggatgtatatgtaaagtccagagctgtctgaggccattcatacaacaaatatacatcaggcatctactgtgcaccaggtactatggttgttgggatatatcagggactaactaaaaacaaaggttcctggcttcatgcagcttattttccaaataattaccagacatctttgaatatcctgtttattatttaatttagaagattaataagaggaaaagtaagaacccagagtattgataggagaaaataggtagtgggccttctgagaaataacaaaaggtgaaattcttatatcagatataaaatgcaagtccatttttcattaaggttcagaaaagttgtcagaattcatgttaagtaagtgactagagttaatgatagataggtctgtatgcagaaagccaactagtgactttgcagattgctttttggggtttggacttcagtaaacagttttaatgcaactttttatcagtgtagtagcattctattttataaaataatggttataaataagaaactcagtcttaattctctttagtttctgtagtcagagaaaagtctaattagatctcttgtggcttctctctcttatctctaaagttctcaatcatttacactgacttagcttgtggtccctagagatttcataagtttatcttggtgtttttttatgttcatgtcagcacagagagccatttgtcaaaattattttcaccttggggccagttctttattcattggttcttttaatatatgtctcttgtaacacatgcttcttttaagcaaactttttgcaaggtaggagaattttaatttactgccttggctttttttctggattgctttaattttttctactacttggtctgtttttccacttttctttccattatatttttttcacctttttttttccaactgactttggctggcttagcttggacaaaaactacacctagttttgccgagttttttagagcttaaaaaattgccattaatctctggtatcataacatcctcttaaggcaagttatcttgttgctctgtcctctaaatgtagcatctagagtcagaaggcttctggcaaggataaaaatagccttcctgcttgctggtttgttgttagctttactggcagtaggaaatcttttgaattccttaattgggtcagcttcttactagtttctctctggacattcccttctgcctgaaattcttagatgcttttagatcttgcagcttcgcacctgccccgagttgtagtcaaagcagtccttcccttctatgaaaccttcctccatctgtagaaacatattccattgacctctcccatcttacagataagtgttattttcttttgccactactacaatctgtttttcaatcatcatattacaattgaaacattaaatttggggttttggttcaaaatgaagatcctctctggttttattgaaaagaaaaattttaggttgaatttttgaagttttcattaaaattattatgtatctttgccagtttggctttgatgaaagtaaggggttaggttttgttcttttctctcttcctgagaagacttatatccctgtttttaaccaaggacactagcaaattctcatttttctgaagctgaaatatcccccagatttgcccctcccttttccaaggttccagtttggaactttttggccaaaataaatcctacttgtcctttctcttacaagtggaaaattgttggttatcttcggcttattactggggaagggaaaggaattaattttgttaagtacctactgcatattgagggattttttttggcattctgcaaacattatctcaagactgtctcacaacagctctgtgaagtcaatggaattatctctgttttcctgaggttcagcaaagctaaataatttgacttaggtcacaagatgataccggcttgactctacccattacactgcatcttccatggcagagagatcatcaactgctgactttgcttcattcattttccacagttgtttattgagcacctttctctgctccaggctctggggtagcacacccaaaatccataaagatctcattgccctacagcaagagattaaaacaagtaatgtaaatatggtgtaataagtgtaaagaatactggaaggagtacagagggttatctgaatcaaagcaaggatgatgtggggcagggaaggcttctcataagatgtgaggcctagcaggggaactgctgggacaaaagtgtggaggcttgagtggtaagacattgaggggcagagagagagaggagggccttctaggtagagggagttacccagaagttgaagttatgggccagcagttctgaatggctggagtgcctgatgtgggaagggaaatggcagtgtggagagttaggaaagccattaattcaaagatttttgtaagtactggcttttgagctgaaagccaaatttgtagcagagaagggttttgtttagcctaaactctgtgtgtttagtgaattttaagtggctctttgggaggggacaagactcttcagctgatatctgtctcagccagttccttctttgtgattttgcatgggaatgtctttgttggaagttggttgtagcacagatagataagggggtagaataagcttactgattttgatttggggagttatttttgtgtcaatacactaaattattaaaaattaaatttataccattaaattatagaacatattgaatgctgttttgttcatattgctatgtcttctgcatttgtgtaagtatataaagttggcattcaaaaccagtggatttattacacatttcttgagctttgctgtccgatgtccaggtccccacagcgccatcttgctgcaagtctcaagtggagtttgtaaaaacagaagatgtgcaggggtaggaggactacctcctttaaaatattacttatgacggtatagttttgatttacttagatgtgagctaaacaaaattagcaggagcagaggtaggagcagcacttctagttaggcaatcaacaactgcaaatgtatgtgtatgtatatatttgtgtgcattagaaatttttaatggtgctcactgaagactcctctgcaaacaccctgcttttctttggagtatccacatttttatagggtgaatcaatcaaaagttgatccttaaaaattttatgctacttgtcactttagagttattccctattatcattccttggcctgcaccatgttgtcaacattgttggcatgactgtgaaaaagaaaagcttatagatagcgtgaaatctaattgtgctgcagatacatttgatactttttggtgtttgtgtgtttgaaatggcagcatttatttttattatttcctgttgaattatcagtagtagtaatatctggattattctttagaaaataacttattttacctaattaatgaaagtaatacttatatatactgctaatgtaaaggaggatttcctctggtcttttctccttttattttttgacttggttactttagttagtgtcttaaaaggatatgatagtacatactgttctttttagcacctcctgcccccacctattctaagtcagtctgttggtaaatattggttcttccaactggcaaatgcttagcatagaattgcctagttgacgtatggatcttttctaggttgtaggatttggtagtgtagatccccagagtcacactgtatctgttgcctatatttggctaggttgagtcatgtcaccaaatatagcctatgccttcggcatgatgtatgccaggcttctggttccaaattctgcagctggcctccagagactactgcttttcctgtcataatgttccttaagattagggctgctgaccaggcagtattttttatatttataacaaaatcaataccaagagccttcaaagattgaattttgctcatcaaataggttcacatgctgaaatcctaatgccttccttctccctttagaaattaaattctgaatgtgcccaaacctggataatgattaaagatagatgagttcttggctgggcaccgtggctcatgcctgtaatcccagcactgtgggaggctgaggtggaggcatcacctgaggtcaggagttcgagatcagcctggccaacatggtgaaactctgtctctacaaaaatacaaaaaaaattacccgcgcatgatggcgggtgccagtaatcccagctactcgggaggctgaggtgggagaatcacttgaacctgggaggcggaggttgcagtgagccaagatcgtgccattgcactccagcctgggagacagagcgagactctgtctgaaaaaataaaataaaaaagatgagttctcaaaaacccaaccagacaaaacagcaggcaggtactgggttatattaatattcagacatctcaatttttattttattatactttacttatgaaatactggtgttttgagttcagtggaatgaactcatcaaatgctcacctggtacccaaacaggacactcaagatgcctaggtattaaaagctctaattccgaagggggctttaatgtaaaagaggtaagaaggttagccagaagctgaaatgattaggtaagaaagttagttgttgctttgtagctacaaataaaatttggtgagttcattaaaaagatgtttccagccaggcgcagtggctcaagcctgtaatcccagcacttcgggaggccgaggcaggaggatcacgaggtcaggagttgaagaccagcctagccgggtatggtgaaaccctgactctactaaaaatacaaaaattatctgtgtgtggtggtgctcgcctgtagtcccagctactcgggaggctgaggcagaagaatcgcttgaacccaggaagcagaggttgcagtaagctgagatcgcactactgcactccagcctgggtgacagagtgagactccatctaaaaaaaaaaaagatagatttgaaaaaatccttgagaaaacttatgcctacgcaaaagcctgcgtgcacatagatgtttatgacggctttattcataattgtcaaaacttggaaaaaccaagatacccttcagtaggtgaatatagattagtaaactgtgatccatccaaacaatggactattattaagcactaaaaagaaatgagcaatcaaaccatgaaaagatatggaggaaccttaaatgcatatgactaagtgaaagatggcaatctggaaggctgcatactttatgattccaactgtatgatagtctggaaaaggcaagtctgtgagacaataaaaaggtcaggggttgggggctggcgaagagggatgaatagggggagcacagaggatttttatggcagtgaaactactttgtatgataccataatgggtggatacatgtcattatacatttgtccaaacccacagaatgaataccaagagtgaaccctaatgtaaactgtgaactttgggtgtaacaaatgtataggttggtgcaaaagtagttgcagtttttgccatcaacctataccactctggtcgggatgttgataatggggtaagctatgcatatgtgggggcagggggatatcagaaatctctgtatcttcctctccattctgctgtgaacctaaaatgctctaaaaaaatgacgtttatatatttatttgtaagtatgcaaatatgcttatataaaagcacatatttatatatcaacataaaaatacatatatacgagacacacactcttcattgggaacatggagtgagggccactgtctcaggcatgggaggggattatcaactagctagccatggaatagaaaagctatagaaacttacaccaatatagcagagaggatattagaacagaaataaaggaaaaagtacgagagtgcaaaaaggttgtagataaccaaattcccatggcacttttaatggaagcttttggaggatttccagaaaggaaatgatatgtgttatccataatatgatggacaactctttagatattttagttgtggagagaatttacggaagagtagggcacacaagttagggaagcattatgaaagttaaaaaaagaaaacagtttcttaatgtcacttatgttaaaatttaagtagaaagaatagctgattgtttaacagaatgtcacaggtgtgtttgctactagagaccacaattgattctaacctgacaacaggaatcatatcacaaggccggatcaaaaaaattaaaaacaagtatcactttcagagttcaactgtgaactttgccagtgatttttcagtgtcgcattgtgtcttagctggagggtagaatgactgtaacttataaggccaagggacagggaaagtgttaaaggtcacctcctttggttgtgggaggtctcttcaggagatatgggaagagttaatctcataatagagttaagagaccgttttgttactgtcaagttgaaattttctctttaaaagatacccaaaacatgagtttgtgataaagtggaacttcatttgtgaaacttcattgtgaaaccagcctgtttagtaattgtcttttggattctcattgttcattatcctcccttagggctgggtgaggtggctcattcctgtaaacccggcacttgaagaggctgaggtgggaggattgcttgagcccaagagttcaagaccagcctgggtaacatagggagacccccatctctacataaaataaaaaattagccaggcatggtggcatgcattggtagtcccagtcacttgggagacttgaggtggtaggatcacttaagcctgggaggtcgaggctggagctgagatagcaccacactgcactccagcctgggcaacagagtgagaccctgtctcaaaaattaaaataataataataatagtccttccttggcatcaagtaaaagggattatggttcatatagaacagccttggtttctattgcaatgttagcattaaataattagaatatcttcttggagataataagacatttcctcttaatatttcaactaatgttatcaaatatttttgtctctatattgatttagtcattcttctgaaaatgttttatgataaatgaaagtgtgatagctcttattcatttactagagagttttagaagtataaaatctctatatatgttccattacagaaaatcagctgctacttttagttgtgattcagaaacagtactctgttcccacctcccaagtttttttttttttttgagacagagttttgtgcttgtctcccaggctggagagcagtggcgagatctcagctcactgcaacccctgcctcctggattcaagcaattctcctgcctcagcctccccagtagctgggttgattacaagcgtgcaccaccacgcctggctaatttttgtattttgtagagatggggtttcaccacattgaccaagctggtctcgaactcctgatctcaggcaatctgcccgcctcggcctctcaaagtgctggggttacaggcatgagccaccgcacttggccctccatcccccaagtttttaacagggtcatgttcttgctcgtagcatctcaagtctatccttttaaaaatacatacttgtgacaggccatagatccaggctttagttaaaaagtagcctagatagaattcagtagatttgggtgcttggctatgtacattagaagtaaagaatgaaaccaatttttaggaagaaattgaaatgtcaaaattaatttttacctttttttcttccatctccattcctacctccactccctacataggactaagctgaaatttaaatggaacgattaccaacttagtttcttttaaatcctttcatttggttttaaaattgtaggaaaattggcagccgggcgcagtggctcactcctgtaatcctagcactttgggaggccgagacaggtggatcacaaggtcaggagattgagaccatcctggctaacacagtgaaaccccgtccctactaaaaatacaaaaaaattagccaggcatggtagcgggcgcctgtagtcccagctacttgggaggctgaggcaggagaatgaggcgtgaacctgggagacggagcttgcagtgacccgagattgcgccactgcactccagccttggagacagagtgagactctgtctcaaaaaaaaaaaaaaaaaaaattgtaggaaaattataaagttcagagtttatccagacttcaagttttggatatggattaattaaagctgttggcaatagagaatagtttcctcttttcatgccatgagttcattactatggagactgtttcaaagaagcagcattttaaaacattgaagaccttaagttcctttctaaagagttgttaatatgtagctgttggattgatgggaccccatgttagctctggttcccagagtatttagtggaactagctagagtccttgctggcatcctggaaggcctgccccagccgcaagccattggagaacctctgtttatccgttattccttagcttttgagagtcatggttctgtggggtcagagttcagactgctgtttcctaaaggaatgtttgtagttccgagtcactttaaaagtcctgttctaaatcctgatttatagaaggtgggactatagtagagaactaacaaccaggtccccctatccattccttagatgaggaagacctgttgagggttcttcagtcattcttctcaaggtgggtgcagatggcatgtgggctttggagatgtaaaagtgttgcatgatgattcttattttataacttacagtatagaactaggtccatatgtgtactcagtaaggatttgtagtgtagataactcaacttacatgtaaaactcttccaaaacagaaatgtaattccttcaacatagagaaatcccagtgccattccccccgccatgcatttgtggctaccaatttggaagacagttcatccaacaaaaattttagtaccttcacaaattcttttttgaggggtatcttgggtgcccattttagtttcaaaagtagattttgacacacttcaaaattcagaggaaagtaacccagcatttagtgagtgcctactgtgccctgggcttttgatatttttcatcatatgtaagtttagtgaaatgttcttcttccctctgagaatatttccccaaacctgaaattaaacccattagcctgtctctacatgtaggcataagcctggcacttttcttatgaatcacataggagaatattactgccaattacatagtttcaaaagtaacaaaacactacacaaatgaagaaaaattttcacatttattggggcagaaatgtgaagattgtcataatgagttgctattacataatggtataaagaaaattaccttggatggaaatttgtaaattagaaggacctagttaaatatgagagatactttcttttcctactttcaaacttttcctttttgaatattgatgaacatgctgattgatatatcctctgattcaaataccttgcctatttgaaagcaagtcaattcagctctgttattgaataagtttaaaccatctatgaaaaaagtaaacttagtaacggccttcttttaccttcaggtcgtctaaactattcatatccaggatccgatagctctctgcttattaatggtaagtgataattgatttaccctagtgaagtgcacaaaactgatacagtagttgtgcttcagcagtggagaaatgacattagtttgttctgtaatgataactgtaagttgctattaaactatcagctattttaagaatgattcttttagctcacaattgtggcagaaacttttctttttaatatgagggccaactgattccctgtcctgaacttggtgacaatgagaatgaaaatcccataatgatacctaaagattggctttatctaatattagcttctgtagagtgacctttgaaatgtcaacataaaagccatttccacgtggctggaaaaatgttccaagaggaaaggataagcagagatctaaaaccagaaaaaggcagcctaaaaccacagtgcttgacattgcataggacaaggtcatttgctgtttgctgtctaacaaaaacaagaaacatgaagttttattggctttccagtgtcttcattagattctcctttcctgtgctaatgttctgttgagttctctttttatgcgcatagtgaagcaagctaagtttcaccaggaggagggaatatccactcacaagaattttagtgtctgtttttttagtatcatggtctaaaacaattgggtgaaatacagaggtcttgtttacttcttttctactaatttgctatggaatgtggatttcaaatttctgtgtgtagaaaatgtcttccatttgtcaaagctcattttaagtcccacgacctctaagaagtgttatggactaaatagctatattctcataattcccaaaacaaataaaaataaaaattcttccactccttgattttagtatgttgtgaatgaggagttaaaaattatttttataactggatctccttttgaaatcaatatgttgaaggattgttgagccaggagaagttagcaggagatttgatgtttgagaattgctgggtacatcagatcttctagagactaaatagtttataaaatcttacttggtcatcagatgtaggtcttttcatgctacagtgcgagaaataataccataatgtaatattctagcataaatatattaggccaaaaaccaaacccagtggcgacagtggcatcaggataaggagaacataagggatatatatatacatgcagaagagtttaccttttcctttggaactagttcaagtcagttccaagtactggaaattgtagtgaaccaagattggggatattactgtgtcatcttaggcaaagtgatcaactcttctttgtcccagtttccttatgaaggtgttcctgttggattagttgcctctggggcccatcttgttgagggttgtcgagaaaaataaactctctctagtgggttttccttaaagctaaattcacttaactaggaaaaaaaagccacctgtaatcccagcactttgggagactaaagcaggaggattccttgagtccaggaattcaacaccagcctcggcaacatggccaaaccttgtctctacaaaagatttttaaaaactagccaggtgtggtggcacatgcttgtagtcccaactacttgggaggctgaggtgggaggattgcttgggccgaggaggtcaagggtgcagtgagccatgattgcaccactgtactccagccacagtaacagagtgacaccctgcctcaaaaaaagaaaaaagtatactattatgagattgcctttccttttttcttcattactatcctttctttcataaataatttttaatgatcttacttgtcaataaaaaaataaaagtaactttttcccaaaatatttatgttttcaaattttactggtccatgaactttaagagaagactagatagtttttaatgttgtatacgtggaaattttgtttattataaaggcatactgacttgggttaacattgcctcaaactgaaagacatgaagataaaggacaaagagagatgtctttcttctaagaaacatctcttgctggctccccaagcaagacccgggagtgtggggtttacagttgccgtggtctcaggtctagtactgagcttcatggggccccaaaacttgattttgtcagatttgatgaaggattagttttttagtaaccaaccaactaggaccagatgccaatttattcatttataatgaagcataaaacttccaggtagaccagatgccagaggtgactactcgaccgacctattctctctccagtagcaatgtccagattagagcagaagattgcttgaaagtcgtgaaattaaaactaggtagggaggagaggtgttgagaattttttagtgaccttgatcaagatatgcacattgtccattctgtcagtcatgtttgtgaaatatcttctagagtggatcacatctgtagacaaattaacctcattcatgtattcattcttagtagctttgctctcactttagctcaggttttgggggtacctgtattgcaaatctggcataatgaattgtgcttagtgaagattaattaaagaatttacaggtactacccatcacatagggttgtggtgaagattcaatgtgtgtaaatcacttagcatagcacctggcacgtagtaagtcaaaataagagaattagaataagtaatatttttggttaggaattaatctcattcatgtattgattcttaatagctgaaaatatataagaaaaaaatacagaacaaaggattaatatgagtttgcaaaaattgttgaaagttgaacatgctttcattgtctgtcattaaggtagataatctaaaactatgcactttcaaatgcattcccttcatgtcttgtgtccatgcagccttttcttaaaactgaaaataaaagcctaatctattatgtcactttatagtcattgtttaattttaagactgaaaggtgctgtaaggagctattcttccttgtccactgtaatctattcaggcttttaaaaacctttaataaggtgattatatagccactctgctttgtttcaatgtaactttcagagctttttcttccaagttatctgttgaaagccgtttcttgttttgtttcgataaaaatgtagagcagctgtttattctctttctcacatgaacatttgaattttgactctctgatttttattttatgctttattttgaaattttcaagcaacctcaaagcttttagaaagaggtttaaatcctcaataaacagaaagaaaatcccctcaccagcctcttattggaaaaattataacaataattaaaagaaaaaagtcagagtcaccaaccagttttcagtggtttatattggactaatgttgtaatttgcctttacaaagataaatagggtgtattcatccatggatcaaattatttttttgccctgctcgatcatcaatttcctacagtttcatacaatgaccttcgtataccactcatgttaaaaggcagtgccaatataattcaacaatgattggtaattgtgttaagaatgttacaattcacactctagggaatttttcaatttattgctgtgttaatagttgtagagatttttttgaggggcaatcttggggacagttcttggattttcaatgtatttttaaaaccaaactatctaaagctactttttgggtgctctattagtttgctagggctgctataataagtaccactgactactggcttaaacagaaatttacttcctcagttctggaggctagaagtacaaaagcaaggtgttatcagggttcatttattttgaggcatctctctatggcttatagatagctgtgttgccacatggttttccatctgtgcatgtctgtgtcctgaactcttcttataaagacaccagtcatattggattagggaccacccaagtgacctcatttaaccttaattacctttttaaagaccctgtctccaaatatagtcacattctgaggtactggaggttaggacttcaacatatgaatttgggcaggagggtgggggtagggggtggccacataattcagcccataatagatgccttatactagtaaatttcatgtagtagggatatagttagaatgcccattttatggttatgagaagcaagcctaaaacttagtttcccagttaagtgagaagaagtgttaaacataggctagttacctcaaattcctctggagtatcttggcttagctctgagatagacattggattaaaagattagttttcctcttacccagcttgaaactttattttacctaagaaaccaccaccacctctgtataaaaatgcttgtgcattatactttttttttttttttctctaacctttcattctcctgctttagccctcaggattagctacttcaaaaatgaaccttgtggcaggagaaagttatagagcaaaaaaaacgtgttaagttttaacaactcatatatgtattttctttcctttgaggaagtgattagtaagagatctattaagggtagcacagaacaacatttctttccttttttttttttttttttttttgagatgaagtctgttctggactgatccagactccagtctgatccaggctggagtgcagtggctccatctcggctcactgtagcctccatctcccaggttcaagcaattgtcctgcctcaccctcccaagtagctgagattacaggcacctgccaccatgcccagctaatttttgtattcttagtagagatggggttttacaatgttggccaggctggtctcgaactcctgatctcaagtgatcggcctgcctcggccttccaaagtgctgggattacaggtgtgagtcacctcacccggcccaacatctcttaattatagttttttggaatgaaaagaggaagattgtttgcttgggagggggaagaaatctatcaaaaaggaaggtgtaatttactcaagagaaatgtagatgatgatcacttactgaaaatgtgtgtaatatggttctagttgctacaataataagcatgttgaaagatcccttcattgaaaagataatatgaaaacaaactgtaaactctaaagtgctctacaattgttaaccttaaaatgctaatgaaaagctgagaataattgttgaagatcatactcagaatatatgcatatgaatttacttttgggaaagggagattatttattgagtatgtgactgaccattacatatacacattgtgtttttcattattctctcatttgcttcccatttttataaataaagaaactgagggttagggacataaggaaactagagttgcattctctgctcttttctaaggtaggccttacaaataatagtgtctttatcatatcttaggaacattctttgaatgttgttgtaccaacaagctaatataagcataagccaatgtgataggaatttctaactataaagcaaatgtaaattaattttgtggcagtgagcctattaaattagggattaatttataaaatcatttaaaatggttctttgcatctttgttgaatcgtatgctttggtctttgtgatgattgtgtctgctttttggttctaccatctttattcttttgttcacagattaattccttttagcttcaagcctttgatttatatcttttcaactgatttactaatttggctaatttctacactcctctccccatatattttcttttagtcctcctggaaaagtcaggttgttttgttttgttttgtactgttttgagacggaatctcgctctgttgcccaggctggagtgcggtggtgcaatctcagctcactgcaatctttacctcccgggttgaagcaattctcctgccttagcctaccaagtagctgcgattacaggcatgtgccaccacacccagctaatttttatatttttagtatagacagggttttaccatattggccaggctggtctcgaactcctgacctcaaatgatctgcccacctcaacctcccaaagtgctggggttataggtgttagccaccatgcctagccaaaagaagccagttatctgataacatcttatcatctgagctacaccccccttttttttccagatagaattgctatttgtcttctcaccttggggcagagagaggtgcacagttggagagcctaaggtagatcagcgtaacccgaataggatccgttttttcattgtccactaaaacatagtaatatcttatccttcatggcctaaagtcctattcgtgacagaattgattaggtgctgtcatgtaggaaagtatgcttttgtatgaaagtaataatgtcatttgttcatttttaatattagtaccaaggagaaaaccaaaaagggttcattaacaaatatagcaatatagcatatgcaataataataaattcaaatggtacaaaaagggataaaacaagaagtgaatgccttctttcctctttctagaagtttctctctccaaaggttcttgtggttgtttctagaaaaaagtatttcatggccaggcgcaatggctcatgcttacaatcctagcacttggggaggcccaggtggatggatttcttgagcccaggagttgagaccagcctgggcaacatggcaaaaccccatctctataaaaataaaaataaaataaaaagtaaaaagattttatgcatagtcccacatatctatttatattttctttatttttaaatgtacacaataaggattctacaatacacacttagacactgcatgcaggccagcatcttagagagctttaggtacatgaacgtgagccacatttaaaaatgccacatgctcagttaatagggttgctcctttgaaatacgtacatacatacatacatacatacatacatacaaatgccacctactaggtgtttcttcttttgaatgtgtgggtactttgtttctttttgattattacaaatgttgcaacaaatgagaaaaaagtactttttatgggataaataatattttatttttataataaaatgtatggggagggagaaagtcaggggagccctgacaagtctttctgtaccttcttcgtaagtctggcattacagattaatggaacattttgctagagggaatttgattctgcatatagggctaataacaaggaaaggaagcatttgtaagcaatcctgtaaagacgttttagaaataaagtatatcaatagatctaatagcaggtatccagaagttataaaaatttatggccataatattttgagcctttttttttttttaacaatcttgaatcctgttagttctgaacattaaattattgaggactttataaatcaaaactaggctggacacggtggctcacgcctgtaatcctagcactttgggaggctgaagtgggcagattgcctgagctcgggggtttgagaccagcctgttcaacagggtaaaaccatgtctctaataaaatacaaaaaaaaaaaaaaaaagctggatgtggtggtgtatagtcccagcgagactgaggcaagaagaattgcttgaatctgggaggcagaggttgcagtgagctgagatcgtgccaccgcactccagcctgggcgagaatccatctccaaaaataaaaataaaataaatcaaaactaagaaataatacaagtggataaacatataaatcgtaatcatttaaactttggtggggactgggagatttttattcagtggcaagagcatgcatctaaacaatctttgaagagtctactttttggtaactgaaggaaacttctgagcagggttagtttggctgacttagaacttttccaaaatgtagatttctttgaacataattaaagtcattttttaacttacacttcctcggatatttgagaaacatcaaataacaggcaatacttgctagtcatgagattggaaatctgtctgacattttcctcaggaaagcagagaagttctatgttgcaagaatttcatcataaagtgtgtgccaatataatttgaaataagtgaggaaaagtgcttagtacatcttttttatgtaagataaagtggcgttatttagcattctattaatgtctgggttctggttacatagatctgttcaatttgtagaaaattcattgaacttatggtttatttttgtgtatatgtcatatgtcaaaatttacatgaaaaataatgtataagtattacaataagtggaaataaaaattacacattctcgttttgcatgttccagaatgtcattgtttttatttcttcaatattaatttacattaatttcctgatttgattgggcaacttttatagttgtaaacattattcacttataacctattttcccttaatatgagaaaatatctacatagctttcagaatttaatctcagaatttaaccatgaattattttatattgaccagtttaattttatagtatacaatcaaagtttgagagtgtacatttgaagatttcgagagtatttgattgtaacttttgatccacagcccttactattccggaaattatttatttttgatataatggaagccatgagagttttcatgttaattttgtagctatattataaaagcttattcttttcaaatatctgttttctcagaaatccaagcagcatcaatcaactttttaagattgacagcattaagattttcaaatcgttactttgtttccccagactccctaatctttgaagcagttgtatgaatagaatgttcgtaaacaagcatctgctttgtgatgctatttgtctttctaacctctgtctgattaagtcagaaaatacctacccctccccaaccccctaaacttaagacctattaaagtgaaagcacaagtgcttgagggagattgtatgttgtgtgaatccatttgctcaaatactttggtgaaatccagggctatctaagtgtggcagaaatgtattttggtttgagatataatttcactttggaagatactcacataatatttctgagttataattatttagcatttatctggaagaatgagaataaaaaccttgaccagtttgtgagtttgtatagtgatttcttaaaggagctataccttctaactcaaaaacctatcccaggctgtaaccctgggactttgggaggctgaggtgggcagatcacttgagatcaggagttcgagaccaatttggccaacatagtgaaaccccatctctgccaaaaaaaaaatacaaaaattagctggtcgtggtggcacacccctgtggtaccaggtactggggaggctgaggcacgagaatcgcttgaacccgggaggcggaggccgcagtgagctgagattgcaccactccagcctgggtgacagagctagattctgtctccaaaaagaaaaaacccatcccagtttactgttgaaacctcatccccagccaagtccccacttgttctacatgcttctgttcggccacctttccctgaatgctacagcagcacccctgcgtgtaacgctgttgagcctggaatgcccttcctctgtttttctgttaagggccacctcaaattccctacccccacccccaactttttcatcagagtcagttcttcctcctctattcctgttacacctaccacataactagtataacaataggcatgctacactgttgtttgcttatgtggccttctggcattaaaagctgctagttcctggaggtcagggacatgcactatttactatttatccacaagatcaggcattcaagaaatgttcgttggatagaattgaggtgtttggacaggctgggcttataagtgccagtttgtttcagggaagacattttctcaaaggttttctgatttaaagtttatactgtcatttcctgagtattccagtggattattaattacctttactttgccccttggctacaacctacttggcaataaaaataccaagccttttacttttcaacatttaggacttggtagaagacttgattaggcatagggaactgttggctaaaaggaagttgatgaattgcttaaagatttcatttgttatgattttctcttataagggattaactgaggaatactgtaaagttgttatttatcttctggtggtgaaaaagtcatgaattaaatattggtatatctactaaattgctagttagcagggaattctgagagaaaacgttattaatatggtaatagttggtttttattatgttgtatactgccttagtttcataatagtttgaaccttgggcaacaattacagcaaaaagcttcccataaaacaaataagattcaataaagttttacagtgtccttgaagaaattttaaaaatgcccaaaattgacctcttacctcccgttccttgtttttttagacatttaccaggaaatgaagaatatagtcacagtttttccattttcaaaagctggtagatgaaatcacagttgattcttttgacaatgtttgaaaggttgttttgtttttttgtttttgtttttttctcatttgacatgcagcaaggacatatgggcgaaggagaggtaacattgtttttaacttttaaatgtatcacttgtatttggagacgacccaagcttgtttaatttctaacctttgtggggaaggggagaggggaaatgaagcatagctttgatccttaggtaatttttgtgttacagttaacattttagacataatttgaaggagttaaggagctataaagaaatttagcagaatggtgggatttggatttgaatcaaaatgatttccctgtgttaaatgagaaactcagcttatttatatctaaagatgtgctttttttcctttctgaaaggaatttcttagaaaaaaattaagaatctttaaaaagaaaaatatagtgacactagtcccaaaatacctcattatcttggaggtttaattatgctcaaatgccttatgtcaacttttttcttttcttttttactaagtaaacaatacatgtggtttaaaatgagatgagctaaataaatgactaatcctataaatttcaaacatttgggggaaaagctctagaaattttaggtaattctaaagaatcatttcgtagaggtacctgaataacttattcttggcacctatattttgcctttttacgagaaagtaagacagttaaatagcttagatttaaaggataagtgatttttttaagatcattcatgaaataacctccagttttataatcagtttgtgtcttcacttgacatatgctattataggataaatttataaaaaatatactgttattatttgtgtttagtaatagaaattgaagacaagtgtggcaaaacctggaatgtttctattaaagtaagagcacttgagatacatttctagaagatccattaacaaattcctcatgtagtacctagaagtaaattggcagccagaaaagtgataaaacagtgcttgggagattgtgcagctatttgtagctctgtgttttccttatgatttaaaagtttatattttgctgtcaggtaaatatggaaagactgttacacatattggcatctctggtgtttcctgcatatatattctggacgataagattttcaaacagcaaatttaatgactagtttttagaaatagataatacccttagcaagctgataattacccagctaataataaatatatctttagcatgcctaataatcttaaatttcataagactacacaatgaagttggaatataacattaagtgggttttgattatatcccattagttaaggtaaataaaaatgagtggtcactttaaaaatctacttgttacgttagccagatgtcatggcatgtgtctgtagccccagctacttgggaggctgaggtgggagggtcacttgagcacaagagtttgaggctgcagtgagctatgattatgccactgtactccagcctgggtaaaagagcgagacactgtctcaaaaaaaaaaaaaaaaaaaattgacttgttcattttaagcacattcttagaggaaactgtgcaggctatattgtttgatttttttaaagaaatgtaagtgattcaatgtcttacagccaaatttaatattgagtgtacatgtctaggttgccaatagccatggggccctgccaagggagtacagtcttctgccgactgcttgttaaagtgtgctctctcctcctgtacttcagttcacctcactgaagtttctggatcccagtgggatacttgagtcgccttctattaatatttaactgtgtgctttctctctgactcagttgggactttaagttggtgggaattcaagagtatagctaagtgtttctattattcagtgagaaaaataaaagcagcagttttattgaatctgctgtttccttgtttctttgcatgataatcagtggcaaggaacattttctgttaccgttttttccctgctttctattccaggtcagtcttcactgtttccaatggaagatggattcttggatgatggccgtggggatcagcctcttcatagtggcctgggttcacctcactgcttcagtcaccagaatggggaaagagtggaacgatattctcgaaaggtgtttgtaggcggattgcctccagacattgatgaaggtatgtttagaactgtttatagcacggtgcccagatggtggcacatagtaggaaactcacagatagtgttacaataacagtcttatctggctccaatagtcagccctgcttgcattgttctcttgtcctatcctcctatcatggcatataagattaattcatagaagggaggggagcagagctgtgcaaaccaactaaagcaaggcattggactatatgaaaaggagtaaacatcactgggaaagcttccaagggacttgattattgtgggcatacatgggtactaactgcgtttttgtctgtgtgtgctactttggacaaattcattgatgtattttcctttttccccccacattttatgagtgctccacaaatgtatagttcattgtttaaaatcttagactaagcatgaacttttgaaaaatatagcctacagttgtactacaagaaggataatcttacttaaggtagtaaacaagatggaaggtccctgcttacatagagtttacattttattgggggaaggcccataaacaatgtataaatatgcaagaaaatactggagagcaagtgttgaaaagcacacagcaggatgatgtaaaatagtgatgcagggagtttctttttaattaggtggataagaaaagcctctttgaggaagtgatatttaagctgagacctgaataaggagccagccatgcaaagacttagagggacttgttcaggaatatgctattcatccgtgggtctgagtgaccccaataaaaatcaaagtagcagaccttatagcatatttttggttgctttcctaatttcttttgtcttcgtttcctgagtgaaaatggaaatacactaaatcacattatggagaatagaatagatttctttacacatgtataagatctaataaataataaggtttaatatcttcacatttagattgggatcagacttatcaagtcacttcattttcttcaagatgatttatcttttggaaggttgagacagaaatggttctaaaaagccaaagattgaaataaacatagaggtttttgctttttcttgttgtccacaataaaatgtcttggtggaagctatgctgaaatttcagggttctctgaatcaatctccatcctgccctcagcatagcttgaagaatattgtgttctgcagaattgtgcactaaaaattacagggtttatgggggaaaataaggttaaagacaaatcatttaaaagctaatgaactttgtacctgaagcactaacaagaagagaattagtaccttggagataacttggacaattcaggcaagtagctcagcatgcttggggctgcttcagggaatattgaaaatgtacaaaaccaataaagcagaaatgctggcttgcaagcatggagaaaatgcagatggaaacagacctttgaacacctgaggaagcgcaaactaaactgtcaggagataagagccctgcaaggttaggggcatagctctctgacaagagaattctggttgctgcacttatttttaattttcttacaatagagctgggagggtttgtacctgtacgtcagacaagtggggggctttttcctttcctgatgaagtttgtaattctttcctcactatgctagcttaccttgcctaggaaaaatcatttatgaaccagtacaacttccatgttatactgacattgttccctgtttactagactcacacaaactaaacttactctgctcacactacgtattccaaactggaatatcaccataatggtgcaataccatcctgtcctaccatgcgcatgttaacctttttcccccccaagataagggctcacatagtgagcccttatgatacctatgagaataggtatcgtagaagagcagactagactgtttcacagtctggggaagatgaaaacagctctgccagactggaatttaggcatactcctcatctttcttttctgttcctttaccctgccctattatcaggtcttatctacacatgcttacctactctttctagaagtctctttgaaatgtatttttccataatctcattagtgtccaaatgtataatgtagcataatttgtatcatttaaattgcaaaatgtggtcaggtcttccttgtctatcattttttcccattcatccctttttcctctccctctaaggctgagatattgctgtcaaggaagtggattggtgacagggaagaggtctcaagtggaggggatgtgtatgaatgtatgtagagggggcttgctcagaggcctgagcagcagtacgtatggtatccaagaaataagggcgagaagacccaaggcacaaaggtagaaggtagaggaggctataggggaaagattggttacattgagcaaattaataaatgtctttacaggtattgggagctaggtttctccctgcaaaaagagaatataaaaatagaaaggcggaaggctagaaaaacccatgaaatgttggagtcatattgaaaatatcaatatgaactcattagtttttgtaagtacatacacagatacagaaatagttataaatttgtgtttgggcgtgtatttctttatttcctagcttccttcactgtgaagacttagaaataatgaatactcactagcagtgagcatatagagcacctgtaacttagtttctaaataccttttgccactaaaatgatcagtacatcttgaaaaaaaatgactgattcttgggctgggacagggaaagaataagacgagcccggagtatcttcgtaggccagaaagcatgaaagtgcttaagaatggaggcaagaagtgcgaaggacatgggagcctcccacgcctaagggacacgcaggacaaaaattgtcccaaatcagggacaattttggggacaaattgagcatcaaaataaatgagtgaattggatcacaacccattgaataaaatagacccaaactgatatcaataaatgaataaatcaatgggacagatggaaaactcttctactgcacaatactaactaatatatgtagaaggaatgatggaaacagataatcattatttggcaaccattattgtggtagttaatacatgcaggagtcttcaatggatgccaaggctcatgaaggaacaggatattggtgagcaacacaatatactcttgtagaacgctaattgaatacaaaaggagaaaaggtttgcttgtggtagagaaaccaggcgatcaagattaacatgccctccaggtgtggtggtatgcacctgtaatcccagctacttgggaagttgaggcagcaggatcacttaagttcaagaacagcctgggcaacatagtgagcccttatcttgggggaaaaaagattaacatgctcatggtaggaaaggatggcattgcaccattatggtgatattccagtttggaatacgtcacatgattctgctcataggagggagagcacagacccaggttgagggtcactatcttaaatctgttcaggttgctataaaaaaataacagacttggtggcttataaacaactgaaatttatttctcaccattctggaggctgggaattccaagatcaaggtgccagcaaattcagtgtctggtgagggcctgcttcctaatagataataatcttcttattgtacactcacatggcagaaggagtgaagggtctctccagagcctcttttataagggcactaatcccattgaaaggattctacccccatgacctaatcacctaccaaaggccccagctccaaatacccttacattggggaataggtttcaacatatgaattttgagggaacataaacatttggaccgtagcagtcattctatagaatgaatatgaaagacaagaaagaacatggagctgttccaagttgaaaaaagactgatgctctgaggatatgataattaagtgcaacctatgttctggatagcactgtggatcagaaaggattttgaaatttaaatgaagtctgtgaatcgcatagtagtgttatatcaaaattgatatataagggagtgaccctgctttgagcagataccaatagttatgtttgggattacagggcaccatttcagaaaaagatgctggctggctggcttggttggatggctagattgatttgtgcatatgtacagatagagggagaaagaggaagagagaagaaagagggtgaaggcagatgtgcaaattattaacagttggggaatctagatgaaggggataaaggagttctttttactgttcttgtaaatagtagatttgaaacttaaaagaaaaactttcaaaaaatgatcataaaaatatttaaatctactgttttcctttgttgtttattagatgagatcacagctagttttcgtcgctttggccctctgattgtggattggcctcataaagctgagagcaaatcctattttcctcctaaaggtaattctcaagattcattatacttatgtaatttattcttacattgtttaatgtgtagccttttcataaatgttcaccttcactgtaaaatgttgcattgttaaacttgcattttcccaaatgctctttaaaatttcaacataatattcttttaattcaaatttaattttactctaaaagatgcttcaagatactaccaaaatgaactgtatgttgatgtcatcagacttttggtataaatattgttttaatttttttcctattcctttttcctttctttagttttgtgcatgattcctttcccctgaagaattaccaaaaaataggaaaacatgtaagccttctttcccccttttttccaggctatgcattcctgctgtttcaagatgaaagctctgtgcaggctctcattgatgcatgcattgaagaagatggaaaactctacctttgtgtatcaagtcccactatcaaggataagccagtaagtgtggtttagcataaaatagcttcttgtttttgcctccattcatctgttatatttgaaaaacccatagacaacttgatgtgtttggggtacttaattgacatgtttgtaagcagactaagtagtcttgttgtgaagttcttaacattgacattctgtgtatttgcacatctcaatttgacatcgaatttttggttagttgaaatataattggtaaatctttatttttaaaagatttcacggctgggcatggtggctcacacctgtaatcccagcactttgggaggccgaagcaggtggatcacatgaggtcaggagttcgagaccagcctggccaacatggtgaaatccagtctttactgaaaatacaaaaattagccaggcatggtggcgcacatctgtagtcccagctacttgggagactgaggcaggacaatcacctgaacccaggaggcggaggttgcagtgagcagagattgcaccattgcactccagcctgggtgaaaagtgagactctgtctcaaaataaaataaaataaaataaaataaaataaaaaaccagacttcatttgataatgcatttaataaaatagcagaatcaactctgaataacggaactcaaatcacaaatactatgtgtacgtctttctagcgttttcctcactttaatgaagattttacccaatattatccttaactttatatatggtactctccaaagtagactgaatcgtgtatatacatgtacaggtacattgcatactgttttttctttctggaaaagtttatcataaaatttagtctttaggaagaggagcaactggcatgttttgatgactctggcaaagcagcagtttattatcactcagccagcacccagtgaatgatgatagtgcagaatggagttgtcagtgggcccagcttaagcaaataacatctgtggagcttctcctgaagtcttgtggttgtctaggtcagaaactttcgaagagttcctgtggtctggactctttctgcttgacttgtttatgttccctgccaatccccatccgtatttgaatttgggacctctgacctaggactctgttggtgtgcatatttgggaatacactgctgtcaacccatagcctttggtgtgggcatttgtgacagttagaaaatgtgaacagttttaaatgaggtacatgattcttgattgacttatctaatggatacactgaagtatttgtcataaaaaaaaatctattgcaaatatcatcagtatttttactttgaaaaccattttgaaataatgcatcagatttgatagtatcaggagtagtttgcatttcctagacatacactgattggacacacaattcttgtttacttagtattgtatattgattggcattggataccatgctaaaaatttaaattatgtagatattgaggcattggacagactaaaggcccaaataagctgaaaaacagtgaattaacttacaaataattgtggacatgttaagtaatttggcttataatagacaatcaaattgaactttccaccttggtttagtttacttctaaaaatgaaacgatgggttgggatacactgtttttaaatcttctagtttcccagctttattgacttgtaatcataggattattgcttttaaaaatactttgtaataattgttaacttttttgcccatgaattgtctgtattgagaatgagacattttggtttgtacattccctaggtccagattcggccttggaatctcagtgacagtgactttgtgatggatggttcacagccacttgacccacgaaaaactatatttgttggtggtgttcctcgaccattacgagctggtatgattaaacaaacgacaaactctctaccctatagcgcaagaaatatgaagatcttcaggataaatttttcctaagaattggagttaatatccaagagtgagagttctagaatcaaaatatctgggtttgaattcatgtgttctaatagttaagtgaccttggacaaattccatgacttttctaattcccagtttccccatctgtcaagtagggatgaaaagcgtttcatccctaggatgaaataacaccagaaaaagtatttcctagtgttattttgagggttgaattagacgaccagtgcaaagtacttagtctagtgttgcataatgctaattattacgctcatcattgtctgaaaagaaaaaaagtccttcaagaatagattctgtattgagattgtcagtatttgtttcccacatcctcatttgctcaacagcgactgactgagctctgggatataatagacttcccagcaatgcatcagatttttagggtagtacttacagaacaaattaaattcctaacttcaagtaatttgaggtttaataatatacatgagataaaaagacataacatgaacaggaatgtagctgcacgattttaacacttcataaagaagaaaatgcagtcattatttcaaggtttttttaaatgaaaaattggtgaactgactgtggggaaagagttttgatggaaataagccaggagggcccacaaagagtctaccagttagttttctagtgttcaagtaattattacattaatcaatacattattaactggtaaatctatggcagcaacatggcacagagcaggcaaacatgggagtactatcacttaatgacctgtgaccttggacagatggatcaccctttcagcacctcaatttcctcaggaaattactacctacttcatatagttgtgagaagaataaagagaacatactagaaaacacctagcaaccccttgcccacaattaaaagattaaggcttaacacaatggatgactggttgtagtaatgtttcattttaataattattataatgatgtgagctcagagtacagatgaattgcttttgatgaaacggttggtgagccagatgaattttcctgattttaaatatcctccttgttcctttcttaattagtggagcttgcgatgataatggatcggctatatggaggtgtgtgctacgctgggattgataccgaccctgagctaaaatacccaaaaggagctgggagagttgcgttctctaatcaacagagttacatagctgctatcagtgcccgctttgttcagctgcagcatggagagatagataaacgggtaagccttatactacattttggaaaattctagaaatggtcctctaaatgtgtgattaccaatattagaacgggagcattttatgacaataaagtgacagctgacaattttgcctatagagttaattatggtctataatacatgaaataatgtcctatgaatttcttttatctttcagttttttgagtagcctaatcagaacactacaatttacttgagttaatttaatcttctctaacttccattcaatctcaatccatccgtccattcattcacttagtttgtaagtcattcaataaatatttactgaatcctttgttctgtgttatatcaagtatacaaacaggaatgcccttgaggtttcctgcccttttttttgtttgttttttaatcctgggacatagggaagacctcagcaagccctatttctcaatgaattgtactcacagatttcttttttttttttttctttttccacagccgccacctctcaccgatttattccttagcttggtgtttcatgtattcaacaaacgttttagtgcttagggcaagaagttcctgtcctcatgagtttatttcctagcagatagaactgtatcacttgccagtactactcagagtgtggcctgtggactgacctccagtctgtaaacttagtttgtagtgagataggaatttagaccagaatgtgtaatcaaccacattactgggcacaatgtttggtccagctggcgatttttttttcatagaaagcctttattgatgagggaagcaatatattgatttatattttggggtcacctttttatttcatggcacactggcactttcatgcatgctgactttgatatccatcactctgaggcattgtgctaaaatagattgattttatcgtgttgttctcaattcaagatgtaaaaatcatcaagtcagtagcagtttttgctttttatgtttcatgtcatgtacagtctacttcactggcagtaaaaaaatttaagatagtggtggtcatcctacaaactgtgaatctattaaagagaaaagtatctgttctattctaagcatgggggagggacaagattagtatgttaacatgcctactttgtttgtttgagatggagtctctctccgtcacccaggctggagtgcagtggtacagtctcagctcactccaacctctgcctcccgggttcaagtgattctcctgccttagcctcccgagtaggtggaattacaggcatataccaccatgcccaacaaatgtttgtatttttagtggagacagggtttcaccgtgttggtcaggccagtttcaaactcctgacctcaagggatccacctgcctcaccccctcaaagtgctgggattacaggcatgagccacccaccatgcctggcctacttggttttttatgcacactaaaaaatacctacatctcactgccttattccaacataagtttcagagctgtgggattggtcattagaaattcagactgaatttgtgttcctctgcaatgaaatcctttgcccagtgttcatgtcactctgtagacattatggagcagcctagaggccagaagcccagtgctctccttatgcctgctcttcctgggcttcgtgacactcttcttctccttttgtacttttatttttttagttaaaaaattttttttagagggagggtctcactctgtcacccaggctggagcacagaatcacaatcatgactcactgcatgttcttctccttttgttcatggctaatcttggtcaggattccttgtcagagctgggtggcaccagtgctggtgacagcctgctgtaagggagtttcagccatgaatctctccagactaaaaataaccagctcttttctagctgatgaattaataaccaggtgactgttaatgcttgaaaggttcacatgacaggttggccgatagaacgctggaacaggcccagttttagaaattcacctctgacttttagactcaggtgaaccattcttactgagaaagaacaaagcagggttttagactgtgaatcctatggctgcatctttttttttttttttaacagagttccaggtttgtgattataacccaacatgtgtacactataaatagaaaccacgagccaggctttttacgacagctcagaatcttgtgacgcagtagtcaggcatcttcacaccaacttgaatattgaagtgcagttgtgtggaacttggatcatcttagttgattttgtttaaattatgattccacatatgacaaaaatccagatccactaattaaaatgagggtttatgtctatgaataatctcctgtgggtttaatctcataacattctagtctaaacagttggcttcacttcatgatgtctgctcaaatcctttttcctttaaaggatgtttatttaataagaaaaaaatgtaaaatgatagataataaaagccttactaggttcttaaaagatgaactatccatatttcagtaaatgaataattagtccttcctctttgggcaccttggaacagattcattcagatagtgggtggaaatgtacatgtatggtaagcattgctggcctagtcactgaaaaatgtaaactcttatttttgattgcaggtggaagttaagccatatgtcttggatgatcagctgtgtgatgaatgtcagggggcccgttgtggggggaaatttgctccatttttctgtgctaatgttacctgtctgcagtattactgtgaatattgctgggctgctatccattctcgtgctggcagggaattccacaagcccctggtgaaggaaggcggtgaccgccctcggcatatttcattccgctggaactaaaggataactgcagtgctcattttcaggcctcagaataagtgcactcttctgttcattctgaccccttcctcaacctcttcacgctggcatgtccttttgtagcagtctgtaacttaactatagtataatgaaaagaatgacctataatataggtgttttgtagattcttgtgtcactgcaaacaatatgaactcctttttcgtattgccatcgggttgcatggaagttttattctcttgttttgctggaaaccaagaggatccaaacttcctgcaacattttcttagaggagagagagaaatattaaaagagaaatgaaacaatagagtattttgggtttttaattaaattattgttaataatataacatataagaatacttttattaaaataaccatgcaacaataacactatcggtctatctgacagtttttcccccagggaagtgcttttgccttttcctttcttttttttttttttttcatcttttttgtctctctcttttttccatccctttttaatttttttaacagcaatggaggaagttaacaatttttaatggaaagagcatgttagagcaaacaaatgcataagcaagactgagcagcattataattaattttcagggttttgaggctgaacataatttcattatccctcaaaaagttaccaccacatcagaaaaaataaaaaaaaaatagtaaagtaggcagagctaggtttattttctcttaaacaatttttaaaattcagaatgtaaaaattgggtaaatttactactgaggggagtgcacttatttatttaacttacttatctggtcaaagccccaggaaacctaccaaagctagaattaatgacaactggtgggaaacctagcatttcctctcctgaagaataaatgtataaatgttatttttgatgtttatatataaactctatatcctaatttactaatactcatcagatgtcagcctttgctctccattttgacgttaaaaaacaacaacagatctagagatacctcaaggatatcatttttgattttgtgttacagtacacttgtagccaaaactggaagacaaaaccaatatataatttggctgctgattggcttacttttagatttaaagttactttgggtatcctgtaatttagttgtaacatagaaaatgaaaaaacagttaaaaaaagtgaagtagttgcaaagtgttttgcactgttgaactaagtaactgtgtaaatctgtgcaaaggtacgtatgtttatcttactcttcctataaactaaaataacattacagtttccgaatttagcatgggacatagtcagtgtttgaagtgccaacttcatcaagtaatgcatgctttattataaataaaattctagctttgaaaggcgttatgtgttgaacagtatgcttcaggggtaaatttaaaatagtctcttgaagccctagtcatggaagtaacttttattttaattgacattctcttattaaatgccctatccatcattaaaaggtttattatcagtgggcaaaacatgaaataatatgatcgaatggcaatcttgctagttgcgctacctaacagtaccatcttggatccttcaaaaccaaagacttgccccagcactgctgtggaaccacctggcttatgacccctatggatgatctttaggaaaagcagccctttacttttaatacaggctttaatgaactatacctgttaagttccaaaggtcaaaatggaggcatttgctgtctaatattcaaacatagaaagggagctgcttttaaagaattccctgcaaatactgaaagcagtcatgcgaatggagggtgctcttgtgtagctggtcagggacttttttttcttttctcctgaactacatgattctaattggaatgttcatttgcctctttttactcttttaaatgcttgtaggtggcttggggtgtgctatcgtgctgttcctactcagtaaacaggtgtgatgagttaacaagaaataacactgtttgagaactagctttgaataataatttttccctttgtacatgacctgctgaatttcggtacagtgtttttgtagctaacttattttgtcatgcacataatgtatatttgttatgcactacttttgtatatcttgtttttccaacagtgaacatttttaggcacacttttcactgacgggatatctctttatgcaatacctcaatttttcatattgcaaagagtagctttttgtacttttattactgagagatcttcatatacttcattttttaatataaataattttaataaattttattttcttatattctgctttttatacatttcagtgctctgcatacattttaaattatgaatgtcgtgcactggcaatgctattttagagtctgcagagaagagaaagcatgttgcttaaacatccttccccagcaccagctattggtgtacctataatttaagaaatagtctatgtaaagtcacaaattaatgaaaaaaattcgcatgaaaatgacagataacactgtagttcctaaaaaaaaaattaaatgcataagcataaggtagaaattaaaataacaaaattgtctacagcttcttactaagtttttaaaattattcataaaatgcagacatttttggtgaatgtttagccatttttaatattaataaattgatgttaagtgtttgattcagagatgtctgctcttttaaattatatataaggaaaaaaaatagcctgccttgggacaggtgtgtaatgttagtgtgcatgactaatgtaagaaattgttattctactaatatttacttgtgattgtgtgacaagtgtgtttacagattattggttacacttcaatttacagggcataaacaatgattatctattactctgaactttatgattacatgttcttcagattacatgggattgtagttgggagttaccatgtaactcaaacataattaacatgtaattagtttacagattgtagggcatcacttcaattcaccaagcatgtagttctagcgcactagcatggcgccagccatgtacttacaatgtagttacagagtaattacatggtgatttttgcaatgtaaaataaagtgtttctgattattttctatgtaaaggaaccctctcctttccccttctggtccctgcgctttggtataatatatatacttctccatacacagacctctgcagaatgcaaaataaaacttgcagtgaatgaatttagcattttatgagagtgctgttggaaagacttgataattcaccccttttgttttgaagagttgaatcttctgttaaaaggtgatttaaaacttgaatgtgatgaattgtggcaagttaacttcaagttatgtgcaatacttatttcaaacttttgaaagatctttgcagtgtaattctttgtttttaattgcagacatttaaaaatgtcattttctactgttaagagtaatcctctttcttgctggtgtttctaaagaaaagaatcagaaatcaatctttctactaatgtaaatttgagattatttttaaaaatggaataaaagaggttttggtcatttgctttattttattattttaaagctactgtgattgatagcattgtaagaatcgggacaatattgtattcaactgttttattttttatatttttaaaatttaaagtataattagtttttataattttcatcagatttttgttatattttttggaagtgaaacttttagcaagtgggtgtctagtttttactaatccctaattttttttccagtgtattgctcatattatcagaaggaaaagttatttaagtatgtcagttaattgtactacttggctgaatttccatatagtttttactgtgtatggggaggttgtagtatttattatagcattttaaataagggtaattcattttttattaaagtcattttcacgttaagttcctatttttgtatgttctactcttaagttatataacacagttccttttttaaaagagttcatttgttgaagtgctagtgaaaaattaatgttattaaatagtttgcaaatgactatttataccagtatgcatataatttttaaatatttgtaatgtgagatgttgaatgaataaaacttttaactca

SEQ ID NO: 4 - DNA, 187791 bp, Homo sapiens
ggcagcccacgtccagggagggcggagggaggaggagaggcgcggagaggagggaggggagaggggagggaggaaggcgagagaaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtactgggcggctcggtgtggtggcgggggcgacgcgggacccagtgcgggcggccggcggggcgcgggcccggggcgcggcggtggaagaaggttcaggcatggcccgtgccccggacgcagccccacagtgtggcccggggagggtggatctcgggagcgtgtgtttttgtgtccacgcgcgtctgcgggccccaaattgcgtaactccaaggacttttcggagacttttgtaagtataatgctcagctttgtttgcccgggatttataagtggaaccgagagctgactcctgggtgacctcagataatcgggactcggagggtcaggacttagggccggggctggaaattgtgtatggattcagggtcggggggggagcagtttaaggaagaaactcgggggaaagttctcgttaaaagatacctctattccctgccccctccctttccgtgttaaaagttcttggtgaaatatctttctagccgaggttttttggattaatagataactcatcagccacattcttctctgctgagtcaaagaccccgagcctgggcggtgaacgcttgtgattttaggggccgtgcagctgaggggagcagagtaagagggttaaaaacgcagcaattcaccaaatgctcatcgagggtattttcataggactttgacttctgagcatgcattttaggtggtgcgtccgtaatcatgatgaaagttttgtgactgcggagcgttccttcggtggaaacaaaattgagtagatgtggtcagaaggggagtcggactcaggaacaaacgtttcagaattcagtaggatatttgtggtatcctaccaaatgactctttttgcaggtacgttatctggagtccaagaaattatttctggcgtacttcttaacatcccacacagttgagttcttaaacattctagaggaacttgagagtgtgtgtagatgcaggaaagtgcacgtctaaatatgacccgaaaagattcacacaggtattggatcctgatataggtgaacacagaaggtaaacggattctaaagcgttagaatgttgagatcattgttgagacactatgttgtgtgcaaacttcaattctgatagtgaaaccaaaattgcagaggaattcattaatacatacaacttctctgcacattgtccacttggaaaatggtaactatttagatggagaaggtagaggagcgagactatgccaaacaatgcaaaataaataggagattttactcgtcacccagttgtatggtagtgaaaacctaaatgaattgcagtcagccaaaaattgctttttcacccgaggacattttctattttattataaaagactatttgaagagttgtttacttgcatgttttctaattacaattgtaggaatgctactggcatttcttttttcaaagcgatggagagttgaatggtgtgttctgattttttttcttgaactttactggctgctttgctatttattttccctaccacttaaaaaaatttaaaaataatgacaagtgtgcttttttaggaattaccatatttaactaattcacttaccatatcaagataatcatcgcttcagaaatctttctgtttcagctagatgtgcaatctgtttgcttctcagggttagaatattatatgaaaccatctttctttattcacccagttgagaaaacttttttttttccttttggtaggtagcaaaagaggttcaatgtcctaaaaatcatacccacattaaaattaagtatagaaaagtcacatttttctgcttgacccctcttaacagctgccaggaccaagggattgcctgccctgttcctggacgctcctccgtccttgtgaggttgtgtataataatcgctgtataatcgcgggccattgcagtacagttgctgcctcttacttgtcctgttatctgacagcgttccttttcaggtaggaatggcatgtggctctagaaagtatcggtctttttagcaaaacacttgttatgtaaaaagtaaggggacacgtaggaagatttcagaacccaagttgtccaagagagatgtcgtgtacaaaacagttaagaccgtgaagagaggggggtttataatgtcagaaattgaggaaaagaaactaaggtggcctgaatgatccaggtaattttgccttaatttcctatttttggtttatattttgttcttgaaaaactcttaacctcttttttgtttttttctttctaaccctgaaagccacaggtaaaataaatagagtattaggtgagtgccattaatgtgcccggcattacacaaaaccactgcactgaccctttccctgcccacccattgtatcagcaacttgctcttaagcacatttaaaaaccttggcggtggactccagtaaacagaacacacacatacaacatagatatatacacgtaatgacgagaggaaaaatgtgtttcgttgtaatttctggtagccattgaactgacatggaaaaatgagtccaatcatcattaagggaaaatagtttatttcacagatcatgagggtggtttgggctttctccacattgtagaacccaagtttgtttttttctgtgtttctagtttcgaaacgaattccttctatcaatcagtgtattttagcttcttttgagagtttctaatgcttaccctgaaataattgtgctgaaatgcctctttggttctaattgtgtagaatgaacagttcaggatctaggagtatttttgcagctttttagggttggaagtttttgagaactttggcagaacatgtattaatacttctactttggatagcattgaaaactttgaggaaaaataatttaggatttggctagccagttgtgtaagagagatgatacatttaactttccgatttttaatgtattattacattaaatacatgtgtaatacacgtacaatgtattatacatgtgtgttccctaagcaagttgtcctgtaaagactaaccagttgtcaaaatctcactgagatttttaaggtttgtttatatatgtttagagtatcatgtcatttcttatattttacaattgataaaatgattcctagaatttctctaattgtgcaatcaaactttataaaaattgatatataatagatccataattatttgtcttacctaatcagttataattgatgagtttaaagtattttcaaatatatcaagaccttttctgtcttatagcttataacttatagctatagctataagctaacttataacttatagctatagctataagctaacttataacttatagctatagctataagctaacttataacttatagctatagctataagctaacttataacttatagctatagctataagctaacttataacttatagctatagctataagctaacttataacttatagctatagctataagctaacttataacttatagctatagctataaagctaacttatagcttgtaacttatttgttggtcactgaattttcaaaatagaaatttagattaaatatgtgatttggtttttatttctacttttatccatgtcattgagtacttttcaggctgattgtaaaacatctttaaaaggccttttattatattgaagcactggtgttaatttctccttaaattgctttgaattgacttgtacttataataaaactaaaaaagcaaaaaacgtggaagtgttggaatattgatcaaaaagatgtgcagaaatcatacagtcagttcttctgaggttaatacaaacctttactttgcattccttcttttaaagtgctaattttgccaaaatattggggttgtaaagaaaattatttcttaaaattgctgcagagagggtaatgtcagtttgatgtggcaacctcaaattttcattgagcattaaagtcaatctacattgtgacttcaggaaagtacagaatggttttatacaatttaaccaagattggggatctctgttattccaagttcaatccaatgcaataaacatatatttcagttgtagaataggatttggtgacaactgatgctccatgacccctgtcaatatggcatgcacttttgagttatttttccagtagcggtttaaacatttccctgataaacccttgtgtgcatctgcagtcttcttcattcccagtggcattagttttcagatgggtagtttggaaggggtggaagttctcttctggagatggtttcacatgattttcgtaggttcatgttaatttttgctttaaggataaaagtgttcagtgctggtgacaaggcaataaagtgggtacttttgtgcagagcagtggtgatgtaaattagtgtagcttttcagaaaggagtgacactatcaaaatgtgttcaggccctttgatttagtacctttatttttagaaatttaccctaagaaaacggtatcataaagatttatatataggaatgatttttgcagtgacttatgacagtgacaattcagaggcactctatctaacatgggaaactgctaactaaatcattgtataattctggaaggggaatattgtgcaaccactaaaggctccgtttttaaagagaaaaatacatggattataaaatatgtattatatataaattcatatttattatgtattatacatatgtggttatatactattctctgtgttctggaggttagaaacctgaagtcaaggtgttggcagggccaccgtgctctctaaaggctggagaggagaacctgtccttacctctttgagcttcagtggctccagacattctgaagactatatttttattctcatgttgtaatattaaatgaaaagaactgattttaaagttttatgctatgtgatgccagttctcaaataaatgtatattcattcataaaaccaaacattaattgtatctaattggtggattacagatcattgctatttactttctgatgcctttcggtgtttaagttttcgaaaatgaccatgtgaacaaaaagaattaaatgtctttttgctttgagggtttccttgaatcgtgatattcacaaaaccgaggttggtcacatttagttttgctcacaagcctagcggtgagaatcaggtctgccttgttcctcagacatagtctttcttagtactattagtatttctcttactcattcccttatcttgattgtgttagtgatcttcagctgctctcctgttctgatgctcttctggagtccatccttacaccatactgctgggccctccaatgccccgaatccttcagtgctacttggtactccacaaagtcaagtgcgcacatggcgttcgggattgccctcacctacctgtatactgtgatccctttgctaagaggaagcctaggtcttcctcttctgttctcttgatctagtctgagctgcttttaagccaggattcaagtttttcagcctacatttttgcaagatccccctcacctgaatgtcccatcccatagagatgatttttcattagaatttcagtaaaagttactttctgttatgtccatttaactcctggttattatttttttcagctatttattttgtatgggtctatgccattttacagtattcccaatgttcaacacctaccccagcaccaggtaaatctcctctgcacacatccacacttacatatatacacgtatataattctttgtaaatatatatgaaatagccttattggtgaggttggtgattatgagtttgtacaggtaataagaagcagccactcgtttaatattgaggatcccttctgtgctctgcactggggaattagaaaaggtgtggatggatcggctggaaaattacttccatccctttgtcattaggaacctccatttgcgagcacaggtgagcctgcctggtccatcaaatagccactgctggaaaattacttccatccctttgtcattaggaacctccatttgcgagcacaggtgagcctgcctggtccatcagatagccactgtcagtgtgggactgcttgtcccaaggtgcatttgggttttcaccattagaatttggtttctgctgtggaattccatttgaccttttggacgagggcttccagaagccttggttaggtggaagagcatggactccctgtgttcccaaacaagcctgctctgtgtgacagccactttggaatgtttgtgttcagtttcatttggcaccttagtgtctgcctgggggtaggggaaagggaatgcaaatgttcctcttgaacagtgcttgctttggtcaaagaaaaaaacttaggaaggaatgaggagaatgaaccttaaaagctggtgcagaagtggctgcatagctcagtgggcttgaggccatctgggaccaggtatttaaaatggatgctatgttggtatgaacaagtcagttccatgcccctggtggggatgagcttatttgtcatatggggataactcctcacactcacatccctaaagtgtaccaggagaatattgtaaacaattttattgcactatattttctatgtttggcggtggaggtgggaggtccttgatattatctgaaacatgaagctgagtaaaggggatatgtctgtggtatcagaagaaagctgcttggcttgtcagtgttgctgatagcaggaaaaaggaaatactgaaatctttagcctgcagaattgtcagaaatctttttatctattcattaaataattatctcctaacttttattgagtatttactatgtgccaagctgatgaagggattatgatgattgtgctgctttgatggggaagtggctgaagccctgaaaagctatggagccagggtcttcatgtgcagattctagagatgccaagatctgagagaggcagttcctgtcttaaagttgctcacagtttaatggtgatgcccctgtatgaacaaacaggtataaccacgcccgaggttaaagtagaggtagttgagttgagcacagccaaacctgcaaggaagggatggagctgtgtcacagaaagctttaaagaagtttaaagagtcagttctttaaagatgacgtatgagctaaatctcagttaagattttgactgatgagaaaagggttcagacagtggggaaaagatgggctaggcaaggaaatcgctctgtgaatgaacacacagaggcttcaaaagacccttttggggaagagcaagcaaggcatggcaggagagaagaaggggaaggaagaatgaaactggggagggggcactggcccacagtgggtggaagagctgcctctgcattagggaattggactttgtcctctgatggggcaccagggtggatgtgccccagaaggcagcaatctaggacgtcccaatgggcagggggatgtggcgaattttggaaaagttgttgagaaccattcttgcagtgaggtttctgctgcaagagtcctggtctcaaagtgaggcagcagcctggcagtggcaactgaggcagagatgccaggtgttcagggcctagataactgtcagatgtgcgggagagaaggcaaggagacagcctagcagccttttgggtttctccttcgggtggctagctaagtgacggttgtatttgtaggaatagaaaatagagatgtggaaagggtaagaaaagaaggtacctaggagatgaagatgttactgagtctggggtgcagaggagaggtctgatcttgaaatacgattttcagaacaattcaagaacatagagctgataattgaaagcgtgcatactgggagtgagtgcccagaaaatggaattcctgctttctaggaaacgttgtgagggttagcaaggaaagagatacaaaatttagtgaaaatttagagtcatgttaaaaagtgtttgggaaggggagagaattgaaaataatcaagaaaaatggaaacttaaaaattaatttaggaacataaaaatgtattacatataatctgcctgtttttaaagggtttggtatacttagccattggaaagcctgagggggagcttagaaaaatctgatatatggtctttctcatatgcttttttttttgctttgctcaaaactcaggaacctgtttataaacctcccaaacttgccattaattcccaggcttttacttctccaactctccatttgccaaccctgcacctaaaaggaaagatcaagctaccataaaatctggagaggcgtgagtttttttacaggaaaaaatttctaagttgcttttatcttttttgacttttttggggaaaaggaagagtaggatgagcctttggccagcagcccaaagacatctaatctgtgggttatattttcattttcttttttttttttctttgagacggagtcttgcgctgtcactcagcctggagtgcagtggcgccatctcactgcaacctccactgcctgggttcaagcaattctgctgcctcagcctcccaagtagctgggactacaggcacacgccaccacacctggctaatttttgtatttttagtagagacaggggtttcaccatattggtcaggttggtctcaaactcttgacctcaggtgatccacccgcctcggcctgccaaagtgctgggattacaggcatgagccaccatgcctggccatattttcattttattcaatttatactttaaaagtttgctgcctttttcagcccagctaagtgtcagctcaaagtagtccaggaacttaaaaagaaaacaacttgcatttgtatttctcttaggttttaactctactgcacctattatggtgacggtgcatattgtgtaaatgctaaagagaaaaaggaaatggcagtgataaatgccagtcacaccgagaagatggattcacattccaggttgtaatacagtattgttacacaaatttaaaatgcaaagggaatgcttagccagttccattctgtcagcctttagggttttgcaaaggtaggagacatctgagaatctccaaaatgaggtctggctcaccaacctctgcaaataagttataggacaactttacttttaattaacttttatttctcatgagttgatttttttgtgacgttcctcttgattttcccagattctcatgtcaccagggtagataggctggcagtggccaatgttgttctaagagaaatcctaaagactacccaatttttttttttcttgaatccgcaggatcctgttttgtgaaaattcctcttacgcccacctataggatagacagtggaggccccccctgggagaaagtgtacacagaaagtgctatctaattacagaagtagcagaatttcctttgtgctcagaggggaagtgctacaaaagtgtaattactttacccagcatgtgtgatttacgggacttaaaatgtgtgagtttccaaagagtcatctgtttttaaatacagtatccctcccagccaggcaggatgtgtttggggaggtgggagtgaggacatgtacttccgtcctgtgcctgctgcaggatgcctggtgacaggggactgaaaccactggtacttgctgcccctcagggtcttgcttatctgagtagaaggaagaaaatcagcaaagggctggaatctagtcagctactcccagaccagatcatccactgctctcctcttaccttcccaagccaaattctttttctaggacctccaagacttttcccagtaataagcaaaagaattgttagagtgaaccctgagaccgtttttaaaatttatttatctttctttctttctttttctttttcttttttttttttttacctgtttttatttgagatggagtcttgtggtgttgcccaggctggtcttaaaactcctgggttcaagcgatcctcccgcctcggcctcccaaagtgctggaattatagacgagaccatttttattgcacaaattttcttttcaatcttacttttcctaatatgcttaagaaaatcagtgggagaattgaagatcaggtgcagtggctgggccaggtggctcacacttagcacttcatgaggctagcactttaggaggctgaggcaggcagatcagttgagcccaggagttcgagaccagcctgagcaacacggcaaaacctcatctctacaaaaaaaattagccaggcgtggtggcgtgtgcctgtagtcccagctacttaggaggctgaggtgggaggattgcctgagctcgggaggtcgaggcggctgtgagccatgatcgcaccactgcactccagcctggacagagtgagactctgtctcaaaaaaaaaaaaaaaaaaaaaaaaaaagaccaggtgcatatccagatgtaatcaaacctgtaaaaacacttaatggtttttgcatattaatggattgattaaacatttatggagttggtgtctactctgcttttaacattgctctttgacaaaccatatgaagtgttgccatcccatgttttgggataagaaagctaaggctctgagagattaagtaattggtctgaggttttacagctggtggataggagcttaaaattctccagtggcatatgaggttcatgtgatccgggccctgctggtttctctgacctcatctgccaagaatcacagcctcattcattatgctccagctgcctgggctttcgttaggtgtctccaacttgccaaacttgttcctgcctcagggcctttgtgcaagccattctgtatgcccggaaagccctacactcagacattatcagcctcatccttgccattcatttagatctcaattcagatgtcaccccagagagacctttgacctccaagtttaaagtagccctatattcccaacccttttattttccaaatagtacttcttacctcctgacgttgccttgtatgcttattgtacttatttggtacccttggaatgtaactccctggcagcagactgcctgccttgtttaacactgtacaaacctcagatgcctaggacaatgcccagaactgtccaataagtttttttgtgaattgactagaatgtaaatctgctttacagacgccaaagcctgtctgatacactgtatcatcataaacctttttcagcagttttcaggttaaactttatatttctgccttgaagatgatcatttctggtcctcatccccactttattgcatacaaaaccgcagttgtcatctcacacacttttaagctggaaatgttcagatggtaagtgataagagcccttgtcggggtatgcagcagtttttcacacataaacgaatccttcccttttgtccacttaggatgggaaacctactaattccacagaacgaggagagggatgtgggcctggagtgtagggaatgcctaagtaccagtagggcaaggtgaatttgattcctgttttgcagatgtgactgttaggttgttagggttaatttaataacccaggtggaattgatttggagatagacttaccacttctgatcctttgattggatctagcctccagctcaatataccttcctcaatttgcctacaagaagaaaaagatctgaagctcagcataatgctggctttagccagaagaatccagcctttaagccatctatatgtgtagccatgaaggaccttctaatatgccttgtgagcccttatggggccacctcacagccacaatttatgcccacgtgtcagcctcacagactcaggagctgtttctattcattgtaaagcagaccagatgacatttcaggatgaaagaaatgtaagtcatcattacatacggcatcaggctaacaagtcacctgttagttgagcagactagttagttggtgaaaatgcatcgatgaaaatgcagaccattggattatcctcatttatagcatttatgtcacacttcaccttcaacaaacttggttaacttaaccatcgtccattacctgatagtcttagaaccaatagtatataaatccttatagaagttatttcttgaccaatcaattcatgagtattctttgttttctctcttattatctcattatctctttgtttctaagggacctaggacaagccactgaagctgcttgtctttgacaagtcattttaacctgtttccttaactaaaaggtagggattgtatagacagcacctgtggtgcattaaaagaaccataaatctcatttttccactttcattccactttccatttccccattgtgatgcagaaagctgccgtggcgtgccaagacacatccagggtgggctgtttggggggaatggttttaattttaagccttttaagtgaaaacccttagaccttgcctctgttttgttaaattacgattctaacaaaataagaaaaaattagtgaagcactagactttggaaactctttcctgtatatttgaaatgattttcttaagactgcttttcttacctgaaattgttttgttttttcctaagcaaatgagtgcctctccttgagaactgggtgggagtctctgggtgtgagagaacagcaggaaatgaccctttctaaacaaaaggactctttaaggcctatcctgagtctttgtgttttgaggaggggttatgcagaaaaccagagctaggaaatgaatctctgcattagccattctaatgggggaagggagaatggagaacattctctccttgcacgccctcccaagtatctaatgccagggaacacttactgtgagatccaaagaagtgcagaaaagaccctgggagcctaggtggtggttcttcaggagtgcgtggcttcaagtcccctaaaggaaagaaaaaaccaggttgggcagaacgacacccaatgtgatgttcacctttaacctgggcttccagaatttgcttgaaaaagctcatgatcaacagaatgcagaaataaatacaaaatgaggaaagtatgagagggattttgcaagatctatttgtcatatatatctttttgtttttgttttttttctcaagacggagtcttgctctgtcacccaggctggagtgcagtagtgtgatctcagctcactataacttctgcctcctgggttcaagtgattctcctgactcagcctcctgattagctggaattacaggtgcctgccaccatgcccggctgattgtttttatttttagtagagacgaggtttcactgtgttggccaggctggtcttgaactctgctgatctcaagtgatccgcctgcctcggcctcccaaagtgctgagattacagtgcctggcctgtatatatgtttatgatcgatttatcatatatatctttatgatctgtttatccataggtagaggttagagtgttatgatttgctaataaatacccagtaaataaatcaaagatttgaattactgtgttaatgagaaaatgaactttgaggaatgcaagtccttttaaatgatcaggtccagagggactttaaaatgagaccacagtcaggtcctactcccctcttgagctatatattcacctctctgtattcactgcttgctgttgctagaagtagctataaattaactaataatgctgcactggacactgtaactcactctatagtttaacaatgtatatagccaatcactaatcagtataatttgtgtaaaccaatgagaattcctggcaaacaactttatatcagcccactcccttgtccctgctcctttttttttttttttttgcctttaaaaagccacttgtaactgctttttaattggaatgcataagcccctgggttgcagtcttcaagcttggccaaaataagctctacttatattaattttgcctcaccttttatgttgctatcaacttcttttctcaatctaagctgaagagggaattaataatcattgctgtgcgaggtagtgggtctgtaatgaagaaatgttgagccttgccctgcagtggaatgttccctcctctcctcacttcaaagtgaccattcattgtatcagtatttgtgcaaggagatcccaaatttaaaatgctagaaaaggggataggtcttatcaaaattattttgcctttataaattcttgctgtcttggagcaatgaacttctctgctcttccagggacactcctgtttttttttttttcaaggaatataaatctcactaataattagaaacacacgtcttgttgaaaatggttttgtggtttacttcgtttttagaacatttgaaaacgacaaacatcttttctaagaaaaagcattgtttgttacaccaccactgtttgtaggcttttcattgtaactatatttttagaaaggctggctcatgtgtttgatggggactctgtgttgagggtaaggggctggtttatttactccacagcaccagatgctttacagaattaaagataagattaaagctgccactcagatcccattatgaaagggttttgtttatatattaaaggcttggaagactctttatcttagatatgaagccagcaatgcagtattcaaaagagatgtgatcattgtaagttccagagttgatagggaaaaattattctcactgaaaatcccagtgtctgaagtgttggtaggttttcttttttttttctttttttttttttttgagacagtatcgctgtgttgcccaggctggagtgcagtggtgtgatctcggctcactgcagcctccgcctcccaggttgaagtgattgtcctgcctcagcctcccaagtagctgggactgcaggcgcctgccaccgcacccagctaatttttgtatttttagtagagacggggtttcactatgttggtcaggctggtcttgaactcctgacctcaggtgatccgcctgcctcagcctcccaaagtgctaggattacacatgtgagtcactgcacccagccggttttcttcatttcttttttcttttgagatgaagtcttgctctattgcccaggctggaatgcagtggtgcgatctcagctcactgcaacctccgcctccggggttcgagctgttctcctgcttcagcctcccgagtagctggaattacaggtacacgccaccacacctggctactttttttttttgtatttttagtagagacgcggtttcgccatgttggccaggctggtcttgaactcctgacctcaagtgattctccgtccactccccagcctcccaaagtagctgggattacaggcctgagccaccacgcctggccctcattttcttaatacatcatttaaactcctaatttgagaaaggttaacgtataacgttgtaacaattggtaagataccaatttacaaatatggaaatatatattagattcatttggaggaggttgtatatggtatacgattggcatatgtttttcattctgaaagtatcagttattttcctgttattatctgtggtaacattgcttgttttttttgttgttgttgagacagagtctcgctctgtctctgtcgcccaggctggaatgcagtggtatgatcccagctcactgcaacctctgtctcccgggttcaagcgattctcctgcctcagcctcccaagtacctgggacttacaggcgcctgccaccacactcagctaatttttgtatttttagtagagatggggtttcactatgttgaccaggctggtctcaaactcctgacctcaggtgatctgcctgccttggcctcccaaagcgctgggattacaggcatgagccaccacacccggccacattgcttgtatttttaaaataaaagattaaaaaagaaaagtgtgatccattctctaagctgcttgccaccatgcaatattgagtcagaagaatggttctcagatcccgtgcattaagaactatttgtgtatcagccttctaaagcatggcgaataagacaacatacgcagtggagacacgtttcctgggatcatttgtggtcgagatggattcaggaatgtagcgtgtctgattttattgggtgcaggaactgctttttctatagctcttggtattcatgtaactgatggttaaccccaaatcaaagtgaaaatgtcctgagcaggcatgtttgtccattctctccatgttcttagatcatcaaagggaagttcttgccctttgcaagactagcatctgttgccatttggtcatagtgcacccagcctgctgactctgtatcttcaaaacaaaaacaaaagccagtagggagggagcaaagactcaaaagtgctgtggggctttggaatactgtgagtttctgattttggtaaatgtacatccaagatgttttaaccattaaatgtcccctcttctacattccattaaaccccactggcctttaatcaacatgagaatttctcttgtaatatcttgggttgtgattagacggatagaggaatcctattggtgtgagcttaccttgaagtcaatgaaaaagtgttatttttccttttttttttttttttttttttgagacagagtttcgctcctgttgcccaggctggagttcagtggcacgatctcagctcactgcaacctccgcctcctggattcaagcgattctcctgcctcagcctcccgagtagctgggactacagacatgcaccaccacgcccggctcattttgtatttttagtagaggtgaggtttctccgtgttggtcaggcaggtctcgaactcccgacctcaggtgatctgcctgccttggcctcccaaagaaaagtgttatttttccatctactggtacttaaagtcagcccaggcaaagcctgggtgctgctcagtgcaggagactcaggcgtggaaatgcagcagattgacctgggtccctcctcccttaaaccagtactctgaaatctcaccacgtaactaacaagccctgtactttccaaattgacatcacaatcatagtcttgccgtggccaggtggggtggctcatgcctgtaatcccagcactttgggaggctgaggcgggtggatcacctgaggtcaggagtttgagaccagcctggccaacatggataaacccccatctctactaaaaatacaaaattagctgggcatggtggcacgtgcctgtaatcccagctacccgggaggctgaggcagaagaatcacttgaacccgggaggcggaggttgcagttagccaagatcgcgccatcgtactccagcctgggcaacaagaacgaaattctgtctcaaaacaaaaacaaaaacaaaaacaaaaacgcttgccgtaaatacctttcctccctccccacgcctaatggattaatttttagtcttataaattaggaaatttctcatatagggctgacataaagagtaagcgttattgttcatgtaaagccctgaaatagtttgcctttatcgaaagctctagggtattttcgcaattattttgttgtgttaaaaatatggagaactaccttctaccccaggtggtcctcagcagagcttctgtgtggagcagaaagttttctcctgggatatttttgcctattttaagccctgtcttatgcttatttctgttggtcatttctcccagcatttctcaaaggaaagatagtaacgtattgcttctattttagggattaaagaatgataaatgtatggggtttttaattttatattttaaattgaagctaccaagattcataagccatttgttcatctaattggatcacattgtgttcaagtttcttttcactgtttttgttttttaaaatacaatcttaaatagttaccctttctctcctcaccatcattagaaaacacaagtaagcaaaaaaaaaaaaaaaagattaaaaaaggaaacaattctataattccctcacaaccagtgttaatacctcactgcgtatcttttacatgttcttttctctgtgtgtgcacacatggcatctatcatctgtttgaacaaaaatgagatcataataggttttccatttatttcacttaacagtattttatgaacatctttgcatgccattggattcatttctctctctctgttttttgagtcgtcgtcttgctgtgtcctccaggctggagttcagtggcacaatgcgatcatagctcactgcagctttgaactcttggcctcaagccatcctcacacctcagcctcccaagtagctgggactacaagtgtgcaccactatgcctggctaagtttttctattttttctgtagagacagggtctcattatattgcccaggctggtctcgaactcttggcctcaggtgatcctcccgcctcaacctcccaaagtgttaggattacaggcgtgagtcactgcatctggccaattggatacattcctgcagccaaattttaaattcttcctattgtgctatagtatggatgtgccttaatgtatttgacccaccccttattattgggcttattattgaacttatttccagcttaagtgatagaaacagtgctgtacatcctcctagctaaatctgtgtatacacccttagtgatttccttagcttcaactcttagaagtggaatttctgggtcaaagggcatgcattcttttaaagatatttgatgtttattgccaaatcttctctagaacactatttccactaagaaaatcagcaggcccattccttgcatcccctgcccctgccatttaaaaatgtccaaagattgttccctcactgtggagtttttcatatttgtgtcccatccgtgactcagaattaatattccagcctcatctgtataacacctggatgttatatagtgacttttttttaacctcatttgaagacatatcccagttgtgtttcttatacttcactggatacaaaaatgcttagcagataatttctgggggtgtcattcttgagtttatcggacaccgtgaagtgtgttgctttttgtgtgttaggtgcttgctatatttttctggctattaatgtctgacgatgaggccagtattttaggtgttgtgagtgcaagtacagaatttgagtcagctctaacatttgtcaggtaaagcaataacactgccaattaaaactttattgtaagatgcatcctgatttcatagatgttacagtgtggaaacatgtctcagaatcagtggatatgttattctctcatctacttttctggtcacatggttggtttgctcttgagatgagaacagagacacactggtcagtttgacataagttttggtggacagtgagccaagtatatccttggaaagaattttataattacagttgaatcaacaatgcttcaatgcctttttttttttctttttttttggaaatagggtctctgtctgtcacccaggatgtggagtgcagtagcatgatcatagcttactataacctcaacctcttgggctcaagcgatcctcccacctcaacctcctgagtagctgggaccacagagctgtgttgccacaccctgctaattttttttttttttgagacaaagtttcacccttgtcacccaggatggagtgcaatggcaccatcttggctcactgcaacctccacctcccgggttcaagtgattctcctgcctcaagcctccggaggagctgggattacaggcgcctgccaccatgcccggctaattggtctatttttagtagagatggggtttcatcatgttggccaggctaatctcgaactcctgacctcaggtgatccgtctgcctcagcctcctaaagttctgggattacaggcgtgagccaccactcctggttcaccctgctaatttttaaatttttgtgtagagatggggtcgcactgcatttcccagacttttctctaactcctggcctcaagcaatcctcctgccttggcgtcccaaagtgttgagacttacaggcatgagctaccatggtttgccccacaatgccttttattaggtacagaccatggtgtatatcgccttgtgaaaatgattcttttcctccctcttcaaattgaggatgctgccttgaagctccagcatgttgcagccccttaagtatttctcaggatgaaggagagaccattcagggcaattgcatcttccctggaggggctgttttcactgtgatgcccgcaacataccaagagtggaatcctgtctgaggagtgcagctccggtctcaccatgtgggcagggcaatcaccattaaccccagcccacaggccttcttaattgttaacagacattctgagaagtgcatgccctccacaaagcctacacacatgtgttcgagtgtgactctaggaaatgagcagatgtaatggaaacctcagtattgactcatcccgattgttatatatgagtggaatttgcatctcatttagtgtttatttcagtagattccagttgaggtcatggagtgctaaatttatatgcatcatagcacctttctcaaaggaattgggagctcttttgcaaaacaaaagatgtcttcttttcccttagcccttggttttgtttggcagatggtgtaggtgaagagaacattagttgtggaagaggtatgtatgactcccttgggtacagtcattgatatttgttaaagacagcctgagagtctgttgtcttggcctttctgggggatgaagaagttgttactgagaagcagttttcctgccttcttggaaagacctcagtcaacacaggaaacaatgggagaataacatttgatcctacctaaatggacaacattgtgtaatatgggcggagagggcttagaaattcagaaagagatcagtgtggaccagaataaaaggctttgagaaagaaaggtggaccttgaggaactggtaatatttaaatagaaatgggtactggcttaggagagtttcaccatcataaaagtttggggcctggcatggtggcccatgtctgcaattccggcactttgggaggtggaggctgggaggccgaggtgggaggattgcttgagtctagaaattcgagaccagcctggggaacatgatgagacactgcctctataaaaagtaaaaaaaaaaaaaaaaaaaaagattagcaggcatggtggtgtgtgcctgtagtcccatctacttgggaggctgaggtgggaagattgcttgagcccaggaggtcgaggctgcagtgaactgtggtcttgtcattgcactccatcctggacaagagagtgaggccctatctcttttaaaaaaaaaaaaaaaaaaaagttttggaagtaagaatgaatgtagcacatttacaggagcagggaaaagctgtatctattactttttaatgaatgaattgtatgtatttggggatatattaaagaatttttaggctgggcgtggtcctcatgcttgtaatcccagcactttgggagaccaagtgggaggattgcttgagcccaggagttcgagactagcctgggcaacatggtaaaaccttgtctctacaaaaaatacagaaattagccaggcctggcggcgtgcacctgtagtctcagctatcaggaggctgagatgggaggatcaggatcacttgagcccaggaggtcagagccacagtgagccatgattgcgccactgccctcagcctgggctgcagaacaggatcctgtcttaaaaaaaaaaaattgttattatttgtcaatgtcattggttttccaatcaggcctgttccacaggtgattgatacacaacctgggaagaagttagacacctgcagaacccaatgccagttaagtctttttttttttttttttttaaactcatttgggtcctagtatgcaaggccatgcaagctgtttagatgaccatactggaaaaataaggaatatttttctttggttattcttccctaagtttcttttttattccagcagggtgcagtggtgcaatctcggcttactgcaacctctgcctcctgggctcaagcaattttcccatctcagtctcctgaatagcagtcacgtgccaccacacccagctaatttttgtatttttagtagagacagagtttcaccatgttgcccaggctggtcttgaactcctgagctcaagtgatcatccccactcagcctctcaatgtactggggttacaagcgtgagtcaccacgcccagccttaactttctggatgaagccatttactccataactttgcttattttttcctgttttttgtttttttttttctttttgttttttttttgggtgggggggtgcttcttcattctgcctcttcagaacagcatgactgtttatcagccgtggtgactcttagcccaatgtataattcctagatgatctagtcatcccaaaggtactcaactcctacttggattaggccctgctggtgcaatgagcagcaaacagacattgtccttgttcatcctggaagttacagtgtagttgaaagtgtatattaaacagtgaagcaccgataaatagagaataactgtaataagtgctagggaggaagagcgcagttgatgtgagattgatagttgatggtcacaaggggacctttttgactttgttctaggtactattcacatcactgggtgtgaactcagtcatcttcactgtgctgtggggtagctatccaccactgctcctcccagtagaggaggaactgaggctcagtgagttgaataacttgccctgggtcacagctaataaataacagcctggatttgaacctggtcagttagttcaaaatccatcatctttcactagacctcattgccagtttagaggtactagagaagtttgcttcaagggaacaagagttctcttccttaggcccatatctctcaggatcctgcctccctaaacagaagagcttgcaacacaggacttgtgtaagctctcagcaatcagtaatgtggaaactaatcttgtcaaggagatgaccagttacaggatccttagtttaagaaaatctaaatggccttgggcttactcttacccaaatctagtcttttctacttcttccatcctgcctgtctagacccttaagttagacccccagaacctcattggactctccccacccttagtccatctaacacgaatggcagattccttttccaaaggcactactccagctgggcacagtgcctcacaccagcaatccagcactttaggaggctgaggcaggcggatcacctgaggccaggagtttgagaccagcctggccaatgtggcgaaactctgtctctactaaaagtacaaaaatcagccaagcgtggtggcgggtgcctgtaatcccagctacttggaaggctgaggcaggagaatcgcttgaatccaggagaaggggtttgcagtgggccaaaatcataccactacattccagcctgggcaacagaacgagactgtctcaaaaacaaaacgaacaaaaatcaaaagctctactccataaatcagttgcatggaaaaacatttggaggctccttgatcaaagatttgatgtgtgtgaaagtgttctgaagacagtggagtgctgtgcaattgcacaccactgtgttctggtgacagtaacacccaatgttgagaaataactctctcacctcttaaaattcgagttaaaaagtgtataattgaacagttcttagaatattcagagctgtggaactatcaccactatctaattttagaacattttgtcaacccctgaaaaaaatcccaaattcattaaccaatcagtcaccatttcctcctctccctaacccaaagcaactgctgatctgctttttttcctctatggattagcctgtttcagacatttcatgcaagtggaatgatacaagatcggtcttttggcttttttcacttagcatcatgttttcaaggctcatccatcttgtagcatgaattggtacctttcccattgtttgaatgataccgccattgtatggatgtgccatgttttgtttgtccattcatctgttaacatatatttgggttgttgacgctttttacatgtcagtctgttcttacaaagcattccacctctgggtccctcaatgtctagtgcctagagcgttttctcttttttttttttttgagatggagttttgcttttgttgcccaggctagagtgcaatggtgtgatctcagctcaccgcaacttctgcctcctgggttcaagcaattctactgcctcagcctcccaagtagctgggattacaggtgtgaaccaccatggctggctaattttgtagttttagtagagaagggaattctccatgttggtcaggtgggcctcgaactcccagcctcaggtgatctgcctgcctcggcctcccaaagtgctgggattacaggtgtgagccaccacgcccggcctagagtgttttctttaatcttttccagttatttctacttttttctgtccgagcttatcctttgggctttcccccaataggactgttgagtcagttactgacttagcacagtgaatatgcgtcctaatacattctttattttttattttattttatttttgagacggagtctcgctctgttgccaggctggagtgcagtggcgcgatctcggctcaccacaacctctgactccctggttcaagcgattctcctgcctcagcctctcgagtagctgggattataggcaaacaccatcatgcccagctaatttttgtagttttagtagagacggggtttcaccacgttggccaggctggtctcgatctcctgaccttgtgatctgcccaccttggcctcccaaagtgctgggattataggcgtgagccaccgcacccagccttacttatattcttttatgtgtctacgtgtattcatttagatgttgagctcagttttttaaaagacaattcacccaacaagtatatattgaatacctactatgtgcctggcactagttggcagttggaataaatcagtgaaccaagctaagatccctgcctccatggggacttaaacattttggcaaagcttacattctgggtgacttaaaatacacacacacacacacacacacacacacacacacacacacacacacacttaactgctactcttttatttattattttttttgagacggagtctcgctctgttgcccaggctggagtgcagtggtacaatctccgctccctgcaacctcagcctctcctgggttcaaacgattctcctgcctcagcctcccaagtagctgggactacaggcacgtgccaacatgcccggctaattttttgtatttttagtagagatggggtttcaccatgttagccaggatggtcttgatctcctgaccttgtcatctgcccccctcggcctcccaaagtgccgggactacagacaagagccaccgtgcctggccaactactactcttttatatttctgggtgactttaaaatatatatataggtgtgtgtgtatgtgtgtgtgtgtgtatagatatgtatatataaatataaataaaattaactgctactcttttatatttccagcacctgaccatgaaatgtcatatggtatagatggtcaataaacattatttgataactgacattgaaattttcttttttcctttttttttttttttgtttgttttgtttttttttagagacaagatctcactgtgtcagccatgctgaaatgcagtggtgcaatcatagctcactgcagcctctaagtcccaagctcaagacatcttcctaccccagcctcctggaaagccaggactgcacgtgcacacagccatgccaggctaatttaaagaaaatttattttaagggatggggtgttgctactttgcccaggttggtctttaactcgtgggctctagtgatcatctgccttggcctttcaagacgctgggattacaggtgtgagccactgtgcctggccgtgaaattttcttaataatttttaatgaagccacttaatcctctccagactgtaaagatctctgtcttatttcgtactggcactgtaatcacagttgctgagtttattcatgaaggtgaaagtgtccctttggcgaatagaaacaaacttgggaaaagcacttctcacttcctcctgtatgtgtctttactccagaccctggcctgtgttttgctcctcctggaggccattaagtaggagtcttattctaaggattggaatcttctggagattctgtgggagacagaggacggagggtggtgtgtgttccttacttactgtcaaaattgagaaatttccctcttggccgggcatggtggctcacgcctgtaatcccagcacattgggaggtggaggtgggtaggtcacttgagctcaggagttcgagaccagcatgggcaacatctcgaaaacccatctctacaaaaaatttaaaaattagctgggcatcgtggcatgtgcctatagtctcagctacttgggaggctgaggtgagaggattacttgagcctgggaggcagaggctgcagtgagccgtgattgcaccactgcactccagcctgggtgacagcaagaccctgtctcagaaaaaaaaaaaaaaaaaaaagaaaaaggaaatgtttaggccgggcacagtggcttatgcctgtaatcccagcactttgggacgccaaggcgggtggatcacgaggtcaggagttccgagactagccttgcccacatggtgaaaccctgtctctactttaaaaaaatgcagaattagctgggcgttgtggtctgtgcctgtaatcccagctactcaggaggctgaggcaggagaattgcttgaacgcaggaggcggaggttgcagtgaaccgagatcgcgccattgcactccagcctgggcaatagagtgagacttcgtctcaaaaaaaaaaaaaaaacaaaaacaaaaacagaagaaggaaatgtttctcctcctttctgtcccatagtaggcaagtgtttgttcagttactgacaaagtcgaggcttgtctggtggtgaacatggtgcctactaggaagggctgccagctccttacacaccttgctataattagttgtaattaggcatctttcttccccagtgtcttttggaactgatagtagcagggctttcacagaacactgtgagaattaatgagttaatatttgcagaggcctctggaaatgttaagtgcttggtgttcttatcttctctctgagcttggttgccttataaggctgtccactgaggctgagggacctttgtggggaacagggccagccctgagcccagatgactgtggcagtccatgactgttcccggaatgggctcaggtttcttattttaataggaatgacactacttttttttttttttgtaattattagtgtcagtctcgcacgtactttccccccaactttactacatctatttttagcacctcatctccatggttcttgccctctcaaaaccaattatagtaaaatccatttaaacagagatactccagtccaagttaagttcttacattttcttttcctggaaagataggctacttatcccaagaattatttgaagttggttcattcttttttaagtgctgtattgaggaggagagaaaaatagtagataaaacattccaatagtacttcattttttttaaaccaatgaattaaaatccacacatattcaatagagaggtctataaaagtttgttaacttctcatgaaacagacatttccaacaatagtatgtaaacatggacatttacatattcaaaagctactttccaagatttttccctcctacccaggttgtcagtataatgacatcgatttaggctatcataggccttttgagctggaaggtcacccaagaaccgtatttgtttaacaccctcacttaaaaagatggggccactgaagtccaaggtggtgtctggaacacattccagttttttaagcaggctggacttttctaattgacattgtttttgtttgtttgtttgttttgaggcagagccttgctctgttgcccaggctggagtgcagtggcaccatcttggctcactgcagcctctgccactcaggttcaagtgattctcctgcctcagcctcctgagtagctgggagtacaggcatgcaccactatgcccagctaatttttgtattttttaatagagataggtttttgccaggctggtctcaaactcctggcctcaagcaatcctcccaccttggcctcccaaagttctgggattacatgcatgagccaccatgcctggccagcattgttcgaattgatccctatttctctctctggaaggagagtgggcatctctttctggatcccttgaggtcaagtaaaataacccctatacttttcaaattttgtaagtagagagaatgatagctactctcagcctgctccaagaagagtgctatcacaggtgaatcctgtaagataaataccaatatttggtgcggtggggagcatcaagaaagtggcacaaggttagaatgttagaacattatttcttttttcttttttaagagtctcactctgttgcccaggctggagttcagtggcatgatctcggctcagtgcaacctccgcctccccaggttcaagcaattctcctgcctcagcctcctgagtagctgggactacaggcatgtgccaccacgcctggctaattttgtatttttagtagagactgggtttcatcatgttggccaggctggtgtcgatctcttgacctcatgatctgcctgcctcagcctctcaaagtgttgggattacaggcgtgagccgcatccagctaattttgtatttttagtagagacagggttttgccatgttgtccaggctggtcttgaactcctgacctcaggtgatccgcccacctcagcctcccaaagtgctgggattacaggtgtgagccaccgtgcccagccagagtgttatttcttaaatctttgttgaccttagaaatatttatttttgtcgtgccccctcctcccccaccccctcctctccttttgatgtcatcagaacaacaggcagtgggtcattgattgctgtctatgctggctcagtggctgtcgccatttttattaatgatacacttcttttcgccagggcagatagcttgtaagtaaacataaatcctatttagaaacaatgaacaaatatttttggtgagccttggacctcctgtatctgtggatgtttataggcaatctcttgtttataggaaatggtgcagagttgaggaactttggcctcagtagtggtgggaagtgggacaaagtaggccaggtctgttgctggttagctcacttgattagaacagtatgctaatgaacccaaggtcactgggccatctgtgtatgggtcagccagctctgctctgctgggatcccagaccttggccaggaggctgggcaatatgtatcactggtcatgaggccggagcagatagaaagatcagtactaatccgtcaccagacccagaaaacaaattcaaaacacatgccctatggatagtacactatctgtggctctttaatttatgagggtatcataacagatttttgtaattttcttaaacagatttttttttctgattaataataaactgcatgttattgaggatcctgggaaaataaagtatgaggaaggaaacaaaattcactatttttcccagcactgacagaggttacattttggatttttccatccttgatgttcccttcccttggcctccatgacaccacacttggttgactttcctcttcctccctgaccccacccctacattctccttttcccctttcctcctgaatttggcttgtaaatgatagtgttccttggcactccgtcctgcctcttcatttctcgtggtcctgcattcccatggatggtgtcctttgtcccagacttctgtcctgaaatccagattcaaagatccaagtgtctacaccacttctagctggatgctaatgtgtccagtaaatgatccccttatccccaccatctaacctgcacccctgtgttcctcctctctaggagtcacagccttcacctaggtgcccagcccttcccctcccctccctgactaatccatcaccagattcaacaattctactttccaaatatctctcaaatctgttgacttacctttaccctgctgctgtcctatttcaggctaccagcaaagcttctgcacagccatttcagccttaagccactttccttgtttccagccttgtctgcttttcagtccttgctgtcttcaggagagccagctaacctttcacagaatggaaatatactctgccactctgcttaaaacctttaactgtgtccacttgccagatggtctcatctgcaactttctcctgcagaccctatgcttcagtcataccgagcttcattcacttctgataatgcatcatctctttcatctatccagtaagcatttttatggataatcaattatcagatatcaggttctgggagggtgcttcaggaaactcaagagtcttggatggggagaggccaagacagacctgggagtataggcttggctggaaagtctgtattgactggccttgggaaaacctggaataagactgcttggtgtgttagggcagtgtgtgtacacactctgccttgtgcgatgtttgacagcttttcctctggtctttgaaaaggatgactccttggaagagttattccaggagcatgttgcatagaagaaaagacatactgatgtcttcatctaagagaagtgcttctgaagttggtcaatttgtttttgtgttagccttatacttaaaattactgtgtatggggctaagttttaacgtaacacaatgaatcccctttgtaacattccaagtgatatgtgccattgcaatgtgggattttcagaattgggaaatccctgagagccaggatgtagagtgttgtttcccaataccctagtggtttatgagttgggagaattgtgtataccctagcgatgttccctgtttcttcttgggtttgttttgcatccctcttgccagataaactaaacaaaatgatgaagagtagaaaaggctgtccattagtggagttaatgtttgtgtaaatgttaatccataggacatacagtgttgctttccagtctaacagactctttggccccttatcctaccctcttggtgattttcattgttttgttgttgttgtcctttgttttgttttgttttgcttgagacagagtctccctctgtcgcccaggctggagtgcagtggtgtgatctctgcccactgcaacctctgcctcccgggttcaagccattattatgtctcagcctccctagtaacaggtgcccaccaccatgcctggctaatttttctttttgagatggagtctcgctctgttgcccaggctggagtgcagtggtacgaccttggcccactgcaagctccgtctcctgggttcatgccattctcctgcctcagcctcccgagtagctgggatgtgccaccaggcccagctaattttttgtatttttagtagaggtggggtttcaccgtgttagccaggatggtctcgatctcctgacctcgtgatccgcctgcctcggcctcccaaagtgctgggattacaggtgtgagccactgcaccctgcctttttttctgtttttgagacagagtctccctcagtcgcctaggctggactacagtggtgcaatctcgactcactgcaagctctgcctcttgggttcaagtaagtctcctgtctcagcctcccaaatagctgggattacaggcatgcaccactatgcccagctaatttgtgtatttttagtagagacggggttttgccatgttggctaggtgggttttgaactcctgacctcaagtgatcctgcccgccttggccttccaaagtactgggattacaggtgtgaaccactgctcctggccttgttttgttttttgttgggggagtttgttcttctaagagacagatggaccttttttttatttttatttttttaagctagtttaagaatacagtaaaatcttctgattgtgtttgtgaacactggtaggtttgttacaatgttaaaatattttacttctgtagaaagaaaaccaaatatatcacgatgactggatatttaagcttttaccagaacatttggaattgtccaatgccctctgttttttcttagagccttcatggtgctgattcacagtgaaccttcactacttagtcccagataactgattatcagtggttgaaatcaacgtggagatgtctcagaaaacctgttttatagaaacttctagaaagttgcaaaccaaaaaaacatgaatgtcatcatgtcatctcatttttctgtttttgaaaaattatgaagttttcagtaattgtgactttttaaacatgtaaaagtatggaagtacatccagtaaacaatgccatgtacattccccctcaatttcccaaccccatccccatttgctgtccagaagtgtgaccacagttaacggtttaatgtgcatctttttatgtacttaacatgtctgtaaatatgtcttttatcttttttgctccctcttttaaattttaacttgacgttaaagtttagaacttccatgttagtatgtgcagctgtaacacattctttttttagtagccacatagtgtttcaatgtatggatgttccaaaatatattacccatttcctgctgtaacattttaactttttagaattcaactatgtgtacttttgtaattaaaaatgtgaattttattttgcctatgtgttcttcatgaaacacgatatgtacgttggtatagttgatatgtgttaccatacgtaacacataggtatatgaagaataactacatatatacttgaacaacttatgtgctgtttaaaaatcttttttaaccatatgtcatttataatataacttgttaattctagaacttgtttaatattgagattcctagaaatgcaatttctggatgaaagtgatgtgcgtttaattttgagtagataaggccgaattgctctctacaattacatcaatttatagtcccatctagcttgtccatttctcaataccctttctaacatttgagattgtgtttctttttcttttttaagagaggggatcttgctatgttgctcaggctagcttcaaactcctgggctcaaggggtcctcccgcctcagtctccccagtagctgggacgcaggtgcacaccgcctggcctggcttagagattgtccttcttactctgtaatcattggctagaagagggcatttcattgttgtgttttgtatttttcttattaaagaagtgtatcattttcaagtgttcattagctatttttagtttttccacaatttggttatcttttgtctatttttctgttagattgcatttttgattttgtaggcactctttattactattattattattatttttcgaggcagggtctcactctgtcacccaggctggagtgcagtggcgtgatcttgtctcactgcaacctccgtctcctgggttcaagcgattttcttgcctcagcctcctgaatagctggggctacaggcatgtgccaccaggcctgtctaatttttgtatttctagtagagactgggttttaccatgttggccaagctggtctcaaactcctgacctcaagtgatccatccgcctcagcctcccaaaatgctcggcctcccaaatctgttttagtggtacaggtactcatgcacatgagtaccgctcctggccttggcactctttatacgttgtaaacattgattgtttttgtctttaatatattttagaaatattttccctagtctttttgcttgtccttttaaagataggcccctgttatcatttgctgtaaatgtcatcatctgcatagaaaatccaagattatcagttgaaaaaaaaaaaaaaacagaactaataaacttcagtaagatgtccagatgagaaaaacacaaaaatcacagggttttaattttatttttaaaaatatggctgggcgcaatggctcaggcctataatcctagcactttgggaagctgtggtgggtggattacctgaggttgggtgttcaagaccagcctggccaacatggcgaaaccccatctctattaaaaatacaaaaattatccgggcatggtggtgcacgtctgtagtttcagctgctcaggaggctgaggcaggagaatcgcttgaaactgggaggcagaggtagcagtgagccaagatcatgccattgcactccagcctgggcgacagagtgagattgcatctcaaaaatgtgtgtgtgtgtgtgtgtgtgtgtgtgtgtgtcagcataggaaagtagtacaggtagagagcatttctaatctcaaaatgccccacaatctgaagctttttgagcactgacgtaccacaagtggaaaattccacacttgacctcatgtgacaggtttcagtcaaaacttggttttcatgcacatgagtattaaaaatgttttataaaactaccttcaggctatgtttataaggtgtatatgaagcgaatgaattttgtgtttagacttggttcccatccccaacatatctcattatttttaaaatatggaaatattccaaaatctgaaacacatctggtcccagtcatttcacataagggattctcaccctgtactaatcaattagaacacataataaaaaacagataccattcttgacagcaatgaaaaacaaatttgcaagaacagcttgaagaatactgcattctgaaggacagaaaagacctgaataggtctggtgcagtggctcatgtgtgtaatcccagcactttgagaggacgacatgcatggattgcttgagcccaggagctcgagaccagcctgggcaacatggcaagaccttgtctcaacaaaagaaacccaaagaattaactggacatggtgatgtgtgcccgtagtcccagttactctggaggcttaggtgggaggatcacttgagcttgggaggttgaggctgcagtgggccgtgatcacaccactgcacttcattctgggtgatagagcaagaccctgcttcaaaaaaaaaaaaagaaagaaaataccaagtaaatggagatacagattgtatttctgtggatagatattgtaaagtctcttttctccaaattaaacattaaatgaaattctgataaaaattcccaagtactttaaacagaatttgacaagctaatctataagtcagctggacttataaacatacataaagccaagaaaatttggaaaagaactcggggggactttccacaccggatatcaaaacccattttgaaatattgtagttaaaagagacaaatcaccaaatgaaactgaagtccacagaggtaaagttactagtttaaggtcacagagctagatgggcatttttcatgcgggtcagttgaagtgtttctcagtggctggactgattgcatgtgattctaactttcagcaatgttgtagactttatcgggaggcttcttcatttcccaattagaaagatactatcttttgggaaaattacttatgcagggaatcaacctattagacatttgccgaacttgaataaaatgagaaaaggaaaatctgtcaagccttcgtgtttcatgttgtagtgttttccctgtaaatgcttcctctattgtagcagagtagttcagagttgaagggtcatcagggcagaagatgaagagagtccggggtctatctaggaacagtagttaggaatggtttagaaactttcagtcaattgacaggctagttagtattttagtgacattatcagttaaaagtttaaaatacttacctatttgaagtcatgaaaatggctaattttgatttattttcatcccatgctttaaatttatttgtgctgaattgtgaagatgatgagcttaaaagtacaggttagagatttagaatttgtatgtaattactcttgtgaaaatttgttttcttagggaggtgtgtgtgtgtgtgagagagagtgtgtgtgtgtgagtgtgcgcatgagctggtcagctgcagaaccttctggttagcaaacctgatagcatctagggtggagctaagggggaaacatgtttaatcacatactcaccagcttcctggcactaagaaattatcaccagacagcagccaccaggataatttaactttagttctggacaggcaaatgtgcagcaatcatttaaagtaaatttcttaaagaacatgtaggaattatgtcactactttgtggtgatgtttccataaatcctctatagtgtttttgttatgtttgtgtttcttattaaaaattccttaagtacaaacatcattttcaaatatcatatttagtattcctacatttgaaagccaaacatgacaaattattttttacaaattttctaggtacctactatgtgccaaggataatgtcatatcctcacatgttttatgggttaggtggaaagtattacacacaaggttaaaaaggctgttttactggccgggcatggtggctcatgcctgtaatcccagcactttgggaggctgaggcaggtggatcacaaggtcaagagatcgagaccatcctggccaacatggtgaaatcccgtctctactaaaaatacaaaaattagctgggtgtggtggcacgcacctatagtcctagctactcgggaggctgaggcaggggaattgcttgaacccgggaggcggaggttgcagtaagtcaagatcgcaacactgcactccagcctgggtgacatagcgagactctgtctcaaaaaagaaaaaagaaaaaaaaagctggttgctatgatagagataagaataaagtaataaccaggtaggtaattgagaaaaagttcttaaaagcagtagggggctgggatgggtaggataatctactgttgtttttctttttcttatttttttattttattttattttatttttattttattttattttgagatggagtcttgctctgtcacccaggctggagtgcagtggtgcgatcttggcttccacctcctgggttcaagtgattctcctgtctcagcctcctgagtaactgggattacaggcaccctccatcatgtctggctaattttgtatttttaatttagatagggtttcgccagttggccaggctggtcttgaactcctgacctcaggtgatccacccacctcagcctttcaaagtgctggggttacagacttgagctactgcgcctggccgaaattttcttaaataataataatactaaattttcttagtaatagaggtcttgctatgttacccaggctcgtctcgaactcctgggcttaagcagtcctcctgcctcagcctcccaaggtgctgagattataggcgttgagccacctcacctggcctgctgttattttatatagaaatctgcgcctcatttaggcatgagagtgttccgtagcacctcctttgtaggaacttaataatgtacaagagaaacccaaatgtacgtttctgaacaaatttaaatagatacctgagtgtggattttagaaaactttctatctgggctcattgttttcatctttttcttgtgtagataaccacacccaagaaaatcataggaaaaatacataacaaatgcacttttaaaacaaaatatcccaagtttataattcatggtattggatggatgtattttactgacacaagagttgcattttcaataaatatttctttttatctacttcatgtgctggggaaatgggtgaaacagggaattctatgatcgcagcaagtccctttcttctacaggttcattttgtagccatcatgttcattgcagctatcccaagtggggttgagaaccaggacctggctccaggtctccgagcagttgaaatgtacctggcaaagtccatgccttaggcaggagagctgctcagcctcacttccagcctgtttactctgggttctgaatcgccgtgggctttgttatctggtttcccagcctcgcctaccagttctctgtctaccagtgttgtaccagggctctttttattctttcttcgactggagatccagactctcaaacatctgtaatacttgtccctatctctttgttcatgtgttccggcaccttgtggatatttgtaggtcaccagttctgcttttgcttgaagacctgtctggcagggcttggcacctctttcctctttgtgtatgcagggcctggttgcctagctacctcggaggggacagtgagggctgggctgcaaaggggaaggcctggcaaatcctgagttaggcctgtgcttgttctctagtatgggcggggcttccaggggctcaggggccatctattgtaggagtaacggccacttcccatccatttcttctttcgtctctcttttagttatttatttctgcttgtgtctcaggaccaaacaatctgcagggtgaattggtggggaggaagttgagggttgggggtggggaggggaggacctcccggaaatagtaaatcttagtttagtttttcagagataagtagtcacatgggtcccttgccaagagagaagatctctctcaggaagaaaggcaggatggtgcgggggtttaaactaggtttgtattacaaaaatctggatgggttttttgttttttttgttgttgttgttttgtttttttggagactgagtctcactctgccacccaggctggagtgccatggcacgatcttggctcactgcaacctctgcctcccgggttcaagccattctcttgcctcagccttctaagtagctgggacctcagacgtgcaccaccatgcccggctcatttttgtattttttgtagagacagaggttcaccatgttggccaggctggtctctaactcctgacctcaaggaatctgcccacctccgtcttccaaagtgctgggaacaggcatgagccaccatgctgggccttggatgggctttgatgtcttcatagtgcatgagttttgggtcagccagtgttaggtttgacatcctggtctcctaacctggctctgacacttattagctgtgctatcttgggcaagttactttctttgaagctagttcttcttgaataaattgggaataacaaaatccacaacatagagttgcatatggatggtagcgataattatagatcatgcctcaatagaatgtaaataggtgctcaacaggtggaaagttgctatcattgttataattatttgaaaggggatatcactgagacatgaaatgagggcaggttatagagcagtcggtcaataagcccagcttttgtgacattggaaatttaattataagttagttactaagggtgcatggttatactggattcataactaggttcatactctgctccgtttggctggctaggtgatctttaacctctctagatcttaatcttttcatctgtttgtaagaagagaatgaggataataatgcctacttcgtggagttgtgaggattaaaggagatatgatatgtaaaatgttacacagtgtctggtacagaatttgatctagaaagaaggcccttattattagacatagtaacctttaaagcacggtaaaagcggtgctcagtgatcagtgacaatttcttttttgtgctctagtcctttgaagcatggctgttgtatttccaagttttttgacactcttggattttattttcttgggtacacgcgcgcacacacacacaaattagcattagcccattattaaatattaactttttattccatgtatttatttatttatttagagacagggtttcactctgtcatccacccaggctggagtgcagtggtacaatttcagctcactgcagcctcagcctcccagactcaagcagtcctcccacctcagcctcccaagtagctgggtctacaggcatgcatcaccacgcccaactaattttctgtagtttttgtagcgacaaagtctcactatgttgcccaggctggtctcaaactcctagactaaagtgatcctcccgccttggcctctcactcaaagtgctgagattataggcatttattccattattactacttttatggaaattcctatcttccttcaaaagctaaggctaggttccttaatatattgaaacgtatatatagcatgagtcctctctgcatccataatttaagtatgtattttatatgtgtatatttgatatgtagcgtaattttaatttcttttttttgaaatggagtttcgctcttgttgcccaggctggagtgcaatggcctgatcttgactcacaacaacctccgcctccctggttcaagcgattctcctgcctcagcctcctgagtagctgggattaaggcatgtgccaccacgccccgctaaattttgtatttttagtagagacggggtttctccatgttggccaggctggtctcgaactcccgacctcaggcaatctgcccacctcggcctcccagagtgctaggattatgggcatgagccaccgagcccggcccggtggctttttttcttaaagggttttggtaagagttagtgtacaatttgtcaggcacttcctacgtcccagatattgttctaaacatttttacagacattaacttcctaagttctcctaacaatcctaggaggaggtacagttctgagccccatttcatgggtaaaaaaacagcagagagggaaattaacttgcctgaggtcacacagctgtaatgtgatcaaggctggcctttgagaccaggcggctgctgactcttatcgatggtgttgttcttaaccaccactctatgctgcttcccaccgtgcccaaagagtgcctgcaggcttctctgtctctttcctgaaaagttacttacagtcccttgactgcactgctttaaagacgcagcacggagttcagcagtgaaatctggcagtgccggtgctgaaagatgtgaggattttgacagatgctggagatgctggctcaatgttcatgtcccaccaggggccaaattgcccatctgtaaataaggtttcttgtcttcagattccgtggtgattatttttttcctcagggaccagtcatccttttaatcttgtggtagaaaattaaaatgagtttcactgaagtgtggttggatttttaaagtttcttttaaatattactttagagaagttaattaagtacctgccctgtggatccagcttcctgcattttcctactgttttcactgtttagacgggaggcttttcttaggagaattagattacaaattgaagggtgaatgaataccttatcggcagatcatgaacatttggggtcctgaataggtagcaggcttgcgtaataggacctgaataaagttaggcaaacatgactatctctgatcttaaaggcattgaacaggctgaggttaaagtgtttgtcgtagtttctaaaagtcaagggagcgaggaagggagagtttactttctcactttgcttgcagtgattttcttttttttttttttttgcttactatgtcttggggtttctccaggtggtagaggttgctcggaggtctgactcccagctggcttgaaagcagtgattgttcatgttttgggggatcgttgatccctttgagagtctggtgaagcctgtgggcatcctccccagaaaacacacacagacatacacacaatgttttgttcatgggtctttaagggccacacacctaggctttagagtatatggcaattcaacatcagaacttgtttactgccccttccctttttcttttgttttttgagaaggggtctcgctttgtttcccaggctggtctcaaactcctggagctcaagcaatccccctgctttggcctcccaaagtgctgggattataggcatgagccaccacgccaggccgacctccccttctgtgtgccgtcctcagcctgggcctcgtggctctaaaattaagctaatcggtgaattcagctattgttcttaatgtcttgtttgtaccccagaattatttgcatttgaaagtcttcagaactccatacccactccagctctatcacatgtgatcacttcaggaggtaactataaaggggaccctgctttattggccattcttagccaaatgggcattgatgttgaaaggggtccaggtagctagcctgtcaaatcttcacagtgctgtcccctccctgtctctccctactgccacactgaattccctcacctcacactgagttcactcacctttacgtatttcagcacatcttgttctttacctggaatgcccttccattcttcctccactacaggaatgcctgctcgtctttcagtacccagatcaaatggaagcctcgctgaactcccctggcaaactctctctcttcctgtctttccatggcaatttttaaaggtctgtgttacagcatacatatcatgttgtaattattttttatgtgtttggcagactccaccgcctgtaaactaagtgcttgtcttaatcgtctttgatcatgcagcatgttgtcaggtgctagatatgtttgccatccagagtttatacaagtgggttgtggggttagaacacaggacgcagattctagctttgtgacttgccatctctttgtgcctctgtttcctcaggtgtaggcttgttggggtgggggagaatctgagtaaagtggaatagtacctagtgcatggtgaaatattcagcaactaggccaggtgccatggcttatgcatgtgatcccagcagtttgggagactgaggtgggaggatcacttgaagccagaagtttgagaccagccttggcaacaaaatgagaccccatcttttttttttttttttttttttgagatggagtcttactctgtcaccaggctggaatgcagtgatgcgatcttggctctctgcaacctccgcttcctggtttcaagcaattctcctgcctcagcctcccgagtagctgggactacaggtgcacaccaccacgcccagctaatttttgtatttttagtagagatggggtttaccatgttggccaggatggtcttaatctcttgacctcgtaatccgcctgcctcgtcctcccaaagtgctgggattacaggtgtgagccactgcacctggccatgggaccccatgtagtcccagctactcaggagacagaggtgggaggatcgcttgagccaaggagttggaggctgtggtaagttgtgatcatgccactgcactgcagcctgggcaatagatcaagacgctgtctcaaaaaaaaaaatcagcagtgttaaccattgtgatatttaatcataacattaagcatatcattgagtgaatgagaaactcttaaaaataacccagcataattggagagaacattatatagatgtacagaaattaagttaattctgcattctccaagtttaatctcagcatagataaaataaagaaatctaaatttacagggctcccagagaggttcggtaggacactctataatctactgttcatttccttatattataaagttaactggcatctgtgtgaggaccttaagccatttacaagtacgtactgtgggaatataaggctttttttttttaagggtaagaaaactcatgtacactattttaatggtatgatttaaatgtgttcaaaaaccttgtgtttttcaaatcccttttcaaagtagccccaataagctggggagtatgtgtgtagtggcgtcgccatttgtagctccactagtaacatgcaaagcacatgggaatccatgagaaacaatcatagaagcatctgcttctgcttctaagacacatcaaaggtggtgagaaaaaagatgtcattgaaggagctctttccttagtgtattttatttgtaggcaggatagaagtatcctgctaaagtcataaaatagaatagtattttagaattagaaggagcttgactagtccagccccttcttgctttacagatgaggaaactgaggtcccaaaatgtggagtgatgtcacattgtgctggggatgtggagaggggtgtttgtcatcacgtggatggccacgtggctggctggggggcctcagaggggaccttctattccctctttatacaggagcccctgtctgtcttaagcacatggcttgcttcttgaaagctttcctggactccccaggcagtatttcctttgtgcattttaaactaaattttgactaaattaaaagcaatgaaatccaggcctcctggaagggtatttagttttcctttttagcagaacagttaagctaatgacagtgttagaagcctcaaccaccccatccagtgattgatatacatgcccccaaatttttgtagtgaaatataaaaacagtctataatctgattttgtaatcaaggtctagccaattacagtacatctcaaaaagtccttagcaattgggttgttaagtcacccagcaaaatccctgtcattgacttccttggagccatttcctttcatgttttggcttcttggtgtctacatagtttctaagatagcagcccaataaattgtgctattatctccaggtttccacatcttacatatggtatacatttgctgttgtctccttttcaaaatgtagtccaatttgtgactgtttaatttttaaagtgaaagagggagaatgttttagaagaagttaaataatttaaaaattagatgcccaagccctagtaactttgatttgtggaaaaatacttttgattatagccatatagttacagaatctatacagaaacttggcaaatttgaaaatctgaaatctggcccggcgcaggggctcatgcctgtaatcacagccctttgggaagccgaggcgggcagattgcttgaacccaggagtttgagaccagcctgggcaatatggtgaaaccccatctctacaaaaatacagaaattagctaggcatgatggcgcccgcctgtagtcccagctactcgtgatcatgccactgcactccagcctgggttagagtgataccctgtcttaaatggatggatggatggatggatggatagataaataaattaaaaatctgaagtcttatatgtccccctgttgtcaatagagaagagaatcatactactttatacccatagtatctctggaggagtaacaagttgtacgtcttggttctattctgtaacatggaaccaaggtatttgcaagctgacagcgaagaagaggcttcattgtgcatattcctacactgtattttttggtacatttttcagagtttgtaaagaaaacatcttgtactgagtttttaataacttttcatccatttcccaatgtacagtacaagtatatcaaagaacaaaaatgcagtaatccagcattgtcaaaatcactgctatttaaatgctgtatgaagagagtagtgtttaagttcctagtagctatctcacttatttgttggctgtggtagagtaatcattgtggcaatcattttatacatgtttgagttacacatatagctttgagggacatctactaacaccatatttagtggtttctcctaaagactaaagttatagcctcatgttcatttacttagaaatggataaaagtactattaatttaaaaaatacctatgtcttatagttcatttattccaaaaagatatatcaaatgcctaccatgtagtaggcactatccaagttgctaaaatttaaagacgaataaaacaaggccttcttatttggtgaggttgatgaaaagtgaaagcagatgattaaaatgcagtagcataagtaattatttgtgagtgtatttttaatgtatgaagcggttttcagatgtattctttattagtctcaatcacttgcatttccttgaattgaatgggagaggaggaagatgtggggttgcagtgggttcactgggaagcatgcattattctacatatactggggagcacatggtataactggcagagtgtatccagggggagaaaaaatagcatgttggttcttgattttattgtgtggcatagggtgtcacatagtaaggggacaactcaaatttcataggaaagattgccttacttggaatgtagagtcaaggcctacacccaatcccctgcatttctttctttctcctttctttcttttctttttttttctttctctttctttctttctctctctttctttcttcttttctttttctcttttctttctttttctcttctctcttctcttctctcctctcttctgtcctgtcttctcttctctttcttgagacggactctctcattctgtcgcccagactggagtacagtggtgtgatcttggctcactgcaacctctgtctcctaggttcaagtaattctcctgaacctctagagtagctggggctacaggcgtgcaccaccatgcccagctaatttttgtatttttagtggagacaaggtttctccgtgttggctaggctggtctcgaactccagacctcaggtgatccggcctgcctcgtcctcccaaagtgttgggattacaggtgtgagccaccgcgcccagccctctctttcaataatagtacttatcagtatatttattcctgattatacaagtctgctatgtcaagtaagagtttaaaacattatttgggccaggcattgtggctcacacctataatcccagtactttgggaggccgaggtgggaggattgcttgagcccaagagttggagaccagtctgggcaacatagggagaccctgtctttacaaaaacattaaaaaaaaaatgttagccagacatgatggcatatatctgaggtcccagctacttgggaagctgaggtgggaggatcacttgagcccgagatcaaggctgcagtgagccatgatcacgccgctgcactccagcctggacaacagagtgagaccctgtctcaaaaaagaaccaaaaacaaattttattttgacatttcaaagactttttcttttgaaccaaccaatctcttacttattaacaaagtttgaagtgatccagtagttgtttaaataaactgactctcccggcagaaagtaactattttctatcccattgtctgatgagatgctctgagtctttggttagatggaagactgcagacaagttagccctgcatctcatttacataatattttttactcttaagcaagaaatcttcaccaggtcctcttgtgatctggtgctgacacagaaccatgaccatagaggtgcccatgacttctttctgtgtcccttgaggatgttggtgccaaaggctacttaaatcctccttggaaggaaacgatttcatcagtcaggaattattgttttaatttgtgtcatttacctgttttgccttcctatcgcaactacctccatgaaagtagttatattgaaaaaagatgcttatattaaaatcagataggctttattaataaagtgtagtgtgtaggcttctatgactaatacatagtttaaagtcagggtaatagctggtgtaatgaaaccaaataaagtttctggctcattcataactgtgcagtagtttcgatttattctttgttattgttgaccaccttgttcttgttagaacaaggcagggaataaataaataaataaaacgattccacattattttctgtttgcctaaattgcaacataaggaagcaacaaaagaaagatccttttcgcttaaacattctgttgatccaagaaaaatcacacagggtctggaagcaacttttatttggagaactagacttgagtacgttcaactgaaagccaatgcaagcttctgttcctctaaaatgatgtcttttgcctaagaatagacccctctttcagtctaaaaaccagataaactgtcctacagtgattcaaatagccagcggcctcactccccccaaacttgactaacaacacagcaatataattctaccgtttaaaacttggctgacccaaacgtgaactttcaaagaaaataagagtcattactaaaagagattccatttctttctggggcctaagttaagatgactttccagaactttgaaaaaacttactctttcaatggccacttaattgtgtaacaaagtaaacattcacaagggaggcaaaatataacattccctatgtttagatttttcaaatatctttaaggggtgcattttctttgttgggttgtcatatgtagtttggagtaatttaccaggttctacccaaaagttgtatcatgatcaaggatcgcttgaacccaggagtttgagaccagcttgggcaccatggcaaaaccctgtctctactaacattacaaaaaattaaccaggtgtggtggtgaatgcctgtggtcttagctactctgaaggctgaggtgcaaggatctcttgagccagtgaggcagaggttgcagtgagctgtattcatggccatagcacttcagcctgggtggcagagtgagatcttgtcttaaagacaaaaaaagaaaaagagggtgaattctacctacctggcaggatcattgggataattgcatgaacataggatctgattcaccacctggtacatagtaggaattcatgatattgtagctgttcttataattattaatttgacctggaacttccatgtcctgattcttagatcttgcatgattatacacgtgttatctaattgatgaatttcaaatatgatctatttcaacagttaaatggctgaacagtcattaatttcaggtggtcctaaacccaaatcagtaaattctttgaggtggataaacctacatttcatttgtagtttaaaaagaaaaagtgaaaaaagtatttaaagtcctgggtcatggaaggcggagcttgcagtgagccaagtttacaccactgcactccagcctgggtaacagagcgagactctgtctcaaaaaaaataaaaaataaaaaataaaataaaaataaagtcctgggtcgataagtgactttatccttctaaggtataaaatgaaggagctacactagatagtctctaagcaaccttcaaactctgaaattctgtggttgatattaggtccagtactggggatctgtgattttttaattgctacaacttctaggaaatgaggagtatcaaagattgttatgggagagtgggggtaggggagttactatcattggtcttttgtgaacaagaccaagaacaaaagaaataagaacaaaaaagaacagcaagccgggcacagtggctcacacctttaatcccagcactttgggaggctgaggcaggtggatcacttgaggtcagaagttcgagaccagcctggccaaagtggagaaaactcgtctccactcaaaatacaaaaattagctgggcatggtggcaggtgcctgtaaacccagctacccaggaggctgaggcaggacagtcacttgaaccgggatggcggccactgctgggagcggagatggcaccactgcactccagcctgggagacagagcgagactctgcctcgaaaaaaaaaaaaaaaggcaacaaaaagaagtcagtccagatttgcagaaataacaggagttattcccatataacacacacacacacacacacacacatttagttctcaagaatagttttctctggcagcaaggattttagggaattccgtttaatctgcatctaagggttctcatgggacagggaaaggaagacatcattgtcctcaggaatttataatctgtgatcagcagaaagacataaaatggaagtgttctaagacatatttctgaaggatgaacttccaaagaagacatccatccatccatccatccatccatccatccatccatccatccgatccaaatgcttacaggttaagcatcccttatctgaaaatctgaaatgctccaaaacctgaaactttgagcactgacatgacgcctcacatctcaccctatgtgtcagtcaaacacagtcaaaactttgcagtcaaaacttgtttcatgaacacaattacttaaaatattatataaaattacctttgggctacacatatgaggtatatgtgtaacgtatgtgaatttcatgtttagagttggatcccatctgcaaggtatctcattatgtatatgcaaatcttccaaaatctgaaattgaaaacacttctggtcccaggcatttagataagggatgctcaacctacactacttgtggaggtgctaagctataacaaatactctctggaggcctcttgggatatgttgcctgttgatttggttaattctgtttcataaatcacagattgttgtaatctcatggtaccagtattttatgatacatgacatagattcaaagccttttgctacaatttaagattccattcatatcagtaatccttgtgggtcagagggtactgtgttggtgatatacacagacaactaacttgtggaagcatagagaagagagacagcagccaatggggatgtatgcacaagcctatgtgggggtggatgggtcaatggagtgatgagttagggaagactctacatcaagaatactcttgaagagtcttcaaagataaatcagtgactggaaggaaaagaaacaacctttggttagataattattattttttaagagatagattcttggctttgtcatccagcctagagtgcagtggtgtgatcatagctcactgcagcctccaaactcctggcctcaggtgatcctcctgatttggtctcccaaagtgctgggattacagttgtgagccactgtgcctggcctggttagattatttaaattaggactatattgatctgaaatataaagaattgggggaatgtgggtaagtacagggagacaacaacaatttttctgactcttcttagtccttatgtggaattcagttatttccaataattagctccttttccttttgaagaaaacaattgtcttttctcagagtaatgacatcagcctcctcctttaatcaggtctttttttcactttccccctttttttcactttccccaacctctaagcatttcctggtactaggagacttttattgctcaagctggcccattttactatggacagttccaatggttgcacactcctgggacattcctgtgacttcatgcttggtatgatttctaccttgttgaatgactaccataattaacctacttctctaaaaatatttgaaagctgctgtctaatttctcttgagccttgcttttttctcctttaggctaaccatctctacctccctcaactactttcataggtcatagtttccagttcctttactagcctgattgcttttctccaaatctccaactttaccctgtcagtcgtcagttggaatcttgtgctctgagcatagctgttctatgcaagaacaggggaggactatcactttcctgtatctaacactaataccacttaggactgcaatagttttctcagcacacgtcactttgtttccctgcttctccaagtctagggtatgcagtgtgcctgagcttgctggtgcccttgcattcttccatgcagttgtggtttgcttgtgtttttgttttaaaaagaattcgttgtgtcaaatttataaaggagttggattttgttctaaaagaggttcttgcttaagggcacgtaataaatatttcctgactgtaactgaataaatattgaacctttacgtgtttacactcccttgtcgtgatatatgtagctttttttttttttttgagagggagtcttgctctgtcgcccaggctggagtgcagtggcgcaatctcggctcactgcaagctctgcctcctgggttcacgccattcttctgcctcagcctcccgagtagctgggactataggcgcccgccaccatgcccgctaattttttgtatttttagtagagatggggtttcaccgtgttagccaggatggtcttgatctcctgacctcatgatccgcctgcctcggcctcccaaagtgctgggattacaggcgtgagccaccgcgcccagccgatatatgtagcattttgacctagatttgttgggattataagtcaaaatgttaaaattgatcttatcagagcctgccacttggaaaaataactttacttcagaaaaattttgtattgaactctttgaaggcttttttaaaaacgatgttattggctgggcgtggtggctcatgcctgtaatcccagcactttgggaggctgaggcaacaggatcatttgaggttaggagttccagaccagcctggccagtatggtaaaactccatctctactaaaaatgcaaaaattaggctgggcttggtggctcatgcctgtaatcccagcacttcgggaggccgaggcaggtggatcacctgaggtcaggagtttaaaaccagcctggccaacatggcaaaaccctgtcgctactaaaaataaaaaaattagccgggcatgatattgcttgcctgtaatcccagctactttggaggctgaagcaggagaatcacttgaactcgggagatggaggttgcagtgagcccagatcacgccactgcactccagcctgggtgacagagcgagactccatctcaaaaaaaaaaaaaaaaaggtagccgagcgtggtgggcacatgcctgtaatcccagctactcaggagactgagacaggagaatcacttgaacctgggaggtggaggttgcaatggaccaagattgtgctactgcactccagcctgggtgacagagtgagactccgtctcaaaaaaagaaaaaaaaaaagttgttatttttacttaggaaatgatttatctattttgcaagttcatcttagagcacaattatagctatttattacttattattcattcctatcttcccctttcctctgataaataacctggtagtttttggtaaaataagctaatcagcagggttctctaaataatacagtctcatgcctgtaatcccaacactttgggaggccaggacatgaggatcacctatgtagccaggagtttgagaccagcccgagcaacagagtgagccaattgcttgtgttggccttttactttccatgttttaggttagtcattacttttatcaggtacagagtataaccaagtggatttttcccttctgtcctccctgtacaatgaaggagactgaccgtaagtggaaccaggaagtgttgacgtggtcattactgcaaggaaggaggaaaaatagcagccaaaaatgccatttacgtgaaacttgtgacttgattgaggaaacatttgctcaagcaaaagcttaactgactacctctaaactgaggaatgtaagaattaccatatttacttctgcactagaattaaattctttgtgtgatcactgtctttagctcttattctaacacactggggcataatgagagaggcatttgaatgcagatattatattattctaccttaataaatgtttttctttgtctttgcaataatgatattattagataggcttgatgtcccatgatttttgtcatcaagttcgcatcgtatctatatagagagataggaagatgcgatcttactttttttttatttattttttttgaaatagccttgctctgccagccccggctggagtgcagtggtgcaatctcagctcactgtagcctccacctcccaggttcaagttactctcatgcctcagcctccttagtagctgggcctacaggcgcatgccaccacacccggctaatttttgtatttttagaaatagagatggggtttcaccatgctgtccaggctagtctcaaactcctgacctcatgtgatccacctgctttggcctcccaaagtactgaaattacaagaagatgtgacttattttaaatgtttgtttgctgagggggaatatctgagtttacctttaagcgtcaaaaatactctgatactgcagtactagttgttattttgttcttatttgagactaaattaacagctgtagtcagttactatgctcaggaaataatgtttggagataaactttgtgtgtgctctccgtacatttcatagtatcatttaaaagcaaacctctttaatcaaagtcaaaaggaaaggatgtgttttctttcttccatgtttcttggcagatcttacaggtgagtgggaagtcatgaatgggcaatttccaagaagtacaaaagtaattttgttcataaagcaaaatattttcctttgattcatgatttacaaggaaacccatagcttagcacctacgagaaactttgaataggctgactttgcagtgagggtctcaaagaaggaatgcggtgagcaaatcttttgacattgtgatgatacattcttctaaaggttaggaggaaaaacttctttcttagagtttggctcccccacaccccctcttgcttccctcttgctaattgcccgttttttgacttttttttttccttttgttttgtttttgttttgagaaagggtctccctctgtcacccaggctggaatgcagtggcaccatcactgctcgctgcagccttgacctggctcaggcagtcctcctacctcagcttcctgagtaggtatgaatatagacatgtaccactttgctcagctaatttttgtattttttgtagagacggggtttcaccatgttgcccaggctgtgcttattttttataattaaaaaaaaattaaagccaggtgcagtggcttacgcctgtaatcccagcactttgggaggctgaggcgggattacttgaggccaggagttcaagaccagcctgagcaacatagtgagacctcgtctctacaatcaatcagtcagtcagtcaatcaatcagtcattcgatcaatcaactgcagtaaagtacacaaaacaaaagtttaccatcctaaccatttgtttattttattttttggagacggggtctcattctattactaaggcgggtgtcaaacttgtggcctcaagcaatcctccttcccaatgtgctaggattacgggtgtgagccactgtgctgagccctagccttttttaagtgtacagttcagtagtgttgagtatattcacattgttgctccacaacttttacatcttgcaaaacagaaactctatacccattaaacaacagctcgctgtccccacatccaccccacctctaaccccttggcaaccagcattcttactccctttttctatggatttgactagttagatacatcatgtaagtagaatcattcagtatttgtctgttactggctttaagtcagcctaatgtactcaaaattcatccatgtcgtagcgtgtgccagaatttccttcctttttaaggcttccatcgtatttttccatccttctgtcaaatggatgtttgggttgcttccaccacctggctattgtgaataatgctgcaatgagcacaggtgtgcaaacgtctttttgagatactgcttttgttctcactgggtctactactactgggtaattgtttttgattttttgaggttctccatagcagcttgcattcccaacaacagtgcataaaggttccaatttttcccacatctttgagaacacttatttttttaactttttttttttttttaagagataggttttcactatctcacccagggtggggtgcagtgccatgatcatagctcactgcagcctcaaactcttgggctcaagggatcctcctgcttcagcctcccaaagtagctgactggctaggaccacatcaccaccacagtcccccgccccgcccccctccagctagtttgtttttttgtttggcttttaatttttttgtagagacagtgtcttgctatgatgcccaggctggtcaagcaatcttcccgcctcagcctttcacagtgctggaactacaggagtgagctaccctgcctggactattttgagttttgatagtagccgtaactgtccatttttaatattaaccgtaatgatgaaataactttgagcacctggggttggacaaatgtgagatttgtgtgcgatctgcaaaggtagagttaaaatttttttctttcacttgctcctaaacactgttttggggtttttaaacttacagcgggtctggtgcagtgtatcattgtttcttcttgattttcagcacagtctgtgtgggactgtgtaggtagaaaaagcagtggaacatcatggtagctaaaattgcagatctcaaacttggcagaactattagaaaaaagtaaagttcagtagaacagattgtgaggaaagcattattcatgtcacaagagtttacaaataacaggtgtacaatgcactgggatgtttcttgcccattaatggaaatgctctggagactgtacagtcaagaagatggataaggtggtagatctcttccgctctctcccgtgattgattttttttttccctcatactgcctaacttcctctgttacagacgctgggtagtatcaacatatgtttccttatcgttcgatctgaaaaataaaccctccaaaaaattaaaaaggggtaaaggaatgttctgatttatctgccatcaatattttttattcgtggattctcttaataccatatcagaaataactttatttttctttttttgagacggagtctcgctggagttcagtggcacagtctcggctcactgcaatctccgcctcctggattcaagcgattctcctgcctcagcctcccgagtagctgggattacaggcgtgtgccaccaggtccagctaatttttttatttttagtagagacggggtttcaccatgttagccaggatggtctcgatctcctgacctcgtgatccgcccgcctcagcctccccaagtgctgggattacaggtatgagccaccgcgcccggcctattttttattttgttgtttctttttgtatagtcttgctatgttgtccaggctggtctcgaactcctgggctcaagcgtgggaaatgtctgacctaagagcgcgtggctactgagtaacaattctaaacagtatttcctgggcctttactgtgctagatgttccctctggtgatacaggcaaacttaagccaaaatatgaaataaaacatttaggcttctttacactccattttctccttccctgcctcaccaagtctcagtcgcttttcaccttggcccttcgttttgttgcactctaggatcctggagccttgcaggtttttctcagctcattcccactcctttcaccctcaccgtggcaactccagaatgtgggtttctggcgctttatcttctgtttctgtaaaccttcgcagccagtcgctgccttttccattttaattgcattctcccacccccgcagtcttcctggaatgcttcctgttttgttcacggtggggccagtcctccagggatccgcatctcttcgtttgccttcgtctggctgagccgggctggtgcgctgagctctaggtgcaggcggaagctgggtcaggtgcgcggccgcacttctggttgcgcggcccacactggccgccattgtggtggaagtcggagcgagtctcctgggcccgaaccggctgttggaagtgcgagggcaccgagagccacggtacctgtgagggatctctttaacttcctcagatgggatgggggaaagatcagagggtgacacttcgggtgaccgatgcctgaactggggcttccgggggaaggctatagaaagacttggcgataagctctccgaccgtgactcctaccattacttttatttacttatcatagctttttaaaaaactttgaaattaataataattcccctgaaatatccacctgtggcagtggagcaatgaaagcacgtgcttaagtattctcgtccacacagttggcagtggctcctccgtacggaaagcagttgtgatagagtcacctcaagccctgcagcttctccacaacccgaatctggaatatgttgcgtggatattgcctttttgtaaaatattggaatccgttggcccaaagtcaatatactcctaaactgtaatacttaatattttttctctgaagactattttaaatagttttttaaaatggtgtcctgcactaatgtttttggtaattatggctaaaaaaaaattaaaaacctttaatatgcatgatgtaaaaacaaaaggttgcgtagtatagtggttaagagcccaggctttgaactgcttgagttcaaatcaagctctaacaccagctgttttgattttggacaggttccttaacccttagtttccttagctgcaaaatagctcctatcttgtagggttgtggtagggggaattgggtagatacaggtttacagttgcttatctgaaatccttggggtcggatgtgcttaaaaatctttcaggttttttttgttttgtttttgtttttaagacaaagtctcgctctgttgcccaggctggagtgcagtggtgcaatctcggctcactgcaacctctgcctcccaggttcaagtgattttcctgcctcagcctcctgagtagctgggactacaggcgtgcaccaccaccacgtccagcgaatttttgtattttagtagagacaggatttcaccgcgttggccgggatggtctccatctcttgaccttgtgatctgcccgcctcggcctcccaaaatgctgggattacaggtgtgagccaccgcgcccagcctcagattttgtattgatttattaattcactgagacagagtctgtctctattgcccaggctggaatgcagttagctcactgcaatctccacctcccaggttcaagcgattctcttgcctcggcctcctgagtagctgggactacaggggggcaccaccatgcccggctaatttttgtgtttttagtagagccgggtttcaccatattggccaagctggtattgaactcctggcctcaagtgatcctccggccttggcctcccaaattgctgggattacaggtgtgagccaccacaccctgcctctttcagattgtaaaagataacatagtacataacccataggtaacataatacagcaatgtctaaggtagcacatagtaactaagcacattaatttttctgcagtgaaacatgaataatacactaagcgggataaattaaagctataaatagttttacatcacttcagatcaggttttgccacccagtgagtttgcaccgcccttctcccagactcagcactataggctttcagagcatttagattttggagttgtggattagaggttgtggagtcatatgtaaaccatttgaacagggcctggcatttagtaagcaccctataaatgttagtgcaaaactgaattcttcctatactttatgactagattgttattatttaaaagagtagtttaaatcatagtggtttaaagtggatgtagtgaaggcctacataagtatctgtgtgtatttttcgcatattatctcatttgggtttcaggtctgtttttcccatggtaaaagaacaagaaagacagaacaaagaaggcagagcagaaaagttccatgttcctcctcactccatcttgcctagccaaaacaattgaacagtttcagatatctatttcaaagatttcagataagttctaaaatgttttcttttgttgtgacttcagccttgacttgcctctactcttaagcacacggtaagaaccgaaagccaccctgtgcatcttaaatcttttaatctgctttgctgccaatggattatttctagaacatgatggtgtagaaaattcttaaattttaggcaacttaaatgcttctaagatttttttttttcttaccaaagagaggtggcttctgagttgaggactgtggggttgatgtttcatgtgagttcatggctatattacatttggcctgaaagtctagtgatctggtatattttatcctgtgatccattaatatctattgaaaatacactgtagctcttacagtgaaaaataattagacctatttcatcctctctttctacttaatacacatatttacccagtctaagcctgatcaaaaggacaatgtgggaatgcatgaaagaataatgtgtgcttttcaaaagataagccagatactggaagcagaaactctgaaggacaaagttaaaatctaaaggtaaatcttgctatccttgtgtctgtaagatacatagattgacaaaagtaactataatacagagctatttagataattcaaaagaattacatctttagattattttattggcttatatctgaagaactataagttccatttttatgcataaattagtagcctattagtttcttttaaaaattctctgtagatggaaagcttacattggagttttcatcttttctttctccttgccatttcttcatcagttatctttagtctattacatgtatacacacacatatgtagatatacacacggatatatatatatatatatatatatatgtattttcctgaaacaaggtgttgcactgtcgcctaggctagggtgcagtggtgcagtcacagctcactgcagcctcgaccaactgggctccagcgagcctatatcaccttagcctcctgagtagcgtgtagtacagaccaccactcccagctgatttttgtattttttgtagagatggggtttcaccatgttgccccaggctgttctggaactcctggactcaagtgatccacccgcctcagcctcccaaagtgctgggattataggcatgagcctctgtgcccagcctgtaaatacatttatgtgaagactttgctaaagaaagagacaatgaaatcagtgaagacaccaatatggtacatgaaaaacaacttggagcattaaatcaaaattgccaaagatcacctttttcaagtgtaaggcttgtttctttgtatacacttatctcttttgcaacttcatgttatcctgatgtctgggatattaactttaaagatgattttatcgttttattatggtagttattccttcgttcactttcccctttattgtggttaatctgcgaagtagatttggtcatgtaatacactttatttttagcagtctcacagtgtcgtaaatcttgtattttattgcctttaatgtaagaatgaaggccagcaatcagggtgaggctgttctgtttcaaacttgacactcaaaaactaacttctgtgttttctattttaaggcttactacaggtagactacttcagccatcaattaaaataagcttttcttaaaaatgagatgataattagtgacagcattagaatccctaatagtgcgtgtatgtgtgtgcatgcacgtggatgcagtatgatagtggctgcagcgacagaaaaccaaagtaatgtggcttaaccataataggcatttatttctctctcatgtaaaagcccgaaaagtggtctatatttatcagacttttttgagacagggttttgctccattgcctaggctggagtgcagtggtgtgatcctagctttctgtagtctcaacctcctgggctcaagcgatctacccacctcagtctcccaagtagctgggactacaggcacatgccaccacacatggcttgtgtgtgtgtgtgtgtgtgtgtgtgtgtgtgtgtgtgtgtgtgtgtgcgcgcgcgcgcgcgcggtggagggtagtggggtagagatggaacttcagtattttgcccaaggtgactttatattttgattctctgccatcttcaacaggtagctgtcatcttatgatctaaggtgggtgctctacttcccacagtcatcttctaggcaacaagaaagcaggaaaaaagctcttattttatttttgattttgttgcataccaaaggaatgttctcttttcaaggcaccacctggaagttgcaggcatcacttctgtccacaccataggccagaatttactaatatggtttgagtatccaaaataatgctccagaatctgaagctttttgtctactgacatgatgcccaaagggaatgctcaatggaaagtgtaattgcaaatatcccccaatatggaaaaattcgaaaactgaacacttctgggcccaagcatttcagttaaagggtactcaacctgtacagtattaactagcaagggaatttaggaaatcatgtgcccaacagaaatttattactacataaaatagagaatatattagaggaagttagcggttagaatagtaaagtgtgtaatagtgcaatgttttgtgaattttggatactcatcattataaacatctgacaaaaagactgaactgcattatagagctgctgggttctataaatcaccagtcttgagcatccctgcaaagtatttccttccagcctgtcacccatgtagaaaaagatctcctaattcttaatttaggaaagactttgtaaggagacattattatattaagaagtgaaacatacgataaaaagaaaaatgaattccataacaaaggggagaaagtaaacgtctattcaactttcattgaaataaatattttcagaactttattgtgtctatacaaaattgtatctgcatctttttttttaacttagcaatgaatcttagactttatatcagtaatggagatctaactcattttaaaaatgatacgtagtaatttggggaattttaaaacagtgttaatacataactgtcacatatctcttttgtgattacatttttttgctagatgatggattatagatagctctctgatacaaacaggagatttctaaaagcctcttagtcctcttacctcagcaatctatagtccatcctttcagtgttcctaaatttcctctgtgagaatatatatgctgttaaaagttaaggggactctgacacggaaagcaaataaacaaaaattattagatggtttacaattgtagtgcccactgtttaattcagaatggaacacagaaaaataaattaggcttgttctaaatgtttgcctaattcttttagaatattagaatttaacttattagctgtatgttgggtaagcattgcaagagttaacttgtatttgacatttttcacatgcccttaacattaagcatgtgtgaggtcttcctgtgtgcatatttggatgtacagcctaactgaggtggaaaacaccaagatgtttgcagggcagatgcattccaagtatgtgttcttattgctcttcctgccattggcttcaagatgagctgtcctgcctgttttcagtactagtcttaaaaccaggtccttttccattccctcccatcttgactaggttgcctctcaaattcaagtcaaggcatgttttctgtcaagtatacactttcaagatgaaagcagcagtgcacgaagcagagaaaaaagcctgcagaaatgtgtaaaaactagaaaaagtatacagagagcagtgggtagaaatgggtataatggttgacagctcttggacccaggactcatgtcttgttcaagattcaaatcctggctctatcactttctagttatgttgaaccaagttattttgaacttcagtttccttatctataaagtggcgacagaaatagaatgtagtatctgttggattcaggattaaatagttcatgtaataaaatgcttggcagtatgtttggcaactattatacaactctatatactcttcatttcttttctatgtccagattattaaaatattacgagaccatacccatgggggggaactttgctgtctttcgtttaactgctgtcctggctagctttcttactcagcccctgggattgaagtcaggcctagaaatttgggagtttggcatgttaaactttatagctgggagtactggagaatgacaggtaacttctgcaagggtaaacagtgttgagaaccttgctaattgcacattgtcaggcttttgaacagttcccattgtggcacgtattccttcaatgctttgttgtgcctgaaaatgaaagaaaagaaacaaaaaggaaaactataatgtttttaaacttggattttgttgttgttgtttttgtttaagtagtaggaaactaacatgatcttttctgacttagtcttatgttcagatatcctgaagcaacttgaataatgtcctgtttcttgcccccacccagctcgattggatccttttcctcacatctcctctttttttttttttttttttttgagacagagtgagactcttgccccggctggagtgcaatggcacgatttcagctcactgcaaccttcacctcctggttcaagcaattccccctgcctcagcctccggagtagctgggattataggcacccgccaccatgcccagctaatttttgtatttttcatagatacaggctttcgccatgttggccaggcttgtctcaaactcctgacctcaggtcacctgcccacctcagcctcccaaagtgctgggattacaggcatgaaccaccgtgcccggcccacacctcctttttaaatggagacagaagcaagcactgtcacctgtacctcacacaaggagaaacttggcctcagggtgattcactggaggtgcattgctgctcctatgaggcttgaggccaggttttctgcttctctgatagcctcttaggcattttgcctttcacagagtacttttccattattttataaagacctccttcagggccagattctacagttttatagttagaatttggtttcaacagaaaatcttcaaaaattacaatttacttttagttacacttcaagtcaactaggatgtcctgtttagaagcagggctccaagcctttttaaagaacagtttatctttcttttaaacaaatgaaggtattaaacggctcacagatggaaggcaggttgccgcattaaaataagttagtgcatggtttccttttcccaaataactttcctcttaaagtgagggtatgggagaatggattaaaattatagattgctacatatagacactttaaaatcaacgagcatagtaactagttggcattttaatattcttttaaaagtaagttgcttaaaaaccctggaggtagactatttaatcatttgcatgctagtttctaagaattcataattaagcaattcagcatgagatggatttatagatggactatcttagatttggtgttctctagcaggcagacttagtttcagtctggtggaaacactggatggtttcagcccagtatctgtttgcttttactccctaaacccacaactggactttgaggaggaggtgggaaggatgtcatgggaggtcacttcaggtagagtcagttcctgtgatactgactggcagctcccaggtcatgagcaaatggcaaccttggtagtatgcctccactgctgtccaggccttcagttccacttcttgtcttggaattcatgacacttgaaagagaagaagtcatctcataaagtgctgcatagtatttccagagagctgcatggctgtgaaaacataattggagttctaaaagctggcacagtcttttataacaacaggtaaatgcagtgaccagtttatttgtggcttttggtttcccactgcctgaaagcaaaaaaaaaaaaaaaaaaaaaaagtgtgtttttgaaaattaaaggaaggactttcatttaaaaataaagaagcttcagaataaaattacttctcctttgccttttatggtactgactgatgaaaggcagatatatatctggtaaaaatcctacaatgtatattaaaatgagtaaaaaatatcaaaaaatatggtgactagccagtatcttaatatttttgaaaaaatagactccttgaaaagccctggaggtagaaaatgtaattactttgcatgccaaaagaaatgtttccatcctggggtcttgtacaggctgagggttctggattataacaagtgtgtccttttttgtaactggctctgtagtagaagtaggtggactacaacacatttcactgccctgggcttctgaggtctttagattcacacctgccatttcaatgccctgagacttttctttctcctatctctccaagctaaaatcgttgaatcatatcctgtcattggctgttctgtttataataaacttcatgtgtaaaatgacatattatcaagaattgcttcagccattgacatagtgtctgtactcatggggctttgttgttcaggcaagactgagatgtctttcattatttagtgggtgttttgatacaggtcgtgtgaatgttgtctgtcaagcaaagcaacagtgctttgcccaggaactgagttgagattctgatagatatggattattatctccactgtcccctgcaccccaaacagttttctctttggaatagctcacgttatttcaggctctctagaagtgtgaatgaggctagtgtctttctcagggaaactgccattttactgatttttttcccagcaggcaacagtctgttggtgatggatatactgctaagaatagagaaaaatgagaaactagagatacttgcacaggcttcaggggcaaatttcattcatggagacatttagcccatttgttttttaaatatcaaattgtaacaaatctcccaaatctctcctatcttttagggactgggggacggcaggcaaatagaacagtgttattccaggcattgtcattagcccgaaaccatcatataatgattgtgtttcttttctatcatatttcagccacagtatcatttcaggtgtccctcagaaagacgtcacatccatagatggcaccttttagggaggaagcagcagtcaagggccattagtactagaacacaggccttttctgtcaagtgctttgtcctccatatcactctgccttcctttgcgagatgccttaacaaggctgcattcgtgtgtctgagagatcatcagtacaggttctaaggccaaacaggttgtaagaagaaggtgatgatcaagcatggcattttacatcatcagtccttagttaagaaaaatatgggcattcctgagggctgtcataagtggccagaaatcagggtctgtaaagtccaaggtacgggagaactggaagcaatgagtaactcatgtttgatgtacagagatgattgtacccagtgttaccatttacagagaaggcatccaaaccataataagcaaaatgctagactagatgtcactgggcagggctgggattggggggtgttggaggtagaatatcaccaggtggcagttagatactcattgctggcattttatccagacaccagaagaacatgatcattgtaagtatatttgttatctctcctacctccaccccctacaagaattcttaaaaatactgctagtgagtgcatagggaggatccgtatctcatttcttttgtgtggttcatgtaattctgtcatctttgacttctataatgatgcctaggtagggaagagtgccaaatggtccttagccctcaaattcctgccaattgctgagttgctgatagtattctctactgcaggggatataccaggacaattagctttagctcaaaaccatttatcagagaatgtgggagactgactcctggcacttgtttgtgtcatgtgagatatgctatttgtctaaaaactatccttttcacatttaatagttactgtttgctagtcagaacttccaaaatcttttccttggagatttccttctgaaaatgtcagtatctcctgactttcagagcaaattgagggttactgttcttaacaggtatctcattctgccttcaagtgtggttacttgatacagatgtcttctttccccttcctcgtggattcattgtggtctctgcagcagtatttctcagtgtgtgttctatgggctgcctatatccgcatcatttagagtccttgttaacgaggcaaattccaggggcccaaccttacttagagtatccaggattcttcactttaaatagccatcatactctccctgtggtccttaatgtatgttaaagtttgggtaacggttcatgtagaatcttgtaatatgatctgtgtacctgacagctagttcgaaatgcagaatctcagcccccacgttagatctactaaatcagaatctacatttcaataaaatgctacatgaaaatatggatgtgaattgctttacaactctttataagtaggaagcactcattaattaatcactgactgttggtttgtggatctgcttttcatatattctacttttctaaaaaaaagaaacaaaacagcttttagcttcttggaaattgtgggggtgtctcagaagaattgttctcttattacattattcacagtaaagaataatagtgaaagttcatgctatcactagtataagcacagatttagctatttcctcctaaataactgcagaagtaccttataaaatctaattgcaaatctgtttcttatacaaaagggtctaatttttctctgcctgtgtgagattcactcacggcctgattcaaaggcctctgctccaagatcaagaaaatcttcccaacgatcttcagtggcacttggcaataggagctttcaagggccacaatctcatctcagtgggagtaggtacaattgaatgttatttgtatgtttttttaaaactagaaaaccttcctgtggatttagtcatatttcccaaatgtgcttgatcaggaagttcatctgtattgcttattaaaaattcatactcctaagcctcatccccagatcgactgaatcagaatttctgggagggatctccagcagtctgttaacagacatcctggacattcttgagatcaggcatatttaagaaatactgaattatgtgatccttctcccagcagattacctttctgattatatttttttgaactcatatcatcccttttgttttcttgaacatactttaccccagcagcagtaaagaggcagctcaggattgctagtttagtattgaaaaccagaaagtgtgtatagctaaatactgcatgatattgtttgtccataatgtaagcatacttgattaacgagtattaacttagtgtgagtttattaacttattaacttattcatactattgtctgttccatggatagtgtcctgaagatggcaagtgttacatttagtctgcaaggaaacaagatctaaaacagtaaaatggcgaaccgtcatgaagtacattaggggtatatgtgtaggggctgatggggagaggttatatgtgtgatttgccatgtcttactctgcaactccttttcttaacattaaacttgtgagtgtgcttcaacctcagggacaaattgttgttatttagagaaatgaattatgcattcttttccttataattacatagtttatgtaccatcctctttgaacgtagcagaaggatttgtttcttataaagaaataaatgtgttggcctctaatttagtattggagtaatccttgtgtctcagacaaaaagatgaattatcaaatactttagggtactactgtgttacacattgttgaatctattatttgtgtgtataaatccatgattaaattaagtagtgttatctaatttgagttcttaaattcttgggtttctttttgtttgtttggtttgtttttttgagacagagtcttactctgttagcccaggctggagtgcagtggcatgatcttgtctcactgcaacctctgcctcccgattcacgcaattctcctgcctcagcctcccaagtagctgggattacaggcacccgccatcacacccggctaatttttgtatttttagaagagacggggtttcgccatgttggccaggctggtctcgaattcctgatctcaagtgatccgcctgccttggcctcccaaagtgttaggattacaggcatgagccaccatgcccggcctcaaattcttgtattttataaatcatttcatgggtttaaattcttgcttatgatggataagtgagaagggagtcttttcctcttaaaactaaattcctgaccatttctgtgaaataatttaaatactacccagttagggctttctctaagtgagtgtgtcattccaatgcaaaaggaaacttagatccctggtctgaggaaatttaaatctctgattcaaagttatagtgataagtgaatgagataccttgcctactctcaaggaatttataattaaattggagaggacttaactaaagcctgtgaaacaattaaaaaaaaagtaagtcctgactgtggtataaacaatgcattaggagtacagaagagaaaaagaattggggcagtggggaaagctgctttggggaaggagagtttaatttgggcttctaagagtagaagagagccttctctggaagtaaagaataattataagagacaatgcaggccgggcgtgggagctcacgcctgtaatcccagcactttgggaggccaaggtgggtggatcacgaggtcaggagattgagaccatcctggctaacatggtgaaaccccaactctactaaaaatacaaaaaaattagccaggcgtggtggtgggcgcctgtagtcgcaactactcgggaggctgagtcgggagaatggcatgaacacaggaggcggagcttgcagtgagctgagatcacgccactgcactcgagcctgggcgacagagtgagactctgtctcaaaaaataaataaaaataaataaataaaagacaatgcttttattcgggaataagcaatgtgtggtattaagactgagccagtagaacccagggaggtaatgaatggaacatctgaaggccagaggcttggggattttgttttgatataattggaagaaactgatgcatgctagcagtgttgaatgaggtcagaagagcaataattttgttgtgtgtgtgttttttaatgcatttcaaaaactagatgtgtgtctttctgtgtgtatgttatatatttatctgatatttgttgttttttagcgtttctagtttttgtcatctaagatgacactgcaaataaaatcgaaaatttctgatgagtggtatactctccagcaaagatgaagatatttgggcaaaaaaatgatgcttgtgctagccttaaaaggtcatcgaaggtctgtgagccagttgtctaagcgctgcttacactctgatggtgttgagggatgaggtgtaaggctaaggggtccatattcttattccctgggtccatagtacttttgacacagtttcagttagcaaaaaagtattgcatgtggtgtgtgacattaaccacactaaaaagatttttttttaaaatcatggttatattgtagtttaacatacatatacagtcttttaagatttctgatgagagtttgtattttattatatttagaatatttggaaattctttcactgggatcggaacaaattacctgtaattaacaatagcttagatgtggccttgcaagagtgattgagaacctttgggtcacgtgtggtgtatcatgaggtcaggagtttaagaccagcctggccaagatagtgaaaccccgtctctaccaaaatgtacaaaaattagctgggcatggtggcgtgcgcctgtagtcccagctacttgggaggctgaggcagagaattgcttgaaaccccggaggtggaggttgcagtgagccgagatcacgccactgtactccagcctggaagacagagcgagactccatctcacacacacaaagaaacaacagaactttcagaacctttggcacaacagaactgcatatctgggatgttggtcgtatctttatttggtcgtactaaaacacagactctctggcactgtgagaactgtttgcctgcacatatctttgcctgtgttctggccaatgctggcctgtcataccaggttccaaagatcactgacaggctgggtcatgtctgctctgaaacatccttcatatgcccccaggttctgacagttttgagagaatcctttctcagttttgagaacagttttggaaactgcccgagatgtttgaaattcacaaaatggaaaatattgagctggtttctgtaaaatatgctattttatttgtgctctttacagatatattacaaatctgtattctcattcacaggttaaactttgtaaattccaaggtcctgaaaggtggtggtcatggtggtagtagtataaataagcatttcagactggaaattcagtattaataatgaaatatttgtgtttaatttgtttagtgatatgcaatttgttcagtggtaatgttctgtttctttaatagcaattgaagcactgttttattatgggtaacttctcaaaatatctgtagctaaatgaaatcctaagttttagaatttgatttacattctttttttttttttttttttttttttttgagatggagtcttgctctgttgcctagtctggagtgcagtggtgcgatggctccaacctctgcctcccgggttcaagtgattctcctgccttagcctcctgagtagctgggattacaggcgcacaccaccacacccagctaatttttagtagagacggggtttcaccattttggtcaggctggtctcaaactcctgacctcgtgatctgcccacctcagcctcccaaagtgctgggattacaggcgtgagccaccgccctagccttgatttatattctttaagtattttttctgtccctgctagcagaaagtgtaacaaggtagcatttgaggagtttatatattcatccctcagtatttgtggggggatcggttccaggacttctgaggataccaaaacctggatgcccaagtctctgatataaaatgggcatggtatttgcatataacctatgcacatcctcctgtacatttgaatcatctctaggttacttacaatagctaatatgatataaatgctatgtaaataggtatactataatgtttagggaatgatgacctaaaaaagtctgtacatgttcactacagatgcattttttttcctcagaatatttttgatctgtggttggttgaatccatgatgtggaactcacagatagcaagggcctactgaatttgtttaacaaaaaaaccttgggtcctacttagtctctctgtcaggtacttttctgaatgttctacaaatattcactgatttattcctcttagcaaccctgagaggtaggttttgttatccttcctattttgcagatgacactaaagcactcatttaattaatagttggtccaagattgctcagctaattggtgttggagctgggattcaaacccaggcagtctggctctacagtttatatgctttaacactattctctactgagtaattctttcacaagaaaaaaaaaacaaaaaacaaaaacaaatagatttagtcatggctgttaggtcagtgtctgtgatgaactggttgcacatcagtaattctgtagtccatttcccttgttttgcactgacaattctgtgctaaattctttaaatttgtggcctcagacactgttttttgagacgggatctcactgtcactcaggctggagtgcagtggtgcaaacatggctcactgcagcctcaacctcctgggctcagttgatcctcctgcctcagtctcctgtgtatctgggaccaaaggcatgggccaccacatccagagctagcttttgtaaagatagggtctcactttgttgcctcccgaagtgatgagattataggcatgagccaccacacccagcatgttggctttttttttttttttttgagacggagtctcactcttgtcacccaagctggggtgcagtggcacgatctccgctcactgcaaccgccacctcctgggttcaagcgattctcgtgcctcagcctcctaagtagctgggattacaggcgtgccaccacacccggctagtttttgtatttttagtggagacaggatttcaccatattggccaggctggtctcgaactcctgacctcaagtgatcctcccatcttggcctcccaaagtgcttggattacaggcatgagccactgcccccagtggttttttttggttttgtttgtggtttttttttgttttttgtttttaaataatgagatctctgttgctcaggctttccttgaactcgtgtgctcaagtgatcctcctacctcagcctcctgagtagctgggactacaggcatgaacactgtgcccagcttcattctattttaattattacatgaaacataaatagattgtacagtttaaataaatataaatatgtggtgaaaagtggctcgattgacaggttctcaatggcaagaagtaggtcttcccacctggtgttcggtgacctctatgcttttaacaaaagcctttcattatacctttggagttggaatggaacttggagatcaacccttgtacactttcatttcataaataaggaaattgagacccaacaaggtcagtccctaagccctcaacagtttgttctaaaacagaaacatgatttaagccacactcctcaatttaatggtcttttcctcccattatagtcattaaaaatttatacagtgccagattaaatagctcaataaactttaaaaaatattttagatcaatttaaaagtacatataatcatgttaacctagattatttctcaaccacaaacctcgccctttttttcctctcacatttgttgtcttttgttgtttccagcaggcacataacattgctagttgtacatcatagcaagacttgtaagatctgtgtctctttacatagttacacatgcatataagcaacatataaacttaatattgacttgattcatgcaaccacataaatggttaacagacataattaggtggttatcagattaaacaaatatgtctttggtggagagtactaagtaggatggggcatattaattgtagcctaaatgtactgaatgtattctgaaatttgaaatgcaaacaattggaaaagctaatctaaactaaaaatccaaacttaaaaatatctaaactttaaaatggaagtttgcttttttactggaagtactcattatcagcactgggctttatagtgttaagtaaactagtttgcgaattagagaaaggcactaatgtaaaataggttgtgttctaaaaacttgtatttcagccatgtggtgttttaaatagtggctggatggatttttttctgtagaaacagttttagaaaagtggatggttcttagtagagagctcaccaaagccctgttagcctacatatacatctatgctctgtgaacgtccctaggcttgacactcttagtctttttcctggtattagcttcaaaatattttacatttatattattgctatttattttctatattacatcagatatatctggaattaagtatagatattaaaggagactatagctaagatttcttatactaccgtaaaaagtagtgattaaacaaatcaggaaaattataagttgaaacctctctttttaaagggtcgtgtttattttattgccttttagattattgaatctagtcaattaaaattaatggagctgggtgtggtggctcacgcctgtaatcccagcactttgggaggctgaggtgggtggatcacttgagctcaggagttcgataaatgttttgacattttgtatttctctaccaaaaacacaaaaaattagccaggcatggtggcatatacttgtggtcccagccacttgggaagctgaggtgggggaggatctcttgagtctggtaggtggagtttgtagtgagccgagatcacaccactgcattccagcctgggtgacagaccccatctgaaaaaaaaaaaaaagaaattaacgggaaaaagaccagtcttctggtgggactttaaagtaaaaatgcatatgcacccctaactacatagcttctactgcctagctttaccaactgataccaatctcttcattgatgttgatataattatttattcctgacaggattatggcatcataaagaagtgatttatataatctaaataggccccttataaaaagtgacttgataacttttagggacaatttttcttcaacatttttaaatatttaagtttatttaacgtatactgaaatttgcttaactaaacttttaaatttgacctcattgtagtttcacatacagtgtgtttgtttgtttgtttttgggagatgaagcctcgccctgtcgcccaggctggagttcagtggcccaatctcggctcactgcaacctctgcctcctgggttcaagtgattctcctgcctcagcctcctgagtagctggaactacaggcgcgtgccaccacgccctgctaattttttgtattttttagtagagacagggtttcaccatgttagccaggatagtcttgatctcctgacctcgtgttccacccgccttgacctcccaaagtgctgggattacaggtgtgagccaccgcacccggcctcatgtacagttctaagaatacagagagatcacttgtgccctttgcctagtttctgcctgtagtaacatcttagaaaactgtagcacaatgtcacaatcaagaagttgatataatccactaattttgtttctgtgaagttttattatatgtgtgtgttcatggatccaccaccacagtcaagttacagaacaagtccccactacagagatctctgaggttgcttttgagtagataagtgggattatgccttatgtaatctttagagattggctttttttacttagtgtaattcccttgagagtcgttcaagttgttgcttgtattagtagtttatttattctcattgctgattagtatcccatgttatggatatatctaatttgtttaaccattcaggtttttgtgtgaacatgagtttttatttctttggaataggtgcccaagggtacaactgctagattgtttggaaattgtgtagtttgattagaacctgttttctagtgtggttgtacctttttgcattcccaacagcaatatatgtgaaagattctgtttctctgcatctttgccataaccagtgttatcattgtttttgtatcatatgagatacaatcaggtatggattttaatgtaaatataaagtagctaaaataccatatactacaataaaaagtgatgattaaacaaacaggaatattataaaattaagtaacattatacttttttgtttgtttgtttgttttttggagacagggtcttgctctgtcacccaggctagagtgtaatggtgcaatctcggctcactccaacctcctcctcctgggttcaagtggttctgcctcagcctcccgagtagctgggattataggcctccaccaccacgcccagctaatttttgtatttttagtagagacgaggtttcaccatgcaccatgtctgccaggctggtctcgaactcctgacctcaagtgatcggccatcccagcctcccaaagtgctgggatcacagacgtgagccactgtgcctggcctgattttttgttgttgttgttgtttttaatctcaaaaatggaatataaagagagacagagattttcctgatgggccaaaagttgactgagatctaagaaatggattttggaaggatgcatgaggagcatgatggtggggtgctggccagagtgaaatttgcccgcggccttttacaaaggtagacagagtgatggtaatgaagagattttgagtcatactattggggtccgtaatacgaaaaatgcttctactttgagttatgcattggttccttttaggatgcagacttactttctctcttgcccacctcaagcctgtgtataacagttgcatgataataccatcacatgcaccttctcttaggattgcctttggtacatgaaaatgcatcttttttgtgaacattgtaagccaccttataatagataacatttttctgagcccttactatgaaccaagcattgaaatctatgcacattgcatgtagttaactcatttaatccttgcaaaaactatgtagcaaattaccccaaatttaccagcttaacagttatttaggagcagcttggctaggtggatctagctcagggtcataaggttggaatcacaacattttagctggggctgcggtcatctgaagacttgactaggcgtgggagatctgcttctaagatggctcactcacatggcttttggccagaggcctctgttactcatcacgtggaccaccccatcgggttaaaatattatcacaacatgacaactggcttcactcagagtgagtaattcaagagctgcttctgctaaagaagccagaataccttttttgatgcagtcttagaagtcatacactgtcacttctgccatactctgctcactagaagcgaatcacttaagtgaagccatgctaaaggtgaaggggattaagctccacttctttaagggaggaatatcaaagaaattgtggacatagtttaatatgaggaaacttaggaagggaaaggttaagtgatttgtccaagtgcataccttgtgagttgcagaacctggatttgaatcccagcagactccatgtgtttttggttgttctgtgaaccacatgctttgagcacttaacctcttgaatgcatattcgaactcacaaggtttggtggcccaagcctgtaatcccaggacttggggaggtggaggtgggtggatcacttgatcccaacagttcaagaccagtctaggcaacatagggagacctcatttctacaaatacagaaaacaaaaaaattagccaggcccgctgtgaatacctgttgtcttagctacttgacaggcttaggcaggaggatctttttgagccaaggaggttgaggctgcagtgagctatgattgtgccagtgcaacccgtttctttaaaataaaaaaagttataatgactttcttcatatttacgtgttcatatctagatattcatgaatgatacggccctctcttttatatctggtttagtactttgactcaatttttacattcactcatttagttgatagatactgatcacctcctgccaagtactgggatgctcaccatcatatgggaaagaactttcaatttaaaggtgaactaactgacctggcaccaaggaatttaaactatatattgggtaatttctgataactaaatattgggaaataaacctccccccaccccagctttctagttcacaccttctctaattgttagaagcatattgcatagttttaagaatgcattgtaaactgaagttggcaatgggatgaagttcctcagatagagtttgtctactgctaatatcaaaagcaataaatacttgagagtcctgggcaatgttgaaactgtaaactgccaatgtctgttttttcttcctggtactttaaatgaccatgaactctgtgttgtctgggttagttttaactaggtagtttgagagatgtgaaatgacttgtttctttgaacaaatctgttttgtaaaatgagtcacccagattatgcaaaaagagaaaggaagagaggtcttagaattttgataagatctttttcatattctgtgcttgtatttcattttgtcagtccatggaaaagtctttattgtggtgatcattttgacattaaacttcagggtacttagggtgaaaccgtaagggcatgtacaccttagggcattagaatgcaactttatgttcataatacattggactgatgtatacatttaaaaacttaatgttttagcagtgtatgcagtgaaattgtatgaaaagtaacatttcataggctgactagggttgaaatagagcaagccacctaaaaattagttagaagaactagaggatggagtaagaacaggaccagagttaagggatgaagcatcctgcctttataaggaacttcttgttgaactctaaggatttgacaaccatgtttcttatttgacagcattcagtgaatttcctaatatcaaggttaagttctctcatgtatacacacatatatctagtttcctgtctagcctaattcacacattaaattcttgatttgtatctgatatacctccctccttctgtgtctgacagtactaagggaatttcttaataatgaggttaagtgttcacatgtgcagacacttctcttgcctatactttggcagcttaaaatcctaggaattctcactttttctcttttccttttagatatatggcagacatgaggaatggcctgagttggagtttgcttcttaagaagtcctatcaggcggggcacagtggctcacgcctgtaatcccagcgctttgagaggctgaggcaggtggattacctgaggtcaggagtttgagaccagcctggccaacatggcgaaaccctgtctctgccaaaaatacaaaaattagccaggtgtgatggcaggcgcctgtaatcccagctacttgggaggctgaggtaggagaatcgcttgaacctgggagaggtggaggttgcagtgtgccgaaatcgtgccactgcactccagcgtgggtgacaaagtgagactttgtctgaaaagaagaaaaaagtcctatcagaattagagcttaggaaacattctgattagaagtcagcattggattgggctgggattggctcctcaaagattgaacatagtggtgtggtatacccagtgctaacttgctgtccgtattctctgaacatgtctgagcagtgctcaggtcctgccttatgaattatggaacatcattgttcttctctcttccacctgtgctcccattagtcttccttcttcccattatcctaccaaaaactttgtgatcaccttggcaaagggaccctggtttccataggccctaaatcagggtatgaatttggttattctacagattgtgtcagccaataactgtcacttacagcaaatactagtggatccctcaaaactagggagtcacgtactctggataattattaatatatggatggctttttcttttagaaaggaaagagcaatgattaatattaaaatagcctaggtgtgatagcttacacctgtaatctcaatactttggtaggctaaggtatgaagatcacttgagatcaggagtttgagactaacttgggcaagacctcgtccctacaaaaaataaacataataagattaattggatgttgtggcacacacctttagtcctagctacttggttggctgaggtgggagaatcacttgagcccaggcgttctaggctgcagtgagctatgattgcaccgctgcactccagcctgaccagaacgagacccaaacctgggagtccataacaacagcacagtggttttggtttttctttctttcttttttttctttttttttttttttgagacggagtcttgctctgttgcccaggctagagtgcagtggcgcaatctcggctcacagcaacctctgcctcccaggttcaggtgattctcctgcctcagccttccaagtagctaggattacaggtgccgaccaccacgctggctaatttttgtatttttagtagagacggggtttcaccatgttggtcaggctggtctcccatttcctgacgtcaggtgatccacctgcctcggcctcccaaagtgctgggattacaggcgtgagccaccaaacccggccagtggcccttttctaaatcctatggttagtcaatccttggtgtctgtagcaatgtgacctcctgaaccaaaacttgccttcccagggcacagaaaaggaacaagtcttttaagtccaataggtgaccattatcaggaagtaagaacttgaccacctgcttttcttgaagtcagtgccaactagaaactggagcttgaccaaagccagttcatttctgctgagctgcaatcagaattaaatgcttgacaggccatattaatggttgcagtaatccattttcatggtggcaaggcctgaatgggaaatcctaccaagccaacaaagccttctttggaaatgagatgaccagcagtcctcagcagggttcagtcttgcaacttggtgtttcagctcatggttacaaagttaacaaataacttaatagattatttaaaaagagtaaaagaagttaaccagtgtgtaaaatttacaagctgggccctgatgccccgcttgtgcattaaaacaccctagctgtatgcgatttatgctgcatgggtatgtggaggccttaacttctcagtttctgaaacccaagtttatattacatggtctgtcagaagagggatggcactgccataggtatgggagtgatccctcagttcttatcttagtagagcagtcacaaagcaagaatacccctttgactgaaaccaggatgtttctgctcctggggcaaccttagtcactggttcccctttttggttagattattttttcagaagtaaagaaacactgacttttggtcagaattgaaatgtgaagcaagttacatgaatatatttttgccagatcaagcttgtccctgaggatcaaggacagggaggaaaatgagaaagaatatttctaaggacagtggacatgctgagtttgtattttcaaacgaaggaaatacatttgggcttggatttgttctcatttttaaagtagttgtttatgcttgtaatttaaatgccaaaatgtataaatacataaaatgaaggttatctataattctaccttcctctccactattaacatatagataatttggtatgtattcctttgataccttttttttttcccttgagcatgtactaacttataaaaaccctaagagaattaaagtgggaatatgggcagttcctgctgtttgctttttcccttaataattgtgaaccttgttctttgtcagtagatctggatatctacttactcagctttttaaatatacaggttaatgagtttgggcttttctttccccaaaaaacttcaagtatgaatttgcatttgttgaaattggacgtatgtatttgtaagtatgttttaattatcataaattaaaatgtggataattttcctggtaaccatatattgatcactattctggtctatatggtcctgaattttttttgcactttctctttttgggtctgtctccatttcagtctatctcttacatttttctccttgattcagattggtttttatcctacttccctttcctcccttctaaatttctttataatactaatctctcctgacaaacacatataggtgtttgtcagttgatgttgtgtaactctattgataaattgtgactgggaaatgccatcttattttgcttgccatgtcaccagctgaactgtttacaagcaaatatgtatatctccatggatacaggattatgtaaatccttggatttgcatatgtttctaagtcagtcgagatatttatagaacatacactctgtgcctaggactgtgttatacactacaaataacagccttcaaactctaaaatgcccatagaaaggtttcatctgtgaatccactgtgtgtttcaagaatggtttctccaaaacaatgattcaaacatacagcacatttaaaagctgctttgaggtcttcatttatatctataagaatatgggtagatagagagagagatgaatgtagccattaacaccatgggtttactcaagagtgtttcaaataagtaactatacagtcattcctgagtcattagaagatagttatccttcccagttccatgaatttaagaggaacctcaagagcccagctcagagcagctagatagatgaccttaaaacttttatgaaaaactagaacatgcagagaaaatgctcatagtctttggatactatgtgtttaccagatgtggctgctagttgaaaagtgtctgtgattattctctgttgtgtactgaagtcgagcatttttctattgctttttattttcatgcctagattaccaacaagattagatatgctctttattaaagagagggccatttcaaggcctgcttttggcctttctctccagggaagctcaagactgccacaaatggctttacttactgaatcggagtttattaaatgagaagacagtcaataaaatgtgtcttgcctttcctagtgggagctggcaatgccatttaagaacacgtggccagtttatccaaaatctaactgtagcctctgcaggaatgctggataatggctaagccaagaacactcttgctcttctgcccagcacaggatgatttttactagcatttattctttcagtcctgttggggtaaaaaggaagttgaaggtacatctacaaatctttttgagtctctttgggacaaagctgtcagcagtttcatctcttgaacttctatgaggcatgttgtgtacttgtctaagaaatatgtttccccatgtgttccataaagtaaacatctgcggatgctaaaggcatagtgccaggcacatctgtgtccatagacattgctggtaaactaagggctgctctggataatgctttgacctgctgcaaagttcagttggcgtagtaattcatttgttatttttggggaacagttttgttaatgagtatttcatcataaatttacatgctgcttatgcttgtatcttactcttggggtttttttagttactttgtgaatgagctaagctttctgttatcacaggcagccattacatattcagtttatttcactgacagtaagctccctgaaggcaaggatcatgtctatgaattcagtaggcttagcaaagccaaaactctgaagtgccctccctttagtggctcagatgaaaagtatgatggtaataagagtagagaaactaaaatgttttaaaatatttctgtgattctaggccgggcacggtggctcacacctgtaatcccagcactttgggaggccaagacgggcagatcacctgagttcaggagttcaagaccaggctggccaacatggtgaaaccccatctctactaaaaatacaaaaattagctgagcgtggtggtgggcacctgtaatcccagctactcgggaggctaaggcaggagaatggcttgaacccgggagacagaggtctcagtaagccaagatcacgccattgcactccagcctgggcgacagaacgagattccatctaaaaaaaaaaaatctgtgattctagatcccagtcaccatagaaaagcatgaatttgatattcagaaagctattttttccattcattattcgtgattttttaaaacttgcttgatgactttcctagtctgaggaggtctctaggactccaagcacattatgtttccggatttaagtgacctctagttggaatcaaatacataatgtaagtattcaaaaattatttcccccttgtcaatctattctactagaggaaagaatatctcagtgagtgagatgagatattctggtagatttctgaaacaatagtggacttcatgagattctaggtaacctaagtctcgtccatgtttaaataaaatgccaaacatctgatctgcctccagtttgatgaacaaagcagagttgctttgagcctcttggcatctatgggtgagtggcaaacttaggcctgacgggagctcagattttctttttccccatgtatgacaattttctattgaaacactaagataagaatctcttcgctttccattatggaatatttacataagaaagaatttcctccataaactttataatataatattgatacaaatattgactttgtttctagtcccttaaagaaagggaggtaataaattgaggtaattctcaacctaataaaataaacttacagtatttaatgcatatttattttagaaagatggaaaatacaaataagctaataaacattaaaatcagttactataccattgaggctaaacgatagaaacatttgagtacacatactataagataaatttttttcctctaaatacttatatgttggctactttatagaacaaagtggaactatatatactttttccttgaacgtcatttttattggctgtgtaatatttcattgtatgatacagatgaaccttagtttatattaagtaaccttttgttcataatccccagatttcaagtaacctctgttggtaaattgacatttatgaagcccttttctctataacaatattataaataatagtttattttctaggttaactcctcaaattctaattcatatttatcacatggtaagatgcaccactagataaatggcaccatgacacttagaacgtaagttctgcttatcgtatcatttttgtggaaatctctgtaatccagttagaacctggcacagtgtcagagagaaaacaggcacttcccaaaatctgaataaatggaagatggtattctcgctctgcccaggttgtcctgaccagaacagccaagtggaatagatggtgttcactttctggactatgggaggagagttgcgggtgacagggagggcacactggattagcaggatttcctcactgtttgtatctttgacacttgtcagcaattctgcctcagcgaacttcataaagaccaccaggaacttgtttatctggtggcaaagttgggggtagtggaaatgaggatgcaaaagatacagaacacttgaacaacaaacttgatgtaattgatacttatagatcattccacccagccccagcagaatacacatttgttttaagtgcacacagaacatttaccatgttctgaaacataagacaaggaattgatgggcattaaaaaaagcatatacctttcatatataggcattccacttctaggtgtttatccaaaaagaaagaaagtatacatccatacaaagatttgtacatgaatgttcatagccattttatttgtaatagccaaaactagaataacctaaatgtcaacatgtgaatggataaactgtggtgtatccacactacagaatacttctcagtaataaaaaggaatagactgttgatacattcaacaacatagatgaatctcaaagtaaatttcacttcatgctaagggaaagaagccagatgaaaagggtacatactctgtggttccctctgtatatgtaagtgtttgagacatatatactaatataaagagatcagagcagtgattgcctggggatggagaatggtgggacagagtgggaggaaggattaaaggggcatgaataaacttttggtggtgatagattgtcttggttgtgatggtggtgatagattgtcttggttgtgatgtttcttaggttatacatatgtcaaaacatcacatatttcaagatgtgtagtttattatatatcaatcataacctcaataaagctgtttataaatatatcataaaataaggcattcagaattctggggctatttacatcattatagtgtttatcaaacatacttacatgcaaatggcatgacattttactgtgtactgtgctgggtcaataaaagggccttgcttggtgattcgcacttctgtgtaacaggaaacagtgaaaagtgttaggaatctagaaaaagccaggcgaggtggctcatgcctgtaatcccagcactgtgggaggccgagatgggaggatctcttgagctcaggagtttgagatcagcctgggcaacatggtgaaaccccatctttacaaaaaattagccagacatggtagcagactgtctgtctgtctaatattctccccatctttcactgaggaaaaatctttcatgtatatattcatggttaacaattgaacaattgagcatcgaattttcaatcatgttgcatctgtgtttgagtagagaaaaacaaatagaaaatatgatgataattcagtagctactccttgcctattgaatcaagatcaaattcctgagccagtggcttttgatgttttgtgtgtttgaccctaagcttcttgtttagttttggcttgcccttccccaagaatgttttcttcttctcctacttcactgccttggtgaatccttttctctgcctgtgattcttagggatcccacctcatcttttggctctatttggtaaatgcccatcctttcgattcttactcagatgctttctctggtgtttcccctgtgttctgtgttttagtagacactaagcacatagtgtgtaccctacactttgcactatatgtatttacatatgtgtcttgaatgacttttattagtggcaccgtagccaggtaccttgtacatggtggcctatgtgttgattgtgccttaaacacagtgggtggaagacagtatggcgattcctcaaagatctagaagcagaactaccatttgacccagcaatcccattactggatatatacccaaaggaatatacgtcattctgttaggaagatacatgcacgtgtatgttcattgcagcactattcacaatagcaaaatcatggaatcaacccaaatgtccatcaatgatagactaaataaagaaaatgtggtacatatacaccatggaatactatgcagccacaaaaaggaacaaggtcatgtcctttgcagggacatgggtggaactataagtcatcctcagcaaactaacacaggaacagaaaaccagacaccacatgttctcacaagtgggagctgaaggatgagggcacagggacacatgatggggaataacacacattgggcttgtcgggggcttgaggggaggaagagcatcaggaagaatagctaatggttgctgggcttaatacccaggtgataggttgatctgtgcagcaaaccaccatggtatgtgtttacctttgtaacctgtacatcctgcacatgtaccccagtacttaaaatttaaaaaacaacaacaacaacaaaaatgcaatgggaacaatagtcagtgaggttggccctgctgttttggaaccgaacagatgaagagttaatgcattttggttactatttaggtgcattgggcttaactttacttttacatttattaaagttattgtaattaatgcctatgaggaaagcagcaacaaaacaagcaggaggaaacaaattgtttttatattatttttgaagcacattatataggcgatatatttagggcagaggagtggcagatttactgtgctcatgtcatttttttcttaagctaatatttaaattatatggaacctccccccatccttcacatttttagaagtgtgcaatggctagttgggaaaagttagcttgtaaatttaaatcaactagatgtaattcactctgaataattcacatagaaatattcaagtgttggcttaggggatgtaccttaagattacacagaaggctgcatctcccctaaaatttaaaaaggaaaaaaaagtgttggcttagtggcatcttaacagtgaagtattcgttgtatcatggaaagagcatgaatttagtatgagttgtggaatatttggaataatatgtttctgagatatcaggtgagagttaactctctggagtgtccacacccttgatcacttcctaaatttatttttccaggtccggaccctatttgtcagtggccttcctctggatatcaaacctcgggagctctatctgcttttcagaccatttaaggtacctttttttatctttcagaaattataaaatgagacaaaagtctgtatgctttctgggagctttttgaagcaagaaatgaaatatttgagaagaaaacagatgtttttaaaaggttaatgagtaaaggagatttaacaactgagttctaatgtacagtctcacttaggataattacatatttatatttcaaatgcagtaatgtaagtgaagatttatttctagtttcataccttattatttgaaatagtactgttgatactgttctttggaaatgtaaataggtttttatgaactgagttaagaacctaaccaccgttattttttccatggcaaaactttcaaacaaagtaaaacaaaattttaaaggatacctaggtgtaagttgatggtaatatttcctggtgtttattgaaatatttaatgcagttacctgtccttcctatggaaataagatcacttgatagatacttaatgttgctaggattgaaaacttcataggaaattaaacaccaagcacttcgtagaaactaagccaaaatagccttgctgccaagaagaaaccttttgaaggttggcctttggaggataggagaaagctggagctgatcgaatcggggccctggaagggatatgttccttctctggaagggcctgtgctcaggaagtcttaagttggtcagtgtggatgtgttagcagcagtgcctggcagagaccacacttatgattaggtgatgggctgtcttgatttctggttaaagatcattctcactgaagcaggtccccagtgatagaggcatgacaggttgagggataggattcagcttcttaggaagacggaattggatatgacaactaaaaactctagtgttggggaggaggaaggagggatgcaggggcagccagttagaaccaacaaagataaaacagtctagcttatgtgccaagagggcaccatgtcataagggacataagtccacctgacagccatcgctttaatgcaacaataatgatgatggcacagggaaacagaggtcaggtgccaggtcaggtgggaggaagtgggaaaggaagagaaggtggtatggagagagtgccaccttttatagaatttcctgagtttcttctgccgggttgtacttttataaaaaggaccatttttctatcctttttatagaatgcaaacttttaacgcaaattgatcttcttagtgtataaaatactgttatgttttggggtgtatagagagaaagacattcaccagcaagccctttatatgaattattaaagtattgtcacaatcctttcaagtgggtgagtctcattttttcaaatgaggaaaatgaaacttggagctgaataaattgtgctcaagtttacacacataaaaattggcagagccaagattcaaaccaagcagtctgactctgccctctctgttctgaactattatgttatactgcttttctgtttgtgacttgagaacacagtatatccctaccagtggtgttttacttgagtgaaatatccagttgtcctttgccttcaagaccttcatggtgtttaaacctctagttttttcagaagagagcaccttgaagaaaggaagaggcagagctgtgaatcatgacctctctggccataagagctcaaggcctttgaggtgaaatgtttatagtagctaattggtaacatagttctctgctgggaagatgtaaggatgaatcaatctcaacatcctgcccagaaaccccgactagaaagtcagcaccctagtacattcctgacaaccctcttttaattaaagtccctggaggctgaccctagtctgcaaatctgtctctgcgctgatgtgtgtagtggtcaatcacgtcaagtggtgtgtttttcccctgtgtcgtccgttaatgcaagccaccagctattgattattttcagaaataaacacattttgttatccttatcttgaggagccgggaggggtgaagagagggagtgaaagagggagggagtgtttctgtcttccttgagcatgagctggaataaaaacctgaagggattatttttgcatgtccccatcagaagagcaacatgaaaactggttccttcagtaagttagcaaagtaactcaacaaaattcaacatcattgcctgcttaaccatttctggcagttttgaaaatgtggtcagggagttttaccaactatatttttttgagacggagtctggctgtgtctcccaggctggagtgtagtgacgccatcggctcactgcaagctctgcctcccgggttcataccattctcctgcctcagcctcccaagtagctgggactacaggcacccaccaccatgctcggctaatttttttgtatttttagtagagatggggtttcaccacttgtcgatggtctcgatctccagacctcatgatccgcccgccttggcctcccaaagtgctgggattacaggcgtgagtcaccgcacccagccccaactatattcttaatgttttattgttgttattttatagcagctacatgaccaatacatggctctgaccttcctgttgtattaaatttaccctctttccttgcctatttctgtaaaactcctattcttatctagaccaagaaaacaaaaagattgctattaacagagacactcatttttctaccattgtgtaatttcatgaaaaaaaaatagaaggaagagaaacacagataaatccatagattgattttttttaaaggccccaagaatgcaaacaggtgtgtgtgtgtgtgtgcacatgcacatgcatgtgtgtaatttgctttcccagataacttaggagacatttgtaggaggagttaggtaatcaataaagaacttatttttacatgaacaagatggtattactacagttacttttggctaaacttggtttttctttattttcagggctatgagggttctcttataaagctcacatctaaacaggtaagaatttcaaagtggcatataaagatcacttttttactttcctcaggaatattgctggggcttgacattctttttttattcccattagaatttgaggggttttttgtctttaaaattaaaagtgagatgtattaggaattagcacaggaaaatacttcataattctataatcttcagctggaatttcagggactgtcccagaggaagataaacacagtgatacattgagattgattttgtatgttcaatgaaaatagtggtttattatttaaattcacttttattcccaagtctttcccatttcttttaatgaggttaaacaaacttttacaatcaatgtgaatatcagatcgtgaaggatcatgctgtctgtcaaacccctaaattaaggcagagtcccgagtccagaatggaacagagaacgtacaaaatggaagtggtagtcagtgattctaatagttcctacaagcttagagattgtagctatatacttttttttttaagctaaacacttggcatacacacctctcgaatcactattcatctctctggctcatgagaagaatgatcttggaggcacccttctgtactgaaagatagggagtccaaagggattatggcctttctgtatttactcagaacagcctaattaagaatatgatttttttttttttttttgagacggagtctcactatgttgccaggctggagtgcagtggcgcgatctcggctcactgcaacctccgcctcccaggttcaagtgattctcctgcctcagcctcccaaatagctgggactacaggcgcatgccaccacgcccagctagtttttgtatttgtagtagagacagggtttcaccatgttggccaggatggtcttgatctcttgacctcgtgatccgcccaccttggcctcccaaagtactgggattacaggcgtgagccaccctgcccagccagcacaggattttttaaggcatcccttaggatttgagataggaatgttcactttgtaattttggtcatgcagtgagagtccaggggttttatcattgtgtcattgtattcttgcacttacagtgtaccaaaaggtgattcggttctctttccattttaaaagatgaagaaactgaggtacagtgaatttgatttaggaaagtagagcctctccaacccaagttttcctctattcccttgttcactgctgttcacctttcaaccacttctagatttttttatgattctctaaatccccagctgtgctcttgaagaactaccctcaccatccctttgattcatattagaaatttggctaagccactgagtcatgattcttcgggacttcgctttcttatttctgcccattgcctgtggtcatttctttatcttagctcttcagtttgatgtcacccttgacctagaaaagtagacatcatctgattttttttcttcatatttctctttttttttctcagcctgtaggttttgtcagttttgacagtcgctcagaagcagaggctgcaaagaatgctttgaatgtaagtactaatgatgtaattgtagggggtttccatatgaggtggtgggaagtaatggaatctctttggacgggaaatcaagtggaaagaatatgactgcacagtctaagagggagggattcatcaatttaattagcactctaaagagctttttccaagaattgtgatcagatatgcagattattaaatagcactctgctttttgattgctctgaatgaaatgctcaaaatatctgacatctgatgatgtgggtcttattttaatctagccccatcccatccaatggtggtgcgtagtgctgctttgttttttccagaggagatatttgaggcgttagcttgctcatcattatactctaaatgactatgctcagaatagattgaaatcctggctttttttatttcatgaggctttccttttagatatgcagcattaaaaaaaaaaaactggttatagcctttattctggttgattaaaaatttacatataaggctttcccaaaagacgtgtgttgtaatagaataaattacagtcatttgtaattgagtagatatatctgtatttggtttgtagttatgttgtttgccatgtgttttgagacttttaccagtattgttttggtgaatatttttcctccttagtatgttgaaaaactaaacaatttaagggaactaagttagagaaggtggaaggaagcagaatgtggtttcagatgctgaggatgaatcctcaggtgaggagtctcagcgaaggctggctccatcatgctctaggcagttggcctaagtggctgtgaacaagtgctgactgaagcactcagagtgtttagggtgcttcctacaaggcaagcggccacttgactggttgtaatacaggtaccattttggaggcgtctgggaacttgcgtctggcctttgtgttgctgtggtacctgcaggtacccctggcagctgctcctttgagtagaccatgcagagtgctgttggagagacctgatataggtgatgacttagaggtctaaggaaaagtctttatacttcatataatggtgtcattgatacacaaccttaaaaggtttttagactttggaacaaaaatgtgtacactctgagaagaaacaccttaattcttgttggtttttcatataaagcatataggaacatcttaggattccaggaattccagagtccagactttttctggatttggataaatgaccttcttgtcagaataactgcctactcactctgttcctctcctgtataacaaagtataaaccaattatttattgagcaccagtggtatacaccgaagcacggtgtataattgaatgttttgatataaaagttgttttatgatttttgcattgaatacgtaaaaaccagaattttctcagtataatgacactttaaacttaaaagtagaaccacaatttcaatttagcagtgttttattttaaccaggtgggaaccttctaaatgcagaaatattctgggtcctttaaagttatgttagatgaagttttcaccatgttcttttcattgttcttacaaaggaagtaacaagcagttgaagcttcacagacttggctctcattgctttactatacttctcctatgtgtataaagatgtcactgactcattttctgaacaataggcttttatagtgacctgtcatctgacaaggcaacattcccttaggtgtggtaggttgcatttttgttttttaaagataactgaagggttttgtttgtttgttaaagaataaagacatggtgttgctgtattgcccaggctggttggtctccagctcctggactcaagtgattctccctccttggccttccagagtgttgagattacaagcgtgagccaccacacccagcctgaagttttttgcttgtttgtttttgtttttgttttaatgtttaaatgataatagtcaaaaaaaactgtgtttcctcatcatactgagtacagcgaacataatttcaatttttcttggtgcccaaaggttatcattacaaatagcaggtaatgaacctagtgtaatataatgatagaggtgtttaaccctgtttgcccctgtgccagctggccgcagatcactgttgtctggtcttgaggtctggttttaggttattcttcttgcactaggctctccattctttttttttttcactggcagtacgcctttctttagcactgtcctctcctttaatcattaatagtttgctacttatgtgttaataacttgggaaggaccccaaataaaacaggtctaattctgtcctgttttgtgggcctgagggaaaattcgtatttacctatggaataatgagcctgggctttctgctgcccaaagctgacttacataagagtgtaggacatttactgagctcctggctgatctctttcttgacgttttgaacttttctatgtaaagtagtagaggtattagaaatctttccgatgttgtagttagggaaacagacgtggagaggatgggtgattaagtcagcatgtgtaagtttagagctccaactaggaggcaactaaaagtaaacttcttgcatctaagccttgtccattttatacaacatccttttgcttgctttgtacatgggatgttgctgcatttttccttgtggcagttacagagtatttaattcacaatgtccaggacaaattgccaccataaagtttggtatgtgaccatggagcagacccattcaaggtaatgtatttagtcatgaagctaataggtatattctttgtgatccaacatattaggctctttttagggtcatcttttctaattgatgagttaaaaacatatgatgcttgtagccattacagaattttctcctcccatgtcatctgtccagggttctcttaacattttcttacttacctttggagagagaattcaatattgtaatgttttgttttattccactattgagaaacatatgcctgaatccagtaaatttctctgtgtataatacttcagtgttatgaacgacttctccatgtttaatttctctttttgttgtttctgtcttgattgctatctggttcagttgttagtattagtgattagtcttttctcaaaatgactaatttttaaaatctattttctcatttttggactgggcttcagccattttgataattgtgtggaaaaacatgctcagattgaattaagttgtaacagtgaacttttatcagggaattaaaccttctaaagttaaatacagtacgttttgtttctatagcaaaaagtcccacgttaggcaaagaataacccaaacccagacttcttttcaggttatctttggtctcattaatccacatcattaaaaacccctcctttctttaacctgacagcaaaatatctgacctattctttgtctttaactcactttgtaatttctgtacctgttttgaatttccaagctaaaggaagggggcactgaaaatcttaagtatcaaattatttttaggacttgtttataattttggaaagtaaatcaaattcactaatataggcagttagctagatttaggaaaaattctgatttgtggaaatttttaaacgggacacaggaagcagcgcatgttgaagggtaaagatccccagcagatgtgggagtaaaccatctagctatttccagcaactgtgaggacctcaaattgtcattattgtctagtaggaatcttgtttttataaataagaatgatttgtagttaaccttcaattcaggcttgtgcatgatctctgctaacctagagatctctgtaatgacctgttatggcattgttttgtcttactggtgtttggaaattggtcattactttaaaaagttttggactctttagtatatgtgccattcatttgctatccttccttccctgattttggatagttgttattaggctaggttttatcttagactgtattatgttacacgagaactagagaagtctgtacatcactacaaattgccttcccaaccaaaattgcttaggctagtgtagtaatttgctttactctcaaactatactcattaatctaagtgatctctaattatcagtgaacctccaagttcagtgttgtttttcttccagatagctcttgagatgtaatttgcatatgattcacccatttaaaattttcaattcaatggcttttggtatattacattattttttttaattacggtaaaatacatttaaaattttgctattttaatgacttttaaatgtactctttcttggcattaattacattcaccatgttatgcaatcattaccactatttccaaactttttcatcaacccaagcagaaactctgtagcccttaatgcagtaaatacctccccattctcccttttccccagcccctggtaatctctaatctgcttgctttctccgtgaatttgcctattctaaataatgaaatatttgtctttttgcttctggctcttctttcttagcataacatttttgagattcatccacgctgtggcatttaccagaatcaaattcctttttatagctaaataaaattgtattatatggatatgtacattttgtttatccattcatttgttggtggacacttagattgtttccatgttttggctattgcgaataaggctgcagtgaacactgatgtgtaagtatctgaatctgttaattcctttgggtatacctaggagtagaatttctgggtcatgtggtgatcatatgttagctttttgtttactttggtttgtaattttttccatagtggttgcaccattttgcattaaaaacttgttcctgtttgtaaaattataaccattctagtagatacgaagcaatcgtggattcttgctaaatgctgtttgactgattttaatagtagatttgatttctgtaggaatttcacatgacttaaaatgtttcttttagcagggacaagtaacatttctgtgacagttctaagtaatggaactgcgtttgttttacctgtcaataagtaacagaagggggaaaaactcaaccctcatattactcttttaataagacagaacttgaaggaaaggtattttctcaaggtctaaatagattttagaataaagagttgaaaagcagttttgtttaaaagaggtaaaatggctgccactcagacttccattgcaaagaaaccttaacaataaatggaaaaactgtatgtaaactaaaaatatataagatattaaattatttcttgactattgaaaaattttgattcaatagtatttgcagttaagagagaattttagaaagctttaatttgtaagaaaatatgctgagaaaagacttaatagtgtcagatgttgaaaaaacagctgatatgatcaggaaaacttagccctattttcatttccataaattcctggcattcaaataaacactacagttatttataaatatcacagtgattacagccttgtacataatttgttatactaaatagtttgagctttccaactaccaaggttctttacaattagatataattaattcattagttctataccaagtttctcatttgtgagatggaggtattatttacttcgaaatggtaaagggaaaacaagcaaaagcatttgcaaatgctctgtaagtaaacctatatcatgaatgtattttcttggccagaagtactggtacagaccgttaagtatggagggataccagggcagtcaagacctgcactgggtacatagaaacattttggcttggttagacagtctctgtttcctgtaccacaggttttcctgacagcctgtgcaagttaggacttttgatcttaatatttgtacagcttgtgagttaggtgaattatttccaccaaacaaaacattttacgaatataagcatccagatggcctatctcaactcccatggcccccaccagacactatatcaatatgtttcttatcagttttgaaattttctccttaagtttcatttagcatattgctgaaagtgggttaaagaggcccaattagtgagatcccagctgggacttttagatgggaaatatgcaggattgccagatgagatcatgggcctgatctagtgtttatctgttaaatctgtttataactgcttaactcttgacttgcagacttttaaggcagccatttgacgtcacagggttgggaacgaggcttgtgccagtataaagccgctgtgatgtggggccattgggcccttctgtttttctcaactatgtgcatgcactttggagcttgacaaacagccgtgtccagtgaactccccccaaagaaaattgaagttgactcaccgtgaaaggcataccaccaaaagtgactcctaacccatgtacaattcagaaagaaagcactagttaacaagtgcccagtgtgtgattatttagttctagaatctgtccagattttctttgttctggctctgttctcttcatggtggccctgcagtttttagatgttataaaacctccctacgattataatagcatgtaagttaaaagttgttgtgaaaaaacaaatgaagatgcatttataagtagtcttcagtctttgcctgaagaagagtaagttggttatttgaatttatgaagcatttacataggaaactagaaaataaaacactaataaaagcgccttgccaggagcagtggctcacgactgtaagcccagcactttgggaggctgaggtgggcagatcacctgaggtcaggagttcaagaccagcctggtccaacatggtgaaaccctgtctctcctgaaaatacaaaatttagccaggcatggtggtagcctgtaattcccttaggagactgaggcacgagaatcacttgaacctaggaggcggaggttgcagtgagccaagatcgcaccactgcattccagcctggatgacagagcgagactccatctcaaataaataaataaataaataacataaaaaaaaaacaaaaaacagggttcagcccaggtctgtatccagtgcccctactttttaccaggctggccaacatggtgaaaccccgtctctactaaaagtacaaaaaaaaaaaaaaaattagctgggcatggtggcggctgcctgtaattccagctacttgggaggctgaggcaggagaatcgcttgaacccgggagatggagcttgcagtgagctgcgatcacgccattgcactccagcctgggcgatggagtgagactctctctcaaaaaaaaataaaaaaataaaagaatctcaaggaagtttaaagaaagaaaagtagtcggaaattttagtagcatcctttccctggagaattagggaggaagaaccacacgttctcacacatgaaccagtgtatattccaatgacaagtatatgtggaaatctcaacttcacccagctcttctctaggtaaaacatttccatcagataattacatgactgtgtgaaatagctctcagaattttccttatggccttttatgaggatctatttgtttaaacttacataattttaaaactcatgccatttaaaaaatgatacctcatttgaccttgccctttctccatggtttttcagacatttcagaaagtgctatgaatctaatttgcctctgttataaatgtaaatagaaaatatagttagtgtttgtggaacatgaagtgccgagtgagttttttgctagatcttgttttggctgctaagatgccaagccagttttagaaccaagaagtcttaatcttaatgtcttgactgtcttgactacccacattactgacggttctgcagggcagcacattttggcagcttaaatcactgtcttctttgttctcttttacttttagtgaatgatcacatcatcacagtgactagggtcttcagagttccctttcacacactggcttaatgcttctgatagtccataaggatttgaacttttgctccacaaagctagaacccttggtcttactctgtaactggaatgcattaaaacattttaaaaccttagggagtcgggtaggacttaaccatctcaaagactgaataaggtgttttgatagagactagttaattattgtactctttcaagtatatgcaatatgaggtattttctttataattaaatgcaggctttttttgctttttatagacatttaataattacatggatgtgttaaaaaattttaatgagaaaattacaaatagtcaaaattttttatatgtaaaataagtgagggagaagaaagagtaaatgtttatagaatgtgaaaaattatatatgtaatacataataaatatgagactaggaggaataaatgaaaccaaattttagtgaacattattagactaatctagaatctaaaagataataaaatctgttaaagctaacatttatagaaaaatacaccgtgaagtatatttttaagactaaaacttcttttctaaaaatctagtgtaaagtttcagtagataacattttgaaaaaccaagtgatgctttgagtaacctggtcattgcataaaaggatatataagattttttttttcttggccattgtgcggcaagttaatttttaggattattgtttttaaattaaaagttcaaaataatttccccagaaaagcagttgggtagaaaattccttttctactataaacctatgaccaacagttctcttgtattttgaatttttaaatctggtttctcctttatttgccttacacaagacatcagtcatatgtaaatgaatgaataaatacacagagtacttaaagagttaaatttgtaaacacaggacatgaaaataagtttagatggaaaaggaattcacatcaagttactttataacaaaggaacaaaaacaggtaaagtataaaagcattatttgtatgtgtactttcaaaaataagaataaaaatacaatccacacaaagtaatttctgtataatgtctcacagaatttaggtattcacttagaagtcagatgtaatgatgtccaaataaaagaacattgaatagaaggcagaaaaggttatttaagattacaggtgatagatacacctctgtggaaaaggcaaacaaccaggtgtgaaacagaatctggctgttcacacctcttagaatgctcaataaatgagtgacaaaatgaatggaggaaaggcttttaggcttagggatgaccctaggtaactctagcaggaaaatgttgattttaacaaaatttcaccctgtccccttgatttatctgtagaggtgtttaccaaattctgaaaacacacttgaaactactcttaaaataaaaaattttaatacactgacattaaaaacatactgtgtatttgatgttagggtagttttatgtatttctgcataacatcaagtgttagtgagtttgtacctgtaaaaaggtactaaatttgttaattgaggctaagaagagaacaatggaagtatgtcttcttgataaccaatcatgtgggtgtccgaatccagcggacctgattatatccaggccctgccactttactgatttgggggctcttcttcaagccttgattttccttcctatgctgttgatcgtggccacctcaaagggtaagaggatcaaattaaatgagatggtgggtgtttttgttggtttttgattttttgttgttaagacagggtcttgtcctgttgcccaggctggagtgcagtggtgccatcatgactcactacagcctcgacatcctggccttgagtgctcctcccacctcagcctcccgaatagctgggaccacagacacatgccaccaggcctggctaatttttttatgttttgtagaagtgttgtctctctgtattgcccaggctggcctcaaactcctggcctcaagtgatctctcacctcagctttgcagagtgttaggattatagctgtgagccattgcgcctgaccgagatgggtatttttaaagctactggcattcagtaatggtaaaaatgctgttaattaatgataatgacaaccttcacaaaggactggtttttattcctaaagtctctttttcttttcttttctttttttcgagacagtctcgctctgtcgcccaggctggagtgcagtggctcactgcaacctctgcctcccaggttcaaggtattcttctgcctcagcctcctgagtagctgggattacaggcgcgcgccgccacgcccggcgaatttttgaatttttagtagagatggggtttcaccccgttggtcaggctggtctggaactcctgacctcgtgttctgcccgcctcggcctcccaaagtgcagggattacaggcgtgagccaccgtgcctggctaaagtctttttttctgtacactggtgtttttattttttctttttttctgtatactggtgttttttgttttgttttgttttgtttttgagacggagtctcgctgtgttacccaggctggagtgcagtggcgcgatgttggctcactgcaacctctgcctcccaggttcacaccattctcctgcctcagcctcccgaatagctgggactacaggcacccgccaccacgcccggctaatttttttgtattttttagtagagacaggatttcactgtgttagtcaggatggtctcgatctcctgattttgtgatcctcccgcctcggccttccaaagtgctgggattacaggcgagagccaccacgcccagcctctgtatactggtttttaaaataattttggtggaacctcaaattccagtggattcagagtatttctaaacattgacttatagttaatggtaaaattattcatccttcctttcttggagctcatcagggaaacacagttgcaatgttatccttaatattctcaagcctataaaatattgtaacctgaacaaacacatcctcatctcccttttattttatcttaattgtgcacatctttctccatttcaaattctaattgaatctctgtttcgaagacccaacatccattgattataatgtttctttagcagccagtgagattcctgacttagaggggttttgtttgttattgttgtcttttttttttgagacggagtctcgctctgtcacccaggctggagtgcaatggtgcaatcttggctcactgcaacctctgcctccggggttcaagtgattctcctgcctcagcctcctgagtagctgggattacaggcgcgtgcctccacgcccggctaattttttgtatatttggtagagacagggtttcaccataccatgttggtcaggctggtcttgaactcctggacctcgtgatgcgcccacctcggcctcccaactgacttagagtttatagataagcctttttgcagaaggggagaaattcagcctcagtttggttagatcactagtaatctaattgcaaggattcattagagtagaggaagagcactgatttcagttgtgtagtggcgagataggttttgcctcactttgttttggctccctgtgcagcacaggaagtactttgcagtgaacttcctaagtttggacttgactgtttacattcttttcaactaacttgtgccttaagccccaagttcttggttggaaggaggttgcaagccatttgatggtgtgtgttagaggtgttttaaaaaatagggttaaggagcaaatttacccactttgcttatttctgtacttttatgaaattcatcagtgacatctccccccaaccctattgattaatttagtatatggtattagtaaatgatgttgaggaccagtaaataatgtattggtataaatggctcatttttatccttagtgaaataaaggatataaaaccattgacttataaaattatttgtattttttaaatgtactacagctttttctttctaaaaatttgttgtcaagttgtacagtttgaaaattagtagctagatcaagatagtgattatctttgggggagggggaagaaaacaagaaaatgcacgttttctacttgctcttggtatttcatttcattaacattacctaaacttggttgggcacacacagggtgggaggtttcactggatcctgttgggggctggggggctgattgctaaaatactggagagcagaaacaggattgtgaaaatatacttggaggcctattgcggtctatgtctgatctttaaatagaaatcttctcaaaatggttttggaaagtttaggcaactgttttttttcaattgtagagtttgtttatgtcagtactgttttctctcctcctcctacctctttttttcttctgcaccagccactaataaaagctcaaagtaaactttgcagaacgatccttaaaacatatacagaaagttaagataggtcctcaaatgacctaacaagcacttaaggtgaagctaaaagaagagctcgttaaatgcattctcttagcctgcctacctcacaagtaggacttattcttcatgtgcttttccatgtagacacagacacccccacccctcccccaatggagtttcgctcttgtcgcccaggctggagtgcaatggcacaatctcggctcactgcaatctccggcctccacgattcaggcaattcttctgcctcagcctcctgagtagctgggattacaggcgtgcagcaccacgtctggctaatttttgtatttttattagagatagggtttcaccatggttgtcaggctggtctcgaactcctgacctcaggtgatccacctgccccggcctcccaaagtgctgacattacaggtgtgagccactgcgcccagccgacacacttgttttttaaaataattctctgagactttttatattacacagtgttaattattcaacttatctttgagtgcataaagcactttcacacatgcatgcatccattgtctcattttgcctgataagtgcataatatgtattagatgcaaaagtaggttgatctccttttcagtaattagaagattaatgtgtaattatgtataattagtcctttctttaaagagctgacaccacgcttgtcaacaccagtaaccctttgacttaaaaaaaaaataccccttttatctttaaaggatctagatcgtcatctgctaattggatatgaaattagtaagtatttcaaaacccatcccttccaagtttaatcctgggttttgtacttggcagaagctgtatgggcacatatgtggcccttatgaatgaaagtgattctctcaatttgcaatcactaggaaaaaaaaatacaagctacttttaaagttgttattgataatgaatttgcacataaacccccctactttttcactggattcactatgtaaccaaaggggtgtgtattttctagactggcctgtttcagtaatatagactggcttctttaagaataaggttgtgatttcttttgtccattttattgttgttttctttttttcttactctttttttcctttttggtgccaaattcactgatttaagcctatgatctgagctttacagagatgaatcacataatcgggaaatcatttacatgttcacattgacagggcatggtttctatgccacatttctgaaatttttgatgtgacacccataaggctttagtcaaatacaaggacgtgctttgttgaggcaaacccactgttgatttcccaagtcagtgaagttggccattaaaattctgaagtttctttggtgtcacttgacagtgaccgacatcagactggaatgtcttgggccaacattaagccaatatggaccattaaaaatttgtttataggttttccccaaatcaccccaaggtctctatcagagttgaaaatttaactgaattgagagctattgcctaggatctgcttcctttaagctttcattttgagtgccttcatttagcaggtagcaggagaaaaagacattgatgcaaaggggaaagaatgtatgccaatgggtttattcattatccttacagtgagacaggagaggaaaaggcagtaaggactctgcaatgaaagggactactggcagcaccagccacgtttggtgtttgtgcattaaggattctaagggatgtttttatgcctaccagagcagttgacctgctgctttaccttctgttcaccttcagagttctcggtgtaaaaatgtgagcatcaggattcctgagtaagagagtaccatctgcactctggcctatgtttctttccatgtaatattatctatttcaaagtgtcactgtaaaatatttctttaatgggtaactgactgtgtttgggttagaaacagccctttcctatcattgtcagggcccaggtctttcaatcatccttttcagaatggtttgagaacatagtggcaaaagttcaaacaatcacgccctctcgaccctttggaaaataaactctgcttgtctctgattctcttgacatgttaaagattgcgtttatcgcttcttcaaaggccctgtcatgactttatagtcatcctatacaaagcagattctcctagggcatggttatatacataggggtggttggctaacacaaaaagtaagtgtgtgttgtagaaaagaaattaattgggctggggtggatggtcaagtcagatggagattccagataccttcgaagtatatctgcctggttcctcctacaaagggaatccagtctctgcaattaccagccaggcctctaagatctactcagactgtgtgaaccaacagacatggggcaggagaagcaggacacacgtcagctccctgtgggggaaacacaggaaataaaggaaactacacagcatcagactggacagcagctcaggtgtcctgctgctttctcccaattggggcagtctcagagcagagtatgaatctcatctttctctttctaagtaatagaagaacctctccaaaaaagccaaaggagaagaatccccattggttcatatttggaagaggagctccatagctgataagcactgggccatagggattagtgtttatcagatgtcaggcattaatccggccatttacaagatctcatttaatctttacaatgaatgctatgaaatatggactatattcatccccagtttacagcagaggactgagacacagaaaggttaaacagtatatccaaggtcaatactggagtagtatttgaatctaggaagtcagactcttaaatccacactcccgattctcacagtgtaagcctcttgttcctggggaggttccacaaaattgattgtgatgctgagttgggatgtctcttttataattgtgactataattaactctagctgatggtactcctagacacctagttttctcgatacctttgccagttgtagaaggggattgattaaccaagaccttcttctcctggttgcttttctaatccttctaggttcgggggcagacatgaggttttccccattttgttattggagcagttactacataccttaaacacaatgtattgttttcaccataggaatttggcttagtggtgggagggtgtgagtttgagtgccacagtttattcaaaggaataaaagtgaagccaaatgtacattgtattttaagaagtggcctagtcactaggaaatattaaaatctttttatccctctggttaatgaggatgagattaggcttctctatcatggccaatattattcttttataacacttagcttgttacagatattatcagaggagaagttacacaggcttgaaatcaaagataaacctgtggaaacattctagactagacatggaaacatattcctgtctgttactaaaacattcaaaagaggataaaattttattgcgttttatggaacatctggtttagaaacaattatgaaggttttttttttttttttaaattcaaggggttaaaaatcaaaactgacttcaagatatgtggtaacctaacacttcctggaagactgttcaattaggcaatcaagcgagaaactgtgcccagactcatggcccagcatcacctctaatggctccatgggcacgtataccacaggaagccttgggaaaggggtctctttctccaagtgcagtatagctgttttaccaatggacaggcaaacatgttttcaaatgactgatttaggcaagggaaaaaaggagtattaaatcagattattctaaggtaaagccagggcaagcactgggaggtagttggattaagaaaaagaatgaggcataattggtgtgatacagtttctcattgggcagtaacccagcagcacaggctgttgtattaacagtcctgatgtctttgcaagcaatgcccttatttaggaaaagtatgaaatacggtttacatctgacggattctttccctcacttgttcattctctgttggaatccatatctacctaagtttcatcacaatgcaaactgaacaacagcctcagttattatctggaaacaatgtagtctttataaaagaaaaatcttcacggaactgtaatgtcctcacacacacacgctctattgggaatttaaaaattggattgtgatatggattctaccagtagttagctgggaatttaggcacattatttttctggatcttttttcatctgtgttgggaagcctattggcattttggatgagaattcttaacattgtgtgggactatcctgctccttttaggactttatcttcctgcctcctgcctaatgaatgcctgtgtggtattcagtcatataacagccttcagatacccttgcgcatttctttttttttttttgagacggagtcttgctctgtctcccaggctggagtgcagtggcatgatctcagctcactgtaatctccaccacctgatttcacgccattctcctgcctcagcctcccaagtatctgggactacaggcgtccgccaccacgcccggctaattttttgtatttttagtagagcgggggtttcaccgtgttagccagggtggtctcgatctcccaacctcgtgatctgccctccttggcctcccaaagtggtgggattacaggcgtgagccaccgtgcccggccaccctcactcatttctaaatactcctaaggagtagggggaaagggcaatgaggagtactaaccatggctgagaactaggcttgatgaccccaaaagttcagtactaattatgaatttcatgatttatgttgacaaacctgtattacttatcagagaacctgacccagttctctactagcttcccattcctgtgatctttactcatagttttctattttaaaaatgtttgagtgtcacaagttttcacttgtaacacagtgatatattaataaatggtagaaaacttctactggttcatttttaactcacctgcacactgttgtctctcagtgagtcctgtgctctccactgtaatagattacccagatgcgggtttatctgtggcctgtcatggagtcatttcaggctccaactgagcgtaacaattgttttcacagactcctggggaaactttcgactataccttgcctagtttctgtttctgatataaccgattatgatgcctgtggcagagaaagctgacaatactcaaaaaactaaatatattttaaccttggaccaatatttgagagctcagaatctctctaaagtatgtatttacttcctagtttctgatggaaatgacatggctatcaattttaagaaacagtttatattcctaacttatgtttttaacttctaaaaaggcaaaaaaaattctttctgcttcatttccttttctcctgttgaaagatttgtggtccccaggatatttccttttcttgtgaccaaaacgctctttgaaaatagtagaaggcttttattgtggctcatgcctgtaatcccaacactttgggaggctgaggcaggcagatcacttgaggtcaggagttcaagaccagcctgacaaacatggtgaaatcccgtctctactagaaatataaaaaatcagctgggcatggtaatgcacacctataatcccagctactcgggaggctgaggcatgagaattgcttgaaccccaaaggcagagaggttgtagtgacccaaaatcatgccactgcactccagcccgggtgacagagtgagactctgtctcaaaaatgataaaccggtagaagacttttattcttagctctctctagaaaatggttttttttgttgttgttttgttttgtttgtttgtttgagatggagtcttgctctgtcgcccaggctggagtgcagtggcaccatctcggctcactgcaagctccacctcccgggttcacacagttctcctgcctcagcctcagcctcccgagtagctgggactacaggcgcccgccaccacgcctggctaattttttgtatttttagtagagatggggtttcaccatgttagccaggttggtctcgatctcctgaccttgtgatctgcccgcctcggcctcccaaagtgctgggattacaggcatgatccaccaagcccggccacaaggtcacagagggatagtagcaaatttgaccttgagtttcattggctgtgggttttcatttggagttggccgtggaggaaggggcagtataaaggttgttagaatcaattgaagaagtctttcagcctactagatgggatcgtatattactactaccttactatttttatcctatagtaaaaggcagtttcatctagttcagtacatatgcctcagatctactggatcaacagatcagaatggaagtgtaggaagctctagcagaatctgataggaagctcttaaagaagtgacttgtggctgtatcccagaggaggtagagcctttgattatttagaagcttccttggagaagttcagtatctcagaaagtcaaagcaggtggggaggggagttggaattctagatcctcagcttttagtcaatatttataatatatattcataagtgggttagcagaaagatgaatgggtcgatgaatcagctttcacttttgaaatggtagaatagtttttacttgctatgaatgcataggcaaagtggagacaacaaggatggggagagactccaaattgaagacagaaacaaatgactaactgtatgtcaaatgaataacacaaccacactgaaggtggggggaatggggaaactaacccacaaataatccaaataatatacatattggcaacatacatttagactaaagacaaaaaactgtaaataaatataagttgtagttaatagactttttatagtggtatcggttagcaattgtgcatttttgtattgagcaaataaataaatgtatagtagataatgagagctaggattctcgctattagaggagttacacataggcaaaggagagggatagaattaaccaaatggtgttagattggaattggagctatcagtatgaacttcaatacatctaaatatattttaaatatattaaaatgtgtttattaaaataaaaattaaaaatattttaaatatatctatatgatgcagagaagtagatctgaatgttagggcatgtatgtgtacacaactgggacacttggaacagcaaaataaataatgatagtaatgaattataaagcatagagctaaatataagtctgtaagtcattactgatgtaaataattaacagggcagaagggagagcttttccatggagtagaaagctgatacactgtatataaaaggagcaatgaaggcaatcccagctactcgggaggctgaggcaggagaattgcttaaacacaggaggtggaggttgcagtaagccgctgagatcatgccgctgcactgtagcctgagtgacagagcaagactccgtctggtggcagcagggaggagcaatgagattactaaagcaccatttggcaactacaatagtaacagttgcttcaggtaataattattaataggtgttaaaactagtagatttttttgaaaaacaacatatttatatagtctggaaatatctgtctataagaaactacttaaaaagggaaaacagcatctttacaatagagaaacttggcaaatgatcaaagctaatatcactcgtaatgggacaaaagtgacatcatgtgcctcttgatattatgcactgtgcaggacatccatctctgatcttcctgccaaaaaatgcgtaacctgaatctaaaccaaaaaaaaaaaattagataaacccaaatcgagggctactctacaaaataaatagcttgtagttttcaaaaatatcaagctcatgaaaggtaaggactgaagaactctttcaggagactaaagtgatgacaactaagtgctgtgtgattctggattagatcttggatcaggaaaacaaagagatgtccttgtttttaggaaatcaaactgaagtaaagggtaaaagaatagcatgcttgctacttacttttaatcagttcaggggaaactgtgtgtgtgtgtgtgtgtgtgtgtgtgtgtgtgtgtttgataaatgtgaaatgctaacatctaagaaatctgtgcaaagggtatataggaattatactatgtctgcaatttttctgtaagtctgaaattatttcagaataaagttctttgttaaaagtaactagtttttaaaaacatagctggttgaatgctgtgtcccagtaggaaatcccttattccacctctctccttttgtttttaattctgtattggattttataaattatacatagttgtaaaaatttcaaatgatgcaaaattgtacaaaagtctgtgccctctctcacccctaccactaagttgtctgctattattaactggttggttgtctcattctaaacctttctggacttacacagatagagaagtatacatgcagatgtatatacagtctcctctacccccatactaccaaacattgttgagtatcttttttttttttttttcaggctaatctagccatggacatctttctcaatatgtatatatagctctgctttgtttctaagcattttttttctaaatgagtcattccattgtccctaaaactcattgtcaaggactgatggactaactttagcgcagaaccatttgtaacaacactgggagcctgaagctaacagaattgaagtactctgtttattgtaccacataaccaagactgtatcaggtatgagggtgctctgaagacctcagtgacaggaatttggagactttttctctagtgagaggctgttacggtgactcagctttggtcaacaccattttctgtgtctctatataggctcaaggttgaaatccttataagagaaaacaggttttgtcactttaggctgcagctgccccttaaataggcagctgtggtcagaggaataagggcacagaacacagacattggcccctgagtacccttcccaaagaagaaggcttagagggcagtagccatctcatcccagcttctcttcccagggctgctctaatggtttcatatctgatctgttctagtcccttcattgagtctgtcttccctaccacccctagagttaccgccaatcactgtgattctcaaatgtggtccctacacaaacagcatcagcattaccctgaacttgttaaaaatgcaaattttcagattccatctcagagctactgaaccagaaactctagcaaatcctccaagttgatgctgctaacatttgagggtcacagacctactacataaagctgatcatattatcccccccatttttaaaacctaatggcttagctgagcacacactccaaagtcctcagtcatggcataagaggtcctttgtgatctctccccagtctgcttgttcagccaccccacccctgacccctcccaccccaacaccctttctgcatcctgttacagagaaatttgctgagccctttcctgaactgcacctggtgaacttctactcttcatcacttcctctggtgccttccctggctccctggcatgaaactgccctggtatacttttaagtatactggacgaacaagaatatgttgtttctcagcagtgtccttttaaagatctcccagaatttgccctgagtagggaattcagcctctgtagattatatggaacctgcatttgtagagactgttggctgtccagtagccagtcagattggggtgcttgtaagtaactgtttatattcaaattaatatactaatattcagaaactgtcctttctggtccatgtaataaataggacaccatttacatttggaagagaaaggttctctgttcattgtgagaagaacggtgaattatgagcaagagaggaaaaggttgcttttgaaagacacaggttcaccctttcacttggcagtaatcttatcctgacagcatttaatgtggagtaattgtagccagagaagaatcttagtaggctttaattaaaaacacaaggaatttttttctcttgtcttcttcctatctgcctctttttcttttttccctcttcgtttctgtgttctcccttttcctgcccctcttttttctcctcttcatcatcccttaacatttaaaatgtttttggcttggctaatccctatggatggaaacttagctgcgcaggatattgattaccaaatatggtattgctgctaaagatgttagaggaatgtggcttgtattctaagcctccggcctctgaataagctgccaaacaaattaggtcattttaacttctgagctttttttttttttttttaaataaggatgctggaactttgatttggaacatgatgttgatgttattttagttcaaattggggggcgggtatgaagaagggggcagggagtaggggagacttagttcagcatgttttaggactcaagccgccagcccaggttgtgtaagaggcaaacacatgatgtggagcttcagttgattctggaacaccagtgaaagagctgaggcatagaattcacatgtgcagcctcattttctgaggctagatgctctagaccacaactaggtcccaggatactcttcacatcatccccagtggcctgggccacaggactcaggttaatgtgaactcaggtttaggaaagttgcttcttcacaggaaggttggtcaagtttagtgccggggaggacgtcctgaagttgatggcaagttgctactatgtgtgtctgatggagtgtggtgcaaatgaggaagtccttttacagcatacctgtacgtaacacccagggactgtgcttgcctcccagcagagaccacagttcttaggtccattcttggaaatattaattctgttgtaatattagctttgttagggtggaagttggtccacctcagtgaggtcctttgtgacctcaccccagcctgcttcagaatgcagctttgctttttgtttttgtttttccttatatactttttcttcaaaataatactgaggtttcccaaatttaaaaaacaaaaatacaacacaatatcagttaaagaaaatgttcttatgtttcacagaacaggcactatctgttcgctttttggtgttgattaggtatgcacaagggtattctccacatcccttttgctactgccctcagttggtttcttctcagaatgagtgagtcatgctcatgaagttccacccactccaagacttctgggtcagggctctgtggcttttgttaggcctccctaaggacctctctttccttccccttccccccttgtttcctgttaatgccattaccatccagccacaggctcttccttgtatacttgaagctgagcctgtgaagttcagagttgttcatcctggtctctagagtaagagagtcttgtttttgtggatatttctttttttgagacagagtctagctctgtcacccaggctggagtgcaatggcgcgatcttggctcactgtaccctctgcctcatgggctcaagcaattctgtctcagcattccaagtaactaactgggattacaggtgcatgccgccacgcccagctaatttttttttttttgtattttagtagagatggggtttcaccatgttgcccaggctggtgttgaactcccgagctcaggcaatccactcgcctcggcctcccaaagtgctaggatgacaggcatgagccacaacgccctgcctgctcttattttttttcaagctcattaggaagaatggtggcgagggggcgggggatgctttggagccctcaggcccatgtgtgtacattcagaacactaaatggcaactgtgttcttaggagactcgttttcaggactccagtccctttccagaccacaccatgaaaacatgggaactgagtgggtcccatgggtgcacatttaaaatacactctcttgggatatctttttgacacgtagggtccagaattcatggtattggatgcttaataatgaagacattcttgaatggtggaaaggttccaaatagacttgtcttgcgctagtgtctttcatagtgtctgtgatttgttttactgaatataatctattttaggtaaactgcaggaatagggtcagaggtaactgaaattactatatattaaagtgtgtaactgtgctaggaatttgctggttcaaattttaaactgaaaagtttttgtctaaaaagaaaaggaatagttgaaaatctgtgtaactacattttttaactaaactaaatcccactgactttcgggacactttgtgttgtcatttttcatgtaacctgtgtaagtagtaagaatgagagtggttgctgaccttttttcctgatagaccagggtttactggtgtgtttattttgtcaccattccggtttgactcaaaggaaatgaaaacatcttccatttgttctctgtttccaaagggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatgtaagtcgatctacttttcattcaaaagtaataataactaagaactgttcatgtgctgcatgtgaggttacaccatgggacatggagctggctgagtcttattttccatttctgtgaagaggttgcctaggcgttcttggtgtcagaattccaaatacagcaatcttgtttgtgattggcttcccaaaagatggttcagcttgaatagaaccataacttcagaatatcatttgatgtactacagatttccttaatgttatattgaccatcatgagtatgcccctagttgccttgggtataaacccttcattcccccctgctcggacacgagagctggttctcagcatttactttaatccatttgttgaaggacatcagctcggtggctttggaaaaataggatattaaaagagaaagaagcagatcttgggaatttggttctattcagtttagccataactctagggggaaaagtaaacacatacaaagaatgtatatattggaactgtcagtctagcaaactaataccagtaaaactttaaggaaatttggggctttcttttccaacttaattggataaggacactggctaattgctcaagacgtcttctaccccacattaataagcttatttcattatatgtccagactaccatttctgcctttccctgaataactttaaaagattgaatttgctttctcaagctcagtcagtggcagaagtggggcatgagacaggccttaacttctcctttcattgcagagccatatgtgatttaatatggcagggcattcaaggaaacccaagtgacttggattccaagttatttggaatatttctgtcctgttgtttttggtctgctttctaaaccacacggttgtgatcttcttccttcgatagtacattttaactcttcttattgaaattgaaggacacatggattccttgctccccccatgtcatgtgcatgtcagatttaatcaggttatctttggaagtcacagccattctgtagttcagtcactcttggtactcatcagtagaaactaacagataagtctccctgaatgttctaaaataaatgtttctatgaatccagaaagtcataatagattaaaaaaaattattttgttctttcaccttctttgtcccagggaaactagaaacctttgcttatttgggaaggaaatctaaacaaaagttacatcttacagtgtacttgtagtacaggaggatataggaacatcttttacataattcttcatccttatagtatctagcttaatactttgtatattgtatatatttaatatttattatagtgagtggataaattgatactgaaattgggctacttgtagaactgtagatgcatttgtatgcctcttctctctgaaatttcttctctcttgatcaaggcatcaaaaaagagtatttttaggatgcctgatttagtaaaaataacctaaagtaattctttgcctttttagtgaatttgccagcctcagatctcagagttctttgaaaagattaattcaggcaggaaatgtaatgctggtgatacttaactttaccttttcaattctttgctgaatgctctttttaacaggaccacgaaactttttctgaatttcctacaacagccctgtgaaataggtagccaggaaggttgtagccagattacgacatgctatacaaaagcaacaaataggaacaaactggacattcacaagtccctgaagttacaggagagcatagaaactgagcttagaactcttttctggcaagctctgctcacctcccttcccagcatacagaacagtgcaaaaatggccagatagtttccatgacagggtaaaaacttgcccagctgttcacagcaacacaaatttgaagtttaaaaaaaaaaaaaaaaaaaaaatccaagcagccagcagtgtattcttgaggaaaataaaagtcagcatgatttatcttaatatagctcatttttacgacacagcatcttgaggagagcaagtccactatggctcaggtcaaccttattatccattgccattccctctgggaactgggaacttgaccgtcacatacaacttgcttacctggaagcatacggcaagactaagaacactgtgttgggtctacacggacaaacccacttgcattgtactcagaattggtactcaaggtggtcagtttaactacttatcaggtgtagaatataatggaattggagaatttgaggattggaaaggccctgaaggctagtctttgttgtaggccatagaggttttttataaatgtttcttttggttactgtttttatatggtagtggctgaaaagcactcgttgccatcactaaaggaagaatgttctgtggtttgattatacaacacacatacacttgaactctcaattctccataaatatatgaacttaatgaacttaaacgagcacccaatgtgctagaccctggagaagaaggaaattggttgctgccttaaaagagctgtcgttccggggaggtgatggtggtcaaagttgtcagaaaaacttggccccatatgaaggacatataagagattctgcagcttagttgagattgaccccgaatcagactgccgtatttgctgagcacctgctctatttgtgccagggatggagagtgagaaaaccaggtgttgcaacttagctgggtagatggtggcctgctgtggagaactttggcttcaggctagaagatgtcactgagaatcctgtcgataattctgccaattattgacaagctttgtgacctttaagagaaaaaaatttttttcacttggttgtgctcctattctctcagctgtaaaataggaataatactttctgattgttaggagaggtaaataaaacaatatcccaggattgggctgaggattaaatagatatagtgtatgtaaagtactaggcaaacgtaaagtacaatcataatttgttaataaaaagcattgggttgcctttctttcctaatagttacagcagatattgatcttctgagttgtcatcacagtttgagtgtagccaattgtctttgcaagttaggagaaaggatgagtgaaattgacatacaatttcaagaaagtagtatacctacctgcctaaattaatagaattgatcattaatttgagcttttatttctcttccttgtatgtaataaagttggaaaagatctgtgagaaagcgggagttaagagatgaggaagaattataaattacattaaattctcttagattgtgcattaggttgtacaggaatgtagtattctataataagaactctgctttggaggtgaagaaagagtaagtcactgttactgatttttatttttctcgtctgtaaagtgatgatgctgtgtgccagatcctctcctaagcatttttatgtgaattatctcatttcattctcaatagcacttattttccagttgaagaaactgaggcctgggaaagtctagtaactttcctgagttaacactgtcagtaagtgtgatggctgaatagtgtcccccagaattcatatgatgaagtgtctgttcctagtacctcaaaatgtgaccatatttggagataagatttttaaagagatgattaagttcaaatggggcccttaggggtggagccctaatccattatgactgctatccatataagaagaaaaagagacaccaggtatgtatatacacggaggaagggccgtgtgaggacagaggacaaagcaaccatctgcaagccaaggagagagacctcaggagaaaccaaccctacagacacctctagactggcctctagaactgtgaggaaataaattatttgttgtttaagccactcactctggtatatcactatggcagccctagaaatacaatacatcaagtgatagagcctagacttaaattctagattttttgtcatttactagttttgtaagtttggtttagttacctaacctctctgtgtctcagttttctcagctacacagcggcaataattagggccacagagtcagtacgcagtgactgttagtgtgcgtgtgtaaaaatgggtacattcacgtgccttttgtccctcataattaaaagacctgtagtttttctgtgtttgtatactcagcatctcacatctataaatacataatggatttttttttttggtaacataccatagttttatttttatgtttttttcaattgatcatgattttcttattcccagcaagtgtggagagaggtgcccttcaaagtactttttaaacttacagtgttactgaggtctgattgggatgtgataaaatgcacatatttaagatggctcatttggttagtttgtcataatacatatgaaattaattgaataaatgttcttgatgagtttatactctttgcaatataccttattataatagtgcccttaaaggtggaggcattcaacacttaatagagcctttactcagtttagacagatcctgtcctttcgattcagtttttatgaagcagatatcaaaaggctccagaactctgcagtaatgaagattcctgtactccagctccaaggagtccggttctgcaggtctgggctaggacgtaggctctgtattttaaaaaaataataattgttcttattttcctcccctctaggcttttaaaagctctttgggtagttttgatgcacagttgagagtcactgataaatcaaggaatttttaaagttaaattctccttcctactttcatattcttctcctttgcccctgcacctttcttccttcctcccttcttccctcctcccttccctctctcagacaaaagcttgctctgttaaattagtactcttagatacctgatcagcacataacattttggtgactaatcagattacttccttgtttacctgccatgtccctggaagttcccatttatccagtaacaacctacgctaactggaagtgagttctgtgtctcatgtctgaagagaccctgtgaaggttcaggagagcctgtaaagtatctcacacattccctcccagagacaacactgagcaaataggaaatctcttaacattcatctctgcgggacaaggtcatccagggcctatctaaagcttcctgtatcccatggtacagagccctggtgcctgcattttttccaaggcagcagtgcatggcatgcacaattagaaagattggcagatgtcttgtcagtttcacgcctgctctccagcggcattgtttatgaagactgactgggcaggaggaatacctaatcaatctgggcagaaggaacgggacacaagggaatgactaaaagttgcaggtgttctgagggcaagactttctatttcatttttttctcataaccaaaatcctacatgcttctcagaagaaaaattttcaggcagtccagcaaaaaaataaaagtcattaaattctactacccagagacaatcaccattaacaatttggtgcttatccttacacaccttttaatatgcacataataaaatgtatctctttctgcattttgaattttgaaatcatttaacttacccctttatctttaggacaaagttttgctgcaagtgagactaagtggctcagtagggccgaaaataatacctgggctctcacaaaacatcacctcagtctctgctgctgttgctgtagagcactgtgtattcatatggcacagatacgcttgctagaatcagagcaagaggaatagtggcagagagaagtctctcttaactctgatgtctcgagtaaacccaaaccagctcctgagctgcttgaattctggcatttgattgaatgattcataggcctttatttaatggatgggaagaaaggaaatgtttattgagcaactactctctttccttaagaattatatgtaaaatacctattttacccctaaggagactgaaactcaagagtttgagtagctttcccaaagtcacatagctcattttaaggcgtgcttggctctaaaactcattgctagtctcacatcaccacactgccttttttttttttccagttatgtttttattatttacctcccaacctgctccccctcctgcccttcaacattgcctacctttatggtccatttcttgattgattggcagggtttggctctgtctcccaggcaggagttcagtggcacaatcatggctccctgcagctttgacctcctctcaagtgatccttctacctcagccttccaaatagctgggactacaggtgcatgccaccacacccagctaaatctttattttttgtagagatggggtttcgccacattggccaggctggtctcctgggctcaagcaatccacctgccttggcctcccaaagttctgggattacaggtgtgagccatgactcacttctttttgaagtagcccatgggtgctgacagctatagttctttcgaagataattccttagaaggtgctttaaactcactcagacctttgaaaatgcacttactaaagagatataaagtcaggatttcagggctggtcaacttcttattgaaaaaaatcaaggccaggcgtggtggctcacacctgtaatcccagcactttgggaggccgaggtgatctcaagtgatcaggaggtcaggagtttgagaccaccctggccaacatggtgaaaccccgcctctactaaaaatacaaaaattaactaggcgtggcagcgctcacctgtaatctcagctactccggaggctgaggcagagaatcacttgaacccaggaggcagaggttgcagtgagctgagatcgtgccactgcaccccagcctgggtgacagagcgagactctgcctcaaaataaaacaaaaaatcaagcttcagactgggcttggttgatcattcctgtaatcctagcactttgggaggccgaggcaggcgggttgcctgagctcaggagtttgagaccaacctgggcaacatggcaaaaccccatctctttaaaacaaaaaaagaaaaaaaaaaaaaaaatatatatatatatatatatatatatatatatatatatatttctgtgtgtgtgtgtgtgtgtgtatgtatagatatatatatttgtgtatatatgtgtatagatatatatatttgtgtatatatatatttgtatatatatgtgtgtgtgtgtatatagatacacatatatatatacacacaaaaaaaattagctgggcatgatggtgtgcgcctgtaatcccagctactcaggaggctgaagcatgagaattgcttgaacccgggaggccgaggttgcagtgagctgagatcgcaccattcctctgcagcctgggcaacagagtgagactgtgtctcaaaaaaaaatcaagcttcagtataattcagtagcatcaaatttgatggccaaggtgcattaactgtaaaatgttagctgaagttgaaccaccagatcgtttatatttagttttggtgtacttttttctctctgggaaaactaaaactaacataggaatgtgagggattgttttacataatattgggttggttattcagggagataaaattttcagtccacgttaagagaacatgcctcaagtcagtcagtctctctctgtttttgaagattgggccttgctatgtcacccatgctggcctaaaagtcctgggttcaagcaatcctcatgcctcagcctccagagtagctgggagtacaagcacataccataccaccttgcctggggtttcttcatgtatttccttttttattatttatttttgtttacttatttgtttgtgtatgcttttttgtttttgtttattttatacataaatatctatgcatttatacatactgtataaaaatacagcatatggcaggttttttggttggatttagtttagataaaacatggccatactattcttaacatgagttctcacctcgtggacccctttccatccaggactatatatccaaagcattgttttttttgttgttgtttgggtttttgttactgttgttgttttttgaggttaggtcttgctctttgacccaggctggagtacagtggtgcaatcatagtcatatctcatcacttcagtctccaactcctgggctgaagcccgagtgatcctcctgcctcagcctcctggctagtttaaaaaaaaaaatttgtagagatgggatctcgctgtgtctctaacttctgggccttctcgctaggcctcccaaagtgctgagattacaggcaagagccactgcacctggccactgaccatactatacttaaacaaattctcacctcatgaacacttttctatccaggtagacttcatcaaaaccgcctccttaagctctaggaaactgataagagcagaactccatatgatctctttcgtgtagagagaggagttcagttagtggtaaataaaaaggggaaggggcctgccctgaagtttcttcttgatatcacccgaaatgctactgggtgggtagatttggaggtacacttagaaaggcagccttcccaccccaccccaccctgagattttgggaagaggtggtagtgagggcacacgtcattatttcacccctttttcttgcctccagtctttgctggtgagggataggagtctcagtgtgaagaacaggttgtggggagaaagtaatgcagagtcttggggcagcagagccctagggtgatagcaaaagaaagaggccaggaagtgagacacagaggagaaagacttcagactgtggcatcagagccacagcacccagctgaatttgtttctttattaaatcattgaacagctgtaaacaaataacaggaactcaggtgccaggcacggtagctcacacctgaaatccagcactttgggaggccgaggcaggtggatcatgaggtcaggagattgagaccatcctggctaacacggtgaaaccctgtctctactaaaaatacaaaaaattagccgggagtggtggcaggcgcctgtggtcccagctactcgggaggctgaggcaggagaatggtgtaaacccagaggcagagcttgcagtgagccgagatttcaccactgcactccagcctgggcgacacagcgagactccatctcaaaaaaaaaaaaaaaaaaaaaaaaaaaatcagggactcgaatctccttggatatcacatatttctattgtaatgcaaataattgccccaacttttgttttatgaactcaaattattcattatattcttagagatgaaagagtaaagggagttgatttactgggacaatccaaaagaaatacaagcttaattatttgatgaccatttctcacctcacttgctcattgtgaaggaaggtgtttcttacattgttgatgcaggctcccttttacttcccttttgtaatcctcaaataaagagctatcttttcttttacagtatggcagttctcaaaagcatggtccacgcacccctggttggtctctgagattccttaagggagtacatgaggcctatattattttcacaaaaatagtttgcttttctcatgtgtagtagtggacataactactggcaccttaatacatatcaagacagtggcaccaaaatacattagtaatcatttaccaatgtgagcattagtaaaaagtgtgcagcagtaaagtgtgcatcctcactcctgcacactttgttaagaaaaaagccaattttgcctaagaatgtttttgataaacaggtaaaaattaacgttatttaacctcagctcttcagtgcaagtcgttttatgattgtgacagaatggggagtgtacataaagctgttctgtagttcttttaaggtatgaagtaaatggctgcttcctttaatccatttttacttgacactcataaactatggttattcagagttggattttggctttttcttgaaaaattgtgagatgtgcctgtcacttcacggaaaatgacagtttttgttccaaataataaaattttaggtttaaggcaaaaattagaatttttgaaaacttgaccaccatgattttgacagtttcccaacagattggtggtgatgttaatgaattttttttttaattgagattgagtgtcactctgtcacccaggctagagttcagtggcttgatcggctcactgcaacctccatctcagctttcccagtagctgggactacgggtgcgagccaccatgccgggctttttttttttttttttttttttaatgtagaggcggggtttccccatgttggccacgctggtctcaaactcctgacctcaagtgatccacccaccttggcctcccatagtgctgggattataggtgtgagccaccactcccagccatattaatgaatttttaaattgcctaatgaaatgggtcaacatttagaagatccacataactcattgaaccattatcttccaaatgaccaatgtattatattccaaaatcatgcatgggtaaaggtctgtatgaaatggaacaatggatttttaaaaatcttttttagtttttactttttattagagaccatgtctcactctgttgccagtggttcgatcatagcctcaaactcctcccagggtcaaacgatcctctctcctcagcctccagagtagctgggactacaggtgtgtgcctccagacccagctaatttttaaacattttgtacagatggggtcttgctttgttgcccaggctggtatcaagctcctggtgtcaagccatcctcctgccttagcctcccaaagtgctgggatagcaggtgtgagccaccacaccaggccaggacaatggattttaatggaacataataggaaagctcattgataaggtttcagattccataatccaagacatctttaataaccaccccttaataagtgttggtgtaatagcagagaagaatatccagttacctgtaaagggtattgaaatattactcctttgaccagctagatgcatgtctctgtgagaccatatttttttcatatactacagccaatacaatatgttacaatagatttaatttgaagcaggtataagaaaccagttgtcttctattaaactagatactaaagagatttgcaaatatgtagatctaaagttttatctttttttctaaatatgtagatttcactaaaatattttaaaaaacatgaattaataaactttttttcttttttaagagatgggggtcttactttgttcttcaggctagagtgcagtgatgccatcacagctcactgcagcctccagctcctgagcttaagtgatcctcctgcctcagcctcctgagtagctggtactacaggcacgcaccaccttgcctgtctaattttctaatttttttgtagagatggggcctcgctttgttgcccaggctggtcttgagctcaagcaatcctcccacctcagcctcccaaagtattgccattataggccttaggcaccgtacctggccccttaccttttttaacttcaaaagtttataacatggtacaaaaccacacaaaagttcttttaggcttgatcgtttttacgtgtgtaaaggtgtcctaaaaccaaagtttaaaaacttctggtcctaataatttaaaattaacattttttggccaggcacagtggctcacgcctgtaattgcagcactttgggaggccgaggagggcggattacttgaggtcagtagttcaagaccagcctggccaatatggtgaaacccaatcattactaagaatacaaaaattagccggctgtggtggagggtggggcacctgtaattccagctcctcaggaagctgaggcaggagaattgcctgaacccaggagggagaggttgcagtgagctgagatcgtgccactgtactccagcctgggggacagagtgagtgaaactgtatctcaaaaaagaaaaaacacctgcaagcttttgtgtcagcctctcctttaaaatgggtcttttatttctgctgtgtattctgtagtgactagcccacgagtaactggttgtatgatgagctggataacataccagccgttcatatagtacctccttgggagactctacccaagtatctttcacaaatgcccaattctctcccaccacaataccagttccaaatgtggtacaagcttatttcaagaaatgtggaaattaaacaaaaattttttaatacaaagatgtaaggcatttataaaattttttaaatacaaagatttaaggcattccaaaaacatagtttttataatacgtgtatataaaaccaggtatagtggcatacgcctgtagtcccagctactcaggaggctaaagcaagagaaggagttgagcccgggaatctaaggctatagtgtatcttgtctgtgaatggtcactgcactccagcctggccaacatagcttgactccatctctaaatacacacacacacacacacagacacacatgagttttcctcatgtgaattgatttttttaataatataacttatttcaatctgtatgttttaaaaattgaatgctgaaaattatgttacccacccagagataagtattttaacattttggatgaatagctatacagatatacacatagatattgtatgaatgggatttgacattacatcctgctctgatacctgctttcattctcagctctagaccttattttttttgtttatcaatagatatataggccaagaccccgtgtgtgtgtgtgtgtgtgtgtgtgtgtgtgtgtgtgtgtgtgtgtgtgaaataccatgtaaccaaagctcttttcattttggaaaacattggcagaaatgatggtcgcttagagagttaaatctctgggtaagtataatgtaatctgtgcaaactcaggtcccttatccttcttttcattctgtgcttcgtgtagccactaggaccctagctatactgagatacagtggaggagcagcagtatctctacttaaacaaaatagtttaattagtggctgaaggtggaggggtgtctttctgtcttttaattaaatagccctcagaaggtcaaggagatcaaactggtcaaacattaacagttctgtgcaggaaattatggtgagttcctgttctaattttctcacttgagtttagcaaacatttgaggggaggtgagagattaaaaagctgaataaggtacagttctgctcttggagtgtttacacatagtagaggaaacaggcctgtaaggagctgccgtgtgtaaggtagagcaagtgttcagttgaagttatagacaatgcttgtgcaactgatgaagccaatcattattcagtgtatgggaaagacctggtggtcttccgcttttagctgaacatgagaaagatttcagttaagtagaaattgtggaaacagatcgacagactgaaggggtgtccagtgtgaggatcaaaaactgaaagtgtagggagaaagaaatcacaaaagagctggagctcatgatccagtgcagctgaagagatgcccagaaggaaacagaaagcagcagcactgggcagggatattgtgccgcatttaggaaatctagataccatttgttctgtgaataggaggaaacttttcaggattcacagaacacatcttaccagcatgctgctttagtcgtctcagaagtagcatgtatggaataggcaaactctgataaaggagtatggagacgtttcttgtgttttttctttgttttgtttaaaacgacttacatttactatgttacacattctgtagggcagaattccaggcacaggttaactggatcctgcttatggtcccacatggctgaaataagtgtgttggctgagttgcaatttcatctgatgtttttccattcccccgtggttgtggtagaatccaggacctcgaggttgtaggcagttagctaggagtatgactttttcattcattcattcattggttatttatttatttatttatttagagacagagtcttgctctgtctcttaggctggagtgcagtggcatgatctcagctcactgcaacctccacctcctgggttcaagtgcttctaatgcctcagcctcccgagtagctgggattacagttgtgcgtcaccacgcccagctattttttttgtatttttagtagagatggggtttcaccatgttggccaggctggtcttgaactcctgacctccagtgatccgcccggccaagcatgacttttttttttttttttttttttttttttctgaaaaggagtatgatttttagctgtcatttaattgaacccccaccacatgccaaatacaggcacatgcatacattatcgttaacccctcctgacctcagtgtaagccagtatgacctacacttgatagatggagcagagagtaagtggaatgctgattacacctcacaccctgagcaggaaaatgatgtttttcaggtgatattgctagtgtcctccacccaaaagcctgaatttagttggaaaggaaaaattttattaaaaagtctctcccttgtgactttgaggaagaaggaggggcatgtttgcaaaagaaacactgctaatgaacgtttccctgttaaatcacaaacatcttaggactcctgtctcatggaatcagtatcttcttggcaggtttacaaagaaaccagtttttaaagccacaatacagaagagattggtgttttccatggcttgggttttatctgcttggagggtatgtgtctaattctctctttccctctcatactggtaaatataccaaaatatagaaagaatagtatgaccaatcccaaaaacgaatcattcatgtttaacagttaccaagatttagccacaactttttgattgcttctttctcctcctcctcagttgtctttttacaattgaattggtcagtccatatattgcattagttatgtcttttaagtgccttttaatctagagcactttctctcaccctacgtgggaggatctctctcttttttttttttttttttttttttttttttttttttttttttggagacggagtctcactgtgttgcccaggctggagtgcagtggtgcgatctcggctcactgcaagctccgccttccaggttcatgccattctcctgcctcagcctcctgagtaactgggactataggcgcccaccactgcgcccggctaatatttttatttttattttttgtatttttagtagagatggagtttaatagagagactattgtctcgatctcctgacctcgtgatctgcccacctcggcctcccaaagtgctgggattacaggcgtgagccaccgcgcctggccggatctctcttttttatgccattggattattgaaaaaagtgccagccttcctgggaaaagattctcctgggtttgtctgttttcttcttttaggtgtccttttgcttgttcttgtgtcccctctatttactgtaaatataaaagcttgatgagatttgcaaggtttggttaaattcagccttgccatttctgggtatgaatacatcataggccatactgtgtactttatatgacatccctttataaaataagtaatttgggggctattccatgcttggtgtaaactaagaggggtttgtggattcaagcctacattgtaaggtccctatcaccttcattttaacgacttcatgtattgatcttttcctcattacttcattagtgactgaaaaatgttgatttttctaattggttgtttaccctgaaatacaggtcatccaaaaaagcaggacaaatgcttaattcttttcctttcagtgcaaattttccgcctaagacattggtgcctggtaatctccattggtgatcactgttttgtggggggttgtttgttgcatcgttgttgttattgtttcccctttccctacttttgagtatcatcgtgaactcgtgttttttagtatattttcaggggtttcagtataccgcagtcattattctttctgatgctcaggggcagggaagggacagtatctttttgatagaaggaaacaccaggactgcctcagtggaccttgttttggaatgtccatcatttgtaggaatgatggagtctcacttcctaatggttcagaaccattagaggtgcttccctaggtgcccaatacgacctatcactgttagagtataatgcatttctttggctatttatctggttaaagcaactcctttatccacagaaaaggaggttgaggtaggaagatccctggagcctaggagttctagtctagcctgggcaacatagtgagatgaacatccacagaaaaacccacttttacagctttgtgagaataaaatttttagaaaggaaatagattttttttttttaattactaagattctttgattaggaactacagtagaacactgggattactagtggctatacgttgttattttcttcccaattgtaaggctttgtcagcagaacatgaaattaagctaaaagtggaaaggtgggacatgtaatagccagaatgttcatcaacaagaaaagaaatttatcttgtaaaaagtgtgtctttgcacgtaagataaacataaaacagactgagcactgatattgactagatgctttaaaataagcagaaggggcagaaagttaaatatttagattagttcaaaatgttagctttatagtagtgtgccattgatggagcattcctggaacatgtcttctctgcttgttttaacacctgaccttggtccctgaaatggaatgtatagacaggaagacagtgatatgggtgggtttgtttaacattttctctttgtttgaataagccctttagttgtttcttaatactgttgaatatttagtggctttctaggaccaagacagtatggttctgtcatgattggtttgggtttattgacgttttccccaaaaggacgggacacacttgaatctgaggttgaatttagttgactttttcgttgtacgtttatgaagaatagatgaactttgtcaacaaagatggtgcctggcagaaagattgaaacgtagtaggctcttggtatgggaatgcttatttccctgcttctctccctcagttagggttattatcgtataaaattattttagattactcatataattgtgagtaacctaaattatatgagtatcatgtgggcataatgtcctccatgttcatccatgttgttgcaaacggtaggatcctctcctctacccccctttttttaggctgggtaatattccaattcatgtatacaccacattttcattgtcatttgccatttagattgcttccatgtcttgtcttttgtaaataatgttacagtgaacatgggagtacagatatttgttaagagggtaaatcttaggttgtgttcttaccacatcctccaaaatcataataaataaagaagatagaatggggggattggagaaatgtcggtcaaaagaaacaaattttcagttaggagaaataagctcaagagatctattgtacattatggtgactgtagttaataacaatgtattgtatatttgaaaattgctaagagagtagattttaagtgttcttatcagaaaaacctaagtgtgtgaagtaatgcttatgttaattaacttgatttaaccattccacagtgtacacgtattccaaacgtcacattgagtcagggccagtggcacaggcctatagtcacagctacttgggaggttgagttaggaagatccctggagcctaggagttctagtccagcttgggcaacatagtgagaccccatctctatttaaaaaaaaaaaaaaaatccagcctgggcaacaagaaagaaactccacctcaaaacaacaacaacaacaacaacaacaacaaaccatgtggctgggtggaggggatcatgccagtgatctcaacatttggagacgccaaggtgggcagattgcttgagcccaggaggtcaagactgcagtaagccatgatggagccactgcactgcagcctgggcaacgcaccaagaccctttctcaaaacacagacacacacatgtaatgttgtacaccataaatatataccatttttaatttgccaatttaaacaatatatgtcaatttttatataatttttaaaaaggataggaggaaacttttggaaatgatggatatatttatgatattgattgtagtgagagtttcataggtatatacttatctccaaactcatgaagttgtagacattaactatgtatagctctttgtatatcagtcatttctcaattaggtgatttttaaaaaataaatacttatgtttctgacaggcaaaaatggcatgacattttagtagtttattaataaagttttttgtcatatacttattaaccatttaatttgagaatggtattttccagttatttgtccatttcttcttttccttattgataggtctatataagaagaataatgctttcttgactagtgtagtttgctttcaggtggatactttcctcattggttgaaggagaagctggtgattctgttctctgttttcctatccctcaaaattaataatatgagcatctccacagctgatggtttctctttaaaataatgatgaattaggctggctgcagtgcttcacgctgtaatcccagcactttgggaggctgaggcaggcagatcacttgaggtcaggagtttgagaccagcctgcccaacatggcaaaaccccatctctactaaaaatacaaaaattagccaggcatggtggtgcgtgcctgtgatccttgctgcttgggaggctgaggcacgagaattgcttgaacccgagaggcggaggttgcagtgagctgagatcgtaccactgcattccagcctgggcaagagagtgaaactgtgtctcaaaaaaaaaaaaaaagtaataatgatgatgaatttcctgttttgttttacctcactgagctgtaatagtaggaatacaatgagataatatactttaaaatgtgttgagtactacataatggcatgttgcaaatacagtccaaggcttaagcagcttcatttggagtatcatttgagtaagattcctctagaaatctagtgtgccagggctttagggtgagcacatgacaggggaagaattcctcaaaattgtaactgtaaagataaatctaaccttgatgctttttcttttcttgatttctgggctcttgcaaagtccataaattgcattatacttaatatagacacattttgtgttctcataactgcattagcatgttaatttctgctgagtgggttagtaatcaaataaccaagtggctagacaagaaaagagactttataagtggattatcttgctttccagtgttaccatttttaatgatggtctactcatttttcctttaactttttgttatggaaaatttcaaacatatctaaaaattgaaggatttttagcataatgttttattgttttaagttgtttgaatcaacattcaatatgttccctctcattctctctcatgttcttgcttgcagtttatttgttgtggaacccagattgtttgtcctgtaatttcttagagtatctctgtgattttgtttagcatgattctgtttctaaattatctgcaagttatcttttatatatattttttatcttgcaagaatacctggtagtgtgtacttcaatcaagaggcacataaggattagtggtctctcattttgtgatgtttacagccattgattatcaggatctaccaattgcccattcctttttatgtttgtttattgtcttttggttatgttaatgtatttcattaaattaaaaaatattttataataatttgccaaacagtgctgtatgaagattataccaatgtacacagccaacagccatgtaccagaatatccaaatttttattttcttattttataggtaactgatgcttaaggagatatgtagttttccccaagattacacagctattcagtacaatactcaggtctatatatgtaaattttgccttaatctcagacataacaccaattttcttctctccttccactacagtcccaggttattacccctcttcattttttgaaaaattatagaaaggcagatataagtagggcaaggtgagatgaaaagaagggaactaagcagttaacataggagggttaaagacccaaatgtgatttccagaacattctgcactttcttctctcatactgattctctagtgcttaaaactatccagccattgataatcattacttagatctactaattcattccctaaccttttgtatttttcaaaataagcatttgatcacattaataactttagaaacttaatttcaaactttatcagtaaaactactttttcgtagccctttaaagaccattattagtactatttataaaaagtaccaaagctgggatcctattggaatattccaagtttagtctatcataccatttttgctagcactttatcagtggatatatttatgaaaaaatttaatctagatgtgtttgatgtgtcattaaaagttatttcaaaaatcattttattgtaaatgtttctcaaacttaagttctcctaaaatagcaatttaacttgatttctggtaaatagttaaagattagcaaagtttttaatgtcataatttttagtagaagttaaatttaggaattagcagtctcctacttcctagttcaaatccaagttaacttttaaaagtctaaaatatactggcctctctcaagacctagacacagatatcaacaaatgccaaaagagatatgcaaacaggaaactatgtgattcttttaacaaatattttaaatcatataatcatttttccacttgacccttctccttcctcctcctccgcaataaaaagaatctacagtaatcctgtagaaactttagaaatctttgtttttcttacccacaactccctatttatatatgttaagtgctacctgatatggcaaacacatgtaaatgatatcctttcaaagttcactggcttcctctctgaagtcatctaaaattcagaagccataaaacaaaccatcagataaaagtgagactttatactgaaatagaaccataagaacatttttttgcagtttctgcaaggaattgtgttacttactcctttcagtgaatcagtaatgacgttttaggtcaggagattggaagctgcttgcgggggaacgtaggtaggtgactctagtacagagaaaggcatttgatgtggcacagccctaggccaggtaggtggcgggtgtcaggacccatgctgtagagctctctgcaggttgcagctcctccagctggccttcctagccctgaccaattactctgaggcttcccagccctaagctgcttctcttgaattctcctctgaatagttatacagtgtgtgaaagaattccttgccactcatgagaaatgtattgatttatttgaaaatatttgatgcacttaaatcccagattagtagcagttatggtaacagatgtccttttgatgaaaagccatttctgatagatgggggatccccatagtgaaatgagaagagcttcacttcctactttgtagagtccaactctttagcacggtgtgcaggcccttcatgatctgcgccccaactccttatccccagattcccagccataaggtctccttcaaagccatgctccaacaatactcagctctgggagtccaaacagagtccatcatgtattcgctttgccttcaggctttttgcttagagagcccaatttctggccataaatttaatccctttacaaattagctgcttgtccttcagaagtcaccttaaccatctctttcttcataaagcttgcctggctctccaaatgtaggttaattgctctaccgtgttggttactgctgtagagctgtgtttattcaggctgcggcattgatactgactacatttatgtaggaccattggtggaaggcaagttccccaaagtgaaaacaatccactgagataaattttctaaccgcaattttattttactgaaggctgggaagccctcaggttgcttcttgaagcacacacagcctggagaaaagcaattctgaacgtatgtggctaccccttgatttagatgaattacattccagtcaaaaggaagaacagatttgaaaatttaatggcaagactgacttcattcaggaaatcataactaattttaccaagctaggggtgagttgatggtgtgcaataaatttgggaagaaggaagaaggaaatgggaatgctagattacagttaatagttttctttaattcaaaaggtattgggaggtattgcagatctggaagaaggagaattacattatcagaaagaactcagcaacagattttaaaggagatgtggctttgtcttaggtattttctcatctaaaaaaattaagagaatgattaaaaatgcatcaccaaaagtgccagggtgatgattcagatagcgctctgtagctccatcctaaaaagggcatgctagcctgttcttctgatacatacttacaaaactttcccagttctctctccacctctatttatttccagcaccatttgcccctttggacctgattctcatctaaagatactctgttgtgggaagtaaatacatcctgagaaaaatcactttctggcaaaaccttgaagtgagttactgtaaaccctcagacacgctactcattctatatttgtagcaggatcagaggaattaacagatgaaatggccctggaagctggtgtgagcatccacaccccaggccttcctctcgtccctaatcacacagctaccctgggaaaccttttctggggtctcccagcctcactctgggtggagtttgttctttcctcaactgccagctccccaggtctctgaattaaattttgcattctcatctcttttcataaattctctttgaagatccagagacaactcttccaacagtttctattccctctgagacatttgtaactaccatctcgtcacccactagctggcctacaaccgttggttacatacacagcccagtcttttcataatttaccatccaagccccacactgtgtgtgctgtgggcttcatgatccatttaccagactattcccagccccagcatcctgtgctgggcctcagcacagtgtgagaaaaggaaaacttggaggggatccagcatgaaaaaaatgaaagattggaaagaggagtgtctgtgagaaaaggatggagaagctgggtaggtttagctcttgagaagagatggagaatgagacatatgttgagagattacagtcagcagtcccttttcttgtttcactttctccatggttataatatccttaaagataggtttaaaatgggccaggcatggtggctcacgcctgtagtcccagcacttcgggaagccaaggcgggtggatcacctgaggtcagaagttcaagaccagcctggtcaacatggtgaaaccccgtctctactaatatacaaaaattagccgggcgtggtggcgggcgcctgtaatcccagctactcaagaggctgaggcaggagaatcgcttgaacccgggaggcagaggttgcagtgagccgagatcgcgccattgcgctccagcctgggcaacaagagcgaaactttattccaaaaaaaaaaaaaaaagataggtttaaaatggtaatccttgtttagtggtggattgtgtgtgtgggggatgtcacattgctttcggagaggtactaaggtgctcaagcagtctctgcaataggatttggttccctgtcttttctatcccttgtctgatcagccctgaaattttactggtacagagactggagaaagaggggtgggtggacaggacatgtaggatgggggaaactcctgcaagtatgtttgccttatgggctccagatggggagccgggacatacctgtgaccatggtgggtcattaggtcttaacatagttctgggaactggtgaaacctgaggtcattagatagtgcatgtttgacctttgggcatctttaggaatgagaaattcaataatgaggatgatagcagctgttactcattcaagacatttctgttaaacacgttatattcattatctcattcaatcttcacaacaccctgttacataaatatagtcattatcctcattttacaaagaaggaattaagctcagagttttttaaatgtgcccatggtcacatttggtaagctgctcatctgaggttttaagccaagtctgtcaggtcacagaccccaaggtgggggttttttggtttgttttttggtttgttttagcagcgttattgagctgtaattcacataccatacaatttaaagcatacaactcagtatttttttttggtatgttattaatttttaaaaattgtggtaggcccagcacagtggctcatgcctgtaatcccagcgcttttgggggccgaggtgggtggatcacttgaggttaggagttcgagaccagcctggctaacatggtaaagcccacgtctctaccaaaaaaaaattaaaaattagccaagtgtggtggcatgcccctgtggtcccaactactcaggaggctgagcgggaaaatcgctggaacccaggaggcagaggtcacaatgagccaagattgcgccactgcatccagcctgggcaacagcgagattctgtctcaaggaaaaaaaaaaaattgtggtaaaatatatatgacataaacctgccattttttttagtgtacaattcagtgacatcaattatattcacagtgttttgcatccatcaccactatctatttccaaaactttttcatcaccttaaaaactctaactgcatgcctgtaatcccagctactcgggagactgaggcaggagaatcgcttgaacctgggaggcggaggttgcagtgagctgagatggtgccattgcactccagcctgagcaacaagagcaaaactccacctaaaaaaaaagaaaagacaaaacaaaacaaaaaaacaactctaaccattaagctgtaactccccattccctcctttccttgtcacctggtagctgaaaatctactttctttctgtctctgttaatttgcctcctctagagacatcatataagtggagtcatacaatatttgtccttttgtgtctggcttctttcccttagcgtaatgtcatcaaggttcatccatgttgtagcatatattagaacttcatcctttttttttttttttggtgagatggagatttactcttgttgcccaggctggagtgcaatggcatgatctcggctcaccgcatcctttgctttccaggttcaagcgattctgctgcctcagtctcccgaatagctgggattgcaggcatgtgtcaccacgcctggccaattttgtatttttttactagagacagggtttcaccgtgttgcccaggttgatctcgaactcctgacctcaggtaatccgcccacctcggcctcccaaagtgctgggattacaggcgtgagccaccgcacccggccagaacttcatccctttttgtggctgaatgatgacccattgtatggatatagtacatctggtttatccattcatttgttgatggacacttgagttgtttccaccatttgcctattgtacagagcccaagttttaactggaatgtatattacaacacaagctgagaaccaccccaggatgagatctcctgatttcaagcttgggcatcacaccatgttgcagagaactggtagcctcagtattgagagtgaggctgacctgagttttgaaatacaagtctatcacattagttgtgggacgtgggtcaagttatttaacttctcagactctgggtttctcagtctccactatccagacaggtaatcacaacaacacggttgaatatgtgttctgtcatgggaagttttctttttttcttttcttttttgagatggagtttcgctcttgttgcccaggctggagtgcagtggtgcgatctcagctcactgcaccatccgcttcctgggttcaaacgattcttctgcctcagcctctcgagtagctgggattacaggcacgtgccaccacacccagctaattttgtatttttagtagagacggggtttctccaggttggtcaggttggtctcgaactcccgacctcaggtgatccgcctgcctcggcctcccaaaatgctgggattacaggcgtgagccaccacgcctggccattcatgggaagttttcttaaaccctttatcttttcaattatgacaacctatgagaataggtactactactactattcctcctcctcctcctcttttgatgaggaaatttgcccgaggtcacatagatggtaagtgaccagggacttcaaacctagatctacctaccaaaacattataccaatccctcatgcaaaccgtatgtataagtatgggcttgtattatatatatatattttttcacttgtttatgcaactttttccatctttatagacaggtcttttacgttactattttcggtggctataatagtggaccattttatagttattgaactagctcttagatttgaacattaaggtatttcccgtcccctaattaaaaaaaaaactttatatgaccatcttcttaatacttaaccagcagtcggttctagatttgtaggggaccttgcctgcactgggatggcttggacaccttcattctaaaatgttctgaagctttagggagggaagaaaccccagaaactccttggttcctgtgttggattacccaccaaagatctgaagtcatgccagagccaaccagccttctgctgaccctcatgcccagatttccttgattttgcatcattgcaactgaaaaaagatttcagactgacaggcaaccttttagtgttggaaggtaatctgttcatcccagaccagtgatcctcatgagatagaattacttactattccccagaaagaagcagctcagttagtctaaactcttgcagttttcttttggtatttcagtgcttctaactaggttaggataccctgttctcatatatgaactctgcaagaatgagtacaattttcaggaatgagagggcaggaggggggagttatttacattagcatttgccaagttttcactgtttatcttaccggaaagtcaacagtgtgactattaacctcctgcataattaaaatttgggccttgttatggttgttcttaaacttgtggttaaatctttgtgatttttagaaggcaaagagatggagagtaaaaggaagataaaatatggctattcaggggactgaggtacatggacacctggagctgcttgttgtaaattggcaggttcattgcagccggtggaatgaatgataagggaattgtgtaggtcagagtctcccaaggtacttagccagttttgtttaataaagttaagtagatttttttgagcagatcacatttccctggtgaagctggagggctgtgagatttcttttaaagaaagtcttctgctcttaaatgaagagcattgttcttattttaaaaataagtacatgaacaccaatataattaacaaagctctatcttctagtgatcattaatttaatcttagtacaaaagagctgaacaatatgtctgaggcacgaagaatgaggaagaaacagttaaacatgagaagtggctgagggcatacattccaaagcaccactccctgccacctccctctggtaggtaatgaccccagatcatctgatgaatcaagggattgtttttgtactgaggatggatttcctatagcagagacaacattatttatacccccagattgtattccttaccttttttcctatattaatgtcagttactaatgttactgttgtttgacactgtgcagtaactatatgcatgtcaaattcgcattcagtttttataatgaactaggtgttagtttttatttttatctgttgcatcggaggctggcagagattaggtaagttatccaatgttgcacagctggtaacatttacaactaaaggacttaaaggggagaaacaccggtttgactttcaggtgaagcttattgagtcacctttcaccaccatacgcatacattctggaattaccccatctataatactgatacgaggaagtcatttgttcttttcttgtccatacccttttcagtgaccatctcctcaccctccaaagagttcccaggtcttcggacacttttcagatgacataccacatcttcctaataacctgccactgtaaaataaggagttccatttccaaatggtttctagtacattccgctacccactcccaccgaggaccaccaggatacattcagttaaacaggaattacctgtagataatcagcattactgcctgaaatctgggctggaaacataaatgatgatgatactcaaccagagtttgcctcacagcaggtgctcagtgtttgttgaagacaaacagttgttaaccaagatgaatttaaatgtgagagtagccctgaccaaattgacatttttggatcttgtgggctttattcatgctggtcataacttcatttaagaattagcctcattttattttttgtaactggagactgcccagttattcatccattttgtggcctcatggcttaacactctcagaaaacattttttattcactgcgatcatggagtatgcagggggattatccttcagtggcaacgtggaacctagcctgcctctgaaagcaagggaggtgaaggaaagcaactctcaggcaacagcagatgtttccagaagtggggttttgttttgcactgaaaatttaatccaagggcaccagatttttaaaacatgaatgaatcaaaataggagagtttggaaaaggagggcacttttgagatgtccacactttgttgctagcagctttgttacctgtggagagacggttctgggtccatgggtggctttgctcctgtaggtttttcttgtttcacagtaattggcagtaaaagacttttcatattcaagtgtgattgatctagcctggcttaaagagatgatcaaattccttggcacacagaaatgtttagcagccttcttcatatccattgccattgtggtgcctgataaatctggtgctagtgaataagtactcattactcaaagaagtgtagaacagatcctgtggaatttcttttcaggactagtaacagtataatttttgcttgtacacaaatcaggttttttccccccaccagaatgccaggttaaattatttcaagtctataaaaattgtttgttttggccaggcatggtggctcacgcctataatcccagcactttaggaggcctaggtgggtgaatcacgaggtcaggagttcgagaccagcctggcctacatgattgaaaccccgtctctactaaaaatataaaaaattagctgggtgtggtggtgggcgcctgtaatcccagctactcgggatgctgaggcaggaaaattgcttgaacctgggaggcggaggttgcagtgagccgaaattgcgccactgactccagcccgggtgacagcacgagactctcaaaaaaaaaaaaaattgtttttgtactctgacttctgaaaaacacagaaactcagtttggaggcagtgatgccttgtcaggaatgtagactctggaaacagattctttagatttgtatccctctacctataagctgtatgaccttggacaagtcactaaaactctccaagcatcaatttcttcatctgtaaaatggaaatactagtatctagctcaaaggactaaggggagattgagactttatgcttgtgaaggatactatacacgtaagcacaaaataaatacttgttctggtttctagggatacattaacataattttaaaataggatttcagtcgttgatgtttttaacattccctgtggatagatcaagggcaagtagcccacggctagccagcatagatggggaaccagaagaacgggggtggtggagttgctgagttcctagagcaggagaaggccatgggtgagagtgggagctcagttcagacacacagcttcattctggaattcctcacgtggctcacagaagagtttgcttatgtgtgtgtctagatttatgttatttgtgctatgaagtatattttggggttctgattcatcagtttcctaggtcagtggcaatctctttaaaactgataactactttgggaggccgaggcgggtggatcatgaggtcaggagatcgagaccatcctggctaacaaggtgaaaccccgtctctactaaaaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaaaaaaaactgataactatgacaagttagtagtttccaccttttttcgtcaaggactggaacctttgcagatttaagaaaactgacattttcttaaaagtcaaggaaatgtgctaaactgtaaatcattgggtggattacataattctgaagtttatatcctcttgctagttttaagttagttgtaggcactttgtaatatcgttaattttaactaacttttcttgaatatgttctgtgtgccagacatatgtgctaaggataggagataacagttttgtgaaggacatagacacagaaaaagaaaatttttcgtataagcagtaggtgcagtgttcagggtacacatagcctgttttgggaggtgtaagaaaggatatctggtctttactggattttcaagagtgctccatgccttgatgaagactcttttaggcagcacctgtcccaactaagagtccctgctaagaaatggaaagttcattagatcagcttcattaattatcaaagaaatctacattaaaataatagactttaataacatttctttagatatagggtgtcactatgtttgcctaggctggccttgaactcctggcttcaggtgatcctcccacctcagcctctgtagtagctgggattacaagcatgtgccctgttctgtttttaaggatgattcccagtgttgttacattaaaatttggtacaaatgttgctactttggggattatacattcaaacagcacagttaggtgtattgagatccttaaaaatgttcatttctgaaagcttggcaaggttatctggaaggctgaggagagaggatcacatgggctcaggagttgaagttgtagtgcacattgatgatcacacctgtgaacagctgctgcactccagcctgggcaacatagtgagaccttgtctctaaaataaatcaataaataatgaatgaatgaatgtctgctatgtaacatgcgctatgctaggtactggagatacagcagtaagcacaacagacacaggccctgcactcagggaccttatagttcaataagagatcatctctctcttttttttttttttttgagatggagtttcactcttgttgcccaggctggagtgcaatggcacgatctcggctcaccgcaacctccgcctcccaggttcaagccattctcctgcctcagcctccctagtagctaggattataggcatgtgccaccacgcccagctaattttgtagttttagtggagacggggtttctccatgttggccaggctggtctcgaactcccgacctcaggtgatccgcccgcctcggcctcccaaagtgctgggactataagcgtgagccaccgcgcctggcgagatcatctctttttatggactagatagagatgtacccaagcagcaatttcaatttcattgaaaagacacctctgcctccccttgctgtcataaccatccttctcccttgctccctttcctccctcaccaaataacagatgtatgccagaagaggtgtgtgagtgacaaatgaaagttatactaaaacactgtttttgtttgtttataaattttttatttttaaaaaattaatttccacctgaatcatagattcaagttgccctgaagatatacttcctgaaacactttttttatgttagaagaaatttattttccttccttttctactctttctcctttgtggacctcctttgtggcgggcacagtagtgaatctaacagaacagtatgctgctctcatgaagcttacccaggtctctagcagagtgggactgagcagattttcttatgttgttcatagatgtaaaaccattacgttttgaaaatacagctcctgttaaacatccagacttgattgcagttgtcaaaatccaggctcgcagagaggctggcagacacttggaatattctgctaatgccagggaatagactttcctggggaaactctgggtaaccctcatcccagcagctgcaggtcataggaaggaggaggaatgaaaatgtccccatgtgatgagtaagagtaggtaatagtagtggcttaagttcccagaggaacagttttcttcccactcatgctcagggttcccttcaactctgattagaaagcagatccttttaaaatcctggattgcatcgcatgatttcttagcctcgaagaagtgggcagcaaaggaagaagacaaccatcaaagcagtgactggtcagaacagcagaaaatcattaaatggaaaagtgactctgggccagttgaatcatgaccagcttgcttttggaatttccttggcatatttattttggggtctgcttgcttttttgcagaaaacttgttgcttctgcagtttgtatcagagaaatagtggagtggggagacggtggaagttaaagtcagtctggctgagaacccgcatttgggtaatagaagtagggatgggaatgagaaagacatagagaatatgtctttacatagagaatatgtctttatcatcagtaggtggagctaatgaacatggagagaggcagtgaagtgcagaagtgaagggtctggactcatgatcttgattgattcacatcctggctctgtgagagtcgttgggctggatatttaacctcgctgtgtctcagctttctcataaggtaaaaggggctcctgctaatgtctcccatgaggatgattggtgcacagaatgtggtcagtaaacacgagctcctactgttgttactactgctatcatcactgtagttatctttgtcatctttattgttactaggacttagcaattgtttggacatgggaagtgatggaggcttctagcctgagtaaaagggataaaggaaagtattggaggtaagaagaggaattggtttatgagtgacagtaagttcacttctccatgagttgagtttgatgagtttagggtgtttacattggagtagaaatcaatgctataggtttatgagtcatcctaaatagaattagtagttgaagcaatggaaatgaccaaggtccatgatagagagaaaatagaaatagtggagagccaagccgagacttgatttctcctcatgactgcagcacgtagtacagttggttccctgtacagaacacaaaaaccgccatggtaattagtgctgggtggtggaaaacacctcctttgagctattcacccaatctttttttttttggagacagagtctcgctctgtcgcccaggctggagtgcagtggtgcgatcttggcacactgcagcctctgcctcccaggttcaagcagttctcctgcctcagcctcccaagtagctgggactacaggtgcccaccattacacctggctaatttttgtatctttagtagagacggggttctcaccatgtgggccaggctgatcttgaactcctgacctcaagtaatccacccgcttcggcctcccaaagtgctgggattacaggcatgaggcaccgcgcccggcaacaatcttttcattagcttctttcataaacatcttcatctacatttgtcttcttgggaagccagtgaatgggtttgacattctatgggaactgtattagttccctagggctgccacaacagattaccagaaactgagtggcttcaatggacagaaatctgaaatcacggtgtcagcagtgttggatcctctggaggctctgaggcattcctctgcttgtagagataccattccagtccctgcctttgtctcaagattcctaaatcaatctgcaaagaccctgtttccaaaaacagttatgtactggggttgcaggtggattttgatttggggaaatgccattcaccctatcacaggagctagtgtgcactgccctgcaccacgggagctggcgtgggctacattcttagtcctgatggcggaagagcatgtctgaataggctagtccttaaaagagtgggcctgtatggctgatttttgaagggcttaacaggcatggatcagctacttgctgaggtatgtgagtgggagttgattgctaacagaatccttgatttatttttcttgtttcaaaatttatattattcctattaaaaatggaatttttcatcatgtttggattttctgtgtcatggctgctgtttttcctggccaaattcttcatctacgaggcaagctctcctggaagactctgtccctgagtttcttatagcaagttgagtatgctaaaagccagacataaagaccacctgctttccaggggacttgtcatcaccagcagcagtgggggcatcacccaccccagggaggaaaggatggtgtatagaagggaccccaaactatgagacaagaggcatgagttctggtcttagttcagacattataagttatctgtgagaccttagatagatcttggtgcctttatgtgcttatttctctcccacccagaattaatcctcagtctggctatttcttcacctgaaggcaggatggaagtatattttttcgtcattcattttctcaagtataaagcaaatggttgatttttttttttaatcttttttttaaaaaatcttttcttttttttttgagacagagtctcgctctgtcgcccaggctggagtgcagtggtgtgatcttggctcactgcaatctgcacctcccaggttcaagcaattcttgtgcctcagcctcccaattagctgggattataggcgtgcaccaccacactcagctcagttttttatttttagtagagatggagttttcccatgttggccaagctggtctcgaactccagacctcaagtgatccacccacctccgcctcccaaagtgctgggattacaggcgtaaaccactgcatctggcccaaatggttgatttcttgatattgtcttataatatggtggtagacactggtgagcaagaataagagtgagcttgccgtccaggaggtaactgctgtgactggggaggtgcaggatgtggtggagcacagagaaagcagtcttctagactagcagtgcgagaccaggcccctccctgcccccagaagaggcatctaagcagagcacactgaggagttaagctgggtggaaggagtaagtaactgatgagtaagagttaagccaggcaagaggagggggagaagggtgcctctggcagagggagcagtgtgtgggcgagaggcaggcatagtcatgcaatggaagtgactgatcccagaccatgagggagaaccagatgagaatcagggctggagaggaggatgagggccagatcatttggggtcttataggccattacatggagtttgggcagtatccacagagcaagaggaagtcatagaagggttttaagcgggagtgacatgactgaattaagagacagggtcttactctgttgccctggctagaagtgtagtggcacagtcagagcgcactgcaacctcaaataagtcctaggttcgagtgaacctcccaccttagcctcccgagtagttggaactaaaggcatgcaccgccaggcctggctaatatatatttttttaagatacggggtctcgctatgttgcccaagcttgtctcaaatcctgggtccaagcgatcttcttcctcctgcttctgcctcccagagcactgggatcacaggtgtgagccactgcacgcagccaaactgtgtatttttaaagttgtcttgacttgagtgtggaagccgggagggcttttaggaggccttttcagtaatccagtagtgttggtgaagatcaaactggatcatgggatagattcaccaggaccttgatgaaagaatgaatgagagggaggatggggtgaccaccaggtctgtggcttgggcagctgagtggaaggtagcatcttgctgaaatctggagccaacgaggacaggtcattgagggagcatgtttagttttgagtatgtcgagcatgaagttgctatggaatatttccaaatagatgttttcaggaggcaaaaaagttcttaaaccttgtgttaccaactaaactcagagatacatggccatacttaagtccattaaagattctccttgttcttccatctctcagttgtttctaagagtcattcatgtttatctctctttcaatgtgaccgtagactgtaagcttcacctttctgcatctgtttcctcatctaaaacgaaaaggcagaagatgatcttcccaagctctgtaggcttaaaccttcatcagacgctctgcagttctttcgtttcaaagggattacagggtggagttggaagtttccagtccttgtttttcagaatccaatttgagctcttctggttgcatattctcatgctaagaaaaaaagcctattcagatgtatattgtgagccctcaacaacattatcctcagaaggtgcaaaaaagaaaagatgtagccagattggtgcaatgggaaaggatttgccctgcctctcaggagggatggattaggcccagacaaaaaagccctggcctcttgatctgccctctttctgcttactggggcctggctcactctgggtggtcaagagcctcttttgtcaagaggaatctcaccccctccctaaactccaattcatcccagtgggccttgggcagcaatctttgtcttcttttttcagccttccatcctgtaaagtttgagcaggatgggcagtgactcaggaaggtgaaacccatcagggccttgcctgctccttcagtggggagtccttgtgaagggcttgtgctgtggaaaaccagtctctctagcttttgtaattttctcaagcaacgaaaaagcaaacaaacgcaaaaagcttattctgctttaatacccatttccgtcaaaggagtgtatgtgtgtgttaggagagtgctcaggctcatactggaaagttaggtgttggtgaggactgcttcaggtgcgatcctgacctggtcagaccacgtatcttttgatgtttatggtaattccacattccttcatgatgggagaagggagacggagatgataagatgtatcaagggatttatcaagtgtaagttcacctttatctcttttaggcttctgcctcactaatacgttactactactcagcaattttgagtttaggggatttcagaccaaatcctcttttctgctgggctgggttttgtgcaaatatcaatggtgaattgtctctaagcatcagtaaagaactaatgggaagtaatgcttcaggataaaaacagagaaaagtctgggaaacataaattccagcagtcaggctgacactgaaatctgattccagcttatctctgttgcttatctctttaggatcagatatcttaaaggacatactcatttcatttttaaaagtttctaaaggaaggacctactgatcaggtaaccacctctacccaccccaccccagttagccaggaagataaggaaggaccactgacaggctgcaggccaaacacgttccccctgagggctctgccatttggaatcagttgtatgtatcagttttatggtcttctgctatcacagtgggaacagacaagcatgggccacagtgtactgaggatttaaaagactcagaatgtcttaaaatagcctggtcgctaaacaacaataatagtttggcattcctgagaatggttgtttgtttaaaattcaaggcattggttctggtagcagttagtttccactagctgggctcccacgtgagttactctggaaatcacatggtctcatcacaacaggaagcacagggatctattaagcccctcccagcccctctgagggtggtccctaagccttgggctacaggcacctacacaccctagaacacagtagatgctgtggacctgatcattttaaggactctggtgttgttgctttcaccctgactaataatgatcagtccactcttaggggcttatttctcccacctagatgcacaggcagtctgtctttctatcaccaagtcctgaggaggtagtttttactgccttgttgagaggagaagggagtcaggaaggccaaccagcaacagtatgttaaaccacattgttggggtcccatcatatctgaaaatgggtacaaactgccctctgaacgtatcatcagcagtcagctcctgactccctaccatcctgagagaagctcgtgccatgcaagctggctgtggggaagcctcacacaggttctgctactttctggtttcgccatagagcagtcccacatcacaccgagcaaagcagttttctgttgctagccccctttctgtattgaagagtttcgggggatgggaaggatgcagagacactgggcctggaatggctccttagatggtaggaaggaataaagtgactctgttgaccttgcactgtagactcagggaaagtactgaatggcagagttactaatgacttctatcaaatcaccttttgctgactcccgtgttagtcctggatagcgtccttggcacacttgatttcagattttgacaggtgataaaagcacatattgagattgctgcttcacagggcccagattccttgctattgactgatgttatttttgcctttcctgagaagctccctcatgtgtttgctgttacttttaatggattgcttcctgatacatgggaggcccaggcacttgcccttcaatctggccaactgcagcctgacctgggtggaattggagctgcctgaggaacacttagaccaggcacttggcaatatgactcacttttttcccctaaaagttagtctgtaaagagcaactggaaatgttcctgtttacatctttgtggagtgtaattttaatcaggattctcaaggtttttcacttcaattctctgaatttttaagatcttaaatgccctgtggtcacagtatttggccctgtacttctgagggctacgtggaaaatgcttgatgatcattactgacttgtcaatagtaattatgccaataaacagaaaagtcttccagttctggtctgttgaggccctgccgttaagccatggttttcccaaaggctctgcagtgggttctcatgggatgtctttcattggttctttctctcccttttcctcagagggtcgcatttcctgttttgtgcaggaaattcccactgttttgggttccccagctacagtcggaaagacatcagagtgttcaaggcggagtccaggcctgagatctcagcaggccagacaggcagcagatgcttgttgcttttcttgtgttatatttttcgttcccttacttagcatttgtgggaccaaagccaacaaacaacaggttgttaaaagaatgagagtaatttgacttccgacagtgattggggctcggggttgttgggtgttttgttttctgatttgaaactagctgtatggtaaccactaactctcgccttattcttttcttgcagatgagctcacagtgcctgcactttaccccagtagccctgaagtgtgggccccgtaccctctgtacccagcggagttagcgcctgctctacctcctcctgctttcacctatcccgcttcactgcatgcccaggtaattgatacccatcggccaggacttcactcacttcaccaccagtcctttcaaacttggttcccgagagcacaccatacaactaacacctatccagctaacagatccaccctcaagagattaatgatcccctctaaatcaagctgacactccttcaggactgacgaggatcgtctgacagcaatgatatcacccactgcctgatgtttgccccaaatgacacctctctcttccttaatgatctcacctcatatcgcacatgagagaccggggcaggtttatccacctggctcccagctagctagagggcatcaccagagtgtatacgtgtgtgccttgtgtggaagggctgcagaggaaggtgtgtgctaggagaaggggatatgtgcgtctgtgcgtgtttctgtgtgttgagagttttccactctcgtgtacggtgagaagaatctctgaccaaagggaaagcttccaggggggaaggctgtactttcttaaatatgttacaggaaagattaagggttccttctctccattttcaggaaaccctgtagaaaaggagatacaagatagtgtctaagatggaattacaggtcaaggtagagatctctattctgaccagctttctttcttagttaaaaatagcctgatttttataaacaaacttcctgtttctccgcaaagattactgtctacatactaacacttcctctccccttggagaaaatatttctcttagcttcgcttttagtgcaagtggtagtaatcagtgtaaagattcacctctggagatcaccactcattctttggcctgcaaagattgatgaccagtaacaaatagaaagtacgtacgtaggtttcatttgtctttctgcatgtgtaattcagcctttaaattttaaatttttaaaaattattaggctggacaggcagagttttcgtttgcctgttttgctcagtgtttgtttacaaggctgggtgaaataaacagcttcccagaaaacctccttctgacttaaaactcttttatgttgtacagaattccctgtcttgataaagaccacctagaagcagcccccagcgagggttcttgaaagtcatggggtcgagattgttgttggctgaacatcttttaattctgagttaccaacacgttgtgcgtgcattgatgacccggcttcctggcctgcccttggtgcctgagccccagtaatgattgccctctatgttgggagaagaagggagaaagtagtacaagtagtgaagaaaaaaatgtaggtggtgttggtggttgagagtacatggcacagaaaataaaggagccaggattacctgtgcctttggcttctccttcccctgctgctttttcttcctttttccatgtcagtgcttgggaaccctcacaactggcaggtaacggggtcgggataaaatgtaaacctgtgggtgtcttctgctgagtcattaggatctttgtagcaggctgcggataaatatgtggatgacatggggcaactaagagccccttttgcttgccacctcccacccctgctctggatggtgtctcctcttgctagactgccgggtacagatcacgtggcaattaaggcaaatgttaataaataccatgaaacagtggtttgcatagtcttctgaatagccatggctttggttagtcagcaacaaagcctttcacccttaccctggataatcaagagttgacaacagccagaaagtactgggaatagtggcttttggccatgacatctgctcattcttcattcatgtaatgggtcaaatcagaagtaattctggagatacggtatggtaagagaagggcctaaagagtctcaagagattagaaagcatatgccattgtaaggaaggatggggagagacagtgccaagattaaatggactcagccatttgacttaatgggatgcactgcccatggtggcaccctcccctgggagttcttccttgatcttgagactttcccaaactggaatccacttagctctgccacatcggtcccagatttggtgggactctcctctggtatcagttttcaacgccacttcttgtttggagtcattcccagtgcagtcatggactctatgaacaaatacggttatttaaatgtatttgtccagtatgagaatcagaatgaactagtagaggctttacagatcagctggtctgacccattttacagatgaggaaacaggcctgagaagatggagggagttacccacaatctgaaggggctctaccatgactagacccaggtcacctgcctcccaggcctggctctttccactccgaggtgctggctcaccacagacttattctttaatggaattttggaaaggcctcactccagtgactctttggatctttcttctctaagtagatgggaagcctgtaagaagagacttggaggcaaagcaaagggaatcagcacttaaccctcacccaaagggcccaagagaatctttagtaactggaggcagagcagactggagcctctacggggcatctccccatattggagaattcagtctttgttttggaaatcttataatgtctttggagaggctttaaataattttgtttttcttagcaatgttatgctctattttgagacatggattttttttttcttctagtgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactatttcttgacgacctttgagagatttcaataaaaattttaatcagagcaaaaatgaactcaagtagactgcagcgttttgttttcatggtgatgcaattttggagcaaaggtgttactctctgactgaggttttgggagaattgggcctgtgacaccaagtctattttacatagaaggactcagaacgagcttcctggagaggccaggtcctggagccgaggccacactgctgctgcttgtctctccctgggctcccagaagagccaccaagagctgcatgttggaagcgtctcatccaccaggagacctcacttcagcagggatgctgcgtctagctaggggagcccctgtgaaacgtgtgggtgcagtgtgcagtctgcccaccgggatccacaggaaggaagaccaggagacaaagtgtcattgaaaagaagttgagtcacatttctagctctgccccggcttcagctgtggtctggtaccccttcagatttcccagctctaaagtaaggatacttatttgccatcagatcccgttttttagaaattattggataaggtaataggactgaaagcctcagtactgacttaatgtttagagatcaaagagcgaccctgtgcagcagacatcggattgctaagaagatcattaacatttttaaaagtgatcatccagtttactttcaaggtcattggtatttgaaatgtgttaattaggagaggaaactttcatctgttgctttcaaaaagcttatacactgaagagagcacacagctgttctgtcacctcacattcacacacttccgcctcttaggtttgagctcatgttctgctttcagtcttgttgtgatgggcagagagaaagtcgttaaagtatactgtccttaccacattctcgaaacacaccatacaccctgtacttcaggcagagtcacagtgtggggccagaagcttctgtaggtaagtaggactgagagagaaagtcctggttacctaattccttttcagaggcctcatttgtccagagtaacagcagttctatcggatttctaatagggctgctgtacagcttacctggacataaaccaaaggttttaaaattataacagactgcctgaggacaaggcatgcgtgtcccttgggatggctctgtgacacactggaaaaattttaaaggttaaacccaaaataaatacagaagtggaccatgggaagagagacataggctaaccaggaagggagctcacagaggagtagatgggcctgggagtagtgggtggactacctgaactgcagggctgtccccacctcccctgtatctgagcagttgctcatcagcagggtgggacttctgaaaactagatttaaaaaaaagcaaatcgtattaagcatctgcatcactatgccctgtaggaaataactgagaaaaaagacacaaggacttctgctttggtgtcgggtatgttttgaatacatagagtgttggggggtgtctcgagggcagtgctgggtatggacctcagtgcgcacacagctccttaggagtcgcccagcagcgagacagctgtggatcccctccaggcgcatgggaggctcacaaggcaaggactctgatggttttggcttccacctcctgtacggtggccagtgctgtgagggtggttggtcccacagggaaacctgtgaacagagtcatgtctggggccccagggacatggcttcaacccctcacctggcagtcctgcctcccaaaagtaaggcaggagtccggagattcccattgcttgcttctgtgaatctcaggtcactttagcacttgacccctgaccccagactgccttgtccttgaggcctgggattcctaaggtatatactgtctgctccagagctgtggctgtggctatccggaaaacgacagctttgaaggactgcagagcttgcctttggggctgttctgcccaaggccttccattgttttcagacataaatgaaattgttaatcctctgacatttaccttttcctctcaacctgcagctctgtgaaggtcagactgtgaggagaagccaccccttgagcgctccgtctcctgatagtgccagcctggcctggtttcctgtttggtgaggctttctaggagcacctggcttagctctcacaggaggaggggcggacggggaggccaggcctcatgctcacagcgccagcctcctgtgagagtgggctgggtctcctttcctttcccaggcccttcctggaggcgatttctttctttctttctttctttccttttcttttcttttcttttcttctctctctctctctctctctctcccctctctcctctctctctctctctctctcttttctttcttttctttcttttctttcttcttttttttttctgaggcagagtctcgctctgtcgcccaggctggagtgcagtggtgtgatctcggctcactgcaagctccgcctcccgggttcatgccattctcctgcctcagcctcccaagtagctgggactacaggcgcctgtcaccacgcctggctcattttttgtatttttagtagagacggggtttcactgtgttagccaggatggtctcgatctcatgaccttatgatctgcccgccttggcctcccaaagtgctgggattacaagcgcctgggggcgatttctatgcctgcctcctgatgcagggcctgtgctctgagctgcgcctttcaggagagctctgcggggcttcatttcctttctaagctcatggcaagaaatgtagggtggaaaagacaggctctggaactccctggccacacaggagctctgccatttacacgctgtgcgacctcaattgagcaagtttcttaacctctctgggcttcaggaaaagggccaataatccttcacataaacacttaagagaatgcccggcatattagaagggcttcatgtttgctttaaaggtagcccttcccaaggatcttttaaggggcacttgaattttcagtaaggagaaggaagcccaggactaagcctaagctacccacaaggccgtgacagttaagacacaggatggccagcacatgtggatgacactaacaggggctgctagagacctcacggctggagccaaatggaagactggaaagcatgaatgaatgacgggagtaagatgaggcattgcagtgagagcaccacccacagcaccgattgacagcacctgccctgctcctggcagtgtgatcttcacagcttacgccagcactgggagagcttatccaaaagaggggcctccccaaaccaggctggacacggccaccggaacccccttctgacaggaaatacatccggggtggagggggctgggcagctgaatcccagcgacggaatggcccttgccctcacgagttactttacacaaacccgctgtccctgacctttccagctgcagccttatctcactttcctatcggagaaactggagaaagaatcacaggtcacccagcccattcctccctggactttctggcactttcttcccacagtccttctgctagtattctcctcagcctcatttccaggcaatggagttacagcttgtacttggggatattgctctcttcacagttctgccaggaaacccgagaatctgcccccggccaggcagatgctctctccctggtgaccctctccacctcttccgtcatttgcagtgagagagacatcagcattttgtccttcaccctctttagaagcagtcctccaaaaccatccgtccagggtgttagggagacgtgttcttttgtccagaactgctgctgctactgaggcccaggcctctccatgttgggcagttttaggaggaaatgccgttcagaaaccagagtcggtcccctagtgtatggctgtgtggctttggccagggtcactcaccccaaggagacttccgtagaaatcacagtattattcaggattgccagaacatctcaacgtgggcctcctcctgactgggggcaccattactctccattactccattactctccatttggtacactgttttccaggtttctaagtgtgttccatgttgtcctttgcggaaggttaaactccccagatcctacgcgccttctcccctgtccttaatagtagtaagagcccaaccctgagtcccaacaagtcgcacctggaagtgccgtctgcgctcggctcttccctgggattaacaaccgcgtggcccaactgtcacagtcgggtgctgctgagcgcctggcacctaactgggactcagttttttaaatcaaacaaacctgattttaatgacagtttctacccactctgctaaatttgggatcctaggcaagttggtttttaactgcacggagcctcagtttcctcatctataaatgggaagaatgaacatctccatgggtttattttgcagaaaacagtaagatgtttggcttaaagtcatagttatgattaaaatagttcttccaatgccttccctttgtcaggattcgatctggtgtggcccagaggctcctgagccctccctgtaagcttgagaagcacttaggacacagggactcctgaccagcaccctgataagagaaacctaagggcctgggctttttgctttggtaaagaagagaaacaccagagccagggtgagaatggtccgtggctgtggcgtataccgagaggaggccgtctggttgggtcagctgggtgtgtacccaaggtttttttcttctgtaggcataggcacccagatgccgtccggaaagtatgtgaactctaactgctttggaaacaaaaccaaggccacagagaaactttggaattataaaatgtagccttcataaaaggggagagtgaacttttctgtgaagaaaaccaattgtgacagtaggggtaaaggaaaatcaactccaaatggaatcatgttttattcaggatttgtgctgccggtggggaaggccagacccagcgacaggatgggaaagtgggacaccccaacttcaagctttgtgcgttctgccacgaagttctatgcgcttcactgagctcagctcctggggacctctaatggcccttgatagcaaacatagttaaaaattaacagactgacagaattaaatatggatgacaagcaaccactgtggacttaatctgacacagggtgttacatgcttgggtgcttttaacccaagtggcatctcaagtgaacttctgagatgtctgggcacatttcacatgcctgtttggaagcagggcttagcttgtgcttaggacagacaggaaaagagtctaagagcccaggagagaaaattctccctggaggcttttgtttcattaaacccagctttgatcaggcttaccaggatgtactcacagtcctaggaccttgtccttgtggtctagaccttgtccctgcctgggctcggacctcagtagcacctgccatcgtgactggaagatccggcaagagcacaaggccagcggggagcatggcctcctccagctaggactttcttgctcacctcttttccagctgttggggcaggtgagatggcagccttaaccaaggaccaagtcatacaaatcttgacattctgcctagatcatagcgacttaattgccctaggcaaggactattaggtgccagacaggtagtgaagaatgctgatggcgttttcatgcctgagtctgctgagaaagagtataggctgccgattctggggggcagggagaagaggagtggttcctttacaagagggcctcatttcatgcagcagcgaaattcccaaaaagtgttcttccagttttggtgagtgcttttttagaaatggaggtgagggttgctgtttaaaagaatcttgcaatcagcgctgtaaggaagacaatctttttgtattgcacatcatccctccagcctattcgatgagtttggagtttcttggaccagattatgctgggcttggcagcctctcttcagcctggcagtctctgacagagcttgctgtaatggcctaacgtgctttatttggtgatgccacccaaaagtggatcctgaggtctggagcgagtagggcagagctgatggtaggtagtcactgtgtgagtggttccctgcagttgctcagtgttgggaacgagccccacagcgaacttcagcgctccattctagggagagtcatggaaacctgcctgagaatatccatgccttcaaaacattaacccattagtttgagataacattcttgtcatttacataaaacaacttgttcaagctactgtgggttttgttttgttttgtcttttgttgaggaagtctccctctgtcaccaggctggcatgcagtggcgccatctcagctcactgcaacctccacctcccaggttcacgcaatcctcctgcctcagcctcctgagtagctgggactacaggcgcacaccaccacacccagctaattttttgtatttttagtagagatggggtttcaccataatagccaggatggtctctatctcttgacctcatgatccacccgcctcagcctcccgaagtgctgggattacaggcatgagccacggcgccctgcccaagctactgttattaactattttgttcaaagagggatagctgacttctgaatgtggtgcaggggaaacctgcattcaggtacagcatctgcactagggaaggtgagagaaaatctgtagctgctccatgtacatgagacatcagagcactagccggtttggtggtctgtcttccagctcgaagcatgcaaatggcacagcccagcctcttagatccaccaaatgctaccactggaagggaccttccagaccagcatttctcaacacccacagggattcacagctgttccataatccagagatcctgcagtcagataaacttgggcagcacaggtctagatcaagtcaaacaggtttctttattttggaacttcttggagccattactgtgcccacacatatcaagaaactgctgaagggaccaaattgtgcatttctctctaatgtccttgacattagagcatttctagaccagtgttcttccagccatacttttcgaaaccttaattaaaagcagcatctctcagacttgaccatgtgcctggtgatcacctggggggctggttacagtgtcgtttattggatgcctctcccagagttttggcatttctgacaagttcccaggtgatgccgttggtccaggaacctgagaaccactggtctaggcttaccccttcattccccagagaagaaaacagtccaaccagagagtatttgctttcagtagtgactattaattgagccagtcacctgctaagcacttttcgtgactctttctaagggcaagtatgatagtgggattcagcccctagaaaggggatagcgcaatgcaaatcattactgtagagttttaccctgtgccagtcactcaccactgcagaagggttggtacttcaggcagggcgtcctcccgagactagtcaaggtcttcctgtccttggcatcagtattaggaacataaattctgtctgtatttaatcctctgggccttcatttttcatctataaatggaagaggatggaaattatttttatgggtgggtaccgctttctctagcattccatttgatttttactctgagttgcttctttttctgggtatcttggtgctctcctgttgtccaatctgtcaccatgctgagtgctggagacttacagtgttagccatgcaggggcactgcattttcagagcattcctgaagaagagggatggtagaatcccaaacagtgtggccctgggtagtgaactgtaacatggtaataacttaccactattgttaagttctagtggagaagattcccagggtcgtccacgttgccttagatgtcacaggctgtgtgaagtgcttagcgcggtctctgacgcagactaaatgtcagggtcagtttggttaagtatattgtgttaaagtttctcacagggtcttgagaagcccctggaattgtgtgcaagactgtgagtgtgcacatttgagagagagaactatgggagaagagagagagggtgtgtgtttgtgtacacatacgttttctgcacatggcatgaagaaatgtgaggggccgctgccttgcatggaaggccagcccttgtcacattattctaatggggagccctaaactagcctgctgaactgtttggagaggaccttgacgcaggcagtctggagggaactgtaggtttccccgttaagaagaattgtaaagcagcccttatgggatgggcaggagtgacctggggccaaaagcccagcagaacaagcagcccgaatggggctaagagagaaccctctcctcattacccccacacagtgattagcgcggagcagcttgttcccccccaccgggccggctgcccgaactctgctgtgcaccatgagccctgccgctctgccggctgtggtgcgggaacctggatgagccgctcagacttggccaggggggcactgccctctgctggaagctgggcgcagcggagcctctcaggctggaagaggaggcagccgtgggtgtctgtggatgcggtgagaagagccccccacttggcaagcacatagtgtcctagcctgagacacaagagcaatgaattcaggggtctgtgtgtccgccacccgccaccacatccactctgaggagcagccacctattgcatcactggcgtcctcactcctcagctgagcacagcctcccctggaccccacagctcggaacccgccttcatgtcactctggagtgcgcctcgaccaggctgacgagagcctgaagacgggctgcacgctcgtccccaaccctgcaggcacctgtgcgagtgagaacgtgagggctgtgtgcgagagctggtcagagaggctggggcagggcttccttctcgcagtcacctgcaccgaaagcagaaccatgccatccactgtgcagctctcctccccgggcagccctccccctcctgtgtctcctgtgaaacaccgtcacgtcttggcctcgtcggggctcagcgccccaacccacacccaggccgcaccagtcacaccactgcgctccacactgacccagtgcacacagacccatcaccctctactgtgtgtttaggtgtccagccccccacctgccatgggggctctgtgtccccgccccgtcctttcccacctgtctcaggaaggcagctccaactctgctctttgcttagtgagcaagtggattcagatgcaccaggccatgagccgtgggtaggtatgagttctttcttctccccacctctgccctccctctcctcccctagactcttctgtccccttccctgcccgcccctacctcacccccatcttccccactcttgccctccttcttttgttctgaacacacttctaatttcccagaggagtgttttctagccttcctgcctgggaaaagtttctgacccttgtccctgtaattgcaatgagtgttgggagtgaccccagccctgccttaaatgagctttggtacctgctggtggccctgaggacagcaactttgcctttccctgatactggggaccctgctctagctggtcatctgatcgctggtcatatctggcatggtcgccagaagagacccaatgcacaggcagcctgacggagtcgtggtgcaggcagaagctccggtatgtcctaagcctgcgtttcctgactcaggccagcgaggaaagaaccgctcgtgaggaggcccatggggaggaggaggttcccaggccgccttgtgctcggaccagggacaaggtcggggtgctgtgtcggatttctctaggacccaatttctagacatccctgcttttagaatcaagttaggggatctcgtggggcctcatcctggattctgaccccactgggctctgtgaccaaggtcattgagaatccccagacttcagctggtgcccacacctgtaaaacaaggagatgaggcaggagctttccaccagtcccttcagagccctgcgttgtgcagtgctgcctcccagacccccctgcacctccatttcagccagaatggctcttgcttcatcactaagctttggagatctcagtaagtcctcctctgccaccctgcgggagggcatcgcctcacctggccccacaggcctcaccttctccactcccagcagcacttctgggctgctcatggtggtcatggggagaccatgccgcctccatgtgaaaggaagagcagtgggaggcgggcatctcttgcctgtgtccaaaaacatgtccagtgatggatgccgttaaagacaaacggcgcttgcccttttgggtgttttttgttttgtttcttgtttgttttgagattttcattcattgcccagaatggagtgcagtggcacaatctcagcttacagcaacctcccccctcctggttcaagcgattctcctgcctcagcctcccaagcagctgggattacaggcatgcatgcccacgcccagctaattttgtatttttagtagagatgaggtctctccatgttggtcaggctggtcttgaactcctgaccttaggtgatccgcccgccttgacctcccaaagtgctagcattacaggcgtgagccaccacacccatttttttttttcatgttttccttggcataggacctggaatatgctgccaggtgggcaaagtgttgctcaatgcacctgtgtttgcggctggccttccactttagaaagctaatggaagagacagggctgctggtcccagctgggaggctccttgctgaaggctgtaggcccatctcctcagtagggtgaacagagggcctggggtaccagacacacacagtgccaagaagctggaaccctttttttaaaagaacaggaatagaatcgcaaagtagtcctggccaggccactggtgtggatggggtcgtgaactgccccttccttaccaaagcagctatgtttccacactctgcttagaaagccattagatagcctttcaccagcctaggcctgggaaaaggaattcgctgtgccggatcttagcctcaaatggctgctaacctttaaaaggaggatgagagcagaggagttggtggaacctcgggcacttctcgaggtgggtgctttcctcagagagcttgcctgtgtgttcataatggtgtgtggaacgcctctcaggacaccgctctgatgcttttcagccccttggggaagaggccctcacaggctagtgtgagtgggtaccatcttggaacagtagggaagtggtagccaagcaggaccctccgtgagaatggggatatgctggggagccctggctcacggccttctcccatgtcttttcagatgcgctggctccctccctccgaggctacttctcagggctggaagtcccgtcagttctgctgaatactatgtaagtactcgctttcctttggaatgtgcgaagcccctagaacacatctgtacatggtgggtgcgccatgaacgcagctctcctcctttctctgcacccacaccttatgcacctcctttgtccatctttgttaaactcacttgaactacatagcagtgcatcttttccgagaggaaattttcacctaggtacgggtgctagtctatttgagtctaacttaggaaaccagtacctggcctccccacttaaaaataagcagtcagtgctaatttctgtagaacagctgtcagaacattttattacctaattgtagttcacctgctgccagcattaaatcaaaaccttaagttgcaggaatagtcatccactaatttacacagtagttgattatgggagatttattagaatgagtttccctgcatacatcatatccaaagtactaatcgttaaaaaatacctcattttcctaccaaaggtgcagtgcacagttccagcaggctttcctttaaggttttcatcatgaaggaagcactatcctaaatgggcatttttgtgccattttaggcctaacgttgcttcagagaactaccaaatgccttttctccatttctacaaaataccaaatgccttctgtaattcagaaattctgaatttctgttaagtacaaggcactgttcttctaaactctaatttagtatgtgaatttggagagtctacttagagttaagtttttagaatgttttagttccaccatcagtcttctcttggtttacacagttccttcatgaaataggaagaaaaatgagaagagggaggggcctgatcctcatgctgttagaaatgctaaagagatcatggcaaacctgtgcacctgattttacaatagtgtcatgggcctttccttggagacttctattgtaagataaaaatacttccaaactaaactagtgttcttttctttttgtaccattaatactgagtccatatgcttttgttagatcatttgaagccatttagatagactcttctggagaggcattctgtggaaagaacaggcccctggtcaacttagattccacttaatggagaaatgtttcagacctctcacaagaaaaagacactagagctgaactcgcgcaggtcagtgcctgtcagtgaagaagaaagagagcattgaataagatttttaaagagtgctagggtttattgtgcacaggtaagttgccctgttgacctgaagtctcggttggtgggtcaggtcaccttcaagatctgggaggactgctgagtgtggacttcatgtttgaagttctcatcacgcaggaggccggcccttttggatgagctcaggtccgagtcagaagaccccttctgtgttcgcaaaggagaggtctcagcagacagtagagagatgagtaatgggcatgagagtgtcggaagcccacagacgattctcagagcagccagtcatagcccagcagccacctggccattcacagctctttctctgatggcagggataggaaagttgagagagagcgctctgtgctttaggacatcagcatcaggaagctaaaattgtatctactcttcctctaacccaatgtatttcatattttaactcaaatacttcatattcgagtgtggccaaataataatagtcctcaggggcaatcgcaggtgaagtacacaaatccttccaaggtcagtgaaacaaatttctttacccaaagattctcagagcctttattaccatatgaacatcatgaatatttaagaggagggggctctggtacacggtgttcctcaagcttacttgaaaccaggtcatccttttttcacagaatcttaggagactaatgtttcatgcctgggggaaccatatcctaacctcttagccagaaacgaaaccagaggcccccatatatagagatccttggatgagtattcatgtgtgatactgctcattaatctgtgatgatatttaaaaccccagacaatgtagtagcttttcttgtactacttgtttgtcccttattctgaaattacatgtcgtgtgtgtgcgcgcctaagtatcctttttaaatggtagtgttaggaaatggtaattgtctcttaaatgtcctttattaacaattcatgatagataaaatgttcttttaaaatgtttaattattttgtgaattctaaaagtttgctttttaggagagatttttttgctccagggaataccattcttaagctataagactatatctgagatatagtctagggtctatgaagtccagaattttgtaagtccatgtttcgtcttcatatgcccataattgacttttaaatacagatcccaaagccttacttatttggttgcataggaacctccccgttaccatggtgcccagcactgccttacaactccagatggcactgagcggaccctgctgtgagcagctccctattccatgacagtgtgttgagctctccattgtcagaggctggtagggtgttcagctagaggtgccgaggatgaggtaactggaaattctgaagcgcacaagagaaggcatggcttgaaacactgacctgaccctcagcataaactgaccgttgaggaagttggtgaaactggaagagaggccccttgccaagcacatctgagagccaagagtcagcagagaaagagcagcccccagagagtggagagcgggctggagaagcagggtgcgccggccacttctgtcagtcagatgcttcaggaaagtcaagcatggtgagagaagaccttcaacttggcaatttcagttggtagagaagtgggcaaaggatgttggcctgggacctaaggaagggcttttttccccttaagaatttatgtaggccacagagaagacatccattgtgaagcagttgcgtgggttccagtgacagagatcctgggtttcatttgtatctgctcacctaatttttttccaaatcatttctcacagacccttcagcaatggctactagaaggacgaacaattgccctcctttggaagtacggctaatagaagccctagatccgaataagatccgaataagaatatgtaatggaccaggcgcagtgcctcacgcctgtcatcccagcactttgggaggctgaggcaggcggatcacttgatgccagaagtttgagaccagcccagccaacatggtgaaaccccgtctctactaaaaatacaaaaattacccaagcatggtggtgggcgcctgtaatcccagctactagggaggctgaggcaggagaatcgcttgaacccgggaggcagaggttgcagtgagccaagatcatgccactgtactctggcctgggcgacagagcaagactgtcgaaaaaaaaaaaaaaaaagagtatgtaatgtctcccgtggatgaatcatttgttctgagctaagcttgggccatgggccagactccttcctcggagcctgtggggagcaggtgaggaaggagtatggataatggtgcccgttactcctgcacgcgggggagtctagtctcccagcccatctaaagttagactagctcagtgcggatctattatttcagctccttctagtctcttggatcaagtcctttccaagatggcccataatccaagctgtgtaatcttaggcaaatgtaaattagaattggaaacagtggtgctgatgagctaatataaacatttttaaaccagaacaagtcaaaaaggccaaatgaaaggcgcataccattcattggcagaggcccacatggctctctccgttcggcggggagggctttcttccccatcttgctttcccagcacggaaagaacagaagacgagcaggagtgatgccgtccttccaaatcctcaaaggccagcactcccagaggtccttcaaggatttttcatttatctacttggacttcttagtgctaaagagaaatcagtgactagactagatatgtaaataagaactttattctctagacaaacatttgttgtgtctgctgtgtccaagatacaaaaatgaaaaaacaggcctgtgcccctcaggagcttaagttctaatggcagagaactgtggacacatgtacaggagagggagttactgctcatgatcctgcaagaccagcttgctgtgaggagagccaagctgagggcatgtacaggccatgtgcatgctgttcctgtggcataagcaaggccatcaggagagggggggtcagaaggggacagggtgttactggtgttttaatttgctccgcctcttgctgatggatggtgttgagtttagtgatgcagacacagcctgtggccagagttttgctgatggttcagccatgtgctagagagcccagaatacagaatcacgattgaaaattgtcagtttcccagatacactgagaacaggcgagcatgagcaacgctgctgtcactccttacatgcagtgagagtgaggcagctttctttgatggatattcaaagagttgaactgttcttgaaagggaagaaccagcgtttgggagccaagtggggtgtagggggacgtcttctttcaggactcttgaaattttcctggccatggaccgggaccagagcccagaaattataagcacatgtagttacagcctccccagattggagaaggaaatgcaagagagaacgtgacggaatttggagctatttttcccttctcttctgttttgggtggaatggccttgcctgtctttggctgtgagcttgagtcatcctcagtagagtcccaggtgctggtgcccaggtggagcttagagcttaacaaggaggaaaggcactggggctccagaggcccagacagctgcggtggctcctgctgtcacgctggcctccccttagaagaaagccacctgtccatgtcatgctatcacactgcggtgcacccaccaaccagtatgaggctgtgaggtctgcacatcacacctaaggctactaacgccgtaactgtccgtcatacctaaggctaatacggtgagcagctgcagcgtcctggggaggagatgggtaataggtaatcaaatagacataatagtttgggtggtgatagtattcagggaataaataataaggccaggtaagcagctcagtgttgtggtacggccagcacttctggtgccttctgcttcaagttagcaaagcaggcagggtccgcctgagaaggtaacatctcagcaaagacctagaacttcaccagctttatacggggtttctttttcagaacacattccactttagtgaggcttggaaaatatttaactcctgtaatcttaaagtaaatggactggaagtgcagcaggcttggctcccacgcagcactaaggaatcactgggagagtgtgcagggccctcctcagagacctttctctgttttcccagtgaggagacgcaagcctggttctgcaattctttccagctctggagtctgttatggttcccatctgagctctaaaggtaggggtgggcctgaagaccctccacactgtcagtcctgtggacgtggtgggtgcccctctagccaccactgtcctccggactgtgccacatcacaagcacttaccgagctcctctacaaaccacgtgacaaccaaatgcagtgaaaactgcagccccccaacctgctcctgcccattgtgttttctgtggatctgtctggagtccttggagactcctgagcatgtgcactggcagagctgcctgactcttccctggaagaagttcaaagagggtagccacgtgttcagaccaggccatggggtctgggggctccgcgactcctgagagcaattcctggccggactctggctcatgttactgcccccacctccccccgcccaggtaaacccgggggtgcagacaactgttgttgaggtcccaggagcgggttgtcccctatgctcctggggacatggaggagagggagggtcccaggatcccagtacttgtatgagtcgcactgattagctgaagcccagaggcttcttaatcatcctagaaatacagcctcccgggaaatgtggcctggctctgcagctctgggtggctcgtgctctccctcctgtgtggaggggtcctggagaggttgggtgagctgattgataggtttcatgtgcaaagatgattattttcctgttctcaagtaacccaacttttgctaggaaactagaatcatctaatgttgcatagtgaagttctggggaaaatgttttcttccttaaatctgaggagagagatgtcctaggaaggtagtcttcaggctcactcttgattccagagctgggtttcagcacacgcagtcccctctccctgaagagtcctggtgggaccactcggaggtgccagctgagccagtgccacctttctggggaacccggacagtccgcagcagtatgttatgcactccagttctcataagcctcgcatactggacacggcctgtctgcagggagggagatctgagaaatgttagtgggaaataggaccgctggtgtccacatgcagggagttgggcttccttccctggcactggaatccttgctgtaaccagccggctcagaggcagccgtgcctgcagggggagtattagaaactgattctttgctaggtctttgcaccttcgtatttcaaaattctcagaccctagggtacaagtagccagatatcttcacaaatgtgcatccttttagtttttgttttccaggagatgcttggagcaaagtttagtccttggtgcctgtgacagacagggatttcctatggccttgggctgaccaaagctgctcagctcctggaggtggctgtttctggatcttgctgtgtgggggcctcaggtcccatgcctttcctctgcagggcctttggacagtcctccgggtctaggccacagcccttgggatgcaaccacagggacgtgggtgtagagtcctgcttgctgggcctgcagcctcctaatgcgccctcagcgaagagttcacatgcttttcttggaatgtccttcctcgctggcccccagaagcctcctcttacttgctccgccaagtcctcagtgcgttttcctggctgagagcttttcatgtcgcatatccaaggccattctgcagcagcctctggtcctcagctcagcagcagaggcctttgatctctttcggcgttgcctctcttggctctctgccctcagaacaggccggtcttcaagaccgaggcagccccaggtggaggttactgtgcaccgttaacgggtgatctttctccatcccaggtcccaggtgtgtgatggcggctgcaatctgtcttgtgggtattaatgcaatcttcagtggtggctactgttctctagctgttctacaaaactggagcatgctggtgagtaacagtcagggctgaacaagccctcaggggcggcatggcgaacacgtgggaactgtgggcctctgggggtggggtctggcattccaggtgctcgtgcccctccaccccaggtgattctgcccggagctctttaacatctgctccaacacggcctgccagggaaggtcatcccaggacagcaactgatacatttttaaagcccatcaccccagtatttggtgctcaccatgtcctccttaggtaaggctggcaccatgaacatctggctgtccagtggcacctggagtgagggattccacctagggaaatgttactgaaacgaagcttttccctttaagcatcgccttttttggggggaaattattattttgttggaaatctgtttcagatgtaatgtgtatatccccccatcttattaatccagttatactgcatatgatcagccatttgatgacttagggacataggataattaccctggagcatgactgaatcagaattcacaattaatttctccagactgtgggcctcttagtagttcatggttttagcttagtagttcatggttttagtgatctgtcttttcagtcggtatcacctgtcactcctcagttcgttagctactagcaggaaatgtagtctaaaaaaaatcctcctgtagcattcccagaggtgaccttgctgttgggtctctggaaagcctggcttagagcggcaggaatgccaggggcgagtctatggtggtttatgtctcagcctaaataaagcggcaggctgcatccctctgaggggcctatgaaaaaagaggagtctgaaaggaacaagattcctgctacagagaaccaagcgcttctggccaaggaggtggggtcgcatttgaggggcttaagtcacttcatactccgacgatacctctcagtgccgacccaggagcaggcatcaggtgtgtgccacactgggcgacccacctcccaccaccccagagagctttcccacaggaagccggaccctgcactttgggcatttttcccagggtgcctgtttcttgcactaacccaagcttttttcacatcacatagggcagctgggtctatcccactaggcccacggccttctagcttttccttttgtcaaagctcttaatggtcatcactcactcaaacttttttaaaagacatgattttgttcttcctcctggggatatttaaaaaccagttaagccacttgcacatttttttccacttatgcaatttttgaatgctggttagacatgattttaaatgcagcaagtcaaccaaagtatcaacaatgcaaggagcaggagttttcctggtaggccacggaagggcctagtggcaggagacagaaaagaggggacaggtttgggtcacggtcctgggggcagctgaggatcaggttgcaaatgccccagatgtgcctgagagagcggcagcagccagcatggaggggagcagtggcgttctcagcaccagtgtgttaaggtggggctcacaatttcttggggccttccctgggttacagcagcgagtttggagggggcttttctcttcccaaatctgaggtcagacaacagtgcttatgtgacctacccttggagggcagagatgggccattctccatgggcccccagggctggaatggagttccaaactgcagaagaccatgcccctagaggctccagagaccgtgaactttttcaatgacacgtttgaaaatctattacaaattaatatcagtacctgattttttgaagatgaagctgacaggtattaaatgaaaacggaagcactcttaattaggaacctttgccacatgatggcccatgtttatttggagttggggggagaacattccttatctgacttggtaaccaggaagccttagaaactcttggggaaggaatcctcaggaattaggtcaaggagctgcagatggatcaagggaggctttcctctgggagaaaaatctcccaaggcatcggaccgagaccctgactgggtacgaagagaccgcagagtgaggggcaggcagcgggcatcctgaccccaggcccatctgtccccacgttctgagttccaccaaagacccaaaatgcagtgttttagaattgtgtaatattccttaagagaccaagagacatcctccagtgtcttcaaactgggactgttcccacttacctgagataaggagatttgttccctgtcttgacgtcccatcacctgtatgtcatagtcggccccttccaggaaggccccgcgaggagaacctgctcctaatcagagccttatgcgttcccaaccctgaccccgccatccatccctccgtggggctgtgttcccagatgtctttggattctgtttaaaatgtccttgttaagacattccaaggtttgaactccgctcctagctaaacctcctccttgtttacagggactgaaatagccacattttgaccttctgttcagtctgggatcatctgtggtagtgtgactacattcctttcccatgcaaggatcccatttacatggcagttatggaaggcccagaaaaccagacttgctcccgccctcctcctgcctatgttccttctcccttcagattagccctcctaggcagccattccgcctgctcaggggctggggcattgggaagctgcgtggttcattacccaggaaagctggagccaccatatccccctcatcagggctgcagctacccatggaggctcagggtgcccctgggctggtgtacagaacccaaagttggtcccctggcctgctcccaggccagacaccatcaaccccaggggcccatgtctcagtgccacatgccataaatgacccaccactcctgttttgtgtgtcctacagtctaagtgtctgaatggagggtttgcatttgggccacctgcaagtgactggggtttgaggagaaggaaaaggtctcaggaaaataatgcaggatgatccctgtcaaagctaaagtggcctggtcagtgagaacccctgtgaggagctcagaggaggaagcccttaagatctccagaggcatgagttctgaaagacagtgtggcctgtatatgctgaggggactagtaacagaagagaggaagtaagaacaggcacggcacgctctgctgaaagtagactgcggccaggcttttgaaggccttgaaggatgtgttagggatttggaagccactggaaagatgagcaggggtggagagtgatttaggaatgttgttgtcatgctgcccaaagcaaagtagatgaagattcgaggtagaagcacacttctgcacaggtggccctaagatggtgatggtggagtggaaggagcagatgagccaagaggacaggaaatgaggtcggtgtaaagggcagggacaggccaggggtgcacagggatgagtctggatttggctgccttgagggctgtctacagtaagcatacttaagcggatgtgctagaactaatgtcattatttatttgccacaacctaaagagacaggcaagtattagtcgcccgtcacagagaaggtccagggtgtccagggcccactgtggaaagctctgcctggcttgcccctgctccgccggccgttacccgctacccactcatactgtcgtccaaaaactgggcagtgaaaagtcacaggtcagatacaaattggacagatttggtgtgaacatttacaagctcatcccgtacgctatgtttcagtggtcacctaaatattctcatttcaggactttttaaaacacattttcccaaatctaacttgggacaaaatctaacttgggacatttaaataggttatcaataattatctgtttatggcctctttcggcacacaaataagcatctccctgtacaaaattctagtgtatgctgagctgattgattgccttctgcatacaccttttctacaacttctcaaacgtgtgtgacatgctggtaagatggcaggaaaaggagtgactgaataatacaatatagctgagatgtgtttcaagaaaacctctgggccagggtaggggtttgtgagcgggagccaaggacttgccccatgtttctaatcaaggtgagaccactgacacatgtggtcagcaaatatgttctatacacacatccgcacactgtcatctaacccatccgttctcccatccacagcatctccaggacaaagccatcgcaactagggaggggttgacacctgctctcctaacatgttttctttctgtttcaggcttgaaaaacccttgcccagttttgatcccttcaagactttgtcacagcctctatcacacatctgtttttctcgaagaaaaaaatataattaataaaaatgttttactcttttacactgtataattgtaagaaatagcgtattatttgtgaatgcatggtctgaaatttctgtacagtttggagatattttcaaacgaaacgtaagagaagtcaacaataaaaccaagaaaagtgagtatttttataccaaacattttaagtatgctgggatggacgatcttacactggtttggatcacagtttttgttcttgacttttgaatgcttgtaattaaaaatatctatttttttcctctgaagtaagttgcatgtttgaggcatgtttccaaatattatcaaaatatcctgaattgtattgtgaatatatagaaatctgtgcctggccggagtccagggtaaattagtagcatggtgttagatgttagaaacagaactgttatttgcagtgttaggtctaggatcccagttctagtaggacagccctgcaagacaatcaaccagaagcctccaggagcttctacctatggcttattcacaactgggcaagaaaacatcattggtaagaactgctgagtgtgcccttagaaagccctagtagctccagctgtgactatatcaactgtgtgccaagtgtgactttgtacagttttatgtttccactctcctgtatgtgtagccactcgatgcctaacctaccttccacaagccagccccgcatccctgctcccgcagtgtaagtgcagagcctgcctcactggtaagggaaaaccttggcttgggaggccagccctggcccttgaaggggttggctgtgcccagcccacctggctgcagtgggcagctcatgtctgtatctccaaagtgatgtttgtttgcaaaacaccggctgaactgagctggtgttgccaactcttggcagcactgggccaaaccgaccacataccatgagctcccaaatggcgtgtgctcactgtgagacgtcctgccacaccccacaggagacggaggcagtgggcatttggaaccaattctattcagacttcgtcaaagccaaagtcagtctggtgttgtcagttgacacatctccagagttcatgacagctcaacctctccccttgtacagaagccatttttgtaaaaccacactgacctaaattcagctgccaaacacagtctttcctattgatccgctcggcttatgttgaaaatttcaatgtcatgattacctggttggtttgggtttttgttttgttattttccattagaaatataaagatgtcaagaagcttttaaaggtcaacacaaaaaaccaaggccaggagtgaggggctctttcttaccgtaaataaggggaaaaggcagttagctcaaggacttgtgacggatccactttggtgttcaaggacctgcttatgccctcagtgccaatcggctcttggtgagatgactgtactcctaaggaaaatagccacttctgcagtctattatgcttttataactgtttaaaggtacttttctat

SEQ ID NO: 5 - DNA, 1913 bp, Homo sapiens
tttgtttagagaggaggtttcactatgttgcccaaactgacccaaacttgtgggctcaagcagtcctcctgcctcagcccccagagtagctgggattataggcaaatgcctgcttggctagtttttgtttttaaacagcaggtttctaattataaaaacaaatttgccattttataatttttaaagtaatctgccattcaaggtacttactgaaaaaaacaataggagaaataagacagtctcctgtcatagagcttttatcatcttacgacaaatacagaaaagcaacaggtattgaaaatgcagtgaagaatatgctgtatgctgggtaggagaactgccccacgtgaaactttaggtgacaaatccccatcgcatctattcaggaggcactgctgggaaaagggtcccagacagaatgtgcacaggcttggaggggagagggtagcagcctggccgaagtatagagcaggaaaaggatggcggagatgagaggcaaggagaagccgatacccaaaaccctgggaggccacaggttaaagattttggactttattctgatattggtagattctactgaaggcttgtatgcagggacatgatgggatcaagtcaaatctgcttgcctgagaatggttgaaaagggaggcagggaagccagtcacgtgagagaaaatgttggtcttaacaaaggtagtggcagagcaggtggaagaaagtggatgaaatcaaatgttttcagaggtacagctaatgggacatggtgaatgagagtttctgccaaaatcaaggatgatttttcagaaatttttttggctttggcaactagacgatggtggtgccacttgtgtagatatctaggcaaggtaggagaccaggtttgggataaagattgctttagacattgagatatctttgggacatcctggtgaagatggcaggtagtttggtctcaaactgggaggtgccatctggggtggagatgaactgaggactcagtaactatagtcactgtaattttctgggggttgccattgctcagggagctcctagagtaagggactgagataggtcccaaggaatagacttgggagggccagggagtggggaggccactgaggtggtgggacaggctgcagggaagaatacctcaaaatcatacgaggccactctttgacaagtgtgcctgtttcaccgttttgtttgcacaagactctaagacagtatactgccttaaataaagtgcaccctgtttggaaaagttcaggagaggtgggtgttttccttgttcctctttggctatgctctgggcactggaaaaagcctgcaaaggagacttatcaggaaaataagcagaatgagggccatatgccgctcaggggccattaagagaaggactgaaaagagcccattgaacttggcaagtaaagattgctggcgactggggcgagctctttcttgaaggggtggggcagaagctggaaagtcagttgaggtgtagaccatgcagtgaggaaagagcgactcaactgggcttgaagaactgacttccccatattcatacttgccccactctatttgtggagtggctggtatgatcttaaaagatcataaaatgcaagcatggtcacttgacaactctacttaaaatccactgttctctaatgaatgacctagtctttacccagaatgccagtttgaccccttctgcctctcctacttcgtttctgccctctccatttggcccctcaggctgcagccacattggccccctgagaccaccaagcctttagtatcaaattttggagactcacatgaagttattatgcaacagctctctgagtctttacactgatcacgaaatcaggagattgagaccatcctggctaacaaagtgaaaccccatttctact

SEQ ID NO: 6 - DNA, 43484 bp, Homo sapiens
ccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttggtgagtcccgcgggcccgagaccccgtccccgggcggcgggaggaggctccgggcgcggcttgacgcgtccccctctctccctccgggcagccgcgctgttgccggcgcgcgaggccacgcagttcctgcggcccaggcagcgccgcgcctttcaggtcttcgaggaggccaagcagggccacctggagagggagtgcgtggaggagctgtgcagccgcgaggaggcgcgggaggtgttcgagaacgaccccgagacggtgagcagccggcgggcgggatgcgggggaacccctggcgcccgcgcgcctccaaccgctcccgagaggcagcgctgctgccgccccccagctccgcgcggcgaggcctggcctcagggtcccaggagccccggcccgccccgcgtcccccacgcccatcccccggcgaccccgggatccccgcgcaggccggtgagacgctgcggggctgtccgggaaacgctcgctgtcagacgcctccccgcggggaagccgggagtccgtttccaaagtgcgagagaaacacaatggttaaaacccaaaccgcttccccgcggccctccctctgctgggctggaggtgaggaacccccgggccgcgcctcgtcctcctgagaggggtggagagcagtcccctcccgaaagaggaattgaaagggccgagggcgggaactgcttgcggcagcaggtccaaaaataagattccaggaatcgagcggggccgcatgcgggaggggagggcggctccgcggccccgttctgccaggtgctctcctggaggcagcgggtgctttcaggagcccgacggtgctggccccggcacctcggttaggaatgtccttggagaaggcggggcgcccggggccgcctcccgcaggagccgccgtgtgaggacggcctggccactctatcctgcgggctcgggagcgggtgactttggaaagtccgagaaggtgtggattcccgttgacgtccctcccgccctgaagtcagggtgatttcatagcgaagttttccgttctgctggaatgttccttttaaagaattctcctggggtggaataaatgtcacccgggatgaaagagtggttctggatgaaccatggaggcctgtttccgcttacatttctagtggttgacttgacccctcttagatctgcctttctgaaagctctgaggctgtcagatggccactgtgcacttgtggacatagctcatccctgcagagatgacgcacctggggctgttgcccgggggctgcccacagccccacaggcccgtgccctccttcagctcagcctagcttggtcgctctccccggcctctctgttttcctgtttctttaatgatgaatcctggcctgtgctgctggctgaggcaggtgggcctgtgtgccctggtcgctcggagtcgccgcccagctgtggggttggtcgtgtggctggtgcagtgtcctccaacagcgtcctcacccggaacattctgcgtgcacagggactgtggcatggggcgtgctggtgatgggagttgagggcagcagggtcacccccaccccacagtacccgctccgcgcagccctgcaaggcctggccgcagcccctcctcgctgtcctccaggacctgcagggcccatgtcaatcagactggacgctgcctggatgtactgtgctgttcttcccaagtcagtcccctacctggttttccaattttaatttaataactttatttacaaaggtgtgaaatgaagataagaaaatgaaaacagcactcaggaccccatcactttaatacaactgcggttgcgtcacatggtttctgtgctggcatgttcatctcctcaccctcctgcatgtggctgagtggctttggtgcccgggaggcatccctcccatcctctcacagcctggccccagcagcctctgtcggcttcttttcagcgtcatctcagttcccagcgttctgccctccttcccagcccccatgccaaatgataacaacccgctttccctctggtttttggatctggccattagcttgctgtctgtttctgtttctgtttccggttcctgccggcaggtggatgctggggacagcctggttggggcaggggcaggggcagggtccagaggctggcttgagtcccagccggctccagcacaccaggcccacccctcccaggaccctagtctccactgcatcctctgccacactcttgggagaccccaggcccgaggggactgtccaagcacaacttcctgctaatgcatgaaaatcatccatgaacttctccctgtcaaaggccaggggctccttgtctttgaaatgttgctcactttacattttgtgcagtgcggctgattgaggaaaagggctgtggcctgagctcaagaggtgaccaggacctggccatggtgactgtcagagcatccttgggtccctggcctccccaggcccaggatcctgatgtgtggtcctccacgggtggttgtagggaaggtggtcccagccccctgccattttaggatgtgggaagtgcctggccgccgttagttaacacgcacctacccagccctggctgtttcccctgggcaggctcctacgagggagggaagggacagctggagccagctctccagtgtgctcaccttcatgtccacctgctaaactgctaacctgcccgaagtgtgtcccactgccccttgctggggcatcttcctggttgcgccttcttcccggaagcacccgctgtgcagcccttccagcaggcagatactaagcccggcacccctcccaggctccaggctcacttgtgtgctaacctctgtgcccacctggccacctgctcacctgcctgaagcgtgtcccactgccccaagctggggctgcttcctggttgtgagggaagtgcctgctctgcagacccccaccttccagcaggcggatactaagcccagcacccctcccaggctctggccctccccacacacctgtggtttcaagccctgttctgctggaagggacactcctcccacctccccagccctctctgctggagccgtgcccctcccccgacattcctccaggctgggccacccccacatgcctccttgctctccaccgcccagaccttctccttatcttgttttcctttttatattgttgttctccctccctggccttgcctctccctgctgggttccttgcccgagtttctaattcagagaagactgggtaactccccacagtgtctctgctaaagcttcccaggcccagtgactttttactaaatcctcgaaggccatcaggttccagggcctgctgaggtctccataatcaccccttgattccagaaatgatccgagactagagacttatcccagcccagccctactgcccaggtcctccggtgcctgcctgggagcctgtttgtgcactttgatccccggcctgcctgccggaaaatcatccaggctgtggttcctgatcccatcacctggctttatctgagatacaaagcacaatattcaccgagggctggtggccttccctgagggttggcctggattagcaacctgcacctgtacccgcacctgcacgacatgtggccaggcctgtgctccgaggccaggtttcccttcccccatctctttctttgtctccctctgtgtttctctctctgtcccagtctctctcttctccccactgctggtggtgaggaattctccgcatgggatgttggtgcatccgttttcaaacttgctggctcatcctgaactgcatgtgccctccaagcaccttttccctgaccttgtggattctttgggaacagctggggaaggggtaccctttatggaaatgaaaacccctctgagtccccacttgggaacagccacttggctgggacacaggcccagatgttgggatggcctaaagggaggtccctgttggaggggagggctgtacaatgtgggggcgcctggtggggaaggtgatggccaggctgagacctcccctgccctgccttgacagaggctgcagcacactcccacacacagacacatgcacacacattcacacatggacaccagcacagataggtgctgactcatggatacaggtgtgcagggacacacacacccctacctagacacatgcacacatgtacatatgttcccatagacacagatatacatgcacacacacaggcacacacatactaacagacatgtacatacgtatgcacacattcacatagatatacgtacacacacacactgacagacatgcacacacataaacaggcacacacacatactaacagacatgtacacatacatgcacacattcacatagacatacgtacacacagtcacacactgtccagacatgcacatacaaggcacacacatactaacagacatgtatacatacatgcacacattcacatagacatacagtcacacagacatgtacacatgcataatgacatgcacacacatactaacagacatgtacacatacatgcacacattcacatagatgtacctacacagtcacacagacatgcatacataggcacacacagacatgtacacatacgtacacagtcacacacacagacatgcacacacaaaggcacatactagcagacatgtacacatacatgcacacattcacatagacatatgtaagcacacagccacacactgacagacatgcacacacatacatgcacacattcacatagacatacgtacacacagtcacacactgtccagacatgcacatacaaggcacacatactaacagacatgtatacatacatgcacacattcatatagacatacagtcacacagacatgtacacacatgcatgacacgcacacacatactaacagacatgtacacatacatgcacacattcacatagacttacatagtcatgtacacacatgcataatgacacacatactaacagacatgtacacatacatgcacacattcacatagacatacatacagtcacagacatgtacacacatgcataatgacacgcacacacatactaacagacatgtacacatacatgcacacattcacatagatgtacatacacagtcacacacacagacatgcatacataggcacacacagacatgtacacatacagtcacaaacacacagacatgcatacataggcacacacagacatgtacacatacgtacacagtcacacacagacatgcacacacaaaggcacatactagcagacgtacacagacatgcacacattcacatagatgtacatagtcacacacagacatgcatacataggcacacagacatgcacacacaaaggcacatactagcagacatgtacacatgcacacattcacatagacatatgtaaacacacagtcacacacactgacagacatgcacacacatgcacacattcacatagacatacgtacacagtcatacactgacagacatgtacacacatgcataatatgcacacatgtacacacagtcacataaatagacacatatacacacacaggcacacatggatgcccagccacatgcatgcagacacacacagacacatgtgcaccctctcacacacttttctctttctacaactttggggtcagaagaccactgacagctgcagcaggatcactaaaaagtgacacaaggtcacggggctctgtggccccagcttcctcagacccccagggtctctccactcccagagccccctgcctgaggggccggagccctgtggccaaggcctttcctcctgggcccatcctgaggcctgcaggtggaccccggcccggcctcctctgagggccgtcttccgtgctggctccgcagccctctcctgtgcccgcacctgtgcagatgcttgttttcacccgggcgtctgcaggcacttggtgccaggctcctccggggctttctcagaggcagccgagtgccaggccctgcacacgacaccctcacccgagccggagagcttcacatctgtggaaaactctaattaaagacgttttgagaaacgctgaacgtctccctttgttatttaggaacaaaacactcttttaggaagcaagtgcttatggcttctttcttgagattctgagtaaaggggcgttaagcttgctagctggggcatgctgagcacttcccaggttatggctttaccccagagcgattgacaggcatccaggtttcctcatgcttcattttcccctgttttctaaggttaaaactgagagctgtttctccaatgcaaagctgcttgtttaagggtttcgtatttgatgttggaaatgctctggactcttccatggtttttatattccagtgatttcactgcaaacctggtgtgtacgccttgtaaattttgaccctggccaagtgaaaggttcattttaaaagttttaaaataaattttaaaggggagctggaagtggaataagttaagaacagtatcagttttgcctttcactctgacagaggcactctctgctctgactgacgggtgttgattaaaagtataatattcaaaagaaatagtaaagtgcattgggccttgttaatgttctactaattttctggggctccgttttcaaattataggtgaaatttttttccttccagtgttagtgcctatgataagaaaatacattttctccacatctgtccacaaacctgctagaccctgttttgtgactacctccccttggaacttggggctccatggaaaacacacagcttgacccagccagccctcagagagcctgggccggtcactgcagtggctggattctcagcataaaaaggccaaacgttcggccaggctgggactggctcccatccaggaccaactgtccacagtacagtaaggccactctctgagtcaacattgtttcttttctgaattgctaagttgaccgtccctgcagaagcagagagggctgcggtgtggcattcctgcccactccaaatgagggcagcccggacgcgggagctctcagggaggcgcagtgggctttgggtgtgtctggactgtctccaccacacctggaagatactgttcacttcctttttacacttgtgggaaatacatgacagtgtttacgggcaggctggctttccgtttatttcaaccctgacaattgaatagcagcagcagatgatgaaactgttcacttcccgatcactcccgttctcagatccatcacttagctcgtccgtcgctcagctcgtctgttagtctgaaagatgaatcgtgcacgggtcctcctgagagtgctgttctcggggtctccatgtgtgaagttgttacatcctcatgacaactgtgtaacagctgtcactgagccattttacagatgtggaaactgaggccctgagaggctgtggagggctacagtgtgtcctgggcatttgagccccacactctgtcattaactcctgtgctcgctgggactgggggagagcaggacgcggcagcacccccggccccactgtgtgctcctctgtgtgcaggcgactgtgagcatactggcacccatgtgagggctgagtggtgctggtgtgggcgcataaagcacagggcggctgcggggagctgggtgtgtgtcagtggctcggagcattagtctcgtgaacatggtctgccaggtgcgtcatgctgggctacagagcccatggctccaccataaatggtggttttgtgtttgaacttgagtgttgctgctcagtgaggccagaggaaggcaccaacctgcaggcctggccggtcctcacaacacggaaggcaaccagtccactagagagacatgtgtcccggccactggaggagtccaagtgacctttaagtctcaccagtcctcagagcaacccaggtgaatttggggcctgagcttggtcgtctggccgaagaccagctcaacttggataaagctggaggagaagcctgtccctcaggcagctgccagggcatctgtgatttctgcttgcgtgcactcttggcgactattggtggtggtcgcagtcagggcatctggttgcctttactgtccttacaccagctgggcagagctcaggctgggagcccagtgggagaggccggggcgtgactcccggcgcagaagcggcagtggcacaccggcgtcccaagcacagctgtccctgccaggcccctgcgcgttggatctttgggttgagtcatgctcgatggtgcagccatcctttcaagggaactgagctgtccagcgtcccatggagcagctccccgtggatccggagaggccgtaaataaacctccccatttgtaagccgggaacacacatgaactttgcaatcgtgtttgtcctgggatcatagaacgtggtggctggcaagacccaggcatcctcatcctgtgctgctgtgaacagaggccggtagcttattgagggaccagtcccagttcgctttctgtggggaagactctgatggaagcctaggccccaaactccaaggttagcacatcttcttggggggattgacacctccaaaggtgaacttgggtccaaggcacgtgtgtgcgacctgaagcatgggtgccgtgtgcaggagacgccctcaccggagatggggaccgagtccacacggctctaactgcagaatcactggccctgtgcccacgactattttattttgctgttttatatgatcacaaagtacactgtcttgtttttcccaaagcatttgcagtgagacatcccacttcctctccacggcagctgttgcgggcacgaggctgctcccaggacagcgatgccaccggggctggggtgggcacggaggaaccctcttccttcctcctccccgccctctgctcccccacagactggcctgtctttagtcagcactttcccaggctcccttctgcccaccacgtgcaaacagtggcgtgtcctgggcctctctccttgtagtgtttcttgtggccagcatccctcccatccaacagctgtgtggcttcctgactggcttctctcagggcccgcaaggatgctgccaaatggccagagacagtcactgctctgcacttcaaagcaggcagccctcggtggggcttgccctgaaagacagcgggccttcctcgatgagagcctgtgctggctcagggcctgtgggggctgcagctctgttccttccctgcgtccacgctcacatgctgaatgttgtgcaccacaggacaccctgctgggggctgtcgggagcatgctctgtgtttggggcagagacgggcagagtgagtctcagcattactgccgtgcagggttgagtctcagcatgacttccatgcagggggagtctcggcgtcactgccatgcggggcgagtctcggcgttaccgccgtgcagctgctggaagccactcgagctcctctgtctcgtttgccatgaagcccatgagagacactgatgtgtgtctcggggcttctgtgagaagagcttggttacccaccgggtcaggcaccacgtcggtgctgtgaggcatggagggtgctcacagctgtgcagtcagctacagaggcctttcccagcatccacatctgaccgggcagtcacaccaggatgagctcccaggaagagggctcccagcaagggagggcgcacctgggtgtgagcttggaggagggcagaggcacctgtcaccgctgaccctgggtgcagatgggcatgccgggtatactgactgtgctttcctggggcctgtctccctccaggtcagcctggggtcctctgggctgggggccatgcactgcctcctgtgggcagtgggatcagcacttccactttgctcagggctagagcaggctgctgcgggtgtgaagacttaggaaacgaattcggaaggaaggaaaggattttgcacttcccaagctagaagaacatgaatagagccgggctgccaggccaagggtctgtaagacggcggctcttcagagagtctgcaaatgctgagaaaggaaggctccccaagggcagttcctgtgggcgttactctgagttttctcatagaagtcaagttcttggaagacagcactatggtcaaagggttagtgaattcttgtgaccatttcccatggaaaatatcagagaaagttatggtgttgataaacagagtccctgtgctcagcagtctccacccacttgtcaagtaagataaagatttttggaaacaaaatttatggctgttatttgctaaagagagtaatacattcttagcacactctgaaaaataaccactatttgctgtatgaatgcagatgaaactcacacaaaaagatttatgcaggactgacatcgggtgtttgcagaaggttctccacgttcactgacctctgatcctcactgcagctctgcggggactgtggcccaaggatgagtgagcgtcaggtcgggccgtgcccttaatcccctggctgcccctcaccaccaggcagagaccttgctgggacccaaggagttaaagtgtattcagagatgaaggtgtttaggaaatgttctggaaccttccaaactgactttaggctgcgtgaggtgcttccagttcagtgcactttgggcccaaaagtgtttcctgtcttgttaatgcactgtgttgtgtgccatcaccgcatggaggttttggccatttttaaaaagtgaatgggccctcccagggtctagttggatcgagagaccactggaaaccctcaccaagctgcaggcaggtaggcaggggccccagagcaggcctaggggaagagtccccccggccccttggagggtctcttcacgtgctgggtgctgcctgattcctgcggtggcatggggaggtcaccccaccttgttctgaaccacagctctgggtgaggaagcctgtcaccaggttaaaggtcatttgggggttggggcgtgagaaccgcagtgccctgctggtagggttgccgcatgggtggccaggctacagcctggtccccgaggccgacccatcctgggaaccctgtgtgcagctccctgccatgcttgacctttgccctgtgggtggctttgagcgggggagacctgggtctggtggtgggcagggcaggggcggaggtggacttgggtctttgtgacactgcaccaattcccatggattctgccggcacccactgccctcctgagcagagcaaaggcagcagaggcggatgccagggtccggaggtggcatctactcatcagacactttctgtagttttataacaaatttggggcctcatgttagaccccagccagaccaggctcctgtcctggggctcagctccctccaagctgcttcaggttcagtttcctccatgcttacgaaaccgaagggcaacgggcacagtcagggaggcgtcagaggaggcaccggctccactgttcacaccgggaccttctgcagacggggctcccagcctcgaccagccccggaacccccagcacggggacgtccaatcttttggcttccgtgggccacattggaagaagaactgtcttgggccacacataaaattaacactaacagtagctgatgagctaaaaagaaggtctgtgcctaaagctcatgttttaagaaagtttacgaatttatgttgggctgcattcatggccatcctgggccactcacagttgcgccagagcctcgggagcacaggccgagcacctgccctgcttcacccagggacggggccctgcactgaccaggaggctgttgccctccaagtcgtccctgccgggaacagcaaagcacacaaacctccgagagacctaatggctgcatcctccgtgcagtgggcaccacgcttgccacctagaagagtgggtttggcagatgtcagttaataacaaggatgtaagttttaaaatcacgtgggggtttgtaaacttgaggaattacagcacaaacacttccatattattaaaagaaacagactgggagcattgattttgacttttcttccaagtacttatctatgatttaagtgaaactgagcattcagtgctctgtgggagtgaaaactgcaggcccttgcacttgcccactgattcattcattcacccatccacccactcattcattcaactatccatgcactcgctcatccatccatccactcattccttcatttattcatccatctccatccatccagtcacccattcacccactcactcatctatccactcactcacccacccattcactcatccattcacccacccactcacccacccacctattcattcattcatgtattcatctatctactcactctcattcacccattcattcattcatctgtccatccattcacctatccacccactcatccattcatgtactcactcatctacccactcactcattctttcattcattcatccattcactcacccatccacccactcattcattcactcatctggccactcactcatccacccactcactcattcattcatacactcactcatccatctattcactcattgttttattcattcatccatccatccatccactcacccatctatctacgcatttattcatttacccactcagtcatccgtccatcctcattcatttatccatccatctccattcatttactcatccacccactcattcattctttcatccacccactcatccatccactcattcatttgttcattcatccatctctatccactcatccattcattcattcccattcactcattcatccactgattcattcattcattcatctggttattcacccatccactcacttatccatccatgcatctgtctgctcactcatccatcctactcactaatctatccaccgattcactcatccatccattcattcattcatctgtgcatttatccatacatgcatctatccatccatctatccatctatcaatccatctgttcagtcattcatccattcactcatccatccatccacccactcattcatgcatccatctgcccatccactcatttattcacccatccattctttcacgcactcatccactgtccatctgtcatccatccatgtgtttggtgacggctcatgaggcctctgggggacagtcagcaccaggctcggtgctgggcaggtagatgttgtctttttcctcttgaagcttcagctaacagtgcagtggcttggggtttgctcacttatttttatctgtagctgttcaaataaaacagaagcagatccccggggaaaggatttccaggggccaaatggcgccatttccagcctgggaatcccagcttcttccccctgttgccctcacctaaccccagcacgccaacccattaccataggtcttgctcttcctaggtttagaagaaagagagtcagtgtgtacataaggagctcctggttctaaattccggcctcctgagtggtggcctctgctccatggggactcctgggggtgctgctctggagatatggctaatgcagggcttcaggccaaggtttatggacctgaacaagcagtagtgcagacaggggtgggagggttttgaggacaaagtgctctgtgtttggttctgcaggtcagggagcttatctgggtgcctttactcaaagccatttctgggtcttacatctttggctagaatgttctcaggacaatgtgaaatgtctttatctcaggagtgtataccagaatgttctcaggacaacgtgaaatgtctttctttcttgggagtgtgtaccagaatgttctcaggaaaatgtgaaatgtctctttttctttctctcaggagtgtatagcgtttttaggtttattcatcttagcttttctcttgctcatggtttaaccatctttcccctagtttgccggtggaattagcatatgctttctgcctccattactgtctcaaataatcaaacatgcaaattaggatacagtgcccagggctataaccctgtggtttcagaaaccccattcccataggtgtggcgaactgacaggagattggcatagtttttccatgaataatgcctttttgcaacaataaaacttggtattaatacagattacacattaagtagtatgactagtcttgattttgaaaaatagaacacacttgctgtaaagctgtggtaatgcaagcatttgtgtatagttaggccgtttgctcactagttcttagttgttttcaatccctggcttctaaacctgaaaggacaccttttgcatccctcgcaagtcttttatttcagagccagagcctcctgctttgagacaaagccccatcacttcccttctccttccaagcctagaaacctggtgccacttcgtgttgctccaggactccaccagggctcacttggtatggctgttcttgccttttcttggagtttgccaacccatgactaaaattggaagtgagagaaatgagggcaggcatgagggtgtgtgttccaggtctgcagccctcctggccttcagggcggccgccctcccaacagacacgtgagctgcacaccagctcaccctgacccttcctttctcttaagggagtaagagtttaagagcatcccatctttcctagaacacaactttgtgaaaacacatccaagcaggcctcaggagggtgttggcaaggctggggcggggcctccaggctcttcccacaaaaggtgtggcaaggccagcaagtgtgggagagaggtgggaaggaggcagaaaggccatgcagagccagcgcatgaagccagaggcgcgttgcagacggcgctgggtacctaccgcctctgtctgctactctgcaaaatgctaccagcgcctgctaatcctgaccttcatgcccccaggtgaatcccacaaccatcctgaagccgggtttcctcattcctgataatgggattaaaaagaccttcctgggtgttatttgtgaggatttcataaaatagtgtaaaaatgctgactcatacccagcatggagaggccgctgggactattctgccatgactgtggtctcttggtttagagcatttagggccaaactgctggcatggttgaccctaagctggagattggaggctgctttaaccaggctgtggccctagaatctgtgggccatggcaaaaggatcctgaagaagtttccggccggcctctgctggccaagtgacaggcaggtggttccaggactcgacagctcacttgtgtcgaatgtggacctcgtcagtgcgctttcatggataagaagacccttcattacagcctccatcctcacccagtaccaattttgtttcaccaatactataagtgcaaatcaatgcccgtgtgccaaaagaaaggtctttggggttttgagagacctttgtgtcaacagggaactaaggtctttgggttttagagacccttatgtcaacagggaactaagagtggggttttacttggaagcattcttgtcctcctgggcaggcctctcccctggacacacctggtagcacttcctacgcagctggaaatggccctgcctttgcttgttggtctcacagcagtcgtgccccggtcacttcccctcagttccccgggtggggcggccctctggctgccccgagagcagcctctgattaaccagctgatgcttatgttgttcagagaccctcgtagtgtgccggtcaatgcttgccttttctttttctttttccacaggattatttttacccaagatacttaggtaagtctcaattacttctctactctggttgtcgtagaggcatagttgggggtgcgtgtttcatgttggaggaatctcctcaccacgtaactcttggaaggaagattcttaatcacatggtgcacgtggaactgtccggaacatgcaggtcagaaacacaagtttctctctttattttataccacagctttattccgtgttagtggaacctcaggtgaatgctgttatctgcaaaccccttctctgagttgatgccaggctcagctccttgtcaggacgtgtaattgattttgtcctccggttttctgacctcagcactaatcacttctgaagtcattgaggaccccaaaggggtccatgttcatgtgggctgtattgactgatatttaccgtattcttaattaaaaccgaaaacactgaatagtgtttctgtttaatttgaagaacgggaatgccagacgttatctcagccatcagagcagctggtgcatgtggggcggcctctggagacccccactgtacacttgggaagggaggacagcaagaaagtgaaacccagagaccccgggtcagcccgtttaactgacaccatcttagagctctttgagagcatttcacttagaaggagagaaatgtattccagggtcttctttttaatgttgcaaagtgcattttagtaaatgtcctcttaaagggtccttccctgggtccatatctggaacaaacacagtgggtctggcactggcccagaaagcccaggcaccagcgaggactgagttctgaagcagggggtggccagcggtccacagcacacctgcaggaggccttccgctgttcatccgtgccgttctgcgcctggataagcaacagtaacccactgaagggccaggtcgagaggccccgcaccgttctgcacaacctcacgcttcgggttatccctggatgtgcatgtgccaggcctcgcctccccccgccgccctagcgggatgtctgctgtcaagctgtgttcagccagccagagagcatggaggggctttctccaaagcagagtggctttccagttaagcacagcgtttcccaatgggggtccactggaaaatgaagtttagcttttcgagtaccgtcaggaacttactgagcattcccggtgattctcccgtatggcaggaggagccccctcgaaacggcgggcggtgctttacgcacttgactgtgggtgcacaactccgctgagttggtggaggtggtttcctgtttgtcagggttggggctaacatgttttttattaacacaagctaagcggcattgtttctggaggatgatagcaccccaggtaagcagagtaactgcctctccagagcgtctcagaagcagaggctctgcagtccatccggtcttgtaaggatgactgacatccattccctttcttcctgcagactgcatcaacaagtatgggtctccgtacaccaaaaactcaggcttcgccacctgcgtgcaaagtaagtcggcctcctttgcgccttcctgggagcactgtgggtttgggcggctttaggcttggctgtggtttgtggagggccctgaatagttctgttttttaaggagctgtggtcccttgccgaggcctgctcccttttcgccaaactttcttttttaaacaagtaaattttgacgtttttagcaataggcaataaatgcacatggaacaaaatgtaaatgtttcacagagtgtgatgtgaaagcccatccccgcctctgagtcgtccagtcagacaccaccgtagttacagttccaagaatcttgtgcttagacatgtaaacatgtgtgagcggccttccgctcttcacacgcgtggcggcttagcacacacggtctgtcccgtgcctctgcaactctgtctgcacaggagaccctctcttagcgtgtctcaccttcacgctggcatttccagccggtgcatcatatgaacttagcccatgcatattggctgatgtccaggttatttccaatttccatcatttaaacaaaactggcgtgacatcctcatgcacctgttgcctcccacacgtctgagtgtctgcgggatgcgttcccaaggatggaatcgcagaggcagtcctcatgtttcctttggatacagatactgccaaattatcccagagccagccttagcctccgcccctgcaggggtgaatgaactgtttttttaaacttttgatctcttccaatgtaacaggcgagaaatgacatcagtcatttcaggtttttttttttttttttaactaatgagtaaagctgtccttcataggtttaaaaactgtgtatttcttttcctataaactgttgtttatattttttgcctgtttttctcaatttgtaggagtttgcacattagccattggtagtaaagttatcaaaaattttttcagcttgccacaagtcttttttattattttaaaattatcatgcaataagattgattgttttgggtgtcctgtatgaattttaacataccttcagcacaacccacacagctccccttgcactgggtctgtggtccgctggcgtcacgtgtgtctagttttagatgaaagtccagcttggtgagtccctgtgggcgctgagagcagaggcgtggcgggacggagtcatcctgggagaggcaggagtctcttcccaggcatggctttggagctggatcccagtcagcagaaggagtcagaggtggctcagtcccgctccccaagccccacgcactgtccgtgggcgtctctggcctcccggacttgtatcacagaccccagcccaagagacacaggcagaggaaatgctcagtgtaaacatgggaatgggagggtggccctgccctgtggcccggcctgccctgacctgcaaccatgcacagtagccaggtgccacgtagggcccaatgtctgcatttggggcagaggctcctgcgtgctcagaggagacaagcagatcctgtcacgcgtgttttatcttagtgattgctaaaccagtctcttcttttaaattctgtattcacacttgttatactctcttagttcctgggctttaggcttctccccaagattacaaaacagttacctgctgttaggtgttttcatctgtgacccgcccgtaatttcttttgacgtgatggatgaggtggggatctagactgcaggctcagttcctgccccaacaccacacatttgagtctgtctcaccccagtgcctcacctgctgccgtcctcatatgctgggtatttgggagattttctgccgggtttccacaggccgtggccacagctttagactcggcctcatgcacgcgggtgggtctcctatgccctcctcagtcttttttctggttgtcttgcttattttttaataaaactaaaccttaaaaatattcttaaaaacctaaaaaagccctttagatatttttaactgggcttgccattcatatatcggagactgtgtctgaacagtgttgcgctttcctaaccccggcaccgtcctgtccgtcccttggagcacttttcttcctgtgcgtcccgtgcttcctttgctcagttcacttctggctatttgcagcaaagaaggccgtccttttcaaggcgtcgcctcgcttccttgcatggatgaagaggagtgattgctacatgttcctttctgttcccgccgcccaatagagttatcttgttttggttatttcctttgtggcatcagcgtccccaagtgcggccagctggggagaggagggcaaggtcaagatccttgagtttgttccctgtgtgataggaagagaatctcttgctgtggctggtgccagaggcaacacatgcagtttctaacgggtccacctgccccaggccagaagctccggccactctccctgagccggccctcagaggctgccctgcctgtggcctggggctctcagcttctcctccagagcacgtggctggggcctctgatgttcgcgtgcctcaaaagatgcctggcggtgaagaaggtgctttggtggcctggccacagcaggcagccttgcactcccttgggaaggcgcctcccggaggatgcagctggggcagcctcacactctgttcctgttcattggttccctcgtgaaaattctctgacttggtgctcacggtgctgtcctggcttcagttcactggttatcggtcattgtgaaattaaagccatagccccataaagtccaaattcagccccagacaagcaggcccccagcgggccttgcatgggagcctgcggccctcaggctgtcccaggacccaggcggcacagtggacggagggaggaggcctgggaagagtgtaggctgcgttcccaggtgcccctgaagagcctctgcttccatttctttcctttcccacggacacacccagcttctccactgcgaacgcgcccgtcctgccatagcggccacttggtgcttggatttctcggctcctttgacccatgggtttccccaggaaggtcaggtccccacaggcggtggcccaggcagcggtcactgagccccggctaccgggatcccacccccgccacggggagtgtcccctcgcccttccctcgggcagacagggctctggtcctcgctcgtcaccacccagggaaaggccctggccgcccgcaccggcttcagattccagccacagccacagccgctccctcctgtccttcaacgcagtcatgggccaagctgagataaacccttcacctcctgaacaggcgctggcgcccagggcatgaccagccaggccaccgataccctaggcccagcttgcgggatggggatcagggaggtgggcgggggtcagggaggtggacggggtcagggaagtgggtgccctcgggggcctgcagaggtttctgtctccatcgctttccctgttgtgtggaggaaattccacagatatttgctgggcaccggctgactgtccacccctcaggtgtggttccgtccttgcatcctagaggtatcaatacattcccaacagggaaataaacaaatgagttgggggaggccccggggcaggtggcatgagtctggggaccgcttaagagctgggcacctggcaggagcaggcactgtccctcagcctcagggacagaggtctttccgaaaggcattccaggcaaagtcaagaccgggttcccagccctttgcatcacatgggcaggtgtccacttctgaaatggctttaatctctaaccaaacatcgtagcggcagcgcacagcatcccccagacatccctccatggtgggggcctctgaggaggtcaggttctggtgccggagggttgggccctgcacaggccgcctgccctgcacgtgtctgactccctcctgcccccagagcctcttcatctgaggccagggtggagaagcggatacgcccctcatttctctagttcaggccagacctccccgttccaggccctgctatgaccacatcgacgtctccagacgccccgcggacacagcacccaggtacagccgggcgacagcagtgtcagggatggggccccggccggctcctggcggctgtgctgatgcagaatccctggtcctggtcctcgtttcctcgtaactccgaaggccagccccagcccctgtgtgcttcagagtagaaagcgtttatagtgacctgctgaaaatagcatcttagaaacacttcgagacgcgagctccgtccacacccacaagtgttctgttgtcagtcatttgtgcaaaacaagcaaacggaggtgtagggaggaaactgtggggtgtactgaggaaactgaggcttatagaggaaactgtgaggcagacggaggaaactgaggtgtatggaggaaactgaagcatacagaggaaattgaggcgtatggaggaaactggggcgtatggaggaaactggggcgtatggaggaaactggggcgtacaaaggaaattgaggcgtatggaggaaactggggcgtatggaggaaactgaggcatatggaggaaactgtggggcgtacagagaaaattgaggcgtatggaggaaactgtggggtgtatggaagaaactggggggcgtatggaggaaattgaggcatatggaggaaactgtggggtgtatggaggaaactgggcatatggaggaaactgtggggcgtatggaagaaactgtggggcgtatggaggaaactgtggggcgtatggaggaaactgtggggcgtatggaggaaactggggggcgtatggaggaaactgggcatatggaggaaactgtggggtgtatggaggaaactgggcatatggaggaaactgtggggtgtatggaagaaactggggggcgtatggaggaaattgaggcatatggaggaaactgtggggtgtatggaggaaactgggcatatggaggaaactgtggggcgtatggaggaaactgtggggtgtatggaggaaaccggggcgtatggaggaaactggggcatacggaggaaactgtggggcgtatggaggaaattgaggcatatggaggaaactggggcatacggaggaaacgcgggtgtacggagcaaactgtgaggcatacggaggaaacgctgtgaggcatacggcgaagcgtcgcagaaagaagccagtgtggttgggcagcttccccaagaagcctgggactcgtagccagggcctctggtgagcgcggtgcctggacccgcctaggaggacaggggctgtgtctgtgccggccacaggcagtgactgtaagccctggatgagctggaggaactcagctttgtgaaccacagacccgcccgccgctcaccctggcaccgggcacccctgaccccggccaggtggggatggaagcggctcctgcactgacagccgagcccagaccctctggtggaaacgccacattctacagacctggtgggaaacgtcaccttgggagcctcaggaacagaagcgacacgctggcagtgagagcccatgcactgaagactcgacgtgcccccaccagggctgaccccttaggacgatgctggcccagtgccctagggccctgctggcccggcctgcacttttcccagggactggtccttattgaacttgtgtggaatcaatggaccggagccctctctcagccagcaggggggccctacccagggttccccacggagccctgtgtggctaagctgagcgtggctgagtcctcatgtggggctgagctgagtgtggaccgcgcccctgagcactgccatgctcagccccgagctgcttctgctctgccagcagccatgaaaggattctttgagctccgggtgtaattgtcgttctttctgccaacttcccggggctcaggcttgcgtaactgcactgtcgggggcttccctgcctgcctctgggacgtggtttgggtccgtgtcctggaagcgtgtttgtgagcagctcctcgtatgaatgtgtttgtgagcagcttctcggatgggggactgcttgggaagcagctgcactggcacgggttcccaccctcaggccctcacccgttcccctgacctctggccctgcaggagctgagcccaggtgaccaccctgagaaagggcagaacacacctggcctaaagccatcaagacacgtggagagggggcagctaagcagaaagaggggggcttcctggaggacccctctggcagtgcagcctgggcctggggtcctccccgccacacccagcagggagagttcaccagagatgggctaggggctggccagggaaggcagaatgttccgagtctgcctggaagcccccaggtcagctgggggttctgtgtgcctactccctgggaggtctgagctcccaggcctcacgccaggcagttcctgctcctttgccctcagcccttcccaccttgcgtccaggcctgctggcactccctcccagttgatctgagttttcctggagccggccccagggcccgccagcctattctgtcagccctaggccagcacagagggctcgggtgcccaggggctgcctcagcctgcgcccctcagagctcctccgggctggacccgagaccccacagccgccccgatctcagctgcgttgggcgcgcaggggtggggcagctgaacatgattttccactttgtgtccccaatcagacctgcctgaccagtgcacgcccaacccctgcgataggaaggggacccaagcctgccaggacctcatgggcaacttcttctgcctgtgtaaagctggctgggggggccggctctgcgacaaaggtacgtgaggctgaagacaaaggcggggtctccctccatctccgaccctgccctgatccccgctcctcactcccactccggggcacggccatcctcaggctgctctccgacagccccaaggaggctgcagccctgaggtatcctggagccccaggagaattgggaggagctgcagtctcctttctgggagcagggctggaaggaaaggaaacaccaagtgatgcctcagcacccactgattgaagggcggggggggaaatttcacctctgaccgtccttgagtgcagacctgtggtgtcagtggcacccactgattgaaaggcgggggggaaatttcacctctgaccgtccttgagtgcagacctgtggtgtcagtggcacccactgattgaaaggccggggggagatttcacctctgaccgtccttcagtgtagacctgtggtgtcagtgaagaccctggaggaagaatagctccagggcctggtggagacccatagtggagagcccagcaggccagcctgtcccctttggcaaatcctaccccacaggtggcctgggagggctttgctaaggagtggccagctctggcctggccttgtctgtcctcggcacccagaggtcactcctggcctgcagcctcctcctgcaagcacatgggcatccagggagctgagccctgtgggctgtgactgccagcagctccccaggctgagaccgcagctggggatcccccatgccctcccaccatctacctccacacgcaaggccaggaccaggggccatgaaacgctagggctgctgagtggggtgtgaggtccaagccctggggtccctctctgctccagggctgggctgtgcacctctaggatctctctctgctcgggggctgggctgtgcactcccaggctctctccctgctccagggctgggctgtgcacacccgcggtcccttcctcctgctccagtgctgggctgtgcacccccccggctccttccctgctccagtgctgggctgtgcacccccgggctccctccctgctccagggctgggctgtgcacccccggggtcccttcctcctgctgcggggctgggctgtgcacccccgggctccctccctgctccagggctgggctgtgcacccccggggtcccttcctcctgctccggggctgggctgtgcacccccgggctccctccctgctccagggctgggctgtgcacccccggggtcccctcctcctgctccggggctgggctgtgcacccctgggctccctccctgctccagggctgggctgtgcacccccggggtcccttcctcctgctccggggctaggctgtgacccctggtctccctccctgctccagggctgggctgtgcacctttgggatctctctctgctccagggctgggctgtgcacctctgggctccctccctgctccagggctgggctgtgcacctctgggatctcttcctaccgtagccaggggctgtgcacccttgggctccccttcaggcctgtgcttgttcccagatgtcaacgaatgcagccaggagaacgggggctgcctccagatctgccacaacaagccgggtagcttccactgttcctgccacagcggcttcgagctctcctctgatggcaggacctgccaaggtaaggccctggggtgaggcctctctcctctctcctctccccaccttctattttcggtcatgtctgctcttctgcaagcggctgctgctggctgggttcctgtggttctggatgggatggggcatcctgcagagactacacaagcccaggccagccgcagcacagggagctgctcggcaccacaccaggatgactcacccggcatctgagggccaggactcagggggccggcccagcccatgaggccacactgctggctgtagggcctcgtccattccccagagcctcacagagcctggaagtgctccaggcacttgtgtagtgagcttgtgggtcagggctccaggctagggtccccccgccgtccactctccccagcatccccagaagcaccccgttgttggtctccctctgtccactaaatatagccctgccctccccacttcctttcatatttcagtctggggttccctcagcccagggccagagctggggagccccaggacaccccagaaagtcactgtgaatgtgcgcgcccccgacgctgttccaggtgctgctgctgccactggccctttgccactttgcagggggagcaccttcctcctccctccccacgttgtatctggacatgcccaggcgtgtccctgagagtttctggcatagttcttagcgctgctgctgactgtccaggacaccgaactgcgtggacaggacagacagttgctcagggagaaacagccccaggatctggagagtgaatctgaccagacaggaggggccacaccccatcccccgatttcaaaaggcagctgctatttctgtccactttggtggttcccttccctgaccacccaggagttagccctgtgtgcagatgacgtgattcccatcttaacacataaacccatttccccgccgaggacagagcccctcccatcactgctctatccctgacctggaagacagcagcaccccaggtttaaagagaggtgaagactaggccgatcctgagagatgacgtctaaagcatctcccgtgggtccctgcaccagtcgggcactcccggcaaagtctaggctcacagttactgcccacagtgacagaggcattcccgtcctctcctcctcctccccatcttcctcttcctccccaccattccccctcctcctttccccactccccctcctcctctccccactccccctcctcctcccccccactccccctcctcctccccatcttcctcctcctcctcatcttcctcctcctctttcttctcctcctccccccactccccctcttcctccccatcttcttcctccccctcctcctcctcattcccctcttcttcctcctcattcccctcttcttcctcctcattccccctcctctttttccccctcctcctcccccatccttatttcccctctcctcctcctcccccacccctccccaccccctccctcacccctccccaccccctccctcacccctccccaccccctccctcacctcctcccccacccctccctcaccttctcctcttcctccctgcttctcctcctcctccccctccgtcgtcctccccctccgtcctcctccccctccgtcctcctccttcccttccccattctcctccccctccccctcctcctccccctcctcctcctccccctcctccccctcctctccatcctctccctaccccctcctcctcccctcctcccctccccctcctcttctccccctccccttctccccctcccccttctccccctcccccttctccccctcctcctcctcctcttcctccttcccctccccccttcctcctcccactcctactcccccttctcctcccccacctttctccgtgcccctgcctttgctctcctctggtgactaaagggctcttcatttcagggttgcccctcctaccccagggtgcttggccgtaaacagcatctgtcccacattagatgctcaagtcttaggattgtggtttaacccggtagtgaaaattgattgaaaccagtaaatgcttctctttggggttggggttttagtttcaaatgcccccggggggttactttttacggccccgtgtcctgtagcaccgtcatttaaatggaacagcacagcgtgcaccgccgccccccacccctccaccaagcagggcccttcccagctctccacctgctgggctgaagtcagccttcccagccgggccttgatcagaagcgtgcaccaacaccccgggagctgcccggtcaggggaggagggcagggaaatggggccagggcgcgctggccccacagagtctggatgcgacctctgggtggtgccctggccagtccctgcagccgcctgccccagccccgtctgagatgccgctgtgctgcggttggccggtttttttttgcttgcagacatagacgagtgcgcagactcggaggcctgcggggaggcgcgctgcaagaacctgcccggctcctactcctgcctctgtgacgagggctttgcgtacagctcccaggagaaggcttgccgaggtacccacgccacgcggtcaccctcgctttctctgacgcccaagtctagacacgggtgccagtcactgcccgagccggttgctaacaaccgggtgcttctggtgaaagaaagtctctttctccctgtttctatcagcctggtaatggcctgtgctaccaccatgcccgcacacacgtgagcacacacaggcacccatgccccttgtgcacatgaacgaaccgcacacatgcatatacaccgcatgtacacacgtgtgtacccttctccacctgcatagacggggcctctccccaaagggacggggagcagcaagcctccctctactgttctctctttccagccgccatggggagggccctgttggccgtagagcctctaagaggggccgtgcccccagtgatgggaacagtggggctgagtaggcagacagagagggtggggaagcccaggctgcctgcactgacctccatttcccaccacagctgtcggcccctctgtgctccgggggacacctcactgcacagcccagaccctgtgcttcccagacctgccttccacaccggcccggcagcgggggtgggtctggctcgttgggagcaccctcctgggacacctgcgacatttttattccctcaagaaagagcccgggcaggagcaggccgagggtgcaacctagctttccagtggggggggacgcgacccccaagccgcccccgttagaatctgcatgtaattccttgagcgcaccttgcgtgtggtttgagcaatcgcggtgtgatcccacggcgggacagcgtagaggcctccccggctcaccgccgcttccctctggctggcagatgtggacgagtgtctgcagggccgctgtgagcaggtctgcgtgaactccccagggagctacacctgccactgtgacgggcgtgggggcctcaagctgtcccaggacatggacacctgtgaggtaggcggcccctggccccgcgggcccttcacggtggttccgggggccctcgccggtgggggctttcgggagaaacacttccgtgaagacctggcctttgctaaggtgttggggatctccagggccatgtggaggtttgggatgagaaacgcttctgttccctggaagatgtttggttgtatttatagagtctctatggcaactcccagctcacagtggatcagcctggtgtggaccccagtgtgacactcacgggggcacggtccccactctgccgcgtgccagggagccaacgtgaccgacctgtcacaccggtgcctgtcacaccgacctgtcacaccggggcctgtcacaccggtgcctgtcacagcatgacctacctgtcacaccggggcctgtcacactggtgcctgtcacaccgacctgtcacaccggggcctatcacagcatgacctacctgtcacactggtgcctgtcacaccgacctgtcacaccggggcctatcacagcatgacctacctgtcacaccggggcctgtcacactggtgtctgtcacaccgacctgtcacaccggggcctgtcacagcatgacctacctgtcacaccggggcctgtcacactggtgcctgtcacaccgacctgtcacaccactgcctgtcacactgacttgtcacaccagtgtctcacaccgacctgtcacaacagtacctgtcacactgacctgtcacaccggtgcctgtcacaccactgcctgtcacactgacttgtcacaccagtgtctcacaccgacctgtcacaacagtacctgtcacaccgacctgtcacaccggtgcctgtcacaccactgcctgtcacactgacttgtcaccggtgtctgtcacaccgacctgtcacactggtgcctgtcacactggtgcctgtcacaccgacctgtcacaccggtgcctgtcacaccgacctgtcacactgacctgtcacaccggtaggaatgcagtacccacatgtggacgtttctgggcagggcggctcttgtctttcctcttcagcctgggcctgtgcctgggggttgatgagagtgagcatttatttaaaaagcaaaaccacaggtggaaagagtcaccaggacagcttctcggagtcgcagacctgggatgcagccgtggggctcttgggtctgggctgcgacgttcagggcttccagccagccctcgccttgaggttctttgcctcgctgcctcatgtactcatgcagagggtgtcggacccctgcgagatgtccagctcaccctggctgcccacggtgggcagggcaggcctggctcagccccagcccctccatcttccaggggtgtcagctcacaccggctttggttctgtcccccttcgggcagcgtggagaaaccacagcccagaacagggaactttccaggacagccatcttcaaggcatccatatctatttcataatagtgtatactttttaatgattctctgtaatttttgtatgcttgaaatatttcataatttaaaaataaagggtcaagggaaatgagcagggaaggagatgacggggacccccgagaagccctgtgggaagcggctgctgcaagcccgcccttcacctgggagtcccagtggggcaggtgtgacagcctctggggtctcagcagctagaggcggggtggccactcccgaggcacaggagggacagtggacccgctgcgcggccggggcgtggggctcaggggagcaggagtgaaggccacatccccgaccggcgtggcccccgtccgtggcaggacatcttgccgtgcgtgcccttcagcgtggccaagagtgtgaagtccttgtacctgggccggatgttcagtgggacccccgtgatccgactgcgcttcaagaggctgcagcccaccaggtgaggaggtgtccacaggaggcaacacaacttagaatggccaagacactggcttcacagggcccgggccagggttcggccagcagggaggggccgggcatctgcctgtgcccagtgctgactcatttctcctgtgggtgcccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacagtgagtgtgcggcagccaccccttccaggcctcacggggttctccctgagccagactcagctgtcactcgcttatgcaaccgttaggagatgagctctggggcctgcatctgctgcgtgccggcaggacggggacccctgccccgtttagttcatgctccgggagacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctctgggggctcactgtggtgctctaggcctctctgctatttcatcacgtttcagcctggctccctcagaaaggggccttgagtgcaacctgtcagtttggtctccctgagtttggtcaccctggctcaggtagaacccgtggttctcagccccaggggaccctgggctgtgtctggaggccatgctgtttatcccgagcagagtggggaacagaagccagggctgcttgacgctacacgcagggtgccccaccaggggaggaggccgccactgaacccgcaccacagcccagagctcccgccgtacgtgtctcccgggccgtggccaggccaggcgccgcccgcccacccttccctgtaggacggcgtggacgctgcggtccctgagccctggctcccagggcctgctggtcagtgcggccatgcatgccaagggtccaggtgacctcacgggagctgccccttgccagagacgtcctgaccacctggaccccagccccatgggcaacctgaggggtcctggtcagacctgcacttgggcagctgtgggcagcggtaaaacgtgcccaccccacatccccatccgtggagcgagagggcctgtaagcaaccaggctcccgcccacagcgctgggcctccctcaccatactgggcttgcagaaggaaacgttgggaagaaaggtggaaagcacgtcttgcccttcagaaacattgtagacttgtatttccatcctgcaaagcaatgcctcgctccatttttcccaacctcttaaaggagcagtatctccaagagcaggaggctgttctcagcaaagctacagaaagcaaaggaagcagaagcagtttcagggatggagccccggggaggagggccccagggcaggtggcctgaggcgaggtcgcctgggggagcggtgttgcaggggatggagccatggggaggaggggcccggggcaggtggcctgaggcgaggtcgcctggagggagtggtgttgcaggggatggagccatggggaggaggggcccggggcaggtggcctgaggcgaggtcgcctgggggagcggtgttgcaggggatggagccatggggaggaggggcccggggcaggtggcctgaggcgaggtcacctgggggagcggtgttgcaggggatggagccacggggaggaggggcccggggcaggtggcctgaggcgaggtcacctgggggagtggtgttgcaggggatggagccacggggaggaggggcccggggcaggtggcctgaggcgaggtcgcctgggggagcggtgttgcaggggatggagccacggggaggaggggcccagggcaggtggcctgaggcgaggtcacctgggggagcggtgttgcagtgtagtcccgcccagtgactcacagcggccgcagcaccccaccaagacaggcccttccccagcaggggtacctcatgaggacccctccccaattccaccctctctagctgctgcccaaacccagctgacccgaatttgtaccatgtttttgtgactcagttcaaacccaaatacctgaaaggtgttttcacacaggaagaaggatattcttctgaagctcaggaatatagtgtatctagcattagactttacaggttttctatgaggaaaggttttggtgaccacattgatgcatcgagggccctcctggcccagatgatgagcagggactctctgaggttgggaccctcttggctcaggtgtggatcaggtggtctccttgaggtcaggtccctcttggctcaggtgaggatcaggtggtctccctgagattgggaccttcttggctcaggtgtggatcagggggtctccctgagattgggaccctcttggctcaggtgaggatcaggtggtctccccgaggtcaggtccctcttggcccaggtgaggatcaggtggcctccctgagattgggaccctcttggcccaggtgaggatcaggtggactccctgaggtcaggtccctcttggcccaggtgaggatcaggtggactccctgaggtcaggtccctcttggcccaggtgaggatcagatggtctccttgagatcaggtccctcatggctcaggtgaggatcaggtggtctctctgaggttgggaccctcttggctcaggtgtggatcaggtggtctctctgaagttgggaccctcttggcccaggtgaggatcaggtggtctccccgggtcaggtccctcttggcccaggtgaggatcatgtggtctccctgagattgagaccctcttggcccaggtgaggatcaggtggtgtccctgagattgggaccttcttggctcaggtgtggatcaggtggtctccctgaggtcaggtccctcttggccaggtgaggatcaggtggtctccctgagattgggaccctcttcgcccaggtgaggatcaggtggcctccctgagattgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggcccaggtgaggatcaggtggcctccctgagatcgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggctcaggggaggatcaggtggtctccctgagatcgggaccctcttggctcaggggaggatcaggtggtctccctgaggttgggaccctcttggcccaggtgaggatcaggtggcctccccgaggtcgggaccctcttggctcaggagaggatgagtgtggtttttctcagttgggagccccttcagaacgtgcactcccatcttttctcatggcgctgcctctcttcagatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctgtgagtactgtacctgtccctgtgtagacgcgccgtgtgctgggatcccgggaacggtgtcaggaagcctcagtcacaccctgccctgtgtttaccattaaccaggtgtgaggaggacctagaggaaggaaaggtttcctagagtttgacaaagtcgccgtacagctatgtcattaattttaccatctctttttatgagacctaagttttcatctgaattgataataaagttgtctatttttcaatggagataagacacaattaaattattattattttttttgagacggagtcttgctctgttgcccaggctggagtgcagtggcgcgatctcggctcactgcaagctccgcctcccgggttcacgccattctcctgcctcagcctcccaggcagctgggactacaggcgcccgccaccacgtccggctaatttttttgtatttttagtagagacggggtttcgccgtggtctcgatcttctgacctcgtgaactgcccacctcggcctcccaaagtgctgggattacaggcgtgagccaccgcgcccggccgaaattattctttaacagaacagtaaacttttttggacaatttccaagaacattttgggttttgtaactctgccgtgagtctcataaggggaaaacagccatgatgggcggtcagtgtgggccattgctccaggtcccgccttctctccccttcagcacagcacacgcccgtgcccccgacctgtgtctccagcccccacgtgctgacgtctaagccgtcatcctgggtattttcacttccacaccaggcaggagaaaggcacgcatgtcttcgcgtctttgggtgctgagtgtcggcagtgcctgtgctgaagccaccccttcagtgttgtgaggggcacctgctccccaggcccacagactgcctggtgccgggaccttcggtgttgtgaggggcacctgcttcccaggcccacagacagcctggtgccgggactttgcctggctggaccctcctcgtttcacagataagggggttgccctgatttgcccacagccatattgaatattgaataattcacatgagtgttggatggttgaacaatccatactctttgaccttagacccacatggccttttcagtcctttcctagctttaaaatgaacctttagttcttgagcatacaccagtggaaataggtattctgcagtgaggcgttgtgtaaagtgaagaaaccttctgtgaaatggccaccaccgatgggactggcccgtttctgccgtagagctgcacataccagggccgcgaaggcgccacccaccgactggggcatccggcatggggcttctcgctcccaggaagccacggagatttctctgcctttccagataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacagtaagtcttggctcttaccgttggggtggctgtggctgcaccttcagacaggcatacgctgaaagcaagcagacggcctcagatggcagcgtcaggacaagctgaggctcctccggttccggggcagggatgggtgggcggggtgggcggaggtgcgggcagaggcccacctctcaggatggccatgcaggtcactcagttcagagtcagccagtgaagaagaaatgagagagatgtgccgagaaggtgcctgcgaagccagtgccaggaggccggggagagaaggtgcctgcgaggccggcgccaggaggcgggggagagaaggtgcctgcgaggccggcgccaggaggccggggagagaaggtgcctgcgaggccggcgccgggaggccggggagagaaggtgcctgcgaggccagcgccgggaggccggggagagaaggtgcctgcgaggccggcgccgggaggccggggagagaaggtgcctgcgaggccggcgccgggaggccggggagagaaggtgcctgcgaggccggcgccgggaggctggggagagaaggtgcctgcgaggccagcgccgggaggccggggagagaaggtgcctgcgaggccggggaggctgggagccttacagggtcctttgcagaaagtccggagacagcacagccttaggactcgtccaggggcacagagaagctctcggtaacatggtggacaccgtggtcaccgatgacccggtgagacagctacaatgggaggtgtgtaaaaacagccgtgaagctgcctgggggacagtgaacctaggcctgaaaaagggaggacagggtggatgtgagctgctggcccagtcctgtgacgccacgctgccgccctccccagtgcaggctccgggggtgctgctgtgaggatagtgttactgctcggccccaccctgcctcacattcccaccccacgtgggccccactggggcaccacagccctgccctattcctggacaccgagccgtttatggtgaagcccccacacgcacagagggcaggcagcgccccctccgtcagatctcagggctgccggccctcaagcacccagcaggaaccccaggttcaaggggatccacgcggagcaaaggggagggtcctgccccgtcctgagccagatccagtgtcaccgtctccccccgggtgtcaaaagcgtgaccgtgtcaggaaaggcatctgagaaaagcgccatctgccactggctggactgactgtgcacacgcgttctccctcagtcttgatttttggacttccaaatctagagcatcataatgtttgacacgaaatcatgtcatatgaaatgcttaaatcctttttccacttaatatcatacacatttctcaggggtaaccttatgcaggcatcacaggggccatttccagtgactgccggccgcgtctgccggccctttttggtctatccggacagaagcagttacagctccatgcatttccagtgaatctcaaactataccagtaacgtctcttacaagacagaggagacttgctgggaatggtagtactggcctggctcactctgcagcgactctgctgggctcaggcttgcagatctccgggtctgtgcagcctccatgcaaggggccacgtggagccgggaaaccttcccggggagagcagaggccggtgcccttgtgaagccccgatggccaacatgtgcctagcctcctgtcaggagcttccttttttttttttttttttttttttgagacggagtttcgcctttgttgcccacactggagtacaatggcacgatcttggctccacctcccaggttcataccacaacctccgcctcccaggttcaagcgattctcctgcctcagcctcccgagtagatgggattacaggcatgcaccaccacacccagctaattttgcatttttagtagagatggggtttctccatgttggtcaggttggtctcgaactcccgaccttaggtgatccacccacctcagcctcccaaattgctaggattacaggcgtgagccaccacgcccgactgggagcttccattttaaagaacaccatcatctctcccttcacaggttatgggaagaccggcaaacaggagactttttgttgttactttttgattctgttgcaatatttttgttactttttctgattttgtgtgtttcggtgccataaatggttgttgagaactgatgtggcgggtaccagctagggacaggcaggacaggcgatgtgggtttcaggcgtacacagccccgtgggaaagagacagggaaaccagcacaattcactctgaccccaaccttggcctgcagtgcgaggcgcccagtcacaaatgtgtacacacagtgatttggggtcctttttcctaaaacagcttctttatcaggactttggaattctgggtgagatagaaacactgaaaacagggcggaagttttttcttctggcttcttagtccacggagggctcagcgtggagaggatatgccgtggcattctccctgggagaccacacatgttcccgacagctcagaccccagaccgcatgtgctcctgacagctcagaccccagaccgcgcgtgctcctgacagctcagaccccagaccgcaggtgctcccgacagctcagaccccagaccgcgggtgctcctgacagctcagaccccagaccgcgcgtgctcccgacagctcagaccccagaccgcgggtgctcctgacagctcagaccccagaccgcgcgtgctcccgacagctcagaccccagaccgcgggtgctcctgacagctcagaccccagaccacgcgtgctcccgacagctcagaccccagaccacggtgctcctgacagctcagaactcagaccgcgggtgctcctgacagctcagaccccagaccgcgcgtgctcctgacagctcagaccccagaccaccgtgctcatgacagctcctgtccgcatgctatcttaaactctcagcccccactgggccctgtgctgctacctgaaagctgcaggtgagatgcgaggcacgaggccacgcacgctctgaggaaggagctgtcaggcgctcctgaaacaagaggacatcggagggaggcagggacaggcctgcgtcccatggtgcacagcctgtggcccctcagacgggcctgtgtggcctggtggtcacctacagggcatttggaagtggggtactggtgtggccagggagaaacagcctgggggtccccggtgcctctgggctccgggccaagatctgaaccagtctgttgagttttccatcacgtcccagatccggggctgtctgcacagcttcccaccccggctgggactgcatctctcgaggccctgctccgacctcactgtggcctctccaccgtgcataccaccctataatgcaccgctttcattgcagtgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcaggtagggcctccgccacccagggcgtcctgaccggctcgacccacgggtacgtgggctgcactccctggcaggggacgaagggggcccgcggtgggatccccagggacccccaaagcctctgaccagaggtctgatgagccaagcccggcgtgggccacgcttcgggctgcgggggttgtttggacaccaggtcaccgccacacagctgagggggccggcgcctgcgagccacactcggctcacagtgtgggagcttttcccctgttcggttgggcagatggtggctcacagcaatctgaattagtctctggtgtttaagtcagatgatttcagcaacaaactcagttttccaatttccctggaaaagtcggatctgtgaccttggccggtcccccaacagcgtctttccgtgggggacaccgggtggagctgagtgcagctgccccttggacaaggtccccccacccccggtcctcacaataagtcagctgtcctgggctgggggactcatgctgttttccccacagaacaatcaagaggtgacagaaacagcttttattctctcgctcgtgtgctaaggagggagacatgggtcaaaccagagaggctcacgttctccaagtctgcccaccccggggccacagagccctcccgcttgctgggatacgacagacaggcttggttcatgcaaatgctcgttaccagggccagacccaatctcagcatctggaataaacagctgctgttatgtagcaacagccgacccctgggctgctgggctgtggtgccagcgtgagtgcccaccgggctgggaggccgccaccgcagggctgggtcctgggtccccatcagggccaccccagttcctggtcaagtgcagcctcggtcttgtgtgtgcctggtgcctggggctggggttgaccctctcacacccaacctgggggccacacttgttcccccacagcctcccaggctggcccctggctttacgtgcagagaagctgagccccaggtggggtgggggtgtcatccacagtcagcgagcatccagacccagggctgcagggaaccctggacggagacaggcgtgcggcgtaggggtggccagcagctgtgaggaccagcttggacctaacagctcacgtaggggtggccggcaggccctgaccacacctcggtctcctgcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccaggtaggtgctccctgctccgctcaacccgggtgaagagctccagggaggcccagcttggtcaccccagatctaacctggacaggctggggtttctggtagtgaatgcggaagaggacttgtgttttaagaggaaggagaagtccaggtgggtcgttagtggctattatggtgtctcggtgctggtcaggtcattggctgagactgagaaacacgtacgggggccggcattggcctgagtcaggccccacgaacctgcatcttcagggagcattcgtccacacccatcagaccagccccgggggagagggctgggcagacctcgggccaggctgcagttgggacccgcggctgtcaccgcagctgttagcagcgaacagagtgaccgccagcccctcccatgtccagcagggcgtcctgccgtgtcccatgggctacacagcacagaggctgggaccggggatgtccttgccatgagctgggagggtcagcggaaaggcacgtgggagccggcaagtcctcggctgcccgcaggttttcacttgcggcaaacggcaggatttctctcttggctgccagacacagactccacttagttttaataaacagagctttgaagaggatgagagcgagccaggaggcctgcagcctgaatgactcactgggcacagaagaagatcacgtttaaccgatgggactgtctgtgctcccagcggggaagggagggctggcgtctgcagagcccaggctggcagatgcctcctgcttgtctgccgggtctgcggccaaacgaacggggaccgagaagttagagaagaaagggaaaccctgccctttcggagggaacccggggctggccacaagcgctgccgggggtgggggggccaggcggggccggccacgtggtgagctaagatatgttgttctctccctgcggcccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaat

SEQ ID NO: 7 - DNA, 113033 bp, Homo sapiens
ctccagcctccgccggcggagcccactatgccagacagtttcgacactttgcaaagacaaagagccctagaccggagggaggaggaggaggaagaagagcggagagagaaggaagaggcgatgtgagctgggaagggggcaagtgtccgggacacccacacccctgtattctcctccgaaccccttcatgcccaaatcccggaaactccagcgtgtctccagccgtggtgagtgcgcgcgcggaggcgaaccctgctcggggtgcgcgggggctgcgtccgcctgagttggggctcgggcagtttcctgtggattctcggagtggaaggttgattgtctggacccgggaactgaaggggtggggaggggactaggagggtgtgacagtggagctgggactgaagaccccgggattctagtggaagacattcgaagggagaccccttccttggcagcggcgaccacccagggctttgggagaggaagaaggtcggggtggaggttcgggcttaggggtcttcggccgacactggaggagctgcctggagctctgtggggaacctacgccaagtcccgggcagcggttcccgaaagcagccccagtgacattgcacccggcgccgggctgggatctcctccgctggggccgcccgtgggaggagacctcgctgggtggccgggctcaggcgctctcgagcggatttggggtcacaggctgggacaccgcggaggccgccagtgttctggacgagcggccgtgggacagtatccggatcgagtcccccaatccgctgcaagcaggcgcagatccgggaggtggctatcggccccggggacgccgtcagagcgcgctgctccggatctgggggtgaagttgacacccgggacaagagagctgaacgcggcgtggcggacagtgggggacgcgggtgggccaaggagagcacggccggagtcgtgttagtggcaactcgaaactctgaatccgccccaaccccgtgaggcgtcgcagctcccaagaaataatctgacaaaagttagcaacttgcctgtgtctctcgtgtgtgtgacctgcgtgggggcagggccaccccttctgggagcgcacggggacggacagcggtgaccctggggcgaggcgctctggtgagggtacagttagtttggaatcgggacggtggcgcaactttccgctcctcctttctctgcgcgagtgtttaagcgtgaccttgcgggaggaagcgcggctgaacttgagatgggggttgagcttgcgccccggcttggcacagagacgtcggagcgcgcattagcctggccttgcagccgggtctcccaggaagcgtgtggggatcgtctggctctgctcgtcagctggagccctgactcgctcctccctcctacgctagggtcctcggcggccgtaccatgcgcggggctcggtggtgtgttgggcgaggggacacgtgcgcacccagaagcgcgcaagggggtgggggttgggcaggtcactgcgtctcgcgggctgggcgagtcccgcagagggagtcagccgtgaccctgagggcagtgactggctcgccgcgtccctgcatcaggcattcgcccggctttctcgtgattgtttccgggcacccctggcctctcccgacttctccccctcgcgggtccccaagccccgcaagtttgcgacgagctggttctccagggagacagcgagcgcccacccccgctctgcggctgggtgtgtgtggtgagaggaagagacgggaggaggaggcgaggccgactcgccaacgaggaaaacggggtgagaggggagccgggttttccaatagtcgccagggcgcctggcacgtcgtaggtgctaacgcagtgttcattgacaaggccccaaggtggaaggtgctggcaggggcccggacgcccccttcttcccttccagtctctaaaatggagttcaaatgtatcgaccaagccctttaggcttctagacgtgcctggagcacctactacgtgcgggggctctactcctggcctgttcgtagaagctgcgggcggagcctcctgattttctttaccccgcgctgcccaagcgcccagaggcttcgaaaaggcaaggtgcactgccccctgccggctgctgtggaaactgccgcttgtctctgcggtggggaaggggcgcccagtgcgggggtccctcagtgccttcccgcacctccccttcctgccccaaacattaggacccctgccggctgttttctgaaatcccatggttggctgaaatgactgactagagttcaccactccgtgcccctcagcctctgccaatatctgggtacagcgtggggcctcttctagtctcccgtctctctgtctctgtctctctttggtcgccagacttaacctctcggcgtctcagtttctatatctgcaaaatgaggccaataatacattctccaaaatacgttctgcataattgcgagtggcgataatacatataattaagtgaatgtgtgtatgtataggtagttcatactctacatgtgtgtatgtgtataccttgacttcaggtctagggaaaaaagttccatcgtacactttttgctaaataaagaatgaatagagggctccttctcctcttgccttttcaaaatcccacaaaccctgaagtttgctttccctgcatttttctgggccggcatttgctgtttagagtctgattggacaaggccaggacctgggcttgagcagggcctttgttgcctacctccctggctgggaggccacagcaccccacccagggtgagagagaaaaacaggaagcgttgctagaagtgatggcagaggagggtttcttagggagtgtggagtctgttcctcgaagctctgcagcagcaggcggaaactgccttctgagcagccttcttgctgattgtaatcagggctgtactgccccccttccctggtggcgctcacagcattggctgtcgctgatctggaagcccttcttatggggatgaagtcgtctgtgagcttgacaggaaggagtccttctaggtcctgggtctttgggggtgaggtagatctctgtctcccctccccaccaagcagcccccgagccaggacaccacccaaaggcaggcagttgacattacccaaggaagggccctctcccatgtgtgactctgaggcttctggtcaggtaaccttgcttgagtcagttcctgtgtagaaggttgctgactcaaagggtttatatttgggtagagctttggccagggatctaaacattaaccctcactctaggcccctcccacaccaccaaaagcgaccaggaaagcaaaaaataaaatccaccagccatcttgtaaaagctttccagtgagttctgcatgcctgtgtgcatacactccacaggctgatggaagagctggcccggtcacaaagaattctagaataagacttagatgcagcttcgttccgttgtgtagactttgtggaaacttcagcatccctgctggcacacctgaggagctgagagctctcttctgctctaatttggtcacaggagcccagaccggggccctgtgagagcctgcatttgagtcccagtggcagcgctcagttactttgcaacttggctcccaaactattccaggctctgggtctcagtttcactctcaaaataagaggcttggctgggcacagtggctcaggcctgtaatcccagcactttgggaggccgaggtgggtggatcatttgaggtcaggagtttgagaccagctggccaatgtggtgaaaccctgcctctactgaaaatacaaaaattagccgggcatagtggtgggctcctgtagtacccagctactcaggaggctgaggcaggagaatcacttggacccgggaggtggagattgcagtgagctgagatcgtgccatggcactccagtctcggcgacagagtgagactgtctcaaaaaaaaaaaaaaaagagagcaaggctttagagttctgctgcccgtcactgagggtccattaaaagcttctctttgtgaagacagccaccacctgatttatgtttgcttcagccagcatcatcctcaaaaccctcccggtatcacagacaaccctggcttggggcagctggactgtctactaccccatgccaagggcatctcccctctcaaagagtggccaggaccattcggagcccacacccgcttggcaaagtcattttctagcagttctcaacgctagattttgaaagcagtcccagaagtttcagactctgaggtctgaaacctgacagagccagggtgccatctgtggggactcccaaatggtacatattgcagaaggaaccccagtgatctcaccagggcctgttttgcttcccatccacaagctgaacatgaccttagaaatcactttggtcagccctttcactttaatgtaaaaatattgaggctcagaggggaagtcactggactgtaaaatctggggttttattgtttatttggtcttgttattggtggtggttgggttgttttgatttcagttgagccaacatttactgggaacttattaccttccaggagcaccatgcaaagtgcggagatgcagagaggaaagactactcggtccttgttccttgctgtcccagaggtcacagtgctgtggggagggggacaaggacataccctgtcaggctgcgtatataaatacacaggtgctaagcaaaatgggaacggagaagggaaaggttccctccaccttgagagacccacagaagggtgttctagagatggatgagtcagactgcaagagagcaaagatatcttcctgaatacattcaatatcaaagcatcatgtgccctgtgtgtgcaaaataataataatcataataataaagtaaaataaaagattggctgtaagcctgttccacatggttctgaagaggtaagggaattgggaattttagaggttcagtgctttggccccatttccctccttaggtcctgatctctggtttgtttgtgtgagaggaatggttgccttgcagccagcctgcaagttcctacaccatgagagcctccaagcattggaatgcccgtgtataaaacagagagtggctgctttgcatttgcctttttaaaaaaataaaataaaacttagtgctttatttttaatgctcatccgtatactttatctcagattttcatagctgatttgggagggtggcatggcaggtggcaggtaggagaaagcgcccaggttttcagggggacgctactatccaggccggctgagtgagctggagcaagtccctgcatttccgtgagccaggtttgaggtgcatgtgggtgatcaccccctgcaatgcgggggatgcagggcccccaggaggattaagggagaggattcttgggagagttgtgcatgcgggagtcccagagcctccttgattccagttgcattaagtctgtttataagagaaagtgatcgcattcctcaagacagagcctacgggagacagaggagttgactgaaggcaggaagttttggaaaactcctggaaaagcacttgaagtaggaggaggctgattttaaggtaaaatggtttgtgaatgatccgcctggaagcagtaaggcctaatgactgtgttgggggagcatgctcctctcattcctatgggttgtgtcaaacttttggcttctttgtccctagggcaggacacagcattactagttagccagaaccctggcctaagaagccacccaaagcactgttaccaggagcagagacacacaggggaggtggggggcagcataagatggtcggggtgcccagcatcataagccacctggagggagcccttcctatgtggcctggctggccagcagggatgggatttgtgtcaaagttcaaggcacctgcagtggacgctattgtggttcccacctgggacaactgttagagagggctctggagttgaggtgttttctacagagtcaggggaatccctgcagggaaaccactggccaaggacacagaactcctgggccctggccctggccctggcccatctgctccgggccggggaccttgggcacgttgtttaacctctttgacccttcgtttcctcacctgggagatggtagtataaattcccactccctctgttacaggagagttaggaggaccccacaaaatgaagcacaggaacctgccttattgataagaattttagtagcatctactttttatagtttaatgtacacccagtagtgccaagtattttgaacatcttatcattctggggttcagcaggaagcattgaatggagggtctgaataaagatgtgcttccagagatggtgcccacattcagagaagtcagcaggggatgctgtagcacctgggcccatttaccacccccagaagaagtggcacggtaggggaagggctaggggaaccaggagagcatcgcaatagttgccagaagcctctggaagagagagaccacaaggccccctcctcaacttggcaggagaggagccaggcggatcaaccctgcaaccttgctctcctctgtcctgccctctgcaactctgtggcaccaagagctgagcccacccagcagccaaaggcagggagctccctgatggagccccccagggcaggacaaggtggaggtggattaggagcaggcctggaggagacacacacacacacacacacacacacacacacacacacacacaggcacacagagctgttatctcatttgaatctgcaacagctgggggtggggaggagtagtcacaagattaccagttggcaggtaagatgcccaggaactggagggtaacccccttgcctaaggccacacagctggtgggagcccacattttaacccattgtgtcttatcagccctagtaaagtaagaagatccattgtaagacattatgaagaccttcaattgttatcagtagcatcttaatgagaagcagaatagtttaagtgttaaggtttgcctgggtttcaattggaggtttattacttagtgatcaaattactgaccttttctatgtctcagcttcctcttctatcatgaaggcacactttgtacagttgatgtgaaaactaaacaagtttattcagtaaaggtctctcaacaaatgttagttttgattcctgagaaggtcaagatttagacagggcggtgtgggtgtgagtggtacttcaacatggccttttaacctattcagcattcaaataatatggtttgaatatttgtaggttaaaagtttctttcttccagttattctgacgatgtttgtttcatttcttctgactctgtgtgtgtgtgtgtgtgtgtgtgtgtgtgtgtgtattttctctttaaaacacatgaaagtgccaaaggagagaatgacaagaaatttaaagacctaaattggctttattgtgattctagaattgagcaacacttcgttccacaaaacaaacagaataggttttccagtgagctgagcagaggaggttggctttataaacaggactgaagaaaccagaagcaacaaagtgtgtactcattacatttagagagaacactagaaaaataactgattagttaacatccggttactttaggctgcctttttttgtgctaaggattaaagccgagagaacttcatgatcataccagttgacaatttaatcctgcttatttgagaaattgactctctcttgatttctcaggaagtcagatgacaacttagttttgtcgatggctgttgtaaaacctcggttcttgtctccttagtttaaaagaaattaaacaagagacacacagcaaaggagatgcagcatggagcgatttgttgcaaaagaggcaggatattctgaaagtgacgtgcagaatagacagtacactctgagacaggattcagggcgggctgctcgtgaggatgggacagcattgacttactggggagactcccttgatgacagccttacacggttattcataaggaggcaggaagaggcgctagcagtaagcatgttctgggtggtcttcggggtgcacatgtgcagcagctgtacctgcttgcttgtatgttacatgtctcattaacatctgaaatctccacccgggagtgtgttttttactattataatgagcaaaggttcagtctgaggacaggtaaaatcaaaatgtgcaccctcttacgggggaaattccttactggagctagtttggcttgagtgaactggactacagtgtgaatgctggcgcttatcgtgttgaccctgtggtcgccatgccacggttgccacatctcgaggacatggctccctttttgactacctatcccgcctcagtttggatttggggacctggaactttagcgtgggtaactccattttgattctcagccggccctgttggggcctagtgcggaaacttagtccaaaacaatggccttctataatttttattaaacaaatcctatgtaatcatgtatgattctaaagcccttaatggagtataaaatatgacttaaaaattacttgcaataattcagaaaagttgagaagaaaagaacattagctccaaattatttggcagaattaaaaagagggttacaagtgacttttggaaagtacacattggggtgtacaaataaagtactttctctgaatttcattagctacattaaaaaaagaaaagatcaaatgcaatagatagcactgtaatagattttgctacattaaaaaaaatccatttgaatacacagtgaactaaaacaccagagtggctaaaaagtcccttcatgcatatttacttagcagagagctcttgagaaagacccaaccaataaaccccaaccaaagcaaatccagctacttctctagctgagagggtggaatgactccaaaatattgtttcaagctcaaaaagcctaaaacaactccacataaaaaaacaaaaatctatctaattggacatttacctttttggaaataaaaggcccagtgggaaaaaaaaaaaaaaaaagaaagaaaggaaggaaggaaggaaggaaggaaggaaggaaggaaggaaggaaggaaagaaagaaagaaagaaacccttttcttagatccttagaagactcgactggagcccaaaataaatcccctgaattggccaagtattaaaggactctattctccttccctgcctttagtgtgctggagccctaacaagggcaaagaactgccagtggtcaagagctcaaacacccggaacaacccagcgacattcacagacaccagcaactacagccctgacccgagttggccctcagttcaactcttctgacggtcctcctgattttgcagataaagatgtggattcaggccaggccctgtggctcatacctgtaatcccagcactttgggaggctgaggtggccagatcacgagatcaagagatcgagaccatcctggccaacatggcgaaaccccatctctactaaaaatacaaaaattatctggacatgatggtgtgtgcctgtagtcccagctactcgggaggctgaggtaggagaatcacttgaacccaggaggcggaggttgcagtgagctgagatcctgccactgcactccagcctggtgacagaatgagactctgtctcaaaaaaaaaaaaaaaaaaagatgtggattcacaggggagaagtgacttactggccaaggtcacatgggcctctgcctccagatcttctgtgtgtctgaaattatcatttctacttggtaggtctctctttttttttatttttatttttggagacagggtcttgctctgttgcctgggctggagtgcagtatatgatcttggctcactgcaacttctgcctgctgagctcccacctcagcctcctgagtagctgggactacaggtatacgccattgtggatcactcttggtgaagggataagcccagaccttcaccaaccttgcagttctatcacagtcgtccttagtttattcctttagagtccccatcaatcacccttcccactctgaactgtagagaggtacacagcacagtgagttgacttgatcaacatctggtcgagtgtctgggaaatggcagatctaggccttgagccctggtagagctacctcgcttcattcccagcaccccagtaccttactgcctccacctcacccccgtgctccctccttggctgagcgtgagaacagtggcaaaaaaaacaacataaatctaagtctctacatcctcattagatcctagagtcagctgatggtgcccaaattatcatcacaacaatataacgtaacataacataacacaaccaccacgaccaccatttacagttcatgtgaaataggagtgaaccggaaccacaagctgacttggccaagaaccagctttagcattaggatgtcagagagctcagctgccacctgtgagactgaggggaggcagtggagggttctgatggtgagacccaggtatgtgtgtctcagtggaacctccagaaagctcaaggaattcatggcactcggagacatgtagttgggtggtttgcccattgtttagttattgtgcatgtaaatccttttcttgcagaggtggaaatcagcttctaaggagatggagtcaaagtcaagcaacagaggccagaggggaggaaaatcttgcagacggtttgggaacaggggatcttgcttgaaattttttggggcaaactgattaactggcagcaagcaaaaaaaaaaaaaaaaaaaaagatggctctgggcaaaccttgagtaaggcttcacagaaaataatttcagttgattgcattttctagaaaactttaagagtttaactgtgcactctacgtgacaggctgtctgccctccacctgggctgggctgcattgcctacttcccctcattagaatttctcattcgtttactatgggagcctagtctttacagtgactctctgtaaagtgtatgtttccacttttttcttaatcccattttatagatgtggaaaccaaggttcagagaggttaagtcacttaaccgaggtcacttagctcgaaagtggcagaaccaggatttataagtgcaccatttctgtctgaagcctgagacctcaggccccatgcaacgtaattcccaagtcatcctatatccctggctaagtggggactctggaagggaagggcagcttctctaaggttcagataggaaactagtcacaccaggtgcctggcccccagcccagcccacgagacgtgctgtgaccacctgggccctctggtgaccatgaacccatgctctgtaacatccttttgggcaggagttcctgacttttctccacctggtgctttccaggtctcacaccagcagcttcattctcccaaagcctggggctctgagtcttctccccgattcaccatcactgggtgagtccgtgggtttatttagcctgttacattctggctttattttcttctaagctgctaaattcatcataatttattacacagcaatagataatacacacgaaatgcaaatactttttctgttataagttgtcatgctgatggaagtgatggtatttcagtgtgtttttttttttagtaaaactgacacatagtaattgtacatatttatggggtacgtagtgagttttcatacatgcaatgtagagtgatcaaatcagggtaatttgcatatctgtcacctcaaacattcatcatttgtgttgggaacattcaaaatcctctcttctagctatttgaaaatatgaaaatatattataaatccttgtttactatagccaccctgcagtgccacagaacactagaacctattcctcctatctgtaattttgtttcctttaactgctccacatccgtccctgcatggctgcttgcaagaactcatctttgtggcttgttgttataaattgaattcgaagagccccaaggtgcctggggattgagggaggcggtgagccactttgagcctgccggggggtttggagaaaggactgagcaggaaggctgagtgcaaagtttgcaatcaggcgtgtaaacttagccagctccctagctagatgggagcctcttggaggcaacctgcttcacgtaaaaggaatcgtcagcgtcgctgttgcaaccttggaaaattcccttttaataacatcttcacaatggagagaaaggtttgttgttcttcttcttacttgaaaacactgttaatcctaccacctggtggagagtttgatgaataaagaccgttgctcaggaaacatgttagctgccacgaataggaatgtctttgtgaggtgtattactggttgtttctaaaacataatcttatgttttaaaattcagtcttttggcaaaaaaaggaaattaaaatgaaagggagagattaggcagacagtaccatcgttctttctttcaccacctgatagaagcttcaaatggaaaacacacctttcagaatgggttgaagaactggttccaacctaaggtctgctgctattttctgtttctccctgcgacctggaacaaactgagctcagcaaacatgatccttggaccacagtaagtcctcatttaatgacatcgataggtccttggaaattgtgagtttaagggaaacgacataaaaaactgatttcaccatagggtaactgatataaacaagagttaagtatctctgatgtatttctgttcataaaaatatcaccaaacttctaaatgaaggccccaaacagcatcgcaggtggccacagcctgtcccagtggcttaggacgtgcacacatgcacacacacacacacacacacacacaaaaccacactctatcgccctgggaccacataaacacagcagttcacctgatatgcacagctttttggggtgtgggaaactggagtgcctggagaagacccacgaggacatgaggaaaacttgcaaactccacacacacagtggtcccggccgggaatccgtattcttctcatcaatgttataatgaaatgctgttgaatgaaacagcattattggaagacctgcggcataggattttatacattaaactgacatttatgcaatgtcagaaatccaaacaaggagaaaaaaatatactggctgtggagacagttttgaatatcagaatacttctgcattgtcaggaacctgccccggatggagtaaaggaggttttctctttttctctgagccatggtgtcataaactttagtcaccattacttgcgggaggacgggggcatggtatgttggttgaataattagttacagaggttgcacacttaaatagtgtcaaagaattataaaatcttagcatttgcaaagagcctttgcagtaaccttgttcaaccttcttctatctactgagtctttcattgattccttgatttactcataaaagtattagctctgccactgcctaactgcgtgtccttcagcaagttgctgaacctctctgtacttccctttcctcatccataaaatctggataacaatggtacctacctcccaggaggtaataaataagcattcaatgagttaacacttggaccgtgctcagaagagtccttgttaaagatatgctgtggcaacacatcatcatcaattacattcttgttccgcctccttgagctgcatttttcactacctgtggtagggagctctgtgccccacacagtggtgttttgacctctgggcagctttgcggtttagaaggctctttctcattcaaagcttccaaccagagagcgcttcctggagcagatggcagaatggtgctcttaggagctatctgaatttaaggatgggaaagttgtctgggctgtgaagctagggtatcatcactggacatcagaggcacaagagacatacctaagattttagccatgagggggacctcaagacactggcctcttttttttttttttttttttgagacggagtctcactctgttgcccaggctggagtgcagtggcatgatctcagctcactgcaacctccgcctcccagattcaagcaattctcctgcctcagcctcctgagctcactgcaacctccaccttctggattcaagcaattcttccgcctcagcctcctaagtagctgggattacaggcacgcgccaccacgcctggctaatttttgtatttttagtagagacagggtttcaccatgttggtcaggctagtctcaaactcttgacctcatgatctgcctgccttggcctcccaaagtgctgggattacaggtgtgagtcagaccacggcctctttattttacagccgagaggacagcacagacagggcctggctggtgcgacagctcaacccatcatcaggcagaacctggataggaggccagcccgtggggtgatactgccaaggcctgcattaccactcagttatcctctcatcttgggctgctcagggtgccctagagaacatgccttctgtgccctcctgcactagagcaggcaggaagagcagcctggaccatgggtaccacatatcctatgaggaccccattgtgccacgcgttggttgactggatgacttccactgtgtttacactgcacagtctcctcacttcctttagacctcccggtgagcaagcttgtattgtcttttgtgaattctggcatctgcctcccctctttttcttcctgaggttctgcccaggaaataccacatactggtcattctaggcccattcactgtctaatcaggctttgagcttgctagtgctatcagtgttttacagctgagaaggctggctcgctgaggttggccattgcctgaaggtctcccaggttgggagggtcaggttggggggttgtcacatacccctttccaccatgtcacaatgtttccttctaacacatgcatgcacatcataaaaggctcgagacccagtatatctggtctccctgcctgcattaatagcaccgctgccaacctccctcccacttccctccacttagttttatcatctaagaggccaaaagaacaaaatgtcccccctccaccacaccatatttcaaagggctataaataggactgttagtggtggcattctgggtcacatttgccagggacagactttatatgatgtcagccgtgtccttgggtgcaaggtttccatggctaatagttttctttctcccttctcttccttcccattttcgttccttctttttctccctccctttcttctttcgtttcttcatcctaaaaatcttgttcgaaagtacatagttatgcagccttcattagctgaggttgcttagaagacaaacaggtccatgtttcacaattcctcccagatctgagaaaggaacgtgactctgagcggacagaacaatatatgctgggcccagaggacagctgtacagcctgccagcatctcactcctctgaaagcaaattcagtccatccaagagcaaggccaaggggttgtctcctgtccaggaggccaaggccagggggagaagacaggctctggagtcaccaggcctgctgttgatcagtggtgagatctggggcaagtgacttccacgtccgagcttagtgttaccccttgtgctctgggggtgacaccaactcatcttcctgggtgagagtggagattcaaaaagaaaaaacaagctgggcatggtggctcatgcctgcaatcctagcactttgggaggccgagatgggtggattgcctgagctcaggagttcgagatcagcctgggcaacatgatgaaaccccgtctctactaaaatacaaaaaaaatcagccaggcgtggtggcaggtgcctgtaatcccagctacgcgggaggctgaggcacgagaattgcttgaacttgggaggcggaggttgcagtgagccgagaccgtgccactccactccagcctgggcaccaaagtgaaattctgtctcaaaacaaaacaaagcaaaacaaaacaaacaaacaacaacaacaacaaaaaaaatgggtaggttgggaacagccccagagaagagatggccttcaagctgggactggaaagatggtgagccgttccaacagcagcagtgaggggtggagagggcaccccatggaggaatccactgcccaagccaggcacccgccgactcctgtgattggagggaagaggtggaaaaaaaggaaacagggaggtcccaatcaggtgggtcctaaatggcttgatcctttcggtaatgaggtgcaagcaaggtttcttttccttcctgcagaatgggatttcatcagactccccctcctttctttttttttaggaaaaccatgtggcccaggttcacagtggatgggagggcaggacgaatgtcccatcaatggtgcgggtgggagtcactgtgagccacatttggagtgtttgctccaatgtgagaattggtgactttatctctggggtttgagaacagattgcactacggtgctgagaaacgacacatggaaagtgacttggagattacgagcctggtggctgagaggactggggagccagggatgacaacggcagggggagcaacagaaatccacaccagggaagcgtgctgttcctcccattacagacccattggatctgagatgaggaagatgaactaaagcccggccaggctgagacgggtgaagaaaaagcaaaggcagaggagtgaagctcagttcaattctggaaaggctgagcagtcccccgcgggggtggcctgcttcctccccaggccgcacagacaccagccgggaaatcccttcccattcccttgtctccccagccctcagagtgaagtagaaaaacccaagtaggctgggcgcggtggctcacacctgtaattccagcactttgggaggccgtggctggcagatcacgaggtcaggagctcgagaccatcctggccaacatggtgaaaccccacctctactaaaaatacaaaaatattagctgagtgtggtgatgtgtgcctgtaattccaggtgctcaggaggctgaggcacgagaatcgcttgaatccaggaggcggaggttgcagtgagccgagatcgcgccactgcactccaccctggcgacagagcaagactccgactcaaaaaaaaaaaaaaagaaaagaaataaagaaataaaaaaaccccaagtagatggctggaccagcacttaggaggaaagcaggtgttcagttaaagtttctccaatctgaatcagacaggcagtagcagatgtgaagaggaggaggtggtggcccaggagaaggtaccctctctcactcatgctgacctggtcatgggcagtcagcgcaatcctagccttcttgacatccttagtcctttcagaaagggcccatctcctttgattcatagttctcactctccagccttcagcccttcatctgcctacacccctacatcccactgtcgagtgtaggattttggaacaccattgtcagagggtcagtggaatggatccacccccaccgctgcagtgtaaacgtggctcattcatgtcattcgctgcaagggagcatagggttggggcagccggagagcagcagatggtcatgtgcattcaggtgtcttccagagtagcctggtgactttgggcaggtgattgcagactctgaaaaatgggtctagaatttgactcatgctcatggttgtgaaattaacttttggaaaagtgcctggtacctagtaggagctcaacaatgaggagcggtcctattccctaaagacagaaatcctccacctttgatgagaatcagaaaccgctatacagccctgattgggtggatcttgtcgaagggtcccagttccaggggctcagtgcatggagtctgcagaagcaataaggccccggacacctccctgtactcttctcccttgtgtctcttcctcctggcccccttagcaccctgctcactggatccttctggaccctcactgtgaggcctcttagattgccgcaacctatgttgcaaactttgttctaggaacctggtatccaggctgttggccatctctaatttagtcctaagatagattcccaaaggtggcacaggttgcctgtggaccttttcactgcatgatcctaatcacagctgatgttttctggtgctctatgctttactaagtgccctcaaatgatgataacagaaagatactcgctaccacttctcaacaagcataccaggcagtgttctgagctcctgtgtacattttctaattcattctcataaccctatgaggtcagggacttttattatccccatcaccaaaagaggagacacaggtactgagtgatgagataacttgtccaagaccctggtcagttgatggcatagccattggccaagtcattattgtgtttgtcccttttgaacagcaggtaaagtgaggcttttcctcatctgtcttcttcatgaccatcatcatcagcatttccacattacagatgaggaaactgaggcttccagaggcacacgggcaaggctggtgaaacaggagctgggatctaggggtttggatgctggggtacaggaactcatcctggggttgaaggtggagagagctggaagttgattgtctcagttctgcttacgttctggccacaatgaatctgctcatggcccatgtggtactaagagctgttaacagcaaagcagagtggagcagggagggctttttatgcaaacagtggggtgcacagggggttggatagtgtgtgcctcaaggtcatgtcagccctggcgccgtctctacatttgaactcagtatccctttgagcacaaagggatattgtgttgaagacagacctgactttgagtctcatctctgccaatttctagctgtgtggccctgggcaaattatactctttcagaatcttaatttccacatctgtgaaatgggagtaaaactaccagccccagaggactgctgtgaagctggaatgaaatcatgcacatgagatgctttgcgtgctgttggcctcattgtctgtacttaacctatggttgctattgttgatgataatagctcttccagcgaagcagccagacctcagtggttagccttcaaattcagaaaggcacttcattatgagagatcccatgtgttgagcccatttcagagagagaggttataagtgagaacagctttcctagtctaacaggtgcatgtgcttcctgcccaaagttcttctcacttttactttcagatcagccaagttggcctctggagtccctgggtctccacagagggagatgccaccgcacccaaaggggacccactctctgagcttccctgctcagtttgctcaaacgctggcatgaaccatgtcattcctggttcacacacccagaatttctgcccataaacctggttctcgacatgcagcccagccaacggctctgctgagggccttccagcactcacaccagatgtttctaggtcctctcaccattcctcactcagcttctgtgtctgctcttgcactttcctacttccggggcaacttgtcccatttgcgaactgatctggctagactgtctcagtcttgatctccttctccgtcagtgtcatgtcccggatgggaatctagattaagaaaccacctacttgcacattcatgagcctgccctggacacagagtggtgtggttccttgctgatggacctgtgttctctctccccctgcagtgggcttttctagggcagagctcaaaagtgtactgttgtccccagcagggcagaacacagtgcttggcccagcccagtgcaaggctcagtaaatactgatggcaagtaaactgtgttagtcccagactttacaatagagtagagttaggaattagttaatcattcaggctccagcctttatcagtcatatgaccttgagcaaattacttaatctcctcaagcctccatttactcaccttcaaaatgatgaaaatcatagtatacacatccaaggaccattgtgaagattaactgagcttttgagtataaagggcttagtttagcaagtacctgtaagtacttaaaaaatgttatctgttatgctagtttaagtgttatctgttattgctactaccagtatcaaagtgatttcatgttgttttgtattcacttacttcttatcagagccctgcaaagtagttgaagcagagacagttccattttaccaatgagtaaagtaaaactcagagaaaggcttgctcgctctttctttctttctttctttctttctttctttctttctttctttctttctttctttctttctttctttctttctttccttctctttctttctctttctttctttctgtctttctgtctctttctttctctttctttctttctctctctctctctttcttttcctcactctgttgccaggctggagtgcagtggtgtgatctcagctcactgcaacctctgcctcctgggttcaagtgattctcctgcctcagcctcctcagtagctgggactacaggtgcacaccatcacacctagctaatttttgtatttttagtagagacggggcttcaccatgttggccaggataatcttgatctcttgacctcgtgatccacctgcctcggtctcccaaagtgttgggattacagatgtgagtcaccaaaaggctgtttttctaatatcacacagcttgacttgaccagtgtcccctaggggcacacctagaagcaggccacactttttggatggaacatgtcatgcccacaggcctcagaaaagatccctataatttaaaaatgcagcaatagtattcagccagacccagtggtaacagttatccagatgattgtttgcatggagaggaaaagctatgatttattaagcaaacttgccctgctcctccaggagtggtatccagctttacttctagtttgctgctatacttcaagaagacacaaaattggagaatacactctcttatgagagttattgtattatattgtacagtagaaaggagcctcaggtggcatgagggggctgtggatggtggaagcgtgaatatgggccaagaaataatgatttatgggttcagaacaggaggaatgagaacataaccatgatttgtttgagtggaatttgtcctaatctgtgctctagctggagaaggtagacatttttcttgcttccgagtctcttggtttaagcccagcagttccctgcttggctcctagattggtgctagtggctaccagttggatggatggaaatgaaagggatgaatgggctggaacaggatgatagtaattcgcctggtattaggaagaacactgaaccccgggtctaaggccctctgcccactgtccagctgcacagctctccagctgtgtcatggaggagccacttctctgggccttggtttcctcatttgtggtcttggagagtcacatgagcttttctgaacctctccaaaaatggggacactttctgatttgtctttcttgtatggctcgtgtgtatgaacatgcttcacagatgtttcagcggtaagagtttagttgttgctcttaattggaagcaatcttggaagggtggggaaatagggactcaatatagaaagaggcatgacagcagagcacgagtgagaagagaactgggacatggcttttagaaaagatttccagggctcctgttaaaaccaaaaggcaaggaaagtctaaggagctcatcaggctgttcctgggatctggggcagaaagacagtggaataattgccttttctctgcatttaacaccccagtgctgtattagagaagctgagaaactgaggctgcaaaaggtgagccccacatggggtgcagttctagttttgtttgtttgtttgtttgttttgttttttgagacagagtttcactcttgttccccaagctggagcgcaatggtacgatcttggctcaccacaacctctgcctcccaggttcaagcgattctcctgcctcagcctcctgagtagctgggattacaggcatgcaccaccatgcctggctaattttgtatttttagtagagacagggtttctccacgttggtcaggttggtctcgaacctccgacctcaggtgatttgcccacctcggcctcccaaagtgttaggattacaggcgtgagccaccacgcctggcgagttctagtttttaagataagcctccaggttgcaaacttgtcagttggaatttggaatccaatgccattgccaacttatttttttcaaagccaacttaagaccaatgaaagaattggttcaagatgttatgcgttgcttcatgaagagtcttaggctttaattgaagatcacagtcggccacaggtgccaggctgtggagtcagaggcttcattcagagcagggctccatgtttaatctgattcatagattaccgccttatatctttttttttttttggagacagagtttcactcttattgcccaggctggagtgcaatggtgcaatcctggctcaccacaacctccacctcctgggttctagtgattctcctgcctcagcctcccgagtagctgggattacaggcgtgtgccaccacgcctggctaattttttgcatttttagtagagacagggtttctccatgttggtcaggctggtctcaatctcccaacctcaggtgatccacccacctcggcctcccaaagtgctgggattacaggcgtgagccaccacgccccgctactgccttatatcttatggcatagaacagttgcagtatatatcctgatataggcatatatacatgcaggtttttatattacaaggattctcaactatttagtaagatgtaacatacataaggcccaaactcagtaatgagcttctgcggagttataaatcagccacatcctgatggattctctgagattgatctggctgttcacccatttattcatggattcactggtcattatttagtgcctcctacacccatatgatagccagtggggtaagagtggggaaatctagtgacaagtaaaatatagctcccttcctcacctctgaagtctcagtctagtgagagcaaccaacagtgggattgaggtgatgcccggtgcttagtaaattcttgctaaatgagagaatgaatgaagaaacacatgaatgtgtgctcccagggtgctcccaggtaaggccctaatccagcttcgagtttggaaggtggtgtgtccaagaaaacatcttagaagtgtggtacctgtattgttttggtcaccctctcattcaagaaataggaataggccttctcccacatgccaagtggtgtgctgggtggtgagggcacagtggtatgtagggcagacatgcccttgcccttatggagttaacgtgttggcggtaatgctttgtaggaatgcagggaacactgaaaatatcgaggggcagtgcccagccttgtccccagagtcagcgaagatgtctctgtgaagtggtgtttacactgaaatgtgaagggtgagtagaaagtacagagggaatggggaaggtgtgagccagtgatgcaagggagggaggcctgagttacaatttacaaggatccccctggctgctgccaagagagggagttggcattagaggcgatggctattttaagactggctaggaggctgtggcagtgagcatcgtgccttaattctcatttctgaaaagaaagagtttcgttcctatagctttcctggaccctgactcctaactgtgctgactctggtcatgttcatgtatcttctaagtaaacatcctgcccccatcagcaggtgccaaatagaatctgtttatagtcaacaccacacatggtttccagaaccaggcaaatgcctttagacaactctgggcttagacagtcactaaatgctgttgtctctccctctaaaagagctcttgaatctcccactcctgcttttgcccagggccctgccttctggccctcattatctcttcataatcaccaactcaacaggggctgaactttcttcctaacacacaagtttatcctcatgtatcaccattgccagcggtataaagaaacctcagtggttgtatcagtcagctttctctgtataacaaacagccccaaaccccagtgcctacaaacagacatttatgatttctgtgggttgatgatctggtctgcacagtttgtgttaggctgattgcctgtgctggcccatccacacatctgggggctgagctggggtgcctcagcctctctccacacattgtctattatcctccagggggctacctcaggcttgctaatgtggcagcagaatgatttccagcagcagctgggcatggtggctcatgcccaggagctcaagaccagccatggcaacatagcaagaccctacaaaaaataaaaataattagcctggtgtgatagcacgaacctgtagttccagctactcaggaggcttagagggaggatcgcttgaccctggaggtcaaggctgcagtgagtggtagtcatgccacggcccctccagcctggaaaactgagtgagacccatctcaaaaaaaaaaagaatgattctcagcagcaagagagaggaacttttaggtataagcacttttaaagcctttatttatgtcacctttgctatggtgccattggctaaagcaagtctcgtggccaaacttcgattctccctcatgctgggaggggaggcaaagccacactgcagagtgtgcgtgcaggtggcctgaacaaattggggccatttcgacagcagtggttaagagttgagggtttctgtgctattcttcctgtcagatgaagtctttttttttttttttcctgagatggagtctcgctgtcgcccaggctggagggcagtggtgtgatctcagctcactgcaacctcgtctctcaggttcaagcaattctcctgcctcagactcctgagtctctgggactataggcatgcgccatgtgccaccacacctggctaacttttgtgtttttagtagagatgagatttcaccatgttggccaggctggttttgaactcctgacctcaagtgatccgcccaccttggcctcccaaagtgctgggattacaggcatgagccaccgcaccctgccagatgaagtcttcagaaaccctttcctatctggcctcagcctgatttatcctaaccccgatgtcacactttcacattcatatcttacatatttatttttcctttccccatgttttgtgtttttactaaacagcacctcattagtgctttgtttagggagcagctaaaaatatcatctcctgttcaaattcttcttctagatggagttggtcatttgtcctttttttttttttttttttgacggagtctctctctgtccctggctggagtgcagtggcacgatctgggctcactgtaaccttcacctcccaggttcaagcaattctcctgcctcagcctcccaagtagctgagactacaggtgtgcgccaccatgcccagctaatttctgtatttttagtacagatggggtttcaccacgttggtcaggctggtgatgaactcctgacctcaagcgatctgcctgccttggtctcccaaagtgctgggattacaggcgcccaagccgcctgtattacattgtcctgaattgtttgtgtatttttctgttttctcccagtctgaactccctgcggagaggagttgtgagttactcaccttcctgttctggtgtgtggctctgtgccgggaacagaataggtgtttgtttaacagatagtgctgtataaataattgggtgagtgagtggaataagtgggtgaatatcttttcattatcttgagtcatcctaaaaaggcagaggatggactaattgtcaaaactgacttaaacttttctcctcttctctttcagttggtaccattttcagatttcatcttcctaaactggaaatgtcaatgagaggaaattaacacccccaagagctgcagtgagcaaatgcattgagcttgggtcaggacaattccatttggggaccagagatggacggtcactcagcctatggaggtaaagtgactaatctgtccgcagcacaagtgagatgtgctgtcttttctgttttgttttgttttccattgattatgttccatggaggatgtggaagatattctcctatttcttggtctctgaaacatgtcctgcttgcccagaaacgtgccattaagaggagttcccatggaaggggaatacagtgtccctcaggagaaatatgcagactgttagtgtctagcagcttttctttttcttaaatggagagctttctgagctctcatgaacactggtaagtaaaaacctggattcagaacatcttttgatgacaagggcctgtcatcctgacgaaggcctggcatgacactctggtgtgtcctagagcaagcatcagcaaactgtggcctacaggacaagcctggcccagtctgcctttgtaaataaagctttgctggcgccccaccatgctcatttgttcaggtgtcatgtatggctgttttcacactgcagcagcccagttgagtcattaccatagagaccgtgtggctgcaaagcctgacatatttgttccctggtccttaacagaaaaggtgttgcaacctctggtctacagctgagctgtccacacagaaccacttcttatggggataatgaaattttaattaaaatgaaataatacgaaaaattcaggcctcagtcacatcacagttcatgtgcttagtagccacatgttgcttatgggtacccatggatagtgcagagagaggacatttttatcagcgcagagttagcttgggaaaaattgagatcaccctggatatgtcacttcactctgctggtctctaacccagcttgggcatgattgccatcactgcagaagaagaaggaaggctgatgtctgtgagtgtgtatagctgttttttatatgattattggcaaggactctctctctgtcgtgcacactgtctcactctctccctctagtataagaatggagtaacttttaaaatttctttgggagccatcttgtggtctctgtatgtgactccatgtaaaacaaatccacttgggccatggggtttattagttttatttatgcaagtagatatggatgtgagcttgagcccttctggtgtcacaggtaggtcaggggccgtgtgaggcctcctctaaaggggaagaagcaatcgcttctgtgttcccaaggggtagatatatgggcaagagcgataagaaacaaggagaggaagaaaatgagctgaagatgtggcatgtgtgagtcttagaagaatgaggaagaatggagacaaaagaccatgtgattcctggttatggtcataggtttactttgaaagaacatgttgaacaaagtaatgatgcttgggaacataccacatctcagaattgtgctgaacacagccagttctatacgatagacaggttgggaagagccttggacctggagctagctcaccatcttatgggacaagactgggggcatggcaggaggttctgcttggtgcataagccagtgcaagtgggaataacaagggctgatcattgagatgcacagtttgtatggaagggacccaagaaggaacagagaagagactctagatggcctacaggtctgggcaaaggccccaggtttggcatttagaagttgggctttcttatcgttgggttacccaagcacaagcaagaacaaagcagagactccactgatgagaaaagatccaattgatatgtattctgcacatctagatttgaaaatggcctcctgcctctttcttttggttggtcttcaagcacctcaccattacagaggagtgctgtatgcattttaagcaggcatttctataacaaaccttcaaacaatggagtttaacgcagatatgaagtaattataagtaacacaaatagtagtattaaatttttagttctttcttacaatcaagcatatccagaatgatgatgatgatgatgatgatgatgatgttaacagtgataatattttttgtccattcccagcttattatgtgccaggtgcatgttctactgataattattattactactaataattattatagctttaaattattggcacatacaatgcactaagtaatatattgatttttttctcaatctcatgaaaccagagcattcgtttccatttttaatttttttcaattattttatttttatataaatgcaaatttatagaaaagttataagaacagccaacaaattcctggacctccttcgtccaggttttcaaatgttcgcattttattatgttcattttttcttttttctctatattttttcctgaaatcagaaacttgcatcttagaacacaactttctaagtcagaaacttaacattaatttgactattatctaaccttctgatttctcattcagatttcatcacttgcccctgctaaattccttcaaggcaaaagaaaagccagttggcatgtgtctttcttggaaaactttcttaatcttgtatttcagcacgttaacctttttgacaagttcaggccagttatttgatagaatgcactcaattttggcttttctgatgtttcctcctgattaggttggcaggactagcccagagctgatgtgtccttttcagtgcattgtatcaagaggcactggtgtggctgtctcccattactggtgatgttagcttggagctctcagttaaggtggtgtcttccaggtgtctccactgcaaagttattgtttcacctttgcaattaataagcatctcatggggagaacttccgggattgtgtagatttctgattagtcctcagtctatcagtcattagttttagcatcttttgatgattcttgcctgaatagatttattattatcatagttgccaaatggtgattttttaaattttgctggttctttttcatttattagttggtttcctactataaagaagaaattttcttcctctgttcatcttttttttttttttttttttttgagatggaggagttactttcacccaggctggaatgcagtggtgcaatcttgatctttgcccactgcaacctctgtctcccaggttcaagcagttttcctgcctcagcctcctgagtatctgggattatgggcatgtacgaccatgcccagctaatttttgtacttttagtagagatggggtttcatcatgttggccaggctggtctccagctcttgacctcaagtgatctgcctgccttggcctcccaaagttctgggaatacaggcgtaagccaccatgcccagcccttcctttctttatatcagtgtggactcacagattttaactttattcaataggttgcagtcttttgtgatcattagttattttgacatttacgttgccccaaatctgtccactagggcctggctcctgtgtctctaacatttctccatcgtcatttgagcacttgctgccttgttgtcatagcaaggtattctagcctcatcttctactctcctcacctcagtggtggaatcaacataggagccctggttcctttccatggaaaatggtgtttagaaaccaagatctggccactaggtgtgctcactgtttctggggtagcattgcctctaggccctctgagcagacataactgggatgtgtgtgtctgtgtgtgcgtgggtgtgtgtgtgtgtgtgtggtgtatcacacagatacccacatttatatacatacataatcacatccacatgtatatccacacatcattcagatcattttcaaattgacctatctatctattaaaatcaccataggttcatactaattatgctaggacattctggaaattcatgtctatctgaatgatgctgaacagtcattctactctcactatcaacgccgccaccaactgcatttattaaaccgtgttcaggcccagtttcagaccctttcccttgctgttacttctgacatcaactcggtggcccaagtacagatgagcaaaccaagactctgaaaagctaattaacttgtgcagattatacagctggtaaagcagcaagcttatagcaagcacctgtttgtccctcggcttttgatcaaaaggcctagggagaaacctctctcaggacagaaactagagcagaagactggggaagcatttgtccctgctgacagcagtgtctggccgtcacagtgtaggccagccaaaacatgtggaccgtgtatatggtctgcatctctcagatggagtcctgttaggaggtgtgtgtagacgcacgtggtggtgtatgagttgcatgtgggagtgagagtttctgtgggggatgcaggactgctgtcctgtccttgtgaagaccttgatcaggttgagggtgtgattacagaaccaggcgtctctgcagagggagcatttgttctcttgcagagtgctttcctgggagagctgcttcagtgtggaggccttaacttaaacacatttgtgtctccagctcccagcaaacatgcagaatgtgcaccagataaatgttggtttcaggcaggcattgacaaacatttctgagcttcttctgtgccaggcactgctctaatcagacaaagatcctagctaggggtgagaaagagggagagacacacagtctctctctctctctctctctctctctctctctatatatatatatatatatatatatgtttatatatatatgtctatatatatgtctatatatatatgtctatatatatgtctatatatgtctatatatatgtctgcatatatatgtctatatatatatgtctatatatatgtctgcatatatatgtctatatatatgtctatatatatgtctatatatgtctatatatatatgtctatatatatgtctatatatatgtctatatatatgtctctatatatatgtctctatatatatgtctctatatatatgtctctctatatatatgtctatatatatatgtctctctatatatatgtctatatatatatatgtctctatatatatatgtctatatatatatatatgtctatatatatatatatgtctatatatatatatgtctgtatatatatatatggtgtgggcaggggcagggggtcccagggcagggcatagcatgggtgtggtggtcaaggagtgtctcttccaggaaatgtttctagaacaaagtcacatgacggacaggaaagagcaaatagggaggtgagaaggagagcaggggctgttgatcaaaggatacacagggactgattcagtcttcttcagggggctgtggctgctgtcatttcccctcagagaaccaggcctgttttccttctgggcagtgtcacatgggtggacactccccgttggagctaaagcatttcctccaacaacaaaaatgtgttatcagctggcccagagaccgaatgcaggccagggcactctgactagataagaggacaacctggcagtcgttcaatattccgatgggcagcagcgaggagctgttggaatttccgttgctgataacctttaagagcagcagtggcagaaacaggggttgtttggggtgggaggggagaggagacttgggagcactctggagtatctgaaaggctgatggggagagaaggattagcggattaatgtgtagagggtgattttgaggatggatccaagtggcgtgagtgaaatgaagagcgggggagcttctcattcaggctgtttttcctttcttcttgttcattcagtcatttagtaaatacttactgagtgccttccagctcactggcacttggctgagcactggaggtaaaacagaataagatgagagctatgtcctcaagatgttaataacttatttgtttccttgttttatttacttatttattttgagacagagtctcactctggtgcccaggctggagtgcagttgtgccatcacaactcactgcagccttgaccttccaggctcaagcgatcctcctgcctcagcctcctgagttgctggaatacgagcgtgcgccaccatgcctggctaatttttatattttttatagagatggtgttttgctgtgccactcaggctggtctggaactactgggctcaagcaattccccagcctcagcctcctaaagcgttgggatttcaggtatgagccaccataactggccgatgataataatttaatgggagaaaaagatcaattaataaatcggtggtatgtttaggtgcagttctggttctttgggtcctgaagcttatacaatttgggagttttctttaaggaaaaataatgcaaagttatgactttgaaataaaatgcaagccctagataagtggggtgcagcccaggggctggagcgtcagcttcctggacgtgctctggttctttgcccgctttgtgagctgcagtgtcagcgagagtgccttctcttacctgctgcctgccgggtgagctggccacaaggggagttggcggtgggaatcctggtgctccatggtacagtgaatttacttgccttctggatcctctgagtccttgtgcttgggctcagggaacagggcgaaagaacttcgttcttcttggttctgctgggattttcgaaggcactttccttgaagttctgcgggctgacctgtgatcccacatcagggactgcattctcaggaatcagctgagctcaggagtcctggggctgggggagtgtttgtgagcactctcgcagggctggctgtggcccttacgcctttgtaacaaccccacacacatagatttcaccccacagcctccctggcagccagctgctgtcatttcccttttttacggatgatgaaacccaggcacagactggttaagtaacttaacagtcacacagctaataagttggggggctgcgctgtgaaggcttacagcgtctccagagcccagtccccttgctgcctccccatcatcctcactgcctactgcttttaagcaatatgctggaaatacctgcaatgtcaagattaggagatgagctacatccagtacagccgcagaatggaataatatgcatttgagccacacaaggagtttttaaccagcatggtggaatgctctaatttttggtgtgaaggtgggatgtctaattacatatgcacagagaaaggaatgccaagtgctaacagtgcttggattccctcagccttttgcatcctctcctgggcagctgtaacagactcactcacacatgcattcaataggttttatttatttatttatttattttttgagatggagtctcgctctgtcgcccaggctggagagcaatggtgcaatctcagctcactgcaacctccgccttctgggttcaagtgattctcctgcctcagcctcccaagtagttgggattacaggctcccaccaccacacctggctaatttttatatttgtagtagagatggggtttcgccatgttggccaggccgatctcgaactcctgacctcaggtgatccccccaccttggcctcccaaagtgatgggattacagacatgagccaccatgcccggccattcagtaggttttaattcaatgcctttgacatgctgggtacttcggatacagcagcaaaaaacaaaaacatggtttctgctgtcatggaacttagtctggcctgctgtttgctccttctgcctatactttcttcctccagctttcactagagagatctttcggaagccctccatggttccgcagtgccctcaaatgcagcccctccctgcccctattgtctcatgtgtaaaatggagcagaagacgcacagaccttccagacctcagagtgtagctcttctcagttgttggctagaggctttgcagtcacaactctcatcattaccatcttctagaaaggtcaggcaccggacagctgaaaccatggcagccggcaacaggaagtgccctccctgggtgctcaaagatccaagacagccgggccctgtgtttgtaggaacaagattccagatgcctctgctgcttgccagcctcgtgaccttcattcatgcagggccttgttttcttgattcagtggggccaatcccggcccccaggggagatggatgctgcagggatgtgcaagctgtagagggttccagagaatgggcctggcgttctgcaagcctggcacccctcctggatgcttttctccagcccttggagcttaggcagtgtagtgttaggatgattattggatttcctccacagttcctggctcattcttttgtagcccttgttacagccttttgtgataatattgggtgtggcaggcctcaggacacaggatgtctccaactttctcctgccttccttcccctgccctaacacaggactctaatctttccctgactttctgactgtgggtcttgagatcctccccagagagggtcctaccctgtaccctgggagaaggaatgctgatgtcaggaagcttccataaaaccccagaagactgggttggaagagcttccagatagctgagcactggaggttcctggagggtagcatgccccttcccccatacctccccccacgcatctctctatctgtatcctttgcaccagtaaatatgttttcctgagttctgtgagcccttccagcaaattaattgagcccagaaagggggtcatgggaacccaatttgaagccagttggtcagaagttgcagagacccggacttgaggcttgtgtttggggtaggagttgggggcagtctggggcactgatctctcaacctgtgggaactgaccctgtctccaggtagatggtgtcagaattaaattggaggacacccagctggtgcatggtgtgtgggcacagaagtcttctgtgttgaccgttcgggtgtgagagcagaggataggcagggtttcagagattttaggaaataggtgggaataacactttctgagacttggtttccccatctgtaaaaaaggaagtagtaatagtacccacttgggagagttctgtgaggactcaaatgacacgaggactcaaaaagctgggtacggtgtctggcccatcgtaaaggctgagtaattgacaggtgcatttatccctgtggttcctcactgagcccgtgataaatgggcctgtggcaggacatgagtgagctgcaggaacaggagccaggcctcccaccttgccggcttggaagaccgtctggctgcagcagagacattcttcccagaaagaaggggctttccatggtgaaccactgtggccaggcccagaggcctttacaatgccaatgtcccaagaagagaggggccatcagaaggatggaaattttctatgtgcttccagaaatcaacctacagattgatcccttctcaaaagactaatttttattctagtcatgcccagctataagcatttgggcatttacagataatctttgttcctgaagggcatccgaatatgtccttcctccttttaatgcccatgacccttactatcctggaacagagtccacattgcagaaaggacaaggctcaccacgttcagggccccatcaagacccccagcctcatgtgtgctctccctgtcccaccccaccccaccttctgctaatcacagagtcatcttcacagtgtgaaccctgaatacagatgacccgggttcaaatcacacttctgcttcttttgccaccttggatacagtatcttctcttgatctcagtttcctcatctgcaaaatggacataacggataacaacagcaccaaactccaggattgaatgagttaatacagatgtggagatatttcaggcttggttccaggccactgcaataaagtgaggattgcagtagagcaagtcatacaaattattttggtttcccagtgcacacaaaagttgtatttatactatactgtactgtagtctatgaagtgtgcagtagcattatgtctaaaacaacaatgtacatatcttaattaaaaaatacttttttgtattttttaattaaagccatgctggcttatgctcctagcactttgggaggctggggcgggcagattgcttgaggccaggagttccaaaccagcttgggcaacatagcgagattcaccccctaccaaaaaaagtgaaaacattagccgggaatggtgcatgtgcatctatagtcctagtcacttgggaaactgaggccagaagttcaaggctgcagggagctatgaacagaacttgacagagcgagaccttgtttctaaaaaaaaaaattaaaaaatactttcttgctaaaaaatgccaatggaatgagcacatactgttggaaaaatggcaccaatagacttgcccaacacaaggttgccacgattagtaaagacaataacaacaaaaaaataatgcagcacctgtgaagtctgattaagtgaatatgcctatgtatgtgaaagtgcttagaaccctgctagacacagcagtctctaacagccagtattctatagatctatagagaatatgaagctaaagatgtggctatggatatagatatagatataatgtagctctagcctgggctcatcaccccaaatgtagtacctgccatgtctgcaggacttggtctgtgaggtttgcatgtgctcttctctacctggaatgcccttctcttgctttcctggggagccctcagctttagcgttgtctcttccgggactcctcctcccgctttccactccatcctcagctgcagggcttctccctcgtcagccctcaaacccctgcctgtgtctgccttcctttcactgaccacactgtcttgtgaggaagggctcatgtacctttccttttcccctgctgcactgggagccccttgagcggtggtagcctatgctttattcttcattggactcacagagcaccctgtgggccaggcatgcctttccctcaccagcaccgagactggtgctctgaaggctgttgcagtgtgtccatttgtgtcagccgcacagagccagcccagctgctggtttgatagacatgatatctggctagctggccttgctactggcctggacacatgcctgggcccccttggggattaattctctcttctttagctcctccgacttgcctccagcctttggagaactggaaatgggcggaccccatgtctgtgggctcctggtcctttcactttgctatccacgccttatctgcgttccatgcaggccagaatacagaatacctgctgtttgcagccctgtctgcctccaattaacttaggcaaacacaccctgccaaaatatcccacggccctttctgatacggatggcatggggtgaaggaggaaggagacacgagtgaacccaaagccagtgtgtctgaaatccatttggcaagcatttgtgccatgtcctataatatatatatgtccatatatatattataacatataatattatataatatatgtccaatgcctgtgtggggaagtcacttcaccattttgctcaatggcaatgaagaaatggcattcatgtaaacactttctcagtctctaaaaatatcctttgtgctggaggattgggtgtcagaagaagaggacgaagggaaggcctttgggtctggggagatgatttgcttattctgttggttgaatagaatggaattggctttctgcactttgcaatctcgacagatggtcagtcatctaactggaacctccttgggggttgggcccgtttttttccccattgaatccccagtactttggtggaggagaggtcactcagggagtgttctggaattgccccaaacaattatgctatatggttgtattgtgttaatatttcatcaagaggaagtgccatacttaagtactcatctctccctgttgctgcttatttgcatattaacgtatgtcatcatcatcattatcacaaacaccaccgtgttgcctttagcattttctgtcatttgaactatgtcctttcgataagttcccaggagagagatactgaaaacgctttgaaggttcttgccacctgttacccattgtgactttgctgtgaaattaggagtggaagggagatggagatgggggaacaagagctggaaggggatccctattgaggctgggacagggagcagtacaaaggtcaggatacagccacagtgggattgtttgacgggcaagtggatctgcctccaatggggcacagagtgcaagtcagggaggaatggggagctgggagggatggacacacggatgaaaagacaggaagttcagacagaggaactcgctcctgataggagagaaagcccattctcatggctctcatttcttggggactaatgtgcggtgagttggtggggagcggggtgagctctcacacctgtgtgtaggctgctcgagagcccatgcctgcactagagcccatgactcacctcaagtccatttgaaaaattagggtgttggtaattcacggggaaaaatagcacagacaaggatcatgagatcctgggtgtctgcaacacctgcacgtcattctctctggtccccagggtaccacagacttaaggaattttacacaactctgaggtttggaattctatgggtctccacggaattcagagtgccattggactgcgggggcgctgggggactagaaggcccacattccatggaaatccagggattccaggaattccagcatccagcggaaattcagagaaccatggcccctgagtaattcctctgaaggaaacgtagtcaagaaagactaattaatttatacctactccttcagctccagcccggcacttaattagtaccttagtggtttcaacgaatgaatatgggaaagagtgagagaaggagtgaagcagaagttagccctccaaagctatgcttctcgtccccaaactatcaccccctccacgctggggaggagcatgtggctgtcccagcacctgcggactcttctggcattttgtaggtgagggctaaggatgctatagatcctgcacaagggcaggaagaacagttctggcaaattgctaaacgtgtcctcctcagaacaccactggacattcggtactgaggaacagcagagtatggcatcacacgagccgccccaaagtttttgctctcgaggatgagcctttcactctattactattgattggtcccaagtagcttttgatgtcatggcttttatctgttaatatgtatcatattctatattaaaattgaggaattatttcaatatttatttagtacttcatttgaaaaatcacaataaagaatctatcatatggtaacataaatgacttttttttttgagacagagtctcgctctgttacccaggctggagtgcagtggtgcaatctcggctcactgcaacctccgcctcccagatacaagcgattctcctgccatagctgggattacaggtgcatgccactgcacccggctaatttttgtatttttagtagagatggggtttcaccatgttggccaggctggtctcgaactcctgacctcaggtgatccacccgccgcagcctcccagaattctgggattacaggtgtaagccactgtgcccatcccataaatgacattttcatgaaaaaataactacttacccaaacaaacaacaacaacaacaaaattagaagagtggtattattttacagatccctttactatctggcttaaaggaaaacagctgggttttcatctctgcctctgtattcagtctttcgtgaaatcagatgtcatttgtctctggggagctctactgtacatgcaggacagaatgagtgtgaaagagtaaatgaagccttcgtctcattatgaaaatggctttgatatcatggattccccagaagtatcttaatgactcagagatccctgaaacgtagttttacgaaccgcagtacagtggttaagaacatggcttttttttttttttttttttttttctgtttttaagtttcgggatacaagtgcagaacgtgtgggtgtgttccataggtatacatgtgccatggtggtttgctgcacctgtcaacccatcatctaggttttaagcaggcattagctatttgtcctaatgctctccctcccctcaccccctgactggccctggtgtgtgttgttcccctccctgtgtccatgtgttttcactggagaagaacatggctttttaagcaggctgcctggggtcagggaggtggcagggaggaactgcatcctggatccacttgcagcccactgggttaccatagacaagagatttcacttccctgcacctcacttcctctgtaaagtgggataatagtagctactcgtaggattattgtaagagttacattagttaatattttaaagctcttagaacagccaggtacatattaaacgctatacaggttatgtatctatagctacacacacatatcacatacatactatatacatacatgtgtttatatgtacacatacataatgtatatatactatatgtgtgagtatatatgtgtgtgtactatatagtcatgtatatttatgctatatatatattacatatactaaaaccaattgaaaaatcacaaatgttactatagcaaaagtcacccatttcacattatttctaaaaatatgaatgtgtaagagctatttcttaaggcagcttttctatcccctactaagagcgggggacagccactgctgtgtttggggtgctgcagagcataatcataaatgtgggagtccagatacaggtcagctgttagggctccaggagtctgcggacccctgccctcacctctttgtgtcaccggagctccggattaagggctttctgacaactcctgaccacactcctcatcttctttccctccctttgctgatgaagcaactgtcttcatttagctgcctgatggagaacatctgcctccaggcaccacagaaatcaaagaaggaacccacgatgctggccccaggaagtccccagaaaccccaggctgctcctcctgtcacacaggatgcttttcccgaaatgctttttgtctggaagctctccatatgagctttacaaaggcatgtgcattcccttagcctttgaaaactctcataggttcaagaacaacaacaacaaaagccttggtgtcagtgatctgagcacagcattggagtatgctaagaaggcatcagggactgggcacggtggcacatgtctgtaatcccagcactttgggaggccgaggcgagtggatcacctgaggtcaggagttcacaaccagcctgacaaacatggttaaaccccatctctactaaatacaaaaaatattaactcagcgtggtggcacatgcctttaatccaaactacttgggaggctgagacaggagaattgcttgtacttgggagacagaggttgcagtgagccgagatggtgtcattgcactttagcctgggccacaagagcaaaactctgtctcaaaaaaaaaaaataaaaataaagaaaaaaaaaagaaggcctcaggacactggctccttgtcctctgagtgcctgctgtgcgtccaggtcctcagcgtgatgctcacctggaaggcattctgaataggacaagacccaccatgtcaccccccctgctctagtttattcattaattcaattatcaaatgtcagtggaatgccttcaagggcggggcagggttcagagccctggggacacttccataaactcacaagcaaacgttccttgcgaaacctacagttcagtcaaggagacttctaataaataacaaagttaacaaataagagatttcatgatgtgtaggagaacaggtgctagaaaggagcgggcagggggctggggagtgctggcagcagaggggcccggggtcagcaacactgagaagagaaagatgagcagagacttgaggaaggcaagaaccttgtccacgtgggtgtctgggggacagccctcaaatgggggttacaaagctatgcctggtgagtcagggaactgagagtctgggaacctgggcagtgcatgaggggctagtgggcaaatgagatgagaagggggtggccagaccagaggggttcttgttgacctttggtgacatgacatgcctccaaggtaaaactgccccttgctggactgcagtgacttcctgttgctgacttcctaggcttctctggccatctaccctagagcccaccatggggcccggagcccctcctctgggtcccttgatattccatgttagctctcgcctggcgtcctcaccttcaggtgggagttcatctgtctgcctgtctgcctcccctgttagctgggcctctcaattttccatcccaccataagggacagccagcaggtcctgagttttacgaccttgtacatttgctcggtagcagcaccttcgacctataagctcccaaggcccatctctcttcttcatcagaactgccgcatcctctctggcccgctttctgtctggcatttgcctgacatattcctccagtagatgccaaattccacagggcgaggacctagtcgttctccatctgcgtcaccttaagcactgtggcaagagggctagaaagccggtcccattggtgggaggacccatcaccacaggggttggcccgcgagccccgtatgcctggccctgcccagctgtctgcaaatctgtgtatgctctgctcggtcaccactggttcgctttgtcccacctgtgctgtgtttctctactagcttgttagttgcagagccccatgtgtcttagcacaggctgattcctctaccagaaatgccattttttctgtttattcatccagcaagtgtatttactgacccttgctaactcatgggaaggaccatctccattgggaagctgatgccccgtcttgtgacacgttttcatctggtcacattggactgcgaatgcaaagccctggggtggagaggggaaatgtggtcctacccttggagccctaataccctagctccaggggcagcaaatgttttctgtaaagggccaggcagtaactattttaggttttgtgggccaaatcatatctctcatgactattcacatttgctgttgtagcacaaagcagccatagacaaaacataaatgaatgaatgtatttgtgttccacaaaacttcatttacaaaaataggtgggaaggccaggtttggcccgtgggctgtcattcgatgacccctggtcttgactcagtgtaggctgtagagggaaacagcttgtatagctcaatgtacttgttaattgctaattactagtgttcccatcactggacagagactcttccagggcacagactgtcctgcagtcaggattgtgccctcaatgcctagcacagtgcctgacacaggacaggcatgcaggatatgtgaataaatcaatgagcaagtgaatggaaattctgtaggtactgagcttagcaatctaggctaggtcctgctccttccctgcaggcacaaaatgctggcaaggggcttggtgtggtctctgggggccctaggagtgaaactaaataggtttctccaagtgcatcatttctgggtaattttttttttcttttatttgagacagagtctcgctctgtcaccaggctggagtgcagtggtgtgaccttggcttactgcaacctccgcctcccgggttcaagcaattcttctgcttcagcctcccaagtagctgctactacaggtgtgcgccaccacacccagctaattttttttttttttttcagtagagatgaggtttcaccatgttggccaggatactctcaatctcttgacttcgatctgcccactttggcctcccaaagtggtgggattataggcgtgagccaccacgcccagcccatttctgggtaattttaatgagctctcgatgggaatgggctcagtcccctggggtggccagagcccatctggattgacttcaaggagttatgatgcgagctggggtaggtggagaccttgcagtctgggaccgcccagcaagcaagctgtttttccttcccccagatcttctccagctctgcgtgagccatgggctgagtcctggcatatagttctcccgtgcctaggatgagccaaatgctattttggttgcacgcacatgatgtcatttaattgtcatgacaacctaggttgtgaatattatcattatcctcattttacacagggtaaactgagtcacagatctgtggcttgcctgacgtcacactgtagcttagggcaaagttgggatttgaacctggcaatctgattccaggctccttgctcataaccgtcattattctaagctgacatgcagtgtaaaggattcagacttgcagggaccaagagtggacacttctcaccccaccacctcaacccctttactcccgatgccgacactgttgcacagagaactaaagtaattggccccagaccacatggcattagtagaggcagaatttgaagctgggtgattcgatttccaactcaatgctttctccacaagctcaagcccctcttttggcttggcacctgtaggcaaacagaggcaagtctctcccctctttctctctgcctcccctcccctcagagtagaacaacctctcattttatcctttgttaaagagcagccccttcacaaagaagtgacagtacgaacttgcaccttagttagcatggatgggtgccctgggccttcaatcagtcaggtcagggatcaggtgagcttgggcaagtctcctcacctctctgaccctctgttttcttgtctagtgactaggggtacaaggcctgacttcgctgagttgttctgagaactgagtgcagcgatatgtctcagtgtctgcctgtcacagcccttggccttcagcaaatgtggtttcctgtcctgcttcctcatctctccccacagctccctcgcccactctgccccaggaacaacagtgcaccccacccactgtactcagctggaaaactgcatccaatgacctctcttctaagcaaccactctgacgtcaccttgtgcaacattctaggtccatccaggaagcaacgtcaggctatttctaccccaggcactgtggcagctcacttttttcttcttgccctgtaattacagggttttgcagtggtttctctgttgcctaaaagtctcaaaattttctttgtttctccgtaacacataattgtatctcaggaacccacaagccattaggtccctgaccctcaatagatgtccttttctatggagacagacatctagatcaaaagaaagatgctggctggttggagcaaactatttgattagacaaaacccttcatgaggcctctacatggattttgtggccctgggtggttggagagacttaggagccttcatgaacttttctacttcccctgtttttgatgtagaattatctgcaggagcccaggtcccagactctggctggggaatgagtatggtagaataatagcagagggtgggggctctagtgtctaggagacacagggatgggtagagttgccatgtttgcaaaggtgggcatcctcagctcttgagcttgcctgaacgcaggctgcctggagcctgacccaactttcctaattcatggctacctttgtgagctgaaagaattgtcagtgatggcagcagtggcctatctggagcagctgctgtggggatgccagctgcagcaggggaggcatagctggggctgcatgctccacagagctggcagggaccaggaacaggtgggaaccctgccttctatcaagttggcagggcaggagccctgagctcccaggcacagctgcagctacctagccacagctctggacccaggcatccctctgctcttggggacccaggaagcccccctgtcatgcaggcttgtaattgcctgctcccgctccctggcatctcaccactcccagtgtccactctgatttttggagcaaagttgaaactgagcctgggtgctgtcgcaacccagctgggtgtgtatgtactctgggtggtgttgacatgccagacccctgtcatcttggccccctccagactttggtcaccgacaggcacaggagggaagccaagaggagactgagggcagctcagtgcaggcctgcaggcgtccctcagcatgcacagcctgggtgctgtggatgccatgttgatggtagcaggaggcagacaggctcctgggcagaaaggggcaggtcccaggtgaaacaccaccttcaacccagggacagcctgaagcctgggggccaggctgccagttccagggggagtccatggcctagaggaagaacttatggtgctttatccaagcccatccatggccatccatggaccaatcagcacacacttcctcccttctgagcccataaaaaccctggactcagccagacatgtaggtgtcaggactaccagctgcaggaaggagctacccactctgggtctccttgactctttgggatgacctaactgcagaaaggagctacccactatgtgtcttctctgctgaaagcttgacattcactgggacgacctgcctgtggaaacgagctacccactgcaggtctcctgaaagctgttctgtcactcagtgaggctcctctctgccttgctcaccctccagttgtctgcatacctcattcttcctggacatggtacaagaactcaggacccgctgaatggtgggactgaaagagctgtaacacaaacagggctgaaacacaccctcctccctccattcaccacgttgcaggtgacaagaaggagagaagagctgtggcccgttgggaagcccagatctaggggctccccaagccagggctgtgacaccttctttgggactgcacagttcctggtgtctccaagcttccgggtgccaccgtgttctcctagaacatttctagatgtgttacttaggaatgtggcagctgtcttgcttcttcatccagacatgggtccagaaatgggtgcctgcagcagaagccatgtgtggtacatctggtccagccacagactcacatggagctggcacctgtgccagtgcccggagctgtccatcctgtcgcagcaaccagcgtacctggctgtgcacagtggctggaccctgtgctagctcacccacacaccccttgctgcttcacgcctggcttgcccttagcaggtgtgtgatctaggctggtagcataagctgagcacaacctgttgggccaagtgggtgacatgagcccagcaggcatgagcaatactcaggtagaaggcgctgctggccacagaggtgtctggctggcaaagtgacacccaaggatcctgtgacatcaggatctgctcacctgcaaaatgctggtctcacctggggctgtagtgttgcctggttgttgagagctctgtctctaggggacaatgcctgggtttgtgtcctggctctaccactttctagctgggagaccttgcacaagttcttaactcctttgtgtttcacattttcatctgaaaaattggggtaataatagctcattcagtcttcattaaaagcttaagaggtaggttttttaattattgttccaggctttgcttgagctgagagggccagcgagagtcaaggtataggagcaattgagcagagagagtgtatcagtcagtttttgctgtgtaacaaaaccatgaaatggcataagagcattcattcagatttcataggtctgtgggtcacatgtggtggttctggcttagtctttgagttgagttggccctgactggagggtcacaggctgcctgaagcatgtttttctcataatggaggtcagaagctccccgaaggacacaaagctcttatgattatggttctgaactggcatcttgacacttcttcccacattccattggctaaagcgtgtcacaacatccagtgggtgaaaaaatacactcccacttcgagagacgaggacgagggatagagacccttgtggctcccatacccagccttctgccagtccgtttgtacttgttctccagcaagaagctcaacagacatttgtcaattggtcataaatctggtacctaggaatggtgctgacctcttgcaggcctccagggaggtcctgagagtcccatgagagtcgactttgctttgtcacagagcaggacaagtggccattccatctgcaataagacccttctaaatgctctgcaggaactcctgatgcatccttccagtgcccctttgaagtagctgccactttaagcatcaccatcttcactttacagaggaggaaatgaaggcacagggaggttgagttacttgcctgagggtgcccagcaaagtgggcagagccagattgaggctcaggtggtttggctgtggaatctctgtactgcttctaagggtggagaaagcaacagctgcacacctttgtgacttgtgctaggacagaggtgtgcatgggggtgtggcagtgtctgtgaattgagacctggaccctccagtctcccatgttctctgtggtgtttgggagattagcaaccccccacagaagagttaggacccacttcccctgctcccagaagccacgcaactcccctctcagcagggcagaagggagaggccccttgctgctcgccagggccctgggccaggtgggagtgacagagcgcagccccatctgtttgaaattagaagtgaattgagcacagttgtccagaaactccatgaagtttagaaacaccgtgctgaatgtctcccccagcaaggctgtctcttcttgagagatttcatccctgtctcttccccacagtgctcattttcttagcaccttctctgccctaggctctagggacagagacagtgagatgagccccttccctcgcctggtgagggtgttgggagcacaccaggaggccagagaaggattgtactccagggaggatagtggtggcaaaataacgacagtaattagtgtgtccatttagtgtgtgcttgtggagtgtcacgtgcttaacactgtgccccttaggccagtgttatgtttgtcttcagtttttggatgaaacccaggctctcaggggttaactagcaagaccctgcggccaccaggtgactctgctggatatgaacgtaggcttttctgtgccagcgcctcagcaccctggaccagctggggtacagggtaaagtactctgagagtcagatcagaaggcttaaggtcccacttactgctctgccccacacaggctgtgtggcctcaggcaagtcagttgacctctctgagcctcagaccctcagctatgacttggaattgcaacacatttccagaggggtagagatcaaaccacactgtgcctgtgatggggctttgaattaaagcagggaaccttctgtgcctggagagcctcagcatctaggggcagtgtcctgagccaccattccagggaagccatttgcaattttttttagatttttaaaaaatgttgctgggtctgcgtttttccacatcctctgaactttccttcctgctagctttctatattgcttcctactttttctctgctttgggtataagcttctaggaatagaattttaaatcttagatggcttccccattctatatagctcttgggagtgctcacgtcaaagacttctgggaggctttctgcccagagttgggctgctggagaagattataaaggcaccaccatttttaaggtttttgttttgttttgtttggaagtttggaagtttcattcagaaaagtaacccatgaccactgaaacaaatcctgaaaacagagaaaagtataaaagctcaaaacagaaacagaaaatcctacagaaaccactctcccagaaagtacctatcttagtagttcatactgttttctttcacggcattttggttcctctaggttaacatatactaaaattggaattataattctgaaatgcttttctcttttcgtttccaatttaacagtgtagtagatattcctccgtgttatttaaaattcttcatgatcattattaatgattgaaaacttctgtcctgtaacagatattttaacatatcatggtttaattaataatttccttaatgtggagcatgcaggaggagctctctacattttgctattaaaaataacatgataggcctgggggcggtgtttcacgcctgtaattccagcactttgggaggccgaggtgggtggatcacgaggtcaggagtttgagacgagcctggccaagataatgaaaccccgtctctaataaaaatacaaaaattagctgggcacggtggcaggcgcctgtaatcccagctactcaggaggctgaggcaggagaattgcttgaacccaagagatggaggttacagtgagcggagatcacgccactgcactctagcctgggcaatagagcaagattccgtctcaaaaaacccccaaaaattagctgggtgtggtggcacacacctgtaatcccagctacttgggaggctgaggcaggaaaattgcttgaacccaggaagcggaggttgcagtgagccaagattgcaccactgcactctagcctgggcaacagagcaagactgtctcaaaaaaaaaaaaaaacaacccacaaaaacaaaaattagctgggtgtggtggtgcacacctgtaatcccagctacttgggaggctgaggcaggaaaattgcttgaacccaggaagcggaggttgcagtgagccaagattgcaccactgcactctagcctgggcaacagagcaagactgtctcaaaaaaaaaaaaaaacaacccacaaaaacaaaaattagctgggtgtggtggtgcacacctgtaatcccagctactcaggaggctgaggcacaagaattgcctgaacctgggaggcagaggttgcagtgagctggaatcgcaccatagcactttagcctggacgacaaagtgagactctgtcaaaaaaaaaaaaaaaaaacccacaaaaaataacatgataaacatctttgggcacaaaactgcacattgagccatttcctggaatagactccgaaaaggggaattacgtatgcagtagaaggaaagagcactttttgaggcttttgatacctcaagcaaatgtccttttgttctagactggaggctatggtggggtgggctgccagagaccctgcttccctgcaggggattcatgtttctgctgaacaggggtccaaacccatgagctcctggctcaggaaaggtcctaggtgggcccatacccaacagcttttcacagtgacttgtgagaagctctaggagtcctgatgatctaaattgtttcagttgaaagtggaacaactaggagcattttgaaggcagaagtgtcaagacgcagaaacttctgtggtgccagaagagggggctgcctccagcaagatggaattcaccacggaatatataccaagcagcgtgtgggcaggtgttgtgcacaccacaccccgctgcgagttgtccccggctccagcctctctatgttcctccctatcagctgacctctacacactcatttctttgcatagtctctgcctcccctagaatttcagctcccttcatctgttttgttccctgctgtagacttagcccccacaaacgttacctggcccattgcagctgctcagtaaatatgcgtgggctgaaagaatgatgagtggggaagattgtaaagacctgcacagaggtcccaaaatatgatgcttgtaagtaagaatccttgcccgcattcctttactgggttctttttgtttattttgttttgtttttgagacagagtctcactctttcactcaggctggagcacagtggtgcaatctcagctcattgcagcttctgcctcccaggttcaagcaattcttatgcctcagcctcccaagtagctaggattacagacaagtgctatcatgccccgctaatgtttgtatttttttttagtagacatggggtttcactatgttggccaggttggtctcaaactcctgacttcaagtgatccacccacctcagcctcccaaagtgctgggattacaggcgtgcgctcccgagcccggcctcctttactgagttcttaatgtgtgcctggcatgtatctctcggacacttcccaggtaattctgttatggataaggtgactactgtcatcccatttatttcctgactcatgccagcttgacattataataaagcatttcccccatgctattttaaattctttgtgagccataatttatcttcctttaacatacataagaacattctggaatttgctcagtagcttgcacagctctagtatttacccaggaatggaattgctggggcctagggtgtgcctgtgtgtaacctgcctctgtacctccaggtacgtccttgcacctgtacctccattagctagtgtggctaatgagtccacactttcactcacagggcatgaggcatgagtgtctgcacatgcctgctaacacttggcatcactgtgccttcttggcatcacagtgtcttctaatttttgccaggctagtaggtgtcaaagatgtcttattctgtttttatttgcatttctgattgctaatgaggccctagaccttcatgcctgccctgcctgccctcaccaggcccctctgtcctccctttccctaccctaccctgacctccatgtctcttctgcttacccttcagaatttaacatagacagacgtttgcacctccgaggggctctaatctcaggcctcctctcttccctccacgggctgcccttgtcaatagcagcctgaggtcgtgtttacagattctcctccagagccttgcactgctgggatcagagtctgctccagcacctacaggctctgtggccttaaccaagggccttaatctctctgagcctcagatccttacttgcaagctggggattaaaaatagcacctcctagaagacttttcttgagaattaggtgggataatttattcaaagtgtttggcgcatagtactgctgagcaaatgtagcttttgggttttagagtccttgcagtccttgcttgtcactatgtttacctgaccagcctccaagcctagggagtcctcctgggtggggctgtgtttgctgcatttttgtattcccagcttccagcagtgctgggcaaacctgaagtccttgactaattggtatgtgtcagtctcgctggataagatttaagcatcaaatgaagggttgctctagatgcccttttaaaagtcttttccaaccctgaaattctctgatcaggaaattatcaaggaaaaagttctccttgcaggatcttttctaagatttctaaatggggactttattacacggggcaggtaattacaggaggctgcagctgcagcagagagcttcacatggctggtggctgattggtgcattttggaggctgtcatctttgttctgactgggggattggaatcctggcagaggcagggcctctcccttagcagtacagtggaaggcagccctgcaggacccaccctcaagctggtcagccctccactgactgccccaggggatggcaggcagcatctgttggcatgtgaatatcagacaagtcatggacagtaggagcagaggtgaccgttggaacactcagcccaggagtcagtttcatatatccccaggggccacgtgggtaacacaaatgggttgaaacatctgggcaagacagtagagagcagtggggtctgcagtgaattgtaaaactgactaggtgccaaccaaaggagatggctgccactcagctctgtgagatcgtcctatggataatgtgagctcagggttcctggatcttccccacctttttcaaaggtagccagaactctagatttttatgtaaaactttctgattattgttgcacctaattcaaagttttgttgtgctctacagtgcagacaaaacatgcctgtggggcaattgttttcatacctctgatttagcccagtatttgacaggttgggaaactgaggctcagcagttaaggactttccagaagtccccagggagttagtgaccatgatggacacaaagtgcccaagtctgggccgggcgcgttggctcatgcctgtaatcccagcacttgggaaggccaaagcaggcagatcacttgaggtcaggagttcaagaccagcctgaccaatatggtgaaaccctgtctttactaaaaatacaaaattagccaaagtgggttggcacgcgcctgtagtcccagctacttgggaggctgaggcaggagaatcgcttgaacccgggaggcagaggttgcagtgaactgagattgcaccactgcactccagcctgggtgagagagtgagactctgtctcaaaaaaaataataaaataaaaaaataaaaaagtgcaagactgggtgagttatccaccagtttggtgggctcttccccagcacctttattcaaggcagggactaaagcttagaggagtaaagggacagggacttgctcaaggtcacatagcttggaacagcagaatccagagaaggactggggcttgctggccctcatccatgggactgtccagccactgtgttactgaaaacgtccccataatggtttcaataaagtcctaaccaggaacttggcacagggcaaattctagcctgctgccaatcagcaggaaaacagctcttatgccagtgggcaggaagctgccaaggtgtcacttctgctcagagaaagtggtttgtgtatttgctgaactaatatgttcaccctgaaggtacagagatcaactctatctctttctggagggtccctccagctggatgcctggagtctgatttgacgacattccttttgcccttgacctggtgttcttagagagcctgcctatcaaatctcataatcagtgagggatgttgattcttctttgtgatcgggcacatgacttaggaaacaaacctgggcttagagttatgagggttgtaagcagttccagcttgcagtgttttagctgtgacattgggctggccacttttataattgctgccctgccagcctcacagagctattgtgagactctggttgaatggatggatctaaattgccaagaaaacagctaaagaaatgtaaactggttttggccttatattcctcctccttgaaggatgacatttgagctgggacaggaatgataggagggagccagaaaattcagcaagtgcaaaggcccaggggcaggaatgagcttgattccccaagaatggatggggagtgtattagtctgttctctgcattgctgtaaaggaatgcatgagggtgagtaatttataaagaagtgaagtttatttggctcacaattctgcaggctgtacaaaaagcatagcactggcatctgctttttgtgaggacctcaggaagcttcaagttgtggcagaagaagaaggggagctggcatgccccatggagggagagggaacaagagagaggggagagtgctcataataaatattgataaaattataccttctaggcatagcagggaggatcagtagacttacccccattaaaggcataataaggaccagtgcaatggctcatgcctataatcccagcactttgggaggccgaggtgggtggatcacctgaggtcaggagttcaagaccagcctggtgggtttagtagaaactctgtctctattaaaagtacaaaaattagccaggcatggtgataggcacctgtagtcccagctacctgggaggctgaggcaagagaatcacttaaacctggaggtggaggttgcagtgagccgagatcgcaccactgcactgcactccagcctgggtgacagagcaagacaccgtcccctcctaccaaaaaaatagacataataaaagctaacataatatttatataaatagagggcatttggtaattatgatttatcacaatctactgagttgaaatcatttgttttggtttaactgagtaccaattcattctaacctcttttgggcttactcataggctaggcctaggattaaaataataattagtatgagagctgtgctaattattaattttaggttgcttgtctggaaaactcatggtaagggtaatagtaagaagatttctccatcaaagaggagaaatgtcatgacttctagaaaaaactttatggaaaaggggaggtggccagagcctactgggtcaaaacctcattcgtaggggctcttttaaacaatgagaacccttgagaactagtagagtgagcactcactcattacccggaggacaacatcaagccgttcatgagagatttgctccccatgacccagatgcctcccacagggccccacttccaacactggggatcacattttaaggtgagatttggaggggacaaatatccagactatatcaggagctgacatgactgaaacagagtaagggagaaagcagtaggacaaagcagaagggggctgaagtcttgccaggagcagggtgtgggcccaggaggcctgctgcctggcgtggcatgggagcgagctctcttgcaagatggcagtgaggacctcgtcctcggaggcaggcctttccactaaggccaggaccatgatgggagagcagagaggtccagaaaatgaagaagctggcagagggtgggggagttggatcaccccaaagacatcatcaggaagggaggggcaggtcatctgggctgtgaaatatgagtagggtttgtctgggcagcaagagggagatggacttcccagagggcttggcatctgctgggggagcggggggccatcggaggacggcacatggcaatgtgtggtgttgcttccctcctgccttggaagctgtgagtacccccacaggattgaattgaaggcctagaaccctggatgggaaaaaccaggaacccaggagatctcgagggtcttagcgggcagacccatgtgatgtctgaaccctgaccctccccacctagtgccccaggattgcagaacacctccttccttgtagccttgctcatttgctcagaagtcaaggcccaggatggaatctcattgcctgagaatgcaggagtacgaggagcttctagggagcccttgcttctgtcgtgggagggcagcctgtgcatttaccatcccactaggagagcatgcggtggaggagaggtgctccccaggaaaggactggcggctgtaagatgggagcacaggatcctttgggagcagggcaaccccagcccaccctcaccctcttgattcctgcctgttccattctcttccatggcatggaaggagccctcaccccaggctccttgctggagatatgacggggagcaaatagctgtgacactggtccattctgagctcctgcagtgatcctaaagccaaaatgaatagtacccaatgcctgtggccagggagcttgctgtactgggtgggaaatggtcctatgaagaatgaactagggatgggtcattggtgttaatcttagatccccatgagtaagaaaggacatacctttgttgtctgtgtcactttgattattagtgaagtaaaactactctttgtagcctattggttgtgtgcatttcttcaatattgatttgccttttatctactattttaaaaaatttgtgttgtgtgcatttgtgatgatcgtttttgcaagagctctttgtgtttattatggatattagccaggtgcccgacatgggctgaaaatacgcttcctggtttgccatttagtttgcactgtcattcagggcatttagtctcttagcacagggatcaaaattttttcttttctttttttttttttccagacagagtcttgctctgttacccaggctggagtgcaatggcgtaatctcagctcactgcaacctccacctcctgggttcaagcaattctcctccctcagccccccaagtagctgggattataggcgcaagtcaccacgcctggctatttttatttttgtatttttagtagagatggggtttcaccatgttggctagactggtcttgaactcctgaccttgtgatccgcccgcctcagcctcccaaagtattgggattacaggtgtgagccattacgcccagccaaaacctttttctagaaagaatcagataataaatattttaggctttgagagccgtgccatctcagtaccatctgtttgtgccattggagcacgaaagtagccgtggacactgtgtacacagacgttcacatttcttatgtgttcagtcttttcttctatataaatatgggaggccttccgtactccaaaattaaatgaaagaaaaacaaaaaactagagaagaggaaaagtcctgaaaagtgatgtaagtgtaatgccccagcagtgatgagtgctcacagaagatgtactggaatctccttggatctcggtaggtctttagttctcaggagaagaggcgagagtgggcgctgctgcagacaggggcaaagtcacgagtgaaggccgaggcatctgggcctgggggagctcttcagcagggctggggtgggggtagcactccagaggggtgtcccctcatcctgtgcctctcctctgatctttattctttccactgacattgatgaccgtgttctctgaggacactgggcccattgtgtcttgagagacatgttcagccaaccacctggtcttcgtcagtcccagtgagaccccaggtgagaccctccagcttccttctatggaagccatcaggccccttcctcccctctaatccggaccctcccagagactggattgtcaggtttgatcttaaggaatcacatgtgaattttactcttagctcctctacccttttcttttaatgttgtttcaaagatgttcttaaacccagtgctgtattcaagatataactttcctatcctataactttgaatgataaactaaaaaacccagctggttttgcaaagggttttctgagtgtgagagggtcagatgggtgttctccctgtctcctcccgaccctcagtttggttggtctcatgacgtactggagaaacaggctcgggcctggaccaaccctgtgcggactcagactcacagctggccataggacctgggacaggcccttcacctttcaatggcctccgagatgatggtatgtgtgatgcttaatattgactgtcaactcgtttgattgaatgataaaaggtattgttcttgggtgtctttgagagtgttactaaaggagattaacctttgagtcagtggactgggagaggcagacccaccctcaatctgaatgggcaccatctaatcagctgccagcatggctaggataaaagcaggcagaggaacgtggaaggactagactggtagactggctgagtcttccggcctccatctttctcctgtgctggatgcttcctgccctcgaacatcggactccaagttcttcagcttttggactcttggacttacaccagtgatttgccaggggctcttgggcctttgaccacagactgaaggctgtgctgttggcttccatccttttgaagttctgggtctcatactgatccaccactggtttccttgattttcaacttgcagacggcctatcatgggactttaccttgtgatggtgtgagtcaattcttcttaatatttttgttttgttttgttttgagacagagtctcgctctgttgccaggctgtagtgcagtggctcattctcagctcactgcaacctctgcctcccgggttcaagcgatcctcctgcctcagcctaccaaatagctgggactacaggtgcatgccaccatgcccagctaattttttgtatttttagtagagatggggtttcaccacgttggccagaatgatctcaatctcttgacctcatgatctgcccgcctcggcctcccaaagtgctgggattacaggcatgagccaccgtgcctggccttctccttaataaactcccctttatatatacatctatcctattagtcctgtccctctagagaaccctgactaatagtatgtgactcgaaaggtctctagtgaaggtgcagtgagacaacttaggtagtatctgttggtgtggcacgttggcatcactccggagcctggtgacctaagtttgggtgactgactttgctgcctactagctgtgtgccctggaacaagtgacttcacctctttgtgcttgtgtaaatatggagagatgataagtcacctactaatagattgtttggaagattgaatggcttaatccacatcaagtgtctgaaacagtgcacatctacatagctgggaaatgttagccattgtaggccaagggccagtcacatactaggtgttcaataaatacaaccacccttctgttattagatgtgctggaacaattccattacactaacttttgctacttttgcaagaaccacagatttaatgcctatctacctccccataagtactgttaattaaagtccccaagcccagataaccttgctttcctgtccttagcaagctctggctggacaagaatttttaaaatgtgtttgttgatcttttaaaacccctaagatgagtatttactgccaaaatgtgcaagtgtatcacaaggatttaattcaggcactagataataatgctggagatttaaagaaggaaaatgacgaggttttcatttctttgccctctatctgctatggctacaagcacttctgtttatcatttaaaatcctatttgaaaaggtcactggttatttgcgtgaatcatacagtgtgaggacttaggaaaaaagagccaaagattggccgccgcagtcacctgcttcattccctgtccttcccctgtgatggagtttgctccgagtctctgctgttctcagcttatggtggccaccatggggtacaggaggaccactgggtccaggcaacatgacgctgtcagtaatgatgagaaaaccagacactgctcagagtgcatggagtttgtaaatccacttgaaattgggctggtgcaactgaggaacggtgctttaaattttattccattttaattattagctaattattttaattaattagctaattaattagtggcactaattagttaattaatgcaattgaaaaactgcattttaaactgaaattttcaatccactctcatttttacttgcattcccattttacagaggagaagtctgagggtccaaatgctttagcacaggtttagaattgcccggcatgtacatagtggacccgctctcttcagataggtgcagactatctctgaaagctcactctgcctcagttcctctctaacgatgtgcagcaggtattcaccaagcttccagtagcctgtgtttcacatgatgtgaggtgaaggggtgatggtatatttattggcctcgtatctgatagttgcctgcacattgtgcccagagaagcactttgggaagtggagctggtgttcaaaaggccactaattggcttattccccaggattcatcttcagttgttgaaatctattttttgaaaggcttaacctgggaagtcccctgaaaacaggtgtgtgatgcagtagggacagcgggaaaccaggggaagtttccagagagaagtgtgaagagccattctccattgctattttttttttttttttttttgagacagagtttcactcttgttgcccaggctggagtgcaatggtgtgatcttggctcactgcaacctctgccttctgggttcaagcaattctcctgcctcagccacccgagtagctgggaatacaggcgtgtgccaccaagcccagctgattttttgtatttttagtagagatggggtgtcaccattttggccaggctggtctcgaactccagacctcagttgatccacccgccttggcctcccaaaggactgggattacaggcgttagccacggtgcctggtcctccttcactaatttttgctgggttacattcactgccctccagagggacatgatcagctctgcttccctcactgacctcgtcctgtaaaattatcccttttactcagcacacctgtcccacaccggctgaataccaccagctactttccaccctgtgatctcccactggcatgtccctccgcctgagctccgctctcctcacatggtgtttgcaagcggctcactcaggagctcagtctcatggtccccctggtgccccacgccctgtcatttgcagtgatgttctgtgatcctcacaggaggcttgtgaagtcctattctcattttacagatgaaccttagagaggctccatagctaactcagagtctcccgtcaagtgaaacacaagggtggaacccacgtctgtctggccctagaccctgtgcctcaactgcacaaccagtgttctccgatagaactttcccagtgatggaaatattcaatatctgtactgtcctgttcagtagccgctcactgcatgaggctactaagcacttgaaatttggctggtgacactgaggaactgtgctttaaatttcattcagttttagttaattagctaattattttaatttattagctaatttagttaggaacactaattagttaattaatgagtgcatctgaggaactgcattttaaacttaaaatttaattttaattggaaatagccacatgaggctagtaactgtaaagaactgtgacaagcctgagatgtctccctatttgcaagctgacaaattagcctgctgacagatgctggcagaagacaggagcttcctggatcagagacaagggacttcattactcaaagcacagcgggcagccagcttgagtttcatacttgcgtcatttctgcttgcctctaagtcttatggggttttgtgcaaaagcatttaccattatctgcactgttttgtatgatgcacaagctttcagagagggactatatatttcactcctcattgtatctccagtatcccaaagagagcctggcacattcttgggacccaacgagtctttactaaatgaccaatggctctggttcctcacaaaagccaagagtctggactcggtggttatagaggatcctcccagctcttgagaaaggtctctgaatttgagcgagtgccctgcttctgagattgtctcttccttacagtcgctgcagagatcagcctcaaacagggatctcagtttcctccctgtagaacctgagtctgggactccgtgcacgtagattgcagaggaagtgttccagggaaagggtgggggacacagggctacgcaggggagctgctgagcagggatgtgctcccagctagagtcaaccttcagcctgatcccacggccaaccccagagcacaaactgtaccatgaggctgtcccacaaacctgaaaatttggcctggactcagggacatttgggagcctcagaagattataggcagcagaaaggaaagacaggaatccgataattccacataagaaacgtgttctggactctggagtccaggtagtttggtgtttgaatcagactccaggtggcagtagggaagagaaatgagtgtgcctccacgctgttggggaaagatgcctttttttcaactctagtacttaccatcagtgggggaaactgaaggaaaaggtaaaggaggccaaccctgtgtaaccccatgtccctctgtcattgtctgtgggctgcctagggtgtggggggtgagagggtgggcacctcccaggggaggcagctcctctgtggccagaggcagttctctggatcaagggacagctgtgagctgtcagcagccaatagtcacagcagctgaggggtggtggcccagccagaagaggcctctgggcagagtgccagcagcatctactctgcagggacccagcaccttccaggtagcctgaccccagctaaggaaatgaaaacctgaaacctgcctttccaggtgaagtggctccgagggtcaccgggcgtaatttgctacctaaggaaagtccagtggttcttgattaccatcccctgccctccatgctgctcaggtttcctgctcgtcctttgggctggcctggagaagaaagaaacaatacgtcttcttttcttcatgtccctacaatgtgccaggaactctccaagagacttggcctatattatctcatctaactttcccagcaaccccgagaaatgggcctggtaatgcccgtgcctgcaaggtggaagccgtggctggcagaggtgaaataccttcctgggaataccttcacagctaggaatggcagtgccaggactcgaagccaaccctcctgggccaaagcctatgctcttccctaccatcgccatgggcgtgggttgtggggaagatgcatcacaagactgtgccttcctgttctttctctttctccaggcagacccagaaggcactgcaggacttcagagagcaaagagggaagtcaaggaaccttatcctgtggtttcctctactgatgagtggtggagttgagaatgtccatctttccccaacagcatggtagcacactcatttctcttccctactgtcacctggcatctgattcaaacaccaaattacttggactccagagtctagaacacgtttcttatgtggaattcttggatttctgtctttccttcctgctgcctataatcttctgaggctcccaaatgtctctgggtcaaggactaacttgtaggcctgggttttgaggtccctctgcagtttgccaagtttctttatttttatttttatttattatttatttatttatttatatatttattttttagtagagacagggtttcaccgtgttcgccaggatggtctccatctcctgaccttgtgatccacccacctcggcctcccaaagtgttgggattgtaggcgtgagccaccacacccagcccagctttttttttcttttttttgggacaaagtctcactcttgtcccccaagctggagtgcaatggcacgatctcggcttactgcaacctccgcctcccagattcaagcaattctcctgcctcagcctcctgagtagctgggattacaggtgcgtaccaccacgcccggctaatttttgtattttaagtagaaacggggtttcaccatgttggccaggctggtctcgaactcctgacctctggtgatctgcccacctctgcctcccaaagtgttgggattacaggcgtgagccaccgtgcccagccgcagtttgccaagtttcttccaaccaatcctatctttcaaggttgcccatcaccatctcccactgtaatacaaaggagatctgccatttatttgcttaatacctaaaaatatttgctcttatttagggagcccttgccacatgcccaagctgggcagatcgctttgtacgtgttgtcttgtgtgagcctcacaaggaccccatcaggtcagtcctgttgttctcatcttacagatgaaaaattggaactcagtgaggtataataacctattcaaagtctcaaagccagtgaggaatagaacaagggttaatgcaagtcagtctggcccagaacctgtgctctctacttctcggtcagcactctccaatagaactttcctgatgatggaaatgctctatgtcggtactgcccaggtcagtagctgctagccacatgagactgttaagcacttgaaattgagctggtgcaacggaggaactgttctttaaattttattctattttaattcagttaatttaattagtggcattaattagttaattaatgagtgcaactgaggacttgtattttaaatttaaaatataagtttaattagaaatagcaggtgagtgcagtggctcacgcctgtaattccagcactttgggaggccgaggtgggtggattgtggggtcaggagttcgagactagcctggccaatatagtgaaaccctgtctccactaaaaatacaaaaattagccaggcatggtggcacacacctgtaatcccagctactcaggagactgaggcaggagactcgcttgaacccaggaggtggagattgcagtgagccaagattgcaccaccgcactccaccctgggcgacaagagtgaaacttcgtctcaaaaaaaaaaagaaaagaaaagaaagaaaagaaatagccacgtgaggctagtagatataaagaactgtgacagacctgagatgtcaacctatttgcaagccaacaaattagctcgttggcagatgctgacaaaagatagcagcttcctggatcagagccaaaagactttactccagcacggcaggcagccttaagtttcatgtttacatcatttctacttgtaccccaagacccacgggcttgcttcatagatgaggaaccacaatcttttattataatgggctgcaagtgaacctactcaacttctctcttggagggaggcattatctttatgatactggagagtaagcacacctgagccctgctctggaaggagacactatctctatgttccaggctctgtgcctccttaaaaaggtagttcagaaaagaaggctgtcagtgcttctgcttgcaagacacacagaagtgcaagagacccatgaagaattgtctgtcaaccatggatcctgcattggatactgcaactccaaattgtctgcagtgcctgttctgggatgtttcacatgtactacatcattgaccacccccaggtgtctgcagagttagcccgtcttttctgtttagcagatgaagaaactgaggctcactctcacccaacttcctgaacttcgagatcgtggattctcctccccattaccaactctttctacttccccctagatcccccgaaaaaacaaaaatctggaatgtttgtcctcctcactccttttcaaaactttaccctccaagactagaattccttttctcttctgccttgtcatcttcttcccattttccagaagagttgccagtctgacctcctctccgaagccttccctgcccagcccaacctatgctgaattcccctgtctcttctcgaccatagaaggtcctatctcatactcttgagtggaagctcttgagggcagagcctgtaccttcctgtggccactctcccccagcatggcctatctcaggacttgggggaaaaacaaactaacaaataaggactcaaaaaaccaaaccagaaacaagcagctattattttatgcctgggattgacttcccacttcactacccactttcagttccaggccccaggcagtgggtgaatgggcttgattctttcccagaaacgggagatgttttgaaatgactcaaagaaaagctgattggattggattgagttttggtaaatccacccacaagagcagagaaacttgacatttgccttccaagccagcaaaagggatgaatctcatttccttctaactgagcaggaggcccagcgatggaatgatgactgagcaggtctcaggagactgggttctagtccaagttctgaggctggctggctccatgaccttggggaaggcactgcccttttccaggccttagtttctcatctatgatgcaggactggaggagggggagaggagtcagactctccagatgccctccctccccaccttccatgctgggcttcagtgatcctccaggctgggaaagcccagccttcacaggaacccagtgaagttctgctcctcccagcctcctttctgccacctccctgagcaggaccagcctcccctcctctccatgtacagtgtagacatcccacactgcctggctgagggagcacctactgtaaggctgtgctgaaagagcagcacttgattctaatccagactcctctatcttcagccctaatgcatcacctcatcgtaaacataattcacagtgctgccatctctgcctttcaaggtgggcagtgcatgtttttttctccactctcgttcagttatttttaggaaatgccatgtagttccatatacttgacatgtacctgctttcactacatctggagatattcaggaaagtccttgttaacgataaggcctagggtggagctgcgacgtacttgccatttgtaaaagccaggcagaagagtccatgcgggttagacacagataaggaaaaacaattgatcaaagaacaattggcccagctagggtggagtttcttaaggcagccaggaagtggggggctggacggagggaggaaggaaaggaaggagggagggccttcaaggaggggtggcggagatggggcggagggggagcagacagtggatcctaattgttacaggcactgaatccttacaacagccccagaatgtaaggatgcttattatccctgttttgcagatgagaaaactaaagttcagagatgaaatggcttatccatggccactgagctgcaaaatggcagagcctgagtggaagtcggctctcctgactatctactcagttcttacaaatcaaacgtttgttggggggcgttagaatacttgcaaaaggaactctgtgtttgtcagctttgctgcataacaaaatcttccaagctcagtgacttgcaacaggtgtttatttcttgttcgttacaagtgaaaatgctgtgggtaacctgcaggtcagctgtggctcagcaatgctctgtgaattttctcagtttaaggtccagggtgaaggtagtcgctaaccaggacatgctgtcctctaaccagaactgaaagaactacttagtcagatttcagctttctgctcagagatggcacataccagaactgcacacactctgtcaaccaaagcaagtgacatggccaagcccaatgtcagtggagcagggaggtatactgtctgtcctcccacagtgagaggtggaggctgctagaaggggaataaatagttgcataatgcagttggccacactgggctctgcagacagatgcctgggtctgactcctatctctgtcacttaatagttgtagtcatatggccttcagcaaagtgcttgaccacactgtgcctcagcttcctcaactgcaaaatggggatgataattatagtcctgcattaatttgctagaactaccataacaaaatatcacaaactcggtagcttaaacgacagaaatttattttctcacagatctggaagctggaagcccaagatcaaggtgtcatcagggttggtttctgatgagggctctctttctggcttgcaaatggcagccttctaatttgtcctcacatggctttcttatgtgcatatggtgagagtgctttctggcacctcttttttttttttttataaggacatcaattctagcagattagggccccaccattatgacctcatttaaccttattaccttcctaaaggccttatctccaaatacagtcatcttgagggttaaggcatcaacatatgaatttggtgggggtgtgggggacggttcattccatagcaagggccaattctgcagggctcttgtgatgatttaaatgggttaggacagcgtctggcctacaggcaagcactgaataagagctaagctgctcttagtaccccagggatagcaggcctcacattatcatattggctattccctgcactgataatgcctcatttgctttctttgtcctttggcaacctctcccaattcctggcataaatgaggtgaccaggaaatggatgcttgagtcccccggtgaatcctgaggcagttgacagaaggcacgcagggtttgaggtgccctgggctgcactccctgctgtgttgctgacctgcttggagactttggccaagccaccatcttctgccagccaggatgcacctcattaagacaaggcttgttctgcccacgacatctcagcagatttcatttccccatggccttctgtggctattcctacgtattgggtagtgctcagagccaaagtcctagagatttttggttgttgttgttgtttgtttgtttgttttgagacggagtttcactcttgtcacccaggttggagcacagtggcacaatctcggctcactgcaacctccacctcctgggttcaagcgattctgctgcctcagcctcctgagtagctgggattacagacgcctgccaccacacctggctcatttttgtatttttagttgagacagggtttcaccatgttggccaagctggtctttgaactcctaacctcaagtgatccgcccacctcgaccttctaaagtgctgggattacaggctgaaccactgcacccggccagagagattgttcttttacataaatgttcttatagattccaaattgacagtacttctccaaaccctctcccacagctactgctccccacctcaagagagcacctaatgaccctgccggatagggctgggctggacgggcataggagaacttactctagctgcctgtgtctggggcagtttctggttatgactaggagcctgagtgttttcctgctcttgagtagccacccacagacacagaacgacctaggcttggggtgaactcttgggattccatggcaacactgaaaaaccctgtgttgatttttctatcctcgctcatgttacctttcccacatctggccttgcttagaaagaacgatgtctgaggctgtttgtttattagagagctctgttagccgaggagagacagattaaaggccgtggggacagccaagcctgtccaagtccccttgcctggtgtggctcagcccagcagtgttaggaaggagagcaccaggtgaaagttcttggtgccctcccagctcactgctaattcattatttgtatgatgactaattcagtgcatttttgaccttctcagtctcaacttcctcatcagggaaacaggaacaaagatacctcctgtgagatgtacagcatctgacccagagtagaaggtgatgatgatgatgaagatgatgatagttcagccctcagggagcatggctgagaggccaagcatgctttacgcacttcatattcattgatcctcttaatcttcttggcaaccctaggaggtggggactactattctttttctttacagatgaggaaactgaggcacagtgaggttaagtgactcctggcaggatgtacagccagtgaatgacagggctgagaattggacccaggctgtctcgcttcatagccccccaccctcatcactgccctcagacccaggtgacattagttatgttaagctgtgtctcctccctataaccttccctgcagtgttggggaaaaggacgcaaagagcaggtgttgcttgttctgaaaagtacttacttgtaattatactaaaaatgtccctttcgagttgtttctttagagagtcagaggcagggcagccccaccctaggcacctcctccctccttctggcccccgtgggcctcttggtgtgatattaacgtctgagggcctcagactcatccattattgatggggcatggggagagggtgagaatgaggcccaggcggtcttaacagctcagaaagttctttttatccctgtccctggtggaaaagtgcattacaggtgacaggagcaaaagcagctgtgaccaaagctgctgccagctgtgggtagagcatgattatcatttgttattgccctcaactgagcaccctcttctcattcaagatttaggaaaaacattacaacaatgacaacaccacttctctgatcttgagtcttagattcacgtctctctgttccttcgcaaaatgcctagctgtctgtttcctgccagttagaagaatatgccagactcagaactacctcccgcccctgcccagtgagatctgtgacctgcccccagccctgttgcgagtgcacacgcttccctggggatgggggtgggtgagaacagcctttgacctgcagacctggattccagtccccattctgcccttgctccccttagtacgccgagctgctcgacctccgagcttcggtttccttgtgtgtgatggcgaggctggagctaccccaagggactgtcatgaggctaaataatgtatgtgaaaggccttaacccagtgccaggcacacagcaggtcccagaaaaaggatgtgccatcctctcactttctgtctaccccacccatcctcatccttcagggtttgagcaagagccctttgtcctggccctctttgcctcattcttcccccatttcggtgttttgcatgttgattaaaactctctggggcaggctctccaaatttagcatttttacaacaggaagtggtcttagagatcatgcggttcagagctttctgtttgcagtttgggacaggaagcttctgcacgtaggtcccctggctcccatccagtgctctttaggtgactctcttctctccccacactgagtggcttgaaagggctcagaggcttcacatgagcacttaacatttactgtgtatatctgagccaagtagggaaagaaactgtctcaccaatcctcacgccctctccccatgctaagtctcccgagtattttcttctgtttttcagatgaagaaactgaggttcagagaggttaagagactccactgaggtcacacagccggtaagtggcagagctgggattcgaacccagctctctttcactccagaacctgtgctctaaattgccttgctttctttgccttaaaaaggggagacctgcgactttgttttctgttttgatggtactcacacagattcctgggttgaaaggagagggcccctgggtccaaaaattcagaagggtggtggcatttgagaaaaacatccccattcccagtgggtgccgtggccgggacaaacccggagcttaggcgcacctgggttcaggatcgagctcactgtagccagcaggagcctgggtctgttctcccaggagggttgctccgaggcctcaggagctctaggaaccagacccctgggaccccacagcagggcccaggtgcctcgtcgtgtgctgtgtgcctcacattctgcctcagccacagaggagcccggcaggcaggactcaatctcactcagcaccactctggatggttgcgtagttacaccgtgtggtttgtagtatttttggttttgttgtttttgcaaaagccaaaggaagtctgtgggctgagttctaccttcccttctttgaggatagttggtctgctcagtcagggacaagcagagctcagctagagaaaaaaaaaaccctccaaacacgaggttgacagatctgagggcacctgccctagctggacaccagccctggctgttcatgggcagggctcattggaagtttcattataatcatcccattttccagataaggacactgaggcccagaaacaaccacacccccacctcttgggaggcacaaatcaaaatgaatctttgctccctgagtgctgagcgctttgctgtttcacagctcactgtccctgcagtccacatgtactcattgagggcctaccactgctcccagcaggcacacagcagtcagggagtcggatgaactgcctgccttctggcgggggaagacagagggacagacattcagtccactgtcgagcgccagttcctgatgaaggctgtgaaggggaatgccacagaacaagtggcagagacagcgattttagggtgaccagggaaggcttctccaaggaaggcatttggacagaaacgtgaatgcagtgagtgagcaagccatatggattctggggtaggaacagttttggtagagggaacagcaggtgcaaaggccctggggcagggagtgtgcttggtgtaacatcccgctctttgagtttgattctctgggtgtttgctcccataccccactaccatcacagtggctgctcacctctagtatcccttccttagttacctccaagtgtctgcaggaatgtggcagtggggtgggggttgtgtagcaagaaaaatccgctgggcatggtggttcatgcctgtaatcctagcacattgggaggccgaggcaggcggatcacctgaggtccggagttcaagaccagcctggccaacatggtgaaaccctatctctactaaaaatacaaaaattagccaggcatggtggcgggctcctgtaatcccagctactcgggaggctgaggcaggagaattgcttgaacccaggaggcacggaggttgcagttagccgagattgcgcccgtgcactccagcctgggcaaaagagcgagactccgtctcacaaaaaaaaaaaaaaaaaaaaaaaaaaaaaattccaacaaaattgcatgggagagaagaaaggtgtatctctaataggaaactacttgtcttagtccttaatcctctttgcacaatttctgtgtttggtgaagtttgcaatggttttgtcttcttgctttgcatgtgttctcaaaatgccttctttaactaaggctgtgagttcacagcacactgcagtccactgtgtcaggcccgtctttccaggcagggcaggaatccggattcaaaaaccacagaaatagcagaagaaacagttttggcaactacactgctgaccttgtgctgagctcagggagggaggtgcagcaggcagacagggcccaggtaggggtgcagtggctgacagacctctgtcttggcacagccattaggctcaggcccctgtgtgcgggctcaggtccctccttcatcacagggtggtattggcaccagcctgggggagcagttcatggggctgggtgtgctggaagagacgtgctgagaagttagggaccccaggttctctctgactttgttttctgtttttattttgctcacatagatttgtgagttgttaaaaaagaagggctcctggggccaagaactcggaagaggggtggtatttgggaaaaacagccccatcccccttgggtgccgtggcctggacaatcccagagcatcagcatacctgagttcaggattgagcccattatggccgagagaggccctggtccccgtctcaggaaagttgctccgaggctccaggcgctctaggaaccagaaccctgggctccacagcagggccaggtgtctcctcaggtgctgtggtctcatcttagtgccacctcagccagtgtacaaccttgggcaagtcacgccccctcctggagactctgaaaatggaacagaaaggtgtggtcatctgtgtgttcctctgtgatctggaaatgctacaacctttgcttctaaggcaggtagtagccaggcatggggacggggcttctgtcagctcccctttgattttgtagacctctggctcttagcaaagagatgtcctaggaaggaagggcagtaccttggtgatcctgtcttgcacatatagactggagcttcagcccattctcacctctccttcacctgagacctgtggctgcagaaccagaaactcatttccagaagcagcagaatgtctctctttccgcagggctcagaagtatgtattaagccttccattaactgcatcttactcagctggaaaaataatactcaggatgcaattttatctgatttctggcctgtaagctcctgaagggttctcttaagaaaggctcaaaaaactcctgcgctgtgtgactcggagcccagccctgtagcctccctccaaggagcaggcagctcagtggttgaccagcaagcccatcatcattcagcactactgggttatccatctgtccgtctgtcaattaaacaagtgcttatgagggcctggggccaggggcacataccgagattactaagactaaataagacacagcgtgtgccctccacagcagttcaggcgcaacctgaccactttctctatttggttaaactccagaaagttcttgactttattattcgcagttcaaaagcagcatgagcttttgtgtctgctccccttcacccactaagtgtcatgacgagcaggcagaacgcccatatagatgccacacatgctatgggttacgatataggacaggaacaccgagcttggggtatccaccatcttgtggcagacagcaagcaagccagctttttgtctcagagagaaacattacctcatgtctcaggattggttgctgcaaacccaacccaggtacagagcagtcagagccttgcattctttgtctacccagcaagatgtgtaggaatgcaagaaactcatggagaagtgtctccaaacaatgcattagcattgcacatgtctggatttgaatcctacgtctaacaatttaagtgcgaaattaagtgcgaaattgggtaaattgcaatggctgaacttctcagcctcagtttcctcttctataagatggggataatgcctactttccaggtgactgtgaaagagagtgtagggtcactcgtctgggaacacagtagtgaactaagaaagcccttgagttcaagaaacttagttgcacggggaatcctttcagctatgtattaagtatgcaatgccagttagtcatgtgtgtggaaaagaatagaggaggctgggcacggtggctcatgcctgtaatcccagcactttgggaggctgaggcaggcggatcaccaggtcaggagatggagaccatcctggctaatatagtgaaaccccatctctactaaaaacacaaaaaattagctgggcgtggtggcacacacctgtagtcccagctactcaggaggctgaagcaggaaaattgcttgaacccaggaggtgaaggttgcagtgagccaaggtcgtgccactgcactccagcctgggtgacagagcgagactctgtctcaaaaaaaaaaaaaaaaaaaaaaagaatagaggaaaaacgcagaggccgatacacatcatggttcagggacagttgctgcaaggatttgccatgtgacccagcaccctgaattgagtaaaggaatgaccttactacctgtgggaagagcattctgggcagagcagataggctgtgtgtaggtcctgtgcttggcctgcttgagggacagcatggaggctgagctggagtgagcaaggaaaagtcgtggaaaatggaatcagagagtaggcagggaccagttcatgtaggatcttgcaggccttggtgagagccttggattgcattgtgggtgtgcagagaacccactggaggcttcaggtaggtaggggcataagcagaaaatagcatggaagaggccaggagaggctgcaaggtctgggatttgcttttatcctgctgctactaacaagttagcctgttagtgtttcatggatcctggcagaagacatgagattcctgggtcaggagtgttgtaaagtgggaaagatctcactgctttttgtgcacaaagcctgagctcagagggaactcttctgagtttgaaggggaatgataactcagtccatactttcagaagctgagcctcagtcaacaaataggaatgagaatcttggaacagattccagggcacagtgtatcagaaggctcttattctctcagcctgcatgtcttacctgcaaaatagggagaacattgcttcccaggcatattgtggggtcttgtaaatagaaattgaatctgaagaccctgtgcttattctctgcgttaataagaaacagcaaattcttcctaataatttatccttctaggtttttgattatcccttttcttcactgagaagctattaatgtttgctttgtagctctagtgcataacacacacacactcagacatgcttgcaaaatgtgcctgccagcgtcttcctggataaagggtggtgttggtcatttaggggagaaggagagagaagaaggtgaaaagagtcagaaccccagagaggcaagagaaaatagctagggtggcctctctctctctttttttttttttttcctgatacagagtcttgctctgtcgcccaggctggagtgcagtggcgtgatctcagctcactgcaacctccacctcccaggttcaagtgattctcctgccttagcctcccgagtagctgggactacaggcacatgccaccatgcctggctaattttttatatttctagtggagacaggatttcgccatattggccaggccggtctcaaactcctgaccttgtggtccacctgcctgggtctcccaaaatgttgggattacaggcatgagccaccacgcccagtcagggtggtttttctttagatcatgtttcttcctcctgccccattctgtacatctgaagggagctgaggcttatacacagcatcccccacatgcaaactcatgtgcaccctccacccaccccaggatgctcagccagctggccaagcattacagctggaattcagatggcggtctctagccagtgctgggcacattctgccatcgccgtccctagacctcctgcccttccagtcttcgtttctctccaagacccaagcagtacagccagccttggcaaggcccacctcttatcactgcattgtgggaggagataaaatgagacttgtgtgttttaaagttgagcagaacaagatgtttttaaaatgctgtgttccctatgtgggaggccttctaatgatcagctggggacagtgcgtccagtcctcccacccctgggaggtcccggaaaggactgcagtgtgggatgggaggcacactcccagtgttggatgcctacctggtggccagctcagacagagctgggacagagctgtctctagcacctctggccatgagggtgtttggccattcccagcggtcattcggcgtagctcagtttatctctcctgccagagtcgcctccttattggacggagggtgaggagcactcgtgatcactttgtggggagagtgggcagagtagggctgagtggaggtgaactccccctgccgcatggacgctccccgaggtggggtatgggcgccatccagagagaccagctgaggccgaaaggtagattcttagcatgaagagctgggcctctggagccgggctgtttggatcaccttttatcttatttttttgagacagagttttgctctgtcacccaggctggagtgcagtggtgcgatctcagctcactacaacctccacctcccaggttcaagcaattctcatgcctcagcctccccagtatctgggattacaggcacatgccactacgcccagataatttttgtattttcagtaaagacagggtttcaccatgttggccaggctggtctcggaaatcctgacctcaagtgatccacctgctgcagcctcccaaagtgctaggattacaggcttgagccaccacgcctggccccatttcttcactttgaaagagaacataccaccccttggtaaagctgttgaggtcaaacaagcaacctaagagaagtgctgacttggagcctggcacagagttggtgcactttagggacaggacccagtgctttcttccccagccatctccaggactcatgagctgggggtgcacttggggagacatcaatactagtatctcagtctctccatggtccacgcctcctgacccccagggacaggctctgggaatgcctcctggtcagaactggcctctgttctcccacctgcttgctgggcctctgctggtccaagctgcccagtgtcccctcgtatcgtccatcccgagcctcaccagggctgccaggcctcagctgctctgagcatgccctgaccccgtggtgccgatccttgcccatatgctccggccacccatgttttcgctcctcccactggacagcttggcagcccctggtcaagagggcaaggtctccctcctttcctgactgctgggccctttctgatgagagctactcttcctctcctctggggcccaggtatgggggtggggctgagcctgggccagggcagtttaatcctgtgatccaactggacaccgtgacacccctccaaccttcagtgtgtagggatgggatggttcatgcgaaatgcctgctgtcgcctgacgctcccacccatcccggaaccctggagggtgctgcatgcctcgccattgtagtagctgggtttataacgtgatcttaatccccattagggacactgctagaggctgcccctcagctccttcaggcacctcctggatgcccctgaaaatcagtagcattaaaatatttccgtgaagtcacggactagggagaaaggggcctctttaagccacgtgtcagactgtgaatctcggctccagagcggccacacctccagcccttcctttatgctgagggttttagaaccagcgacagatgcctgagggcaggtgtaaggggcattaggagctctgaattgtctcttctttatcagcctccagcaccacccaaatggggggaaatcctttcttctgggacaggtgtgagcctgggtgcgcgcatagtgcaacccctggaattcccagccacgttacacgcttctaatgtcatttggctatcctaggactccaaatgtagcactcctcgatccacacacataagaagatttgtggatttaaattctttttgtgaggctatgaatatgaaaacatattcgcctccttctcatgtgaccctaatcctggttaatcgtgtttctctggggcacttctccacactgcctactctgagccactatttgtgcttcagcagaatcttttttttccccgacttccccagcaaaggaacaagcaggaggcactaaggtgcaaagaggaagatttgcaagcacatcgaagggttctcccaacctgctggcactgctgggctgtggggcaaatgggcaggcgccgatgcagaaaggagcagggaaacaggctccaaaggaaacggacttcccaagtcatgctcatggagaccgggccactctctagactcccacagggtgtcctgtgcacccctctccagtccagccacgatgtgccagttgcaatcactactgtctgctgctcacaagccagccgggctcccctttgccttcagtccccaagtccacgttcctcaggacttccacgatccagctccacccacagcagcccctctgaagggcgccctgttttctgtaacataccagcgtctccatcatcaccaccatgtgcttttttgggcacaggcctggtttaccctccccctctgccctcctccatcagtgctatgccccctgtctccatggccacctgccttacacagccttccctctccctttggttgtcattcacctgccacttgtggatcactaaggcccttggcatcatgtcttgggaggcactggttcctcctgagcagatttatgcgtgtgaactgccctgggctagatcctggagccggcctagtgtgcggcttcgctatctagcagtgaagatacgcatgccgccagctgtgttcttgaagcatcgcaggcatgcttgggtacctgggtgaggtacggcagtggagcatggaagagcaggctcaggaatcggccctcaccccttcctagccatgtgacctggagtaagccactgatacccaagggcctcagcatccccttctgtaaaatgggattatggtgtcacctccctcataggacctggaactgcactttagctagtccctaaaatactgcgtagtctctcaaagcccaacttccttctctgcccaaagagcaaatgcctgcccgaagagcccctggggactttcgccaggcatccacacacaagaaatgtattagctatggatgggtcaggcatgcacagataagttggggagggagtgagttggagagaaggaggggcagaccagaggccactagatctagttagagatattccatgggcttttgtctgcaggcttatcaaacaatgaggattctttgatatttaagcccggcaggagtcagagaacaacaggagaggacccagcagatcaaactccaagaggggcccaggagtgggcggtggtcaagccacaggcgctgattggagcagccatgggcgggctaaggggaccttgccctctggctctactggtgttgactacatttctatgggagggactgatgctgtcatcagggagcttgggggacaggcttcttggagtgtccccctggtgggacctggaatgtgttgaacttggctgagtggtgcaagggatcccctggtgccatccctgccaaagaccctatcagtgtcatgagcctgaggatgaaatctcccgatgggtgagtgccccagcagcagttggagcagagtttgggcagattctagcgagagcagctacccaaggtggaggggaggccagggctcagggcatccagctgacccacgtgcttcttgcaaatcctctgaggtggccagcgcctcagaggggtgtccggggaggggcgggaggcatggctttctgtggggcacagctcctggggcactcattgcttagaccacattgtcagctgtgccccttggagttaggtctgcggggtcacctggactggtcatggtgctggcaggacacaaatggtgcattcaaagtgggcagtggaggggagctgagttgaaaggtcattcacaaggtcatagtgtggtgtaggaaacagcaagtgtggtgcagtccctggggctggaaatggtgggactgtttccaaccctagggctgaagggacaagaggacatagacttactgagacccccaggacacagctaatgtgtggatggggtcatttgacaggagcaagggaccatcagcccttggctgtcccacagggagggcgccaaggcagtcactgcctgtccccagttccctctctccctctggccttcctccagggcttcctgtggctcccaggaggttgtccagactttaggggggccaccagaccttgcctggccccccctgtctgccagtgccgctgcagtcttccaatccacttgactttgttttctttcagttcgttggactcacctactgtccccacaggccttcatacctgtagcttcccctgcctgggaggctctcacactccctgcccaatcacctgtccaccctgtggaccctcagtcactaccacttcccccagacatcagccagtccctcttacgccctctgctcgtggcactgaaggctgccagtcagggctctccaggggagcagagcctatcccatatttgtgtatgcatattaagagattcaactttcggaactggttcaggcagttgtggaggctgccaggttcaaaacctggtgggcaggccagagggctgaaatctcaggcaggacttgacttctctgttacaatcttaaggcagaatttcttcttttccagggaacctcagtttttgcccttaaggccttcaacctattggatgaggcccacctgcattcatctcctttacttaaagttaactgattggagagcttaaccacatctgcatgctaccttccctgaaatacctagacgagtgtctgaccaaactactggactccatggcctagccaagctggctcattacatttatttatttacttagagataagtctcgctcccccaggctggagtatgatcatagctcattgcagccttgaattcctggactcaagtgatcctcctgcctcagcctccacatagctgggatgacaggggcaagccacatgcctgctgatacattaaatctaaccatcacagctggtcttttgtgtgattccttaataatctcagcctctgtcccaccctgtgatgttgctttcagtgagcaaggacgaagatcattctactttctctctcctttttttttttttcgacagagtctcgctctgttgcccaggctagaatgcagtggtgcaatctcggctcactgcaacctctgcctcccgggttcaagcaattctcctgcctcagcctcctgagtagctgggactacaggcatccgccaccacacccagctaatttttttgtatttttatagatagggtttcaccatgttgtctgggctggtcttgaactccttacctcaagttatccaccctccttagcctcccaaagtgctgggattacaggcatgagccaccacacccagccattctactttgtctaacttttgttttgttcagcacttgacagcaactgctagatggccggagcccagtgagtaattgtcaaatgaaagaatgaaagcaagagcgagaatccacaaaggggcttggcagtgtccaagtcagagatgttgccaagacaaagtgagatgctgtatgtaaagggtctgcatgtagtaggtgtgaaactcacacatgccatttcttcttcattttcaaccccactagccattatccacacacacacatatgcagttctgaatttctcagaggaatgatgatcctgggtaggtgacattttcctaatgttaatgttaatgttaaatattcttttgtgatggtcaggaattgttctaagcactatatatatatatatataccaatagtattgtttccaatatgtgttaaatattcaagattattagtaacatgattgtacggtgtggtagctcatgcctgtaatcccagcactttgggaggccaaggtgggcagatcacgaggtcaggagttcgagaccagcctggccaacatagtaaaaccccgtccctactaaaaatacaaaaatgaaccaggcatggtgcacatctgtagtcccagctactcgagaggctgaggcaggagaatcgcttgaatccgggaggcagaagttatggtgagccaagatgacaccactgcactccagcctgggcaacagagcgagactccgtctcaataaaaaagaagtaagaaagtgactctcaggactaaccaatagtcattaatttgttcaattagccaagtctaggtgagcaggggctgggatcattgttgcattttacagatgaggagctgactggcctcggcttctgaagtggcccaagtcacgctgtgctccgtggctgctgtccctggggttgggggtgggtgttctctcctctcctgggaggcgcagggagcctcagggcagcacagttgctggctggctggcttcattcgagactgatttttttaatcgacataaggagagaaatgtccaccccagtcctgccattgacagggagcttgtcatcacctgtttaccttgcagtggccaggacctcctctcaggcctcacctcactgtggccctgtttctcttggatgatgttttctggagggaaacgggtctggctcccctcacggctgatccttcctgacccaggggaggagagcggcgttgagtgggtccaggcctggctcggccatgagagcacagctgtcagcttcaggggtgactcagagcgggtggagcccagctggaaggagaaaacaaaacaagggaagggagggctcacactcgcccctgccaggccctgagctgcgccacacacaaagcccactcagtgctcacagtgccaccatggagtggggataggctggttcctcttccacagctcagacagcaaggaggcccagggcaggggccgacctcagcctggcaccatccacttcacaccagtaggtgtgaagttgggattctgcattggccgtaatcctgactttacacctaccggccgagggccttgggtaggtggcttgaccactgtgggcctctgtcccagctctgaaagctggagatgatacccagtaccttcatcgggagcttgttgtgggcccagccaatgtgcaccggtattgtgcttagaacacagtatagaaaagacaaaggtgatggtaggtgtcctcagtgttgacacattactgctctgtgcagtcacctcaagtagggatggtttttaacccccgctttatggatgaggaacttgaggctcagcagcccatgtaacttcctgggggtcaccgcaaacagccccccaccccttgtggcagcagctaaaccaactcccgaccttctatcccccccaaagctccaccctctcttttcagttgcagcccatgacacctcctaagatcctgcccctgggaatgggaagaacacctactccggggtagccaccctgtagaatacagcaggttttttctaaggagtcaagcgggtcttgggacttgggcatctggttttctttagccctggtgcacttttcctgtgtatccttggaaaagtcacttcccgtttctgagctcagcttccacatctgtggactgaagtgaggcagcagcttgaagcgtgaggatttgattcggggatccaggtgcttatgaagttcttggaagggcagtgagaatgggggacctccagggtttgggctgcaatgcttcaggttgaggcccacaggccacgaagcttcaggaagtcagggcagaatctgcagctgccccgctgcctggaggtagaagaaggcaggttctggagtccagattctggggcagctacacagcagcttctaccactgccagaggaaggaaggctcttgcctcgcccacctgcccgtcccagctatcactggtcagatctcaactacttccaaagcgctatggacagggatgctgggaaatgtagttcccaggcttccagcccctgcagttaggggaagcacacagcgagtgggaacaaactctcactcctgtagacagtggccagcataggaacccctgctggcagcaagaaacagggtgccctgagaaccctcgaatgcaggcaggattgatgcaactctcaatatgggatttgagccatgtggattgcagataccactctagcttctagccttattcgttgatcatagctacaagtttgctgagttcttaaatgtttctgaacagtctcccatcacaattcccagtgcgtgatacccagggagcagggagggttaaggacatcagcaaagagaaggcctcatcacccagggtcagcggtatcaggccaggagtaccccttagcttcagggggatggacaggtggcaggaatcctggggcggggtgggctttttaaagcccagcaaggcttccaaccaggtgcctctagctctgactcacttggcccaggtttcttattaggctgattctccaaatgagggattaaagtggaggtcagacacactcccttgtaataacacaggggcacaagggactgcgctgggagagttccatgtggaagttccacacactcagcttccagagacagcatcttcttcctggggacccatgccgagcacagagtgtgtaggaaaggagggaaggaaggagggaggaaagaaacgtttagacattgatcccaaagatacaaaagacctggtccaagttggctctgccatctcctagttgttttaactcaatccaggtgcctgccctccctcagcctcagttttcttgtctgcaagttgacagtgaaggtaactcccgtgtattaagcatctgttaaatgtgaagcatttatgcacttaactctcatgtgaacctttgaagagatgtgattttccccatcttgctggtgcaggccctgagcctgatgaggtagacgaggtccctacccaagacctctcagctaggaggtcggaaatttaggaatcaaacccagatctggctgacccccaatacccatattctgttcaccacccagtgaatggggctgctgaaagggtcaaatggatggcagctgtgactgttttggcaaactataaaaaacaatgcaaaaaaagagatgacccccaattcaagactggcagtcggaggttgtgaggtggccaggctttcctgcggatgtgtaaatcttggatacttcagaagacaatgcatctgcgtttccaagtgtgtgggaaaaaagactgattggagagtggaaaattggagctaccagagcaattttgaggaaccttttcctggggaagatcaaagctggtggcaaactcaggtgggcctgactctctacataagcctctgggaccagctgcctcctgacccaaggcaaggctgttgcagagtctgggtctgggagcccctgggaaccctgacatttcccccagtgtgttaggagctccttcctgcaggtcctgggaggtcttggccacgggagtagaaagcatgaagatttagctgttcagcacatcaaggaattcacacaaataatgaattcggccagaatcatcatttgtgtaataccactggtttgcatgatttgatgcctgatttcatttggtcttttaaataaccctgcgagtaggacaggccaagggttctgctggactttttcctttttgtttacaaatgaggaccttgaagcttagtggggagagacagaattgacctttgtggtcatctactctgtggcgggaactgagctgttcacttttgtgcaaggccatttatcccacagcaacgcttcgtgtgagcatttttgtttgtttgtttgtttaagatggagtcttactttgtcggccaggcgggagtgcagtggtgcaatctcagctcactgcaacctccacctcccaggttcaagcgattctcctgcctcagcctcctaagtagctgggattacaggtgcctgccaccacacccggctaatttttgtatttttagtagacacagggtttcaccatgttggccaggctggtctcgaactcctgacctcgagtgatccgcccaccccagcctcccaaagtgctgggattacaggcgtgagccaccatgcccggcctgcgtgagcatttttaatcctattttgtagattcaggaattgaggatcagagagggcaagtgccttgcctatgaacacacagccaggaatgggaagagtcaggatttgcatgcaggtctctcatgcctttgttgttgttgttgttgttgttgttgacaactgttggccatgatccactaggaaattcttcacaaaaccagaataaatgggttccaagcgtccagtgaccaggcatgggccggacagcagttcagaaaggagtcattcttcttactggaaggtttgagggccattaagtatccaagatttactggtcaggtcttacttggtcccaccctgtgcccatacatgaagccagccggccaggatcccaaaggccaggacatgggaggatctgtttttcaataatgggaagtccccggatgtgttgcattggaagtcatctcactgtctgtgcagagctggcctgggagcaggaggttctgacataaagtgaaagcagatgcagtggggccgcttgggtggggcagggaggtggtggctgccatggctgcagctgcaactttccagcctgcagatctgcctcttcctcccaccatctgtgcacttggctggtgtgaggaggtttgcctcggcacctctggggcctctctgggccccatcctcttctctgaatttgccacgcccgtgacacatacaggcaaccactccaagaacaggaacatggaaaggcaaagaaaagatgctgtgacttctactttgggcaatggcagaagcttgtaccagatcttttctcccactgagaactataaaagctggaaaaacttgaaatccagctctttgaaggcattagagaacaactaaagcagccaggacttgaggtgcgaagaccccccaagagaaaggaaataagttgggagaaacccaatattccctgctcattttctgcacgaggtatgtgctgatttttgcagagggttcagaggacgagcagagagcagcagttcagagtgtttggcagtctcgcaaggtggggaaacaaaacagagataggtaggtaggtagagggagtcagtgagttcaggactgctaggtcaaccaaaacccaaggaaccaagaacctagagcaaaaacaaccacaaagaaaagaacatgtgctctgtgccttctaaaattttcctttcaaggcatttgccagcacttaagtttcatgggtccagagtctaagaaaccaagcagaaaacagcagatgaaaagctaaaaagactgggcatggtggctcatgcctataatcccagcactttgggaggccgaggtgggtggatcgcctgaggtcgagagttcgagaccagcctgaccaacatggagaaacctcgtctctactaaaaatacaaaaattagccaggcatggtggcatgtgcccatagtcccagctacttaggaggctgaggcaggagaatcacttgaacccaggaggtggaggtaatagtgagccaagatcaggccactgcactccagcctgggcgacagagtaagactctatctcaaaaccaaaaacacaacaacaacaatgacaacaacaaaaaaacccaaacaaacaaaaaagaaaggctaaaaagttaagcttacggtgatctcatagtacaggggagacagaaattggagataggagcctgtaaggaagagtcaccctgataagcatcttggtttacctgttgagaacggctatgccccaggggtaagagtaaaccagaaatagaccagtcttcatgaaaagtgaaacacagctgcagttagaacaaagtaatgtgccacttctgtacctgctcatcaggagacaaccggtcctctctgaaggaggacagcctcatccagagcctctgcatttttgtcatacacaatacaaacagcaaccaggcctgccaaggacagaaccaaataaccaaagaaagaaagagcaaccgagaaaatagacaatagaaatacacccacattatccaagtatcacaggatatccaatgtgggctttaagacggctgtggtgaataaaattgcacaaagatagatgacaaggtggagaaattcaccagcaaagtagaacctgtcaaaaaattaggtagaaattccagaactaaaagacaccactgaaatgaagaactgaattcataattcaaatagagtaggcacagcaagaagggggagtaaacaaggctggaaagatgacagtaaaccaagtccaaagaagttatcagaaagggaatggggaagatagggaagataagagcaggtattgatggaattgaatgatgagccacggctacacagaaagccacaggagaaggcaggagtctgcctttgctaccattttgctgtgtgaccttggataagtcacttgccttctctgggttttagtttttcatttcagggagacaagcgtaagggttacccacctctcctggtggcttggggatcacatgaggaaagttgtggccactctgtattgaaagcgtcaattttgccaacagcctgcacagttcgctcaggcatttctctagtgaccatagtgccaggggctgtgtgaagggctgggagggcatcccagcctgtgatgggtatttactaccatcccgttcagtgggtatttactacaggttcaaaaccccgtgtggttccttcatttgtgtttccaggagtttcacacagttctctcagtctctggtcattgcccctcaactccctattgccagaggagtttatcttcattagggactctccttagggaaattcttacttttcagtccccaaaagtgtgctgacatttgtcagtcttgtgctggtgaccccgctaagctctgttgtgtgcaggtgcttcatgcctcctcgtattgagcatgtggctgggaaatgactgccatttggcagaggacagggagccagcttccctccttccccatccttccctgctccctctcttctttctccttgttctggggggcccggcctccctcaccgcacacttgacatgcagagatctttggtctgtggcgtcttggcccagatgtcatttccgggagccagggctggcattcccccatgcctgcaggctgccccacgcttgctagagcacggagaagacatgcagtcctggtttcttccctgcagccagggaaggggtatagcggtgttcttgcttttccattgcagttttatccagggctttggaaagcgctaaatgataccagctcagaagcctctgatggttatggggagtgccctggccttggaggtgtggctgcaggatgccccagaggagaggaggctgtcacagtcccacaacctgtgcagcacaaccttgccctctgccctgcctctcacgccatccctagcagcagcctagagcattaatatctctcacgcagaggcaggacattgtaggaaacctgacctctcatccagagccttgtttgatcaacacggatcaacagtcatctgtttcagggaactcatctctgccctggcattaggggtgcagaggcactaagggcaagggtgtcctaggccctgctcattataaaggcaaatgtagtaagaccatggcattcctctgctcagccccaccagcaggtttctatgtcacccagagaaaacttagtcttgactgtggcttctctggcccaacacactctcaccccagctgcatgctcagattccccctcaccccccacccactcctctcctccacactgtgtctgatccagccatacaggcctcctttgctccacagggtctggggccctattgatgcctgggaggcgcctaccttagatccttttacgatgcaccccagccaccttgtccagggcctggagaacgcaaggaccagcaaatatgcagtcaatgaatgagatgaatggacaaccttgatgggctgacggccccgagaaatgagcagaatttgtgttatcaatccgtttttcccattgaagggatggttcggaagggctaggtgacttgttcatggtcacgcagtgagtagtgtgggacaggctgctgagaatggaaatgtgactcagagtctgtgctttctttctcagttctccctctggactgttggccgttttgtttcccttcattcatttctgggtttcttcatgacccaagcctccactgagcattgagtgtgtgcacgggtgacagggtcactgccatagtgaggctgagtttccatcctcacattgctcccagtccagggaggagacatatgtgtgaagagcacagacagagtgcagccaggaccctagggagccaggagaggcccctaactcaccccaggagagggcagggcttcctccaggagtcagcaccagctgagccctagagaatgagtaagagccatcggcaaagcagggtggggtggttttctggacagtggggacagcctgagcagggacacggaggtaggagcaactgtgacctctgggtcagtcacattgcttcaagttacaaataacctactttaccccataaaggggatttattccctcatgtaactgaaaagtcaaggtgagggtggggctgcaggttgagcaggatcagggatttagcaccatttgttcgggttgttcagctctagtctcttctacacacgctagcaaaatagccagcaggatgttccacatgtcaacaacaagccagccagagcaaaagaaagtttcttccctccctacagaagcttggctggatgaattaaggcacatgcccatccctggatcaattactggggtaagaggtgggaaccctctgccagtcaagtgaattgtgagcctatctgtgatgatgcagaagttattcttacttaaattacagagctgctccttgatgggggcaggtggggagagaattggatgggatacctgtggacaccactaggttataaacaaaatctaggttgtcatgaaaagtgaaaactggagcagagaccggataaaaatgacgttgccaactgagctgcagagctcagaccttgtcctccatacgttgggcttctagttctggaagctgtagagggttgcaccctatgcatcttgggccctggatgtcttcagaagggcactgtggatttaatatggttttggagctgtccccctttctaccaaaaggtgatcaatctcctttcaactctaattttcctggaaaaaaatataccctgcttattgacaatctacaccttgagaatggggaggaatcgatcagatttcttccattcttcagcattccaagcaaagaccaaaaagaccacgctccagggcagacgtgcaaccacagttgtaccatacagaaatcccaaggtgtcggtgagagccagaggggtctccgatgggcatttgagaggtacctgtttgccttcttcaaaagaatactccccccttgctctatatccctccagccgtagtaatctgaagaccagttaacaagacaggtgtctgctccagggtagagccccccaaccccctgttcctggtcccccaacccctcccgatgtaaggaatcagaggactgtggatttggactcggatcctgctccttcctttccttaggcaagtcatctaagcactttgagtctcagtttcttccaagacaaaaagggaaactaatatctagctgacagtatattctgaggattatctgaagagatacgtatgcatgaatatctcatcctctcagctcttagtggatcatcagagaatattgattcattcacatgttgaagaagaaaaattaaagttcagcaatggcctaatagataccagaagcccagcatacatcattttatcttatcttcataaccattctataagtaggggtgttagtatcccactttgcagaagaagaaactgagggtcaggaaggtcaaataactttcccaaggctccacagctgggaaatcagaacttgaacctggaccatctaaagcccctttttatggaactgaggccaattggcagagcttgaatgcccaggtaaaaggaaccctgggccactctctaagcataccattgttgttgtgcttgttgctgaaatccaaaatctggaagagaatgaagtagagagaaaggcaaataacatgcatttaacaattcctgtgtatattgtacctacatgcatcacgagctctttgacaaatgtttgttgagtgtgtcaatgtgctaggttcttgttggaaacatggaggggacaccttctgcatcccataataaccttgcaaagagatgataacatccattgtatgcacgcactcaggctcacaaaggtagataaaccatccagagccacctgccaggttggcatgacaccagaaggaagaccacggaatacgtcctggtggagatgtggagagaaacattttttatagcaggatcacagaatctcacgctgttttcttcctccttttctttgcagatgacagacaaccttctgtgccttcatcaagctggttgtgtacccaccatgtccctggcgacaggatgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttatcttctttggatgtgaaaggaaatcactggttaaagcttgatcgagagacattatcagctctttaaggattgcagaagaataggctactttattttctgaaaaggtaaatatatgcaagcaaagccaacatgccacgaatggcgttggtctaccacacagccgtgtctgggacacagttgggggtcatcccccagcaggagtgaagtcgagcttagcggcccttgtgtcctcccttggaattcctgccatcccttttgattgagcctccacctctgggatttttcttccatttttctcctctcttaggagggagttcctgctacccatcgtgggaggccaccatcaggactgcgaagatggtgaccctgcggaagaggaccctgaaagtgctcaccttcctcgtgctcttcatcttcctcacctccttcttcctgaactactcccacaccatggtggccaccacctggttccccaagcagatggtcctggagctctccgagaacctgaagagactgatcaagcacaggccttgcacctgcacccactgcatcgggcagcgcaagctctcggcctggttcgatgagaggttcaaccagaccatgcagccgctgctgaccgcccagaacgcgctcttggaggacgacacctaccgatggtggctggtgagatgctgcctgagagcggggtctgggctgagagttggggtgtggactgagagtggggtctgggctgagagtggggatctggataagagtgggaggcctgggctgaaagtgggagtctgggctgagggtaggggtctggtaatgagagtgaggtgctctcagagttaaatgctcagtccccgtgtacacctggggccctgccaggcagttagtaggattcagattattgtcccacactatttattgaggatctattatatctaagtcagagcaggaagcacggctttagtttcctgtggctgccataacaaatttctgcacaattcatggctcaaaacaccaaaagtgcatcctcttgcagctctggaggccagaagtctgaaaacaaattatgggcagacttggctcctcctggaggctctgagggggaagccgccccaggcccgctcctggctcctgccagctgccggcagtgctgggcgttcctgggctcagagctgcagcagtccagcctctgcctccacttccacagggccttcctccctgtatccctttatgtctcacatgtccctctccttttcttatgaggacacctgtcatcaggtttagggcccaccctaatccaggatgatctcatgcagagatcctcaacaatttcacccacagaggcgctttttccaaatgtcatgctcacagattccggtgactagcacttgaacgtatctttttgggagccactatttcacccactacagctattgaaatgcaaaaagagagagagatccttattctcatggaattttattctggctgggaggggaagataagaaataaacaaggtaggctcacacagaagtgctttgaagacagatccaatgaggtttgtcatagaaacttagagggggcttctgtaaatggggtcaccagggaggtctctgagacagcaggactcaagttgagacccacaggcagagaaggcagcagccatgagaagagcaggaccatgcactgcaggtgtctgggacagcgggtgcaagagcccgagggtggcctctgctggatgtaatggggagtagaggagctctgcatggctggggggctgtaaatcaggggaggtgcagtgagacgaggcctgagagtcagcaagacccaggggaggactctgggatttcttgtaagtgcaacaggaaatcactgtagaatttttgtcagggggtttcatgatctgatcttgtcatttgaaaggtcattcccatgttaaatgcaaaatagatcgaagaagagcaagatatatgtgttcatgtcttatttattgagcacctactatatgccaagcatcactacattgagatggaaaagatagagtctttcctttcttgggttgcaggagtgatggggagagaagggaaaacagacaaactcaagccaggaccataggtgctgtgcaggaagtgggcacaggagcgatggtcttcatgtccaactccccttggagcctggggttatcgcagaaggcttcctacaggagtgatggccaggttcatcatgaaggattcagagaggttatccaggtagattctggggaaggtctatttgaaatgaacagaaaacatgtgtgagacttagaaaggtcaaaagccctgggctatgcttccaaagacctggctgagtcctggtttgctaatctgtgttgagcaccactgtgtgcaggtcctggggtgggctctggggaggtaacagagaaccgggcaggtagggtcttttccctttcaaagatccaagggtctagggaaggaggtggcgagccaggcatggtaaggattagggtctgctctcagcctcagcactatggacttgtggggcaggatcagccttagtcacaagggctgccccgtgcattgcaggatgtttagcagcatcactggtctctacctactaaatgctaggagtgccccatccccagttgcgatagccagaagatctccagacattgtcaggtgtcccaggtggggtgtgcgtgtgtgtgggtgcacatgcatgcacaaagttgccctcccttgagaaccagcagggttgggaaaatgacacattgatggcagaggtggcttcacacacatcccatctcctctctggatctgattccccctgtagcagcagttgctgggaccacgttaagtccaaacttcctcttcagagcctggagtctgtgatgttcagtgtcaccatgggattctgtttacaaaggccttttggggacaaacagggtactacacagcctgtttatataaaccaaacaggaagggaccttacacaacagcaggtaaaggagaaacttgggggcctttgtcctcattttacagacaaggaaactgaaactcagaaaagttaggtgacttttgcaaaagagaacatcaaatccaacctctggaaataccgtattaaaaactgttattagagagtatcaccaagacagtatcgatctttcttcttggggagggcggtttctaaaactcttaggctggtgtcgcccaggagggttaaaaaggcgtaagggaaaaacatcagcttctggatataagccatgtgtcttcaaagaacacaggctataatgtagacttaggaactggggcctggcatcagcgttcctaggttttgtcgcagagtttgtaggtcccatcaggagtgactttgaagaagctcttcatctcactgagtctcagcctccttcgtgttacatgggagaaatgttacttcaccaggttctctacaaccctgcaaacattagttttaacaattgtatttatttttgttggtttaatgggcaagtaatactgaacttaggtgggttttttttttttttcagtactaattaaggctgaatatatttccacttagttgtttcccatttaccagatgtcttcccctacctgcagcccttctctgcagtctttttctgaagtttagcctctggtggctgatcccagggcagccacttggaaggaatggggcttcaccctctggaaatcaacagaaaggagcagggctttagagctttggggttctaaaaaatgcacagataatacggaaaccacacgctttgaataaagaatcgggatacaggcatggaatatctgacaacaaagccatcctgagaactccaggctgcgccattgctctgcttaaaggcccccctgcaggcaggaccatttcatgaatggaactggacttgggtcatgatatggtttggctttcacccaaatctcatcttgaattgtagctcccacaattcccacgtgttgtgggagggacctggtgggagataattaatcatgggggcgatttcccccatactgttgagggggttggaagaatcttaggtgagaatgtgaggtcccgagctcccatcctgccctgagcttcatagtcctcctcagtcaagtgggcatcacaattccagctcgtcccagccctggcaggaacagggacacaggagcagtcaccagggctcactcttttagttgagttgagttgagttgagttaaattgagttgagttgagtttacaaatcagccccgtgccctgcaagtgaagagactgcaccaccatcccaggctggacctactgacccctgtgaccctctcctcgggtctctgtcccagacacccaggaacagggattccttcttccccagtccccatgtccaattcagagacaagccatgtcgaatgctgactctgccttctctacttgcccccaacttgggaaaccgttttgtgatacgcaggggacattctcaagggacagaaagagtgcgaccctcccctgatttccgccccctgccctcctaaggcatcttcccatcccagacatccatgcccagtgcccaaatgcaaaataataccatcatactgtccacccggcgcctagcaccaactctggccaggtcctgggcccagctttccaggtaccactgcttcgcccttaccacccccaccaccaggagggtgtaggtatctcattgtcctcactttgcacttaccaggtcacccactgtcaaagggcacagtcagatccccttgtagttaaaggacatggtctggagtcaggcccaggatattcaaactgttttggtcctgggaaactcacttcacctctgtaagcctcagtttcctcacctgtaaaataggtctataagatcacctttctcatagaaccattatagaaactcagtgagaagctgcctatcaggttatcagcacagggtcctgcatagggcaaccatagaacatgcgcttctgctcagggtgagccatctgagtcctgcacgagccatttctaagcaccgcctgtcccggcgctaacctgtccaccccacctgtccaccccacacggcaccggggatgtgataggggctcagttgtgatgagttgaatgaatgaatgtgtgttagctttagcagttgtcattcacttattcaatggacatatcttgagcctgtactacctagcatgcttgtgtctgctgcttggatgccaaaggggccagggaaaccaacagcagctggggattggaatgaggcctgcggtgaggccccagtggtgccacccatgtgtggaaggccagagactgatatttccagggtccaagggaggcttctcagaaggcgatgcatcattcattggccgtggaaggaggaaggaggatgggaagggagcgcgggtacctcttcccaacactctcgggacgggtgtggcctgtggatagggaggacttccagccatcgtgcctcaagacaggacaaactctgccatagcacaggctccagagttcctgtggatcatgcccgagtgcagggtgaggtgaggcacccagggctccagcttcaaggagatgtccgctctcgggccgtgcccctgggcatgagtgggcctccttatcccacttgcccgactcctcactcgcctcgcccccagcctgcagtgcttgactccatggagacctccccttccttctcctgccttgcttctcatccctctccagacagcacccaccatggacacctgcatccgtgccccagcctctgcttccagggaagctgacccgaggccccgtgcttcccaaggagctcaggccaccaggcggcaggcattgattgagcgctgattgtatgcagattgagcgctgattgtatatacttggaaactagtctggaaggctggagagggcgtgtccctgaacttccaaacactctgtcctgtgttcatatcagtagcactgtcatactttttttttttttggcatggagtttctctcttgttgcccaggctggagtgcaatggcgtgatctcggctcaccacaacctccgcctcctgggttcaagtgattctcctgcctcagcctcctgagtagctgggatttcaggcatgcaccatcacgcccagctgattttgtatttttagtagagaccgggtttctccatgttggtcaggctggtctcaaactcctgaccacaggtgacccacccgccttggcctcgcaaagtgttgggattacaggcgtgagccaccgcacctggccagcactgttgttcttttattgccactgacaaaaggcagagaaaaccagaatatttctttcccaaaacagtgacgccacatggagtaacctgcctgctccatctcagctggtgtggggaggacttactatgataatctagagaaagagccagtttcccatctgagctctacctggccctgcactcactctgggacctcaagtgagccctttccagggtctgggcctccatttccccttttgccaatgaaagattggaatgggtctgagatttctgaagcgtggggcttgtgatgttaggtgaggcagggcactagagaaagtcgcatcacagagcccggaggtcatttctgccgtccctccttcccacctgtctctgcagtgctggggcttcagtttggcctggtgtcttactttgcaccttgtcagcgcttgtcagccttgttctaagggagaggagagtttgcctgggcaggcagcagggtagagctgcaaccgaatacagtagttttgttttcattgcattgtacaactaccattttacttctgccaggtaattcttgctttctacgtgtggtagagatgagaggtttcctttctaataagtttatttttattatttggccaggcatggtggctcacacctataatcccaacactttgggaggctgaggcgggttcatcacctgaggtcaggagttcgagaccagcctggccaacatggtgaaaccgtgtttctactaaaaatacaaaaattagccaggcacagtggtgcacacctgtaatcccagctgcttgggaggctaaggcaggagaatcccttgaacccaggaggtagaggttgcagtgagccgagatcgcaccactgcattccagcctgggcgatagagtgagactccatatcaaatcaaatcaaatcaatcaatcaatcaatcaatttatttttcttaaataagtcattaaagaaaagtaagtcagtcagagtccagcaggatgatgtggtgctgtgtgaagcaggcagcatactctccacacacgtccatggccgagcttgagtcctggcttctcaggcctctgtggcacccagtagacactcagtaaatgtcactgcatgatggatacacggtgccaggctcccaaatcaaagtagcggcgtgatggaaggccaccccctgggcctgggcacatctttacaagcctaaggggcacagcagcccttgctagttggagacctccatggaggttcaggggagtctggctgtggtcctctaccctggggctctcagagtgtagtccccccaccagccctggcagcagcatcacccaggagtctgttagaaatgcaggatttcggggccagctttaaacctactgagtaagatctgtgccttagcaagcctccagggggttttccgcacattcaggatcatggagccaccctggatgatcccatcagaatcaggcattttatctggatatcacatctgtgtgtgtgacaacatattcataatatttatcattttcaccacttgtgtgtgtacgattcagtagcattaaatatattcacagtgtgtgtaacaatcaccattatctataaccataactagcagatttttgtcatcccaagcaaaaactctgtccccattaaacagtaacttccccttacctcctcctcctcccagcccctgacagccacgctgccactctctgtctctatgaatttgactactctaggtacctcacataagtggaatcatataatatttttccttctatgtctggcttctttcattaatcataatattagtattttcaaggtccatccatgttgtaacctatttcaaaattttctttttatagctaaataatatcccatcatatgtctggaacgtactatgtttgtttattcatccatcgctggagactgggttgctcccaccttttatctattatgaataatgctgctttgaacatgggtataccaatatctgcttgagaccctgctttcaatttctgggggtatatacgtaggagtggagctggtaggccacatggctgttctgtttaaccttttgaaaaaccacccagtttttacctcggctgcacggttttacatccccaccagcaatgcacgagttccattttctccacatcctcaccgatacctgttgttttgcccttttacttatgataactgtagcagtgggtgtgaagtgtggtccagatcatgttgcttcccatgacgtgtctaacggtcttaagccagaggagaggctgcctgggtttaactggaagagcaatctggttctgcttgtgtgcctccccttggggcatccgattccttccattgcagtggggactgggtgccccgggatctccctacatatgcccaggtcactcatcttctggacagtggccaaagccactgctggccactccttcctctcccagccaccccttgcccctggggcccggagtagccgatgggaatcaccccacagcttatcacccctaccccaaaatccagggtctgggctttccaaaggccaagattccaagagccagagttagggttgtgtggtgggagaaacctgctggtgggtttctagaagcctgggttcaaatcctggtttgtatttgggatgagttgcttacctctctggcctcagagcatcctacctcacccacagtgaaatgacacagcactgtggcatggggacaaggtcagatgcaacacttttatgaaatctctccagggtttaccacgagtgaggaaggctgaggcaccaacaggcatcactacatagtgtggccagagctccacctgaggtgacgggcgggcctgggcatgcagcgggggccaatagtgaaaccaccgggggccaatagggataccaactcatcctggttttagcactgagagtcctgcatctagggaaaccccttaacctgggcaaataagtaatatttagtcaccctggaataagactggcattcaatctgcgagcagctgaccctcgagctaggtcttttttttttttttttcgagttggagtctcgctctgtcacccaggctgaagtgcagtggcactgtcttggctcactgcaacctccgccttccgggttcaagagattctcccacttcagcctcccaagtagctgggactacaggtgggcaccaccatgcccggcttttttgtatttttaatagagatggggtttcaccatattggccaggctggtctcaaactcctgacttcgtgatccacctgcctcggtctcccaaagtgctgggattacaggtgtgagccaccgcacctggcccaggctaggtcttaaaagatgaaaacaatttgctaggcagatcgcagaagccttgtgcatccagcaaactgctgattcttcaatctggctggagcccagcagtgctggggccgggggaactgagggtcaggcaggaaagatggcagatgtccctactgctctgtcccccatccctggccggggctggagaactggcatttccacctactcctcgctcttcttgttaaggcttgagcgggagcacgcaacccctgggccctggtgtctgagcagggtgggagtaagacacagctagaaggcttctgctatttttctctctttcaagtggtgacacgtagggggatggagggcctttcagagagacaggagcccccagggaggagcaggttggagaaacgctgatcacatgtggagtgggaggggcctgtgagtccaggtgtggctggatcacccaagcggcttcagcagtgcctggcacatggtaggtgctcagtaaacacttgcagaatacatgaatgctctctttacttcctgagtaacccttagtctccttgaaggaggaagtggaggtgtctgtgtgtgagccgcctccatctccgggggcccagcagagagaagggtgaacaggagggccccagtaaacgacagcaggtagctcaggggctctgctgccaggaggctggagccacaaagccaggttgaccaccttctgtcctccgcccacagaggctccagcgggagaagaagcccaataacttgaatgacaccatcaaggagctgttcagagtggtgcctgggaatgtggaccctatgctggagaagaggtcggtgggctgccggcgctgcgccgttgtgggcaactcgggcaacctgagggagtcttcttatgggcctgagatagacagtcacgactttgtcctcaggtgagtgccagaccctctcccaagcctaccgtgctgcacccaggggccccttggagctgtaggaagcatcttggctcaggctcaggaaggcaaggttcagtcctgggactgaacttacccagggaccccaggctccacactgcaccccctgggcctcagcttccccatctctgcatcattgcaggattggaatggactagaagggcctctgcgtgcagagaggaagccatacacgggaggtcccccgttgttgggagcttggcacatggaggcctggggagagggcaaaattaatgtgaggactcttatctttaaaattcatccccattttgtaatctaggccataataaaaccacatattttatgtaaaatatattttcccctgtcgccaagtgaaacagacatttcaggaagatgccccaagtctgtcctgggtctcctgccattcccactataccactcacaagtgttccacgctgagaagtgcaggggtgggggctggccatccccagcagccttctagaatagtctctcctgtctgtgattcctgactttagtccttagaccacttacctgcctctcagagcctcagtgtaccaggtgtcccatgggtacatccatggtaaggatcagagtcaggtttccttgactgcaaaaaaagggctgtggaaatatcctttggatgagattgtctgtgacaggcgggcagtggtggtgatggctagactcccttgaggtcatgaaagagagaaaaatagcagaagccttccagctatgtcttcattgtctctattttacagatgaggagaaggaggcccggggaaggcaggtgacacccctgaagtcacactggaggctcactctctcggagctctcaggctgtctgagaacgggtgcccgtgctacaagactcagctttctccccttctctcccaggatgaacaaggcgcccacggcagggtttgaagctgatgttgggaccaagaccacccaccatctggtgtaccctgagagcttccgggagctgggagataatgtcagcatgatcctggtgcccttcaagaccatcgacttggagtgggtggtgagcgccatcaccacgggcaccatttcccagtgagtccctcctgtggccccgcctcgctgctctgccccttgcagtggcaccctgtccccccaccctgccgtggtcctgctgtgcctccaccggggtgcctcccctcccccagcctcctccggcacacacaagcccagttcccgtggccgcctccccgactactccaactcttctctccctatcacttaacaaaccacaagctttagtgtcctcttgctaacaattcctgaagggacctccacgcgccctggagactctatgggaaggggccgccactagaaagggtcagcccatgtgagttcagcctccctttatttctgaagtgcagcctgacaaataacaacaccttatttttcaaacttatgtgagcgtggcagggtgagggttcctaagaaatgaggagtggggagtgcaggtgcagcctgggcccctccccagggcaagcagtgctgagcaacgcggctgtggcttccctgacaatcaggagcttagtttcctgagcagacaccgcacgtggcactcggcacatattatctcaatgaatcctcacaatagccattatcattagctcctcccagtgaggactctggagctcggccaagcaccttgcctagggttgaactcgacacagagcctgtgctgtcatctgacccttactgaagggaagtgttttgatgtccaggtttccacaagctgtctgtcttctgccaggttttctaggaacagagctagcccccggatgtgggtgcaggagactgtggagctgtgccctcaggagaccgggagtgagggaggcagaccggggcggggtggggtggggtgggacccaggtccagaagtggctcagctgcagtctctctgggagcaggaatcacacccgtgggaccagctttggcacctttgcactcagggtgcatgcaaccgcccaggtgagaaaggggcagccgcgggcctcaccagccagtgccccagcagctgggcaaaggtgctctggccctgagaggtggaggcaccacggccccactccactccttaaggctgtgcttggagcaagtcctcctcacctttttggggaatggggccaaaacccagcagaatgtcctcaaattaggaaaggccgtcctctggtgtctattggggcttgctgtgggcagaaacccggctggggtagggaggtgggggtccctgagggaagctatggggggcaggagaggctatgcctgcttcattatctagccactacccccagagctgcatgcccaggttcctgggcctgtcccctgccccattaaccagcttctctttctccaactgcagcacctacatcccggttcctgcaaagatcagagtgaaacaggataaggtgagtggaggccccggcccctctgttctaagttcaggcttcctcatctaaggctctgctctaaggtacggcattgagttgcaagacagcccccagatccccaggccgctggaggtagcatctcccacttagctatccccctgggggaagaggtcaaacactgggagagattctcaaagtggggtcccccgggccagcagcatcacccgggagtttgtcacagatggacatcctcaggcccatctcgaacctactgaatcagaaaccctggctgccccgcattctggttttaacacattctccggggacccctgtgcttgctgcggtttgtgaattactctcaaagccaggctgcacctcctgcttctccatctctttccatgtctccatcttccccagcaggcccctggcatggggctggccaagagatgggcaaagggcagaagaaggagggaagtgaggtacccaccacactggccttttgcatactctatcaaacttagataggctcggagaggtcaggaaacttgcccagagacacacagctagttctggataaggctagaattgaagactccccgtgcctccagcatcttgccctttgcattgggttgtgctgcctcagggaagaagccacttatgtgtctctatagggtggggttggtggaagggacagcctcctagagatggtaggaggccacactgagaggtgaatggtttaccagagacccacagaatccacccttccagtccattcctaggggctggagtttggctttctggacgtgcacgccctctcctgcctgagaattccctttcgttgtgctcaaggcaggctttgggtggtggaatcaaggccaggcctgatatcggcctcctcccagctcagccactgctggctgtgtgacattgggcagatcacttagcctctctgggcttcagttttcttatctgcagcatgaggagagggaaacctgggacatgaggtcattttaaggattggcgatgattccagccatcatcaggtggcttggtgcatatgtcttcactcactgacagtgtccagtcccacctcacactgttccctggagcccccttctcctgagcagcctcccatctcactccctggcctccttggatttttctgtgtgtcagctcagtgatcctcctcacacggtcctgtagggccctcctctgcatcattgctctccatagcacttattagctcagcacctctgtctcttagtgatgtggatgagtgtccatctttcctacgagcatggaagcccacaagtgcaggcgtatctattaggctcatggctgtgcctccatggccacaacagtatgtacatctgacaggcgctccatgtcctttgccccccagaactcactaagggccgtgtcttcccatccccgcagatcctgatctaccacccagccttcatcaagtatgtctttgacaactggctgcaagggcacgggcgatacccatctaccggcatcctctcggtcatcttctcaatgcatgtctgcgatgaggtatgccaccctccccctgcccacagggctgcctcgaagctcaccgtcctgtgttcccaagagaggccagggagggggagggcaggtagacctagcctgcctcttccggaagctcggattccctgtctctacgacaggacttgcaacatgtgtctcccagggtgttttagtgagtaacagtgctctatgagaaagttctcaggagcaatagttctggcacattctgtgtaagtgcccaggaccgtggtggtggaagctcggatctcgcagcagattccggatacagaagcggattctcatagcgagagttgtctaaggccacagttctcaatcccacttgctccttagaatcatctgtgggtctaagttccagcacccaagccacaccttggcccaattttaccagaattaatgggagccaggtacccaggggttccactgtctaccgaggttgagaacccgtgatctcgagaagcatgcatttgccttcccatgtccttcgctgtccgctaggctgtgttcgggtttccacttatgctctgagaggtttgctgccaccccaggaagaggggcaggagggcaggccacacagcccccacttcctccctgatgttgggttcaggcagggccctcacgtgtcccttcttgtctcattcagcccagccccagccccaccctgcctggtgcctggtgggaatctcagaaagggtcagaggcattgcaaggcaggtccccaggctcagccccaccctggtgttcccaggtagaaacatgggtgcccctgtcatttccccaccccacccacctccagccagctggtcccagacccttgcttgaggttctgctcaagagccctttctcccatcgtcccaccgatttggccctaacgttcttgccctggagcaggcccatgtccatgttgcatttcctgagaaagccacatgtggcatggtgctgtccccgtcccctctttgtccccacccctccaatctatcttccacgctgcagcccagatagcacgtcctctccctggaagcccctccatgcaattccttctggtcatcttgtactcattttccaagacccaactcacatgccacctcctctgaagagcttcctctgacctctcagggcatagctcctccctcctctgtgctgcgggagccctgaatttagccccatttccaacaaggaccactcagtcagtgactccaagaagctataagctccaaggctgcttccccctgcagctgcccagctggcatctgatcaagctctgcctgaacttcagtacagccagcagggtgctgggctcagaataaatgcacagggtttgtcatgtatgtgaaaggcctggtctagtggccctgagggcgcctggaccagatgaatgttggccacagagaagaaagggatcagccctgccctctgcctcactgcaatcatgattcttggacccattttccagatgaggaaagtgaggctcaaagaagtgacttcacatgcccagggcaccacggagtggcagagctgggatttggggcagtttgcttggccccaaagccctgctctccttccactctcttccattccacgccctccttcctattccttccctctgtagctcctcaatcctgggagaataggttgcacttgctgcagaggtaagacccgggcccctgagaccacccagatgcagtaatctctcagggtgcttctggaattagacttgagttttacttaacttgcatttgcttcaccaagactctgagagttccaggaacgtagagaagggtttttaatgaagggttagtcagagtccttggaaatgctgtttatggtcctgtgggattccaggaacgcctacaggcttcctttctcagaggtgccaccagcagccctgctgtctggttctcatctttgctttgctcccacaggtggacttgtacggcttcggggcagacagcaaagggaactggcaccactactgggagaacaacccatccgcgggggcttttcgcaagacgggggtgcacgatgcagactttgagtctaacgtgacggccaccttggcctccatcaataaaatccggatcttcaaggggagatgacgcagtgaagggctgaggatggacgcactgtcacacctctgcatttccagccccagcatcttgctggagccgttccatcccggagcttggaggggcagcctcaggtgtgtgcctgggcaccgctcacagcctcttgcacccagccgttggcagcatctactcagcaaggtcactaagctctgccagcgtggcagagcatgtcttggaacctgtcttgagtggggacaacgtccccccactgctgccctagagctggggagacgctgggaaaggttcaacctccacacactaaaatcattttggctcctggggcaagcttggggaatgaatgtggaagatgcctatattctgagagacaggacagtttcccaggaagatgggcagagacttgagtggcgattacctccagcacagagacgtgccaggcggtgttggcgctcggggcgagatgctgcccttctttgcacgaagcctggcctcttgcttggcgtgataaccctgtcatcttcccaaagctcatttatgagccaccagaggctcctaccccaaagattttcacagaaacttgaggccaggtgccgtggctcacacctgtaatctgaacactttgggaggccgaggcgggaggatcacttgagcccaggagttcaagaccagcctgggcaacatagtgagactcctgtctctacaaaaataaaagatttaaaaaaattagccaggcacggtggcacacacttgtagccccagctactagggaggctgaggagggaggatctcttgtgcctaggagttcgaggctgcagtgggctgtgatcacaccactgcactccagcctgggcaacagagtgagaccctgtctctgaaaaaaaaaaaaaaa

SEQ ID NO: 8 - DNA, 22108 bp, Homo sapiens
gttggtgacgtcaccgcgttcaccagcccggaagtgcgcgtggcggcggtggcggctgcggcaacagcggggccggtaagcgggcgcgcgccgctcagaggggcagagttggtggcgtgagttgctgccccttccttcctgctgtgggccagaggcgccaccgcgcccggtcctcgaggaagacgggagcgggacgtggcgagaggcctcctcagcagtgggcaaaatagccccgacgcggaggtcgtgtccccgccacgtttccggcgaccgcaggcgcggattccttggcttccctcagcactttcccctccgcgcggacggccccgagacgctttttcactgggccttgtcgccagcacccggcgtggggggtgagacgcgccttttcagggctggggttccccagagcgttttcctaagtcgaggcggaggtgcgaggaaactgagtgggtctttccgccccacgtggcctgccgggaagcgcggctcctccacccgcttccgtggaatggaatggtttttctctgcaggtttacaccggggtcactcgagagctgctgcggcctccttatgggcaggacccccgtatggggagaacgaggatgtgatatgtagaagggaaggccgcggtgtgccagaaatcagaggagattgcaagatggcaggaaaagaatcaggaaaatgggggcagcaaaactaaattcatgggaaaatacaatgtctaggagctatcccagggtcgtgaatcctcgagtgcaggtggggaagtagggtgatacccacctgtgaccatgacaagttttggagaccagaaactcggttagagtttctagaaccccgcatccctctcatactgcctgaagccctgctctggggagagtgtcatcacagtaccatgtggcatgcgagtgtcgtggtaatgctccccgaccaaaccaccaaaccgagggttgggctgcttattctcgctgcccaataatgagatgcagataaactaggaaagaaaggagtttatttctgtaaccaggtacggggcgaaggcgtggaaaatatcccagaccgactcagaattacagagctttccagagcttatataccttgtaagttgtatgtttatgtgtaagtgtgcattgatctaaagatacaagtgattaacttcttacccataagatctgagtcctgaagaccttcctctggagcctgagtaaatttacttaatctaaatgggtccaggtgctggggtgattacccttatattctctcctgctaaatcatggaggtttggggagttccctcagacccctaataaacttgttcgtggaggcctggggagtttcctcagatccccagtaaaacttgtttaattctaaacgggtcctgttaagaattcctttgtggccgggctcagtggctcacgcctgtaatcccagcactttgggaggctgaggcgggcagatcacttgaggtcaggagttcgagagcagtctggccaacgtggtaaaaccccgtctctacccagaagtataaaaaattagccggatgtggtggtgtgcgcctgtaatccctgctacttgggatgctgaggcaggagaatctcttgaacccaggaggcaggggttgcagtgagctgagatcgcgccactgcactcccgcctgagcgacagagcgagactccatctcaaaaaaaaaaaaaaaaaaaaaaagaattcctttgttattttatcatgcttcaaggtccaggaaaggcctaggcaaaactcttggggggcttttgttacattctagccttgtttaagggcactggctggctctttcagcttttaatatgtaactcaaccagtcagtcagtactgaaacagttatggaggcctgcgctagtgagaccccgcctgccacagtaagtgcttctggagaacaaaaccaggtagatacatagacctagtcgtaatccctcaaactgacaccgttttcagttttttcatctgaacaagagatgaatttctgagttgataaacttgaaatgtgtccccctttgttttccttcacttaccttcacttttaatttcattggtatgcctgtgtatttgccttgtagatgtgtagttggtgactgcctctccagatgctgaggtgcctgtatcattggcacaggccagtgctgaaccgtaggtggagtaggctgtgccttccgaagcagtatctattcacaatgaagttgcagtctcccgaattccagtcacttttcacagaaggactgaagagtctgacaggtgagagattaggataccttttcttgattggaaacctatataaatggagaagtagagggttaactttttaagccagcattcggatattttcattgttgttttaattatttttattaaaaaacgtaagtagagggtctctttgtgttgcccaggctggtctcaaaactcctgggctcactccttggcctcccaaaatgctgggattacaggtgtgagccacggtgcccaatgtgcacgttttcattgttggaagaaaggcttggctgggtgtacccagcctgtaatctcttggggaggccaaggtaggaggattgtttgagcccaggagtttgaggctgcagtgagctatgatcatgccactctagcctgggcaacagagtgagaccctgtctcaaaaaaagagaaaggaatattaaaagagaaaggcttacatatggctgatccaaaaatatagctaaatcactggaaaaggcaagaagttgactgcagtaaaaagcatggcttttctgtatgctgtgctaagtacttgccattcattacaggactggtgctactaacttaatgagtacgcacattttgacctgttacgtgaaaaaggaaacagattgttaggcatgtgaagtgctttgcctgtgtttctgtaactactaactagagagctaggtttcgaacttacgcagattgatttcagagcccagcttgcaaccgctaagctctgtttccttcctaggtataaatgctttccatgagaactgaaggaagaaggaaataggagttgcctccattgtgcacgttgcaaaacctgtctggaaggagcataggaaatggctttagctaagtgccagtagcttcttgctgttgccacagtttcattagtgttgattctcaatgttgtctgctgatgttgctaaagcagccacacagtagcattacaaagcctgtgggaattttaatagcaccttcataaatatatttagtagtatatgtagaaatatgacctatacagcactggctatctattagattcacctggggagcttttaaagcacacatgctcgggttctacctgcagcctactgaattagaatctctgggtgggatgaccatctatatttttaataaaagctccacaagttaattctgatgcacagaagatagacgaaccattactttaacatgactcaccttgtattagcttattctcaaagctactttcccattcttgaaattggatgatggctttttaggtacgtgccagagataaatggcccagaatatgttgattcttttagattgttttaggcagactttaagtagagggcttaaatgcatgtttggttttgccgatgcttcactatcttttttaattggagagagtgaaaattgctaaaaattgctgtccaatagaaatttatgagcccatatgtaatataaacttttttactaaccacattaaaaagatagaaatggtgaaataaattttaataattatttttggttcatctaatttaatccaatatatctaagatactatcagtatgaattttgtataaaaattgttaatgaggccgggcacagtgtctcccacctgtaatcctagcactttgggaggctggacatggtggctcatacctgtaatcccagcacttttgagtggctgaggtgggtggatcacttgagcccaggagtttgagaccagcctgggcaacacggtgaaaccccatctctactaaaaatatgaaaaataggcaagcatactgatatgtgtctgtagtccctgctacttgggaggctgaggtgggaggatcactgaagcctgggaggggggcttgcggtaagccgagattgtgccactacactccagcctgggcgacacagaccgtgtctttaaaaaaaaaaaaaaattaatgagatattttatattcttacttggaagtctttgaagtctggcatgcatttaatacagcacatctgaattcagacttaccacattttaagtgctcagtaagtacaagtggctgctgtttgaatagtgcagattttgaagctgtgattttgggttgagttgaagcttttttctttctgtgtatgcccttcacagcccccaatttttcaacttcaattgcaagaggcctcttggaagaaggagtagtaattaactcttgatggcctaactcaggtcattctgcattttttggaaataaggttctaaatattgattactatagtttcttgaacatcattttaacaattgtgtttaacgttctaaacctgaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcgaggacttcatgtccaaaacaccaaaagcaatggcaacaaaagccagaattgacaaatgggatctaattaaactaaagagcttctgcacagcaaaagaaactaccatcagagtgaacaggcaacccacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagagacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaattaaaaaaataaaaaaaaacatatacctattgaaggaaaaaaaaaaaaacacaaaaaaaaaacactggattttctccaccctgagaaatgaggtcctaaggaagttagagcctaaatggtgtggtaaggtagaggtggtgattgcttccagagtcctgtccttgaaggactggcaaatgagaacatggatatattctaaagttgactttttctaggctactggagaagtggcaagaatggaatcttttagtgcaatgatcaacaagttagaatgtcaaagacttgggtgccctggtaaaatgtaatgttctgtataaaatcaaaatgtacaaaaacacacagcctttctgatggctgctatatagtgatacttggagtttaaatcctgtaccaattttcaaatcttaatagctgctttgccatgtgtaaaattagttttcagtatgcaagaatatgagagactagaatagtgtattattgtcatatcataagggttttataatttgtcaggttattttatgtatctttttgcttcagtacaatcatatgctagtggcatagaagattatttcccagctagctgtggtagctcatgcctataatctcccagcactttgggaggccgagatgggagaattgcttgagcccaggagttagagaccagcctgagcaacatagtgaaatcccatctgtacaaaaataataataataaatttagccagttacagtgatgcacacctgtagtcccagctactcaggaggctgaggcagggggttccttgaacttggggtcagggctgcagagtgagctgtggtggtgccactgcactccagcctggatgacagtgagaccctctctcaaaaaaaaaaaaatgagagactatttttctgtcctagagatgaggctgaagttcccaatgcagacgatttttgcctgagctaacagcattaatggatgagcaaggacttgtttagtcctttggctgttgtccacagggggtgatagcgctcagtgttatgtgacgtcagaaggccatcatgttaaaatatagcacgatagggacaactgatcactctcttgaagtccggagctcttagaacagatggtctgtttttctgtagtaatgctcacaccatgtcttcccactcatagctcccactcactgccccttaccccaccccagcctccagtcgtcaaaatttaaagctgtaaagggaagacgttcatgaaaatttaattaaaagttaacattaaaaagaggtgacagttataaaagttttctgacacattaatgtatggtcttttgaattgctaataataattaacaattgcttactatcagaggtggcatttggagcaaataaacgtagtttggggatgatgagattctgcattctttgacttttaggcttaagtttacagttaaatttagttacattaggtgttattttcactgaattatttcattgaatgtagctcgcaaagtcttttgaaatgttgactgcctccctgtttctgtaagattgaagatatcagtaacaggaataaataaatcttgaagcttgatagtccctgctgttttaggccaatgtgaaattatgcttttcttataatttttatgactgctctttcatatagacaaatatgccttgatacgtctttctcagttgtcttaaatgttattttaaaaatcctgaatggcaaggtttttggaatggtttaataacataggctaatcaaaatggtgaatatattactttgagttctggatctctttgtaatgcagttagcttactgagtaaatttgaacttatcgttttattttagtaaagccagcatgagaatcttaaaacagtagttatctgtataaattaagccttgaccttcttcatcccactgtttatagtaagttcaagtgaacgtaaaacttgtcctttatttgcttgaatttcagaacagctacttgataccgttttaagaaaacttaaaaaaacccaatacttaccagtgaagtcattcttttttttaatagttagaatatcataattcagtttaattatgagccagattggtataaagatgaataagataggttttctaccctgagaagtggggagacaaagacataaaacaggtaattttaatataattggtatgtataaagatatgctgtactagtcgcttagaagaaattcacctaaccttaccttcaggtgaggcttcctaaagtgagtcacaacagataagtaagagtgagctagatcattgttttccaactgggtagttacctcttagtgggccatgaagtcaatttagtggtcatgaccagtaattaaaaaaaagagagaatagaatagattgcatggtacgaagggtaggttttcttttatgatacttttgtttgccatgtagacatacaaattttggtgactgctatgtgaatgtcttagtgtgggttatgggctaagaagtgtgacagccagccactgagctggagtaagttggggaggtgtttcagtgaagtgactcacacaagcaaaattatggaggaaaactgtggggagagttttgtgcagacagctggtacagacagtgtgatgcagagtttagcaagagatgagacaaataggtcatggaagcctttggatatagcactgaggaatttgggtactgtgttgtgagtagttaggaggagcagttaatgcgtagcgtaattaacctagtgttttaaatccctatgtctagatggtggaggctggatttaagggaggtgatgtggtcccagaagtgggctttcatgggaaatgtggcattaggggaatatgaacacttccccttggggagagcttgtggaaaagatatccttaattaagtcaagagggtagggagcatttgttacttttaagtacatcattttaaggagtctacagagaatggggctgaaaagatgtgggaagagtaggtggaagaggagtgtgggcaggacagaaaacagatgttgaggtagggatagaggattctgttttgagttgtgattagaggtgctggaactttgatgtatgatgagtttagttgaatgctcgtgttgctgtctgctagccaaagaccaacagggacacaagttgggttgttactcctggcagtgaggagcaacatgctgagtgaggagtagcatgctgacactggagaacctggaggtatactcagtaagagggctttagaaatgacttcttataggagttgggcttgtattgggtcattttggagagcatttaaggtagtagagctttgcagcgggttagatgctctcaggaagcagaagtaattctgtgattgggtgtcttaataatggtttcctagaagttgagtacagttgtgagactaaacctaattggtaaggcacagtcactgttaccaactattgtagggtgtatcatggacagtgttcatgtttcgtgtatgtttaggtgattacagagttgtcttgatcgatccatcgtggtcacagaatgggcttgtctgatattgatgttttgtgaaaatgtttctgtaccacagaccccagggcctaatattgtggcaggctagctcctggatgccattctcactaggttccatgtggacatatggatatagttatagtggattttgccttatcctctacatatagaggagtcagctatgtagttgcttatagttgttcagtgttcaaatggttctacctagagcacagataggagttgattttagaattatatacagaccatttcttgaagatttttagctataaacattaatcataagtggtatagactaatgtctgatagtttcatgcgtgaacatcctgcctcaacatctatctgtaaacacagagaaatacaagaacatgttaccatttctaaagtatgcacataaatggggaaaagaaagcagaattgtttgatttactttctttttttttcttttttttttttttgagataaggtcttgctctgtcacccaggctggagtgcagtggcacgatcatagctcaccgcagccttgaactcctgggctcaagccatcctcccacctcagcctcccaagtagctgggactacaggtgtgcgccactgaacctggctatttttattttttgtatagatagagtcttgctctttgcccaggctggtcttgaactcctgggctcaagtgatcttttcacctcagcctcccaaagtatcaggattacagatgtgagccactgcgcctgacctgctttagtctttagtaatacttcaaatttatattgatcactttgaggcattgtggaattctgaattatcttctgaataagcaaagaattctgcaagttctctgtttcctgttggtcctcagaggcactctcctgtagacaagtctttttacttctttgggccttgttctcatttttcatatgaaaagcctcagttaaatgaatctctgctgttccaactagatggaaaagccttgtacttttgtggttaaaataaacacattgaaataaagaacttgggaataaaaatcttattttctctcatctcagaattatttgtcaaagagaatcacgaattaagaatagcaggaggagcagtgagggatttattaaatggagtaaagcctcaggatatagattttgccaccactgctacccctactcaaatgaaggagatgtttcagtcggctgggattcggatgataaacaacagaggagaaaagcacggaacaattactgccagggtgagtcaaaagtttgacaggtaattacattgcttttttggtaatttttaaaaacttaattttctctagttaaaagcaaataacgaaaagtctaataaaaaagtcagtctcttctatgcccgtcataaaccctgcagtcctctgttcttgcagccatgtttactttttatgttacctctccatttctaaaaagacctttgtatgctacgggtatttacttttcagtttttactatcccagttttaagatgtgttacgtattgactttccataagggaagatgatttagctttcttaccacacccttctcaacaacaagcacgtataattctccttcttctgtcttcctagtatatttatatcataatttttggttaagtcaatattcagggttcacgtttatgactctgtattgtttacagccagattgtggagtatattgtgatgacatttcttctattggcatgtttttaaattttcctgcagttaatggcatttttcttttacataagctttccatatactaccaatttattcctgcactctgtgccagagctatagagttcctctcaaaagatttaaacacattatatcaagtttcaattgggtttttgggaaacatcttacctggtgctgtcttcctgctccaatatggacttttaggaatttccttggcctctcttttttgttaagcctcctgtttcctgggtcccatgtgctgttctctcttggcttaagccctcattttaataatccaaaacctgaggaagccttacacgtctgaaaatgtttttatttcacctccatggtggtttgatagttacggttatagaattctaggcagggaataatttttactcagaaatttaaaggtattgttttctagcttccagtactgccagtaagtctagttccatttagatttctcttttgtttaaaaacctgattgccattatttccttttggaagtctttctgatcttttcatgtctaatgtttttaatttcaagatgatataacttgttttggatttttcacttactgtgcagggcacttagtgggccctcatgtttctttcataatttcatcccttttgttaaatgctttttcctttggaaactcttattatttggatcctggattgctgggactgaccttctagttttatcttttgtctttattttatattctcctgtcttactttctatgagagtgccttaacttcatctcccagtcattgtataatactgacaacttctgtggtcttgtagaatttcaagaggtctttcttagtatatttctttggaaagcttcccgttcatgtttcagatggaagatcttttatttctcttaggatatctactatagttattttgacagtgtctttgtttcctccgagtgttttctttcaggttggctttccttgaatttgggtgatgctctgtatctgagggctttattgtagttttgcatgggaagtgtcagccaactgggactcccagtctaagtctcagtaggagttttcattaggagaaatcagagaagaatactccagtattatgccagggaatgaacctgattgttagcatcttgaaaccaagtagggaaagggatgagggtcatgttaattttcacttgaatcttgttttcattatgatgcttcattcccatgagcatctgtgcctggtgcaacaagttctgattatttttggttgaacctttctagagaatcagtccctggttttctgcctcattaagggagtcattctaggtgggtctgattatttcttaaaatgagttgcaaacagttttcctatttcaaaccttaccttattctttgccttcagagatacttgtgcctcaaattcttgagttctggaattctatagtgagagatagatgtagcttgtatttagagaagagtatgtatcaaattgagagaaatcctacaacagacttctggtgatcgttaacggctttcacttcctaaataaagacattcctaactcttggcacataaaacactttattctctactcctaaatgctaatatgctacctgtcagatatactttctcttttacatatattcctcttcctccaccgtgcctttggtcatctcttctcttcatttgaagtttttctaccacacctgcatgtacaaaccctgctgctttttcaaggcttggcacagacgccaccctaacatgaagttactcagcttccccagctggaggtagtctgtcttcccaagatagaggtaactctttattttaatttctttctttctcttttgagacagggtctcactctgttgcctaggctggagtgcacagtgtgatctcgactcactgcagcctctgcctcccggggtctagcgatcctcccacctcagcctcccaggtagctaggaccacaggcatgcaccaccacacctggctggtttttttgtatgtttggtagagatggggttttaccatcttgcccaggctggtcttgaactcctgagctcaagtcatctgcctgccttgacctcccaaagtgctgggattacaggcatgagccaccacccccagcctttattttaatttcactggggattatcagtaagggagttgcaagatctgttaactgtacttattctttatcagtctttcgctcaatggcaaatgttccataaattgacattcacctctttgcaaactggagctattaaaaatatttctgataatagcttgatttgaaattgaagaacagttttgagtttgatgtggagtttctccacatcacttggcagaggtgacatgtttgtgtgttaaactcatcttttttaatcatgatggattttttttaaaaaaatcagtcttttgatctgtttttgaataatgtggatatctttctgtttcaatgtttaggtatggtagttgacgttaaaaagactataactgtcagggcttatagtaccatccctttataaagacaaaaacttatttttttcaattcagtagtatgaaaacctaatttaaatgacaacaaaaaccccatgtatttaattgcagcttcatgaagaaaattttgagattactacactacggattgatgtcaccactgatggaagacatgctgaggtagaatttacaactgactggcagaaagatgcggaacgcagagatctcactataaattctatgtttttaggtaatatttgcagataaaaccatattgtgagtctatcagaatgccttcttttcaagtaaaacctacattctggaaatgttcttcaacttgagaagttgcattaatttcttctaagagatggtttagcagattgcttcaaagaatagtccctcagccgggcacggtgggtcacgcctgtaatcccagcactttgggaggccaaggcaggcggatcatggggtcaggagatcgagaccatcctggctaacacggtgaaaccccatctctactaaaaatataaaaaattagccgggcgtggtggcggctgcctgtagtcccagctgttaggcaggagaatggtgtgaacccgggaggcggagcttgcagtgagctgagattgtgccactgcactccagtctgggcaacagagcgagactccatctcaaaaaaaaagaatagactctggagccaaaatccctgggttcaaattctgactccgtcactcactagccacaaaacaaaaacgttaattaatattggcttcctttgtaccgctgttgtgaggtttaagagagttaattgtaaatgcttagaacagtgcctgacacatgtacacactcagtcagtgctaacttcttaactgcatataaacatgatttcagggaagagaagtgcacacacacatggtacatgtacatactccacacacatctacacacacacacacccaggatcattctttttcctttgcactatctttcatgcatgtttattcaatctttcttctgcttccctggcaaacaatggtgaatgacttcagcactttttactgctgagcctacacacaacctcagattcttttttagcattgtattctaggaatcatcaataatcagagttggtatgtaagatgaaacctatttatttcagcttaacttttttgtttaatgaaagcactgggaattatatgggggctagatacgaattaggttagtgttttgatacattactgatgcatcatatgttgtactttaaagttaagacaagccctttatgtttaagattttggattaaaaaaggatgaaacatccactgttcataacctagtttgtagcaatagtagtggtaaaaggatgaagtaataggatttgcttcatgcatagatgggcaagaagtttataagctaaggtggcatctcttgctgattacagtaatgacagatacaatttctagggtacctactgggttctaggtacaacattgggtacctgatatactttatttcattaaactctcagaaaaacttcataaagtatgttaagcccacttgatagaagaggaaacttgagactgagagatattaagtaacttagtttaagtcacagagaaccatgattttggcttgtttccaaggcctaggcaatatatgaccatagagagcccaattggtgcatttttctctcagttaatgtagtcagagctccaggtatttatttattctcatatttactcatagaggaagctgctccaaatagtgcaatatagagtcttgtctaactggcttctcataagcatactgaaagagagaaactaatactctttttcagtgtcctagtttataaaataaaagttgttcctattggtactatcattttctgacatttactgaacccttataacatgtcaggcactgttctgagcacattatgtaaatttaatctcctgacaaccctgcgaagcagatactgctatttaaccgatggtaacttgcccaaagttgcacagcttgtaaagtgtaggatcagaattccaactcaggcagcctgactccagaggtcacattcttaaccactacattattccctgcaactcaaccatatttcatatttttatttactgtattttaaaaggatgatattcagagcaaaacaaaatacacaccagtatgatgcttactaagctttgtgtagttttctatcctggctttttccaagccttattggatcaagcattcatagttctggcatttatggttggttactttgcttcccaaacgcttatttttgctttgatcatattcctatgattttttcctccaaattttgatcttgcctttaggttccccagggacggttacaagtctcttcattaggagaaataacaccaagatggatataccatattatttgctactttgtgatcatatttttgcctatttacatattttctttttatcattttcttttatgtctttttgaatctggagccttcgaaatttgccatgtatgtcaagatggttcccttttaaaagttactatgcatataaaactattaacagcttggaaagagttaagcattaagtgtgaacttaccaatgtactgttgcttttgggataatcagagaacattcaagttcaaacacagccaagaggtatttttgataagtagttgtcagtgcctcttttctgtaatgctacagagtgaagtatctcatagatcactgacctccccatttggtgagctgaatggtgtctgtgtttcggctctaaattcctttttctatttttttaagtctccatggtaaccaactgtcttagtttgcctgagcttgaaatacttccttggatgtatgattttcaactttaaaactaggaatgtctcaggcaaaccagtatgaagtggtcactctactaattaatacttgaggttttatgtacatatatataaaattagttttatgtcacttttttcattcaacatatgagaacatttgtttattaccatttttgtgaatggctaatagattaacatggttcaaaattcacaaagttttaaaggctctacagtgaagtctcctgatctgtaatgaacaggactgcccatttaaccacacccttgctaacactgttatcaagtgtttgcatcgttgccgatctgaaagacgctatcttggaaatgggtatttactggccgggcatggtggcttatgcctgtaaccctagcactttgggaggctgaggcatgcagatcacttgatgtcaggagttcgagaccagcctggcccacttgccgaaaccctgtctctactaaaaatacaaaaattagctgtgtgtagtggcaggtctacttgggaggctgaagcaggagaatcacctgaacctgggaggctgcagtgagctgagattgcaccactgcactccaaccagggtgacaaagtgagaatccgcctcaaagaacaaaaaaaggatttatgactaaggttgaaaatcttcattattaaagagatttctatatttcctttataggtagcctatttttctatttacgtggcctttttattagaacttttatatattatggaaattagccatttttaaaatatggacttacatatatttttccaaaaatgtcacttatgactttgtgtgtgatagtagtttctgccatacaggcatatttcattttttatgtcattcaattatttcttcgaaaatcctgttgtttttgtgttgcgttttctgttttcttgctgagtttgaaagatcttcaagattataaagattccaagattaaaaatattttcctcgtttcttctgttaatcctgttacgtattttttccattttattttggctattattttcccatattgtgaaaattagcttgtatggtgtcttgttggctccactccacctcatacaagttttgcatatttcttgtttagtttattcttggattatctttttagttgcaattgtaaatgcagctaaacagactaaaagacagtcttttattgtcttccatttgatagttgatatgtatgaatacgtatgtgttttaataactgttcactctgctgaatttttactgtttgtgatagtgtttagctgattttcttgtgttttcaaattcttatttgccaatagtgatttttctccctccttttctaatgaataggttttgatggcactttatttgactactttaatggttatgaagatttaaaaaataagaaagttagatttgttggacatgctaaacagagaatacaagaggattatcttagaattttaagatacttcaggtaagaatttttaaaaataaaaaatgatagttttaatatcatgactagagcataacagtggtcatacgaaacccacagcaggtcagtgtacaaaatggtgacatcccaaatgtctgtctccagtggagacctagcaccctatgacttatgagtgaaaattacttagctacttcatattgtattttcattcccagaacgcacatatactttatgtcatctttcctacaattttaagtcatctttttaaatgtccatttttctttttgattgatatttcctccattgatttattaattacacagatgtttgaatgcttaccacaggtcaatccctgtgttaggtgcattaaacgtggtaatgaacgagtgaaagtgttcgccttcatacagcttacggttttaggtagtcatggaaatcggtgatggttcacaacaaaatgattttggtgaaaagaaatacctgttatatgatttaaagaatcaaagcataaagacataatcgaaacttggatgggccgggtgtggtggctcacacctgtaatccccgcactttgggaggccgaggcgggtggatcacgaggtcaggagatgagaccatgctggctaacatggtgaaaccccatttctactaaaaatacaaaaaattagccaggcatggcggtgtgcgcctgtagtccgagctactcgggaggctgaggcaggaggatggcgggaacccgggaggcggagcttgcagtgagccgagatcgtgccaccgcactccagcctgggcgacagagcgagactccatctcaaaaaaaaaaaaaaaaaaaaagaagatcttggataaacttggtaaatatgaaacgcatgactagttttgtgggtagcaatgatgtttaaatgtcacacactaacctttttaaaaaactatccgaattggctagtttatgtcaagtaatattcatttttcactggttgggattgctctcagaatattctataacagaacatggatattttgtcaatgtagtttctctaaacttgagtatttgtagtctgtcttataaataatagaacatagattaagacttagctgtatttgtatcactaatccagatttagcattaatttacttatttagcatcactttggaccgctgatgaattcattagaattttaagggcatgagagggaaacacatgcacgttagggcttccagttctaagattccgcgaaatatactccagggtgcgcaactagatgagtcgtatttgaaggttttccttgaaagtactaatgtgtacagacaggcaagctttgaggaattcagactactctgttaaggcactgcagtcttgttttggtttgctgcctttacaagaatgctgttttttttttcatctagtataagtgccaattcaggaattgcatttgatgaccattcggaatgtcttgagtcagtaatttggaagtgaggtggagaccttgaagttttagttcttgctaacctcaaaaaggctacttatattttattcgatcctgggttttcttatctgggaaaagaaagaggaggtggagaaatgaccagttgctttctaaggtcccttctagacctaactaattatatgttgttttcattaagcagatgtatgggatagtaccaataaaaatgaaaaacagattttgcttgtgatatgccaatatagaggtaataccctgtgaagattttgtcttgtaggttttatgggagaattgtagacaaacctggtgaccatgatcctgagactttggaagcaattgcagaaaatgcaaaaggcttggctggaatatcaggagaaaggatttgggtggaactgaaaaaaattcttgttggtaaccatgtaaatcatttgattcaccttatctatgatcttgatgtggctccttatataggtgagagcaagttataaagtgtttgaatttttggcagtgaaatatctggtttcaaatttcataaggaaaaaatgtttgactcatttggttgaagaattcttggagaaatggagtattttaaaataagacaaagtttgggttatggggtaagttttgtcgtgagtagggaagagctcaaagacagcttgtggtgcttgtagagtagtctctagtcagacctaggtttgaaggaagctcagccccttatctagtctttgcaacttgggttagtttctaacccaaaaaagcggtttaaaagtaatgtagcctctatctaataggaaagctaaaaggattcagtgagttaatacatgtaaagctcttttagaagagtgacttgtacacagaaattgttcagtaaacgttgtaattcattttcacagagaatagtgggattatatggtttatcacacttcggtaagcttgggcatatttcaaatttcagtaacattactgaatggggggtggatcttgtatcagtgtaaagtcaggaatttgtgattagaaagagtatgccttgtgagtctgacaccactgtcaccactacccctggaactcttgatgtagctttaatggaaacaagaacattttagaggttttgaaggtgacaggggagagaataacaatatattagtggttcgcctttaagttggaacatcagactgaacctatataatgtatcctagtgacaaagcatttctggatactaaaatggtggcaaggtttaggatatgagtggttttttatccccactaaaaacaggtgaaaaatgcttttgtccctacaggtttacctgctaatgcaagtttagaagaatttgacaaagtcagtaaaaatgttgatggtttttcaccaaagccagtgactcttttggcctcattattcaaagtacaagatgatgtcacaaaattggatttgaggttgaagatcgcaaaagaggagaaaaaccttggcttatttatagttaaaaataggaaagatttaattaaagcaacagatagttcagacccattgaaaccctatcaagacttcattatagatgtaagtatatactaggcttggtcagaaatatgaagtatcgtcacgaatttagaattaatttattaaaactaagatctacaaatctgtgaattttacttattttaaatgaaaaaatttatgttgagtatttaaattttaggataagattgtaagtgtatgttttcatgtgtgacgaaactaaatgtttgattttgacacgtagtctagggaacctgatgcaactactcgtgtatgtgaactactgaagtaccaaggagagcactgtctcctaaaggaaatgcagcagtggtccattcctccatttcctgtaagtggccatgacatcagaaaagtgggcatttcttcaggaaaagaaattggggctctattacaacagttgcgagaacagtggaaaaaaagtggttaccaaatggaaaaagatgaacttctgagttacataaagaagacctaaaactgatggctactaaaaagcagagcatttctggtaagactaaattttctcccctccctcttaatgaggttttagagactacaccagaataaaagacagtttaggggacctctgtagaacaacaagggtcttattttgtgaattatatatttcaagaactaaacagagatccacctttctggatctgatttatatcactgaaatgtacagttcttttggaatagtttcacctgagaaaacatagttggctattatctatcttaacctgttcaggcttttaaaaaaaactgtttttgcatagggtagtactaagatcttaaaaagtggtaactgtcttgaagaaaaaacgtttattgtttgtttgcaattgaaataacagggttaccttaacaatgactgtctatgatgtgtcagttcttatctgaattccaaaataaacctgtgcttaaaaaagaaataattgaccaagtaagtttgcataaaatgtgaatactaaatgtgtccccagttgctggcattcatatgtacaggatttgttctagcaagctatgcttcagtatgtggttgatatttttctgtcacaatgatttctttatgcatgcagagcctggggaagtcatgggattaacttgagggtcactattgagcctattaattaattattgttttaataaaacaaacattggtattggaagataaatatgtttatgtggtatctgacaatgtgtattaggtgtcatatacaatggtaatatgcctgtctttaaagtgttattttattaattaaaaggatatggctattattatatattctctaaagatttgagtcctaaatgctttcatcaggtaaataaaatgtataatacaaa

SEQ ID NO: 9 - DNA, 12858 bp, Homo sapiens
cgccgctctccgcctcgcttgctcctgccgggcgtgcagggccccgccgccgccatgtcgggctcgttcgagctctcggtgcaggatctcaacgacctgctctcggacggcagcggctgctacagcctcccgagccagccctgcaacgaggtcaccccgcggatctacgtgggcaacgcgtgagtccctttcgcgagcccggccccgccgtccctctcgggacgccccgcccacccgaggctggggtcggggtgtcgcgagtcttgggttgggggagcccgggcgcgatggcccctccgggagccacagcgggggcttgggaggggcctggagtcgacgcctacccccgcgcgtggggccaaggaactggaaccctgcctggccgggcgcggcccttccccgtggcggggtgcacggagcccgggtggcgcctgcccgggtcccagccgccacccgcttggggcttggccttgggcggggtcggggctaccatgttcacttaacaggtgaccctcggtcgcccggccggtctcctgcccgcgcgtcatgtgacagctgcctggttctgcagtgaggtcaccgcggaatgtctgccttcgccgccatggcaacgggccgacgtcacaattcgggcatggaattttcccggcccggcagtcccggatcagggaacctaaacaccccaaatgagcgagtccggggagctgggccgggatttccaggcccccaccttccagatgtgatttgatttacaggagattctagaacggtccagtgataacccccctaaggacctgagccaccacctagaaaaggctcttgacctttcacccccaggctctgtcacccaggctggagtgcaatggcgagatctcggctcactgcaacctctgcctcctgggttcaagcaattctcctgcctcagcctcccgagtagctgggattacaggcgcccgccaccacgcctggctactttttgtatttttagtagagacggggtttcaccatattggccaggctggtctcttggccaggctggtctcaaactcctgacctcatgatccgcccacctcggcctccaaaagtgctgggattacaggcgtgagccaccgcacccggacagtaagagattttttttaatttaaattttaaattttttttctagtaagaatgtctaatcagcaggaaagaaccagtgttaacattctgagatgtgaaataggagcctcaagaaagaatatattagcatgcctgtacagccttggaaagcctcaagttggattttcacgatactctgaggacccagttaccaaaatcctaagcttcatggctcagcccaaggatggcatgttgaaaactcaaaactaaccctcctcccattttacagaggaggaaatggtggctcagagtgtgtgagggactacaaggacagggtcaatgtcttgttcatgtatgtatttcctgacctccgctatgacctgctgtttagcctgccaaggactgccacggaaatgggggtcatcatggaactagaaggggtccatcaggccccagcctcatggggacagttctcatccattccatcattcattcaccagtctgagcacctgctttatgtcaggcactgtacaatgttcattcatagtagagatagtaataatgataattgtaaattttttgaatgttgaattattaatagtattagaggcctggcacgatggctcacgcctgtaatcccagcactttgggaggccgaggcgggtgggtcacctgaggtcagcagttcgagaccagcctgaccaacatggtgaaaccctgtctctactaaaaatacaaaaattagctgggcatggtgcctggcgcctgtgatcccagctactccggaggctgaggcaggagaatcgtttgaacacgggaggtggaggttacagtgagccaagatcgtaccgttgcactccaactgggcaacaagagcgaaactccatctcaaaaaaaaaaagtattagagaagggagatgaatgggagtgactcttcaaagtgtttttttctatcagccactgcttcacagtcttgcgcggtgtcctaagcaggaataaacagagtcccacagtgtcagccaaaggcttcaggaattggaaagctctagagacacccttcctcttgcaccaagcagcaagcaggccttgttagcctcaggaatcccgcttgcttgggcaggttggccattcagctgtcatcacttcccaagtggaaaccaaggttgtacacgtctggtgtagccagagtggcaattgctgatggccactgtagaaaatacatcccttgccctctaagcacctctgaccttgacttggccaggggtgtgggggttcctcaacagggaggatcagtgagcaccaagcaccaagaggatttgggctccattcccttaacaaaatcagggccgcagccacgtcctcacaaggcagagccagagcctgtgtgagccacatgtgccaggccttgggggttttgcagcagatgtgggcatgaggggcagagtgaggtggaagatagagcagggctggatgtcgggagaaaggaggtcttctcccagatctgccaccagcagcacacggggcctgtgcccatccctctgctcatcctgttgggcctgagttcaagctctgttaagcagggatattgccatccttgttcctcacagggctgctcgcagtgggcaagcaagatcacacaggaggtggcattttataaagtataaactgctatttggactgggatgttttgtgagatgaaataaaggggccttttcaccattcagaccaattattatttttattttattttattttatttttcgagacggagtctcactctgtcacccaggctagagtgcaatagcacaatctcagcacactgcaacctccacctcccgggttcaagtgattctcctgtctcagcctctgtaatcccagagtagctgggattacaggcatgtaccaccacacccggctcacttttgtatttttagtagagacggggtttcaccatgttggccaggctggtcccgaactcctgacaggtgatccacctgcctcggcttcccagagtgctgggattacaggtgtgagccactgcacccgaccttagataaattattttgtaacctcccatagttctgttggggccacttactccccaagtactaaatcacccaaaagagctttggaaacgtagccagtggaatgtggcaggtaggatccctctgggggcagggagggggctgcctggtacgtgacaaatttattcttttgcactcattcaccgcttatttattcagcacctactatgtagcaggtactatagcagatggtggggaaacagacttaaagcagacatggttcctctctcaaggagctcacagtctggatgtctaaacacagaagcacaatcaagcattagaatcatagtgctcactaccgtgtccagctctgtcaatggaatagcccatttaatactcataacaacctcaaggagaaggcactgttatccccattttacagagagggaaactgaggcacagaaaggttaaatggcttgcttaaggttgcctggctagtacctgggcaggatgcagacccagttagtctggttccagagcccatctgtaaccagttggctatgtacacccccaccacagcttagggagcatggggccaaatggaatggaggggagacaaacactgcggagggtgtgaaagatgagagggcgcatttctccagagaaggtgggaaagagcattccagacagaggggacagcatggctatgaaaccaccagtctatttggggaagctgctggcaattcgatatggccagagtgagggaagaggtcataagatgaggcaggagaagctggcaggggccagagcatggagggtttccttgctttgctaagaggcttaaatccttctccatcttcctccccctggggctgccatttggttggttaatcatccccaccactgtctcctgtccaggtctgtggctcaggacatccccaagctgcagaaactaggcatcacccatgtgctgaacgcggctgagggcaggtccttcatgcacgtcaacaccaatgccaacttctacaaggactccggcatcacatacctgggcatcaaggccaacgacacacaggagttcaacctcagcgcttactttgaaagggctgccgacttcattgaccaggctttggctcaaaagaatggtaagggacctcccaccaggaaaagatgggaggcagctctgactggactgtccctctggaaaacaggcccacaacaggtctcttcttagaaactcccttgtttcccatcttctggggtgaacgacagagctgtaggtctctctctgctcacctggctggctgtcaagtggccccgtgtgtcacaggatgtgcaactcattcacaccatggcagccccagggtcctcgcgtttgactgcactttggctggaggttggtttccagttgcttacacgtcccccattcaaacagctgtaacgatgaggaagatgtgttaatgtgttaatgtgcatggcaagaagtcctgaggtgaaggagcatgggggctggttgattaaggggctgcttgattcagcagctccatggtggcctctggaccaggccctttccctttctctcttctgccacctcagtgttgggtgctcccgtcatggtcccaagatgggatccagtcaccacatccaagcaggacaaagtacagcagatgaggccctgcagccatctcttcccactcttttttttcctcttctctctctccttttttttttttttttttttttttagatggagtttcactcttgttgcccaggctgaagagcaatggcgcgatcttggctcaccgcaacctccacctcccaggttcaagcgattctcctgcctcagcctcccgcctcagcctcccaagtagctgggattacaggcatgcgcccccacgcctggctaattttgtatttttagtagagatggggtttcaccatgttggtcaggctggtctccaactcctgacctcaggtgatccgcctccctctgcctcccaaagtgctgggattacaggcatgagccaccgcgcctggccactctctctctcttttttaaagagacagggtcttgctatgttgtctagactggtctccaactcctgggctcaagcagtcctctcacctcagcctcctgagtagctgggactacaagcacgtgccaccatgcccagtctctctctttaagaacaagtaaaacatttcccagaaatacccctcacatctcattggctagagattcacgtgattgcctggcaaggagaaaaggggtagctgcggtcagcttaggttggcagtcagcaaaccacagcccccctggccaaatcttccagccacttacgaaacacttcctgcagcccccaaatataagataagactgaaggagaactaccaaggcgctggcagtcaccaaggcattccagcaagaaaccctagaaggccacaaagcagacatcagctgagcaggctgggccacttgccctttctccctttctgcttttagctgtttctctcagctcctccctttacctcttcgtctctccccaccccaaaccctcccagcggaggggacccccatgaggtgtgaacagccttggctgtactacactgatgactcttgggcccagcaggctcactgtctgaatgatttccagtaaacagaattttctagaccactggacagtgaacgctcagggctcagagagaagctttactgtggagtatctgcagactttgctgacaggcccctcatggtccttcctggtcactgtcaccccccaaccctgctcacctcctccactccagctgtactgagttcctcaccctgtgtaaacataggctgggcgaaggggaaggattttgttgttctcgtataatagcaattggttattcattcagggaatttcaagctctctgactttgtttcctctttccaaacaactaggaacacgccctttttttgacctgtctcagtccaggtgtgctgggtctttagtctgaaaagttctctctgcctctccctaccccttcctctggcaaactccaccttgtccttggcatggtgtcctctcttccatgaagcctgccctcaggctgggtctactttgttccttgtctgtctccttagcacctgatgtagcatcaggcacatagtaggtacactgcaaatgatgaatgagcaagtgatgaagaattccatgggctctaatgccaagtataaatgcttctaagaatgagtggcgaagtgagtcaacagaaacatgctggcctccaacagtgtgtggggcccagggacccatcactgagagctgggtgggatggctgagggtactcaagagggagcagtcacttctagctgggaaaacagcttcatggaggaggtggcatctgggctgagcctagaggaatgggaggttgaactggcccctttcccagtaggctctgtgtgcactgggcatgcagagtatgttctagatggtaaggtggctgctctgcagagggtctcattcctagggtggggcaggggaagccccactctgaatatttcgggcatacaggccggagggtgaatgggcaagaaagtggaggactcctgcttcctgatttggaaggcattgggaaaatagagtggtgttttgggggtagggtgataggagcagaagagactctgttggactctgggctagcagattccttgccaaacaatggccttatagaggtgttagtaggtaataattcactcagctagtcagcaaatatttattgagcacatagtgtatgctagagattgtaacgcatccaaaaatcaatgccccacatttcttgcctttttttttttttttttttgagacggagtctcgctcttgtcacccaggctggagtacagtggctcaatctcagctcactgcaccctccacctcccaggttcaagtgattctcctgcctcagctttctgagtagctgggattacaggcatgtgccaccatgcccagctaattttttgtatttttagtagaaacggggtttcgccatgttggccaggatggtctcgaactcctgacttcaggggatccgcccacctcgacctcccaaagtgttgggattataggtgtgagccaccgtgtccggccatttcttgctcttaaagaattcgtcctctgggagagaaaagtcaatctgcgcatgtctggcaatgacacaggaccagggctgctgtagttgagggtgtactaggtgctaccagaggatgcccagtattgggtaacatttattgagtgcacatggatgccaggtgctaacctagaggattcatgtgtcctctcctttaatctaaccaccttgtgcaatgggtactattggccagataagaaaactgaggcaccttgaggttaggtggatcatgagttaataaccagtgtattggtcaggattctctagaaaaaacagaaccaatagaatatacagtcggtcctccatatccgtgggttccacatctgtggattcaactaacctcagtctgaaaaatattaaaaacaacataaaaagatgttatgtctgtactgaacatgtacagattttttttcttgtcattattctctagatgatataatctaataaatgtttacattgtcttgggtatcataagtcatctggagatgatttaaagtataggggaggatgtgctgtgcagaggttatttgcatatatgatgtcattttataatcagggacttgagcatctgtggatttgggtatcggcaggaggtcctggagccaatctgccctgtggatattgagagatggtgtctatttatatatatatatatacacacacatacacacacacacacacacacacacacacacatatatatacacgcacacacacactatattaaaataaccccacctctactaaaagatacaaaaaaattagctgggcatggtggcatgcgcctgtagtcccagctactcaggaggctgaggcaggagaattgcttgaacccgggaggcggaggctgaagtgagccgagatcgcgccactgcactccagcctgggcaacaagaaggaaactccatctcaaaaaaaaagaaacaaaacactaccagcaccctggaaagcacccccagtctctatgctccaccacccccatccccagctcccagggcctctgccacgcgggcttctttttttttttgagacagagtctcgctctgtcacccaggctggagcacaatctcagcacaatctcacctcaccgcaacctctgcctcctgggttcaagcaattctctggcctcagcctcctgagtagctgggattataggctcgcgccaccacacccagctatttttttgtatctttagtaaagacgggatttcactatgttggccagtctggtctcgaactcctgaccttgtgatccagttgccttggcctcccaaagtgctgggattacaggcgtgagccactgtgcccagccccttgcaggcttctgacagcacagatggttttgcccgctttcctactctgtgggctcatccacctcatatgtgtgtgctgcctccgtgttgcttctgctaagtggcagtctggtcattctttgtatttgtcctttctactgtggatgggcctttgggggtttctaactgtgggccatgatgtgcagtgttgcctgtgaacattctggcccatgttcgtgaatgtgaatgcgtatctctattggacctgggcctgggagtgggattgctgggccagaggggatgcacgtgttcagcttgaggagataccgccgtgccgcacagctttccaaagtggttgtgccaattcacgcctcacctcccccagccacgcagaagagttccagttgccccatatcttcaccagcactttgggttttccatccttttcattttagccattctgacaggcacacagtggcgtgacattgtgcttttaagtggcacttcacggaagagtcttgaccaacgccatggtgtgatgggacgcccccagctcaccacgtctcccctgtttcttacaggccgggtgctcgtccactgccgggaaggttatagccgctccccaacgctagttatcgcctacctcatgatgcggcagaagatggacgtcaagtctgccctgagcatcgtgaggcagaaccgtgagatcggccccaacgatggcttcctggcccagctctgccagctcaatgacagactagccaaggaggggaagttgaaaccctagggcacccccaccacctctgctcgagaggtccgtgggggaggccgtgggcaaaggtgtcccgagctgccatgtttaggaaacacactgtaccctgctcccagcatcacaaggcacttgtctacaagtgtgtcccaacacagtcctgggccactttccccaccctggggagcacataaagaagcttgccaaggggggcgtccttgctccccagttgtcctgtttctgtaacttatgatgtcttttccctgagatgggggctcagagggggaaggcctgtggcctgcatgcttcccgatggcccacggcaggaggtgtgtggaagtgtaaggcctaagatgctcacagaggtccctcatgacctcccttccccaactcccgaatcctctcttgagtgtggacctcaacaccttgagccctagtaaaggaactatgcaaatgcaggccactctccccaccacgtctgtgccctgcactgtccccacagccttccacaccctgtgcataggcagccctctcacgtcttgaggtccgaagctggggtgggggtgtccgtcagttattagtggatggagattcccacagcaaggctgcatttgaatgatttccttaggatgaatggtccctacacaaagaggccttgtgggcaaacctggagaaccctcctaaatccatagagttttcaaaatgtgaatctttggaagccttgagttcagaatctgctgctctggaatatttcccttcgatcttatctcagtcacttcgtttttgagaagagtgatgccttgggcatgcttttttttttttcttttttagaaaacagggagttgaagtccaacctatttaaaaaccccaccatttggagaattacaagggttttgtcctgaattgtagtgttggcaagcccaagccactcgtgctaactgctttttgtctcggttgctattccaagaacagaaggaggaagttggccaattacagcgtgtgtgcatggatgtgtgtggggggcgtgcctctcagaaacgcggccagaagacaagcagggaagtgaaaggtcccaggcacacaccctgcccattgcaggtggctcttacagctctctggtgccagcacgggatccctgaagtgactcagccaggcagacatgagacatggcggagtgtccaaatggatcctttattggtggtagagcaaaaaaacccaaacacgataaacctttcaaaagactttctaaggatgatattggaatgcaccagccctcacatgtgtatgcacatttgccagaatataagagttttgttttaaatacagtcttgttaggattttacgttattgttattatggaaagtgattgtgatgctatttatcttcagggtcactctgggcaaagagaaggtcctcagccatgcccccagcaccttgcacataggtgtctgataaaagtttaagaaagtaaacactttttgagcaccaaatatatatagggcattgttctggtgggtgtgtcacgctcccagaagactgaattcatggtaggatcactcgcaaggccttgtgaaggagtcttacctaaaacgaaagaaatatcagggacttttgttgactatttacaactcagttttacatttaaattcaggcagtgttaatatgccaaggtagggaatgtgcctttttcagagttggccaggagctcctggctgggacacggagaggcaggtgtggcgtaaggcctcactcccggctgggaaggtctctgatcacacagaagcagccctgcccagcctggtcatttgctgtccgcttttctctgtgaccacagcagccctgaacaaccagtatgtgtcttcttctccagatagtgaaaaaggtgtccagataaacccacctaagtgaaatggccatcctctaaactgggtacctcactgcacagcttctaggtagccttccaacttaatctaacttgagcctcacagtaaccctgtaaagttagtagagcttgttcttgtattgtgaccttttttaaaaaaaaggaactgaggttcagaatgattaagggcctggcccccagggttgtccagctccataaggtggagctgggcaagattttgggtttgctgctccctgaagctggattctttcatacgatactctttctcaagaagggggctccctgggatctccaggtgtactgcacttaccctcaatccagccccggagaagcaagtgaaaagggtgggtccctcataggctagaatgtgcagctctttctccaggtgggatgtagcaccccgaagtagagctttctgctctgctcctggaaaaggctagggagctggggctggggctcccctcccatgaccaggcagtggtcaccccatgggacaggcacagctacttacgcgaacacagcaggttggtgtggctggctaactaggacctctcgaaagtctctgtgggggcatgagggagaaaaggccattgggagaattactgcctttactttgggactacttttatgctgataacttgggatttcttgatagtccttcacccctgaaaccccgtatttacttaacaagatttagctcttagttcttcaagtaaaattaaagtctcttgtgtaagagccaacacatgcccagctgcggatgggagctgttcctggacagccttctactgcctgggaagtgatggaacaggaactcagggtgcccttaccccctccccagacctgttccctttctttgactgacagagcaccatccaggcaaaattagagcgccaaatggttttcttctcaatcttaaagcagtatacctttccacaggctcgtctgtgtccctgccactctgagttatccagaaaccaccacctacaaatgaggggactcatctagaagacctctaaggtccccttttggctctgaggggtctctaataatccccacttggaattcagcaccgcaaggaaattatgggtatgtgagccataatatgatgggcagcaggtggcgctgccttccacccatggtgatggatggtttggaaagggaatgttggtgccttttgtgccacaagttaagatgctactgttttaaaggaaaaaaaaaaaaaaaagtactgatcttcaatatgaagacatgagcttttctcgcaggaaattttctttttcacagaactggtgtcaggaatcactgaagggctaaccgtgatagtccttgcaagtaagtcaaggttttatcctgattggaaatagaagacatttccggttgagagaacagattcgttggaagcttaacttttgttgcctcttaacgccaccaaattttagggtaatttgattatgaaagagtgaatttttctggacagaaaagggagagctaccaaattgtttttttctttttaaaaggaagtttaatgtccgttgtatcacaaatcagtgttaaaacaccagaactttagccaaaataaatgtcttacattacaaaggta

SEQ ID NO: 10 - DNA, 71470 bp, Homo sapiens
ggcctgactagtcgtcgccgtcttcgcggctgctatgaccagcgggcgaggcgcccttcgcagctccgcgcaacgctagtcgcggccgtgcgcccgccgtagccgtctgcgtcccagcgcggccgctcccgcggccccctcggctttgccagcgccgcctgcgaggcggaggcaggatgaagatgactgtggatttcgaggagtgtctgaaggactcgccccgcttcaggtaaccggcacggccgcccggcgtcaccgcggagctgccttcccggcgctgggggcgtgaaagccgggcccgcgcacccggaggaggccccgccgtccgctccttccgacggggcgagcggctgttgccgccgtttcccaccctgcgagggcactgcagtccccaccgagccctcccgaggggcgacgaagtggcggggacggggacgtcgcctctcatttctttccttgccctctgccggggcggagcgccccgaaggccggcgcaccctctcccgctgggggaaatggggtgcagccgcgctcccgaagtcccgtccccttcgcgggcgctcgctctcgcccccttcctcctctggctgctcttccttcccccttccttccgccccttcttggtttccaccccctccccaccccctctttgagggagctttcagggcatcctcttgcagttcatttagttcctctttgcgcttttctgccccccttccccggggaggagagagtagggggcgaactgggacgccgacttctgcttcgcggtgcccccggccagagcgactctccggagggcgcccgcggtggatgcgtgcgggaatcgcggggggaagcgctgtgatcaaccgcattccgtggaccctagttggtgactacctgcttttctttccacttaagctcgttgaagggggcacagctgtcgagaggtaccgggctgagggcggaggactagcagaaaagtgcatttctgttttgagaacggaagtaggagggccgtgaagattgcctgtgtgttcctcttccagcagcctctgcccaggagggcccggatcacagtcggatgctcccagtggatctgtcacagagttgacatgggggcactccgattcacatgggttgcccttctttctatgtgagaggcggtcgtcctgaggccgtccaggacacaggttctttctgttttgaggatagtaggaaagtcttgagttgttttggacaatggagtttttctaggttgcgttttacagtgtatttatttacagggctggtcatagtccttacaaatataaggccttaacacttccgttagatagtgacatttcttgaagcttcctctgagcactggcgtgtgtgtgcccgctaatgtctgggccaagcctggattgtaaattgcatcctctgcctgggaactaactgttctcatccttaacactgttaattggatttcttattctcctttcagcgaaaaagaaaagaattgtaaaactaaggaactgctacttagagaaaatttaagaacgctttttgcgtttgccctttgatgatttttgggtattaattttattggagcctagggctattatttaaaaaaacccacttcctttgatagctgttgttgcgattcatttttgaaacttttatgttctgcattattgaaggactcaagagacacaaatagatttcctaggacaggcgtgcaggttggtttccaggacagcatggcaagtggagtaatttttaaagtgcaccttagaaagttcagctttttgtgaaattttgttactatgactcagctatttatttttaagtgaaataatcacagcatttttcccttagaagatgtagctttgaactccctttgtttcacattaatttttttttttttttaagttgagagaagtgatttggaaatacttctagctactggggttggtcacaaaccatgtgatgtctttgtttttgaaataaagaaatcattgaatataaaataagagggcaacatactgattaagttgtagggaatattatagtgaacttttgttaaacttgattgtaacataaattctatgttaattaaaatattacaggttttcaggagttgtttcccatattccaattattgttagctgcaaattgggaagagatgccaaaatttcaataacttcaacatcttatatacattttggggacaaattagatttgcaatagagggaagactgccgagaaatagaagtttcattattcatattcttaattttttatagtttttccataatcctattactatgaggatctgtatagcatttgaaaagaatatttgagaagtcttcattcacatgttgtatgtataagaagagctttacttttgagagtattgtgtatgttgagtgatagtgaaacttgtatcaaaataaaaagcttgtgaggcctgggcttgttttttggtagtaaggcagctgcacttgtgtcctgatctattgggctgtctttaaattaatacgtgtctttattcataaatgaatcttgtggcatttaagtctagtgtgtgcacataactgtcttggtgctgtagaattaatgcaaaaggcacatcttgctgatgaaaatttcaccactgttcaagctttaaacatctattttcctgttaaatcaatgaggagaatacaaggggactggttgaaatagggagaaggatgttgcatttgcaacattgtcttttgtaatttgaatagtcaatggttacttttacatcccagtgaacattttttttttgttttggattggagggcacatttcgttgtataattttgggttccctttttggttttttaaataccagtttaaaatcagcttaaaggtcaaaatcttgttcatctaaaatctaaaaaccttgttcatctaaaaatctacaggaatgtaaagtgcctaagtatacttttttttgagtggaaattttgcattttggccaaaatatgttgaagttggaatttgtttgggcccttaattgtatgtagttgcatgtagtaggtctttaaaattttacaaaacctccgtaaaagtactgcttttcttttacttaaacatactcttgggctgaacactgtggctcacatctgtaatcccagcactttgggaggtggaggacggcggatcacttaaggtcaggagtttgacaccagcctggccaacatggtaaaaccccatctctactaaaaatacaaaaattagccgggtgtggtagtgtgcacctgtaatcccagctacttgggagactgaggcatgagaactgcttgaacctgggaggcagaggctgtagtgagctgaggttgtgccactgtactccagcctgggcaacagagcgagactgtctcaaaaacaaaaaaaacaaaaaaaacaaaaaaacccaaaatgtattctgttttacttaggaagtgaatatctatttgaaataaaaagtagaataaataaattgaataaataaacatctttctgaattatgaaagatttttgtcagcagtgttcaagtataaaaatattgtggccaggtgcagtggttcatgcctgtaatcccagcagtttggaaggctgagacaagaggatcgcttgaggccaggagtttgagaccagcctgggcaacaaagtgagacaccgtctctacaaaaataaaaaaattagttgggcatggtggcgtgcatctgtgattccagctacatgggaagctgaggcaggaggtcaaggctgcagtgagttatgttcacacctctgcactccagcctgggcaacagagctagactctctctctctctcttaaaaaaaaaaaaaaaaaggccttagccttggtatgctttagtttttatctgataatttatttttatcctttaacaatgtctatcatacaccatcctgcaggtttttcatttttagattctatttcagatatgattctttttttttttgagatagagttctgctcttgttgcccaagctggagtgcaatggcacgatgtcggctcactgcaccctccggctcttgggttcaagcagttctcctgcctcagcctcccgagtaactgggattataggcgtgcacctccacgcctggctaattttttgtatttttagtagaaacggagtttcaccatgttagccaggctggtctcgaactcctgacctcaggtgatccgcccgcctcagcctcccaaagtgctgggattacaggcataagccaccatgcccggctagatacgattcttgttcagtaacttagaataactttttttttaaaaagggtgtttgtgggtgaattatgtttgagagacagagtcttacttgttatccaggctgttctccaactcctggactcaggtgattctcctgccgcagcctcctgagtagctgggattacaggtatgagtcaccatgcccagtcaggtgaaaggttttaatgggcgaaagacattggaataaaatgtgactactaaatacacctcagttatgtgttgctattaagtctggattggtgccaatcttgtctccttcctttgccttccatctttataataaacttttagcaactgcctgttaatacagtgggtaagggctgaggggaaattttttttttttttaatctcagaagcagtagaatggaattataaagtaattttattatgaaccaaaatacaggaatcctgactgggtgtggtggctcaaacctgtaatcctagcactttgggaggctgaggtgggcagatcagttgaggtcaggagttcgaaaccagcctggccagcatggtgaaacaccatctctactaaaaatacaaaaaaattaggtgggcgtgatggtgggcacctgtaatcccagctactcgggaggctgaggcaggagaattgcttgaacctgggaggcagaggttgcagtgagctgagattgcgccactgcactccagcctgggggacagagtgagactccatctcaaaaaaaaaaaaaagaaaattcttgcaggtggggcgcaatggcttacatttgtaatcccagcactttgtgaggtcgaggtggaaggattgcctgagaccagcctgggcaacatagagaccttgtctctaattttaatgaaaaaaaaaaaaaaaaaaaagcatgtaaagtaggacttatcctcattttaaaaatgtgggtttttttttgcttttttttttttttttttttgagacagagtctcacactgtcgcccaggctggagtgcagtggtgcaatctccactcactgcaacctccacctccctggttcaggtgattctcctgcctcagcctcccgagtagctgggattacaggcgcctgccaccacacctggctaattttttatatttttagtagagacggggtttcactatgttggccaggctggtcttgaactcctgaccttgtgatccaccagcttcggcctcccaaaatgctgggattgcaggtgtgagccacctcgaccagactcaaaaatgttttaaaaaatccggaaaaatctgcaactggacattttgatagattaattgactttttaaaaatagttacttcttttgctagtaattgactttcttaatggtgaactttcacatggtggtcctggaagagaattcactcatttactctatatgttaagccaaaggctttaatttcatttgttaggctgggtgcagtagcttatgctataatctcaacagttcaggaggctgaggagggaggatcacttgaggccaggagtttgaaatcaacctaggcaacagagtgagaccctgtctttacaaaaaaaaaaaaattagccaaatgtggcccacgcctgtagtcccagctactcaggaggctgaggcaggaggattgtgatgccctggagtttgaggttacagtgagctatggtgatgccactgtactccaccttggaagacagagcaagaccctgtctctttaaaaaaaattattaaatattgtgtcagttaaatttgcgttgtttatggtgtcttttatcatatagaaatttaaaagctggcttttgtttattgcctagcaaagtttccctaccccattatatttttctgtcattttatagtgattttaagtttcatgtaatgcaactgggtcttagttttgattgtagcagataatctaattttattttcttcctaatgaaaaccacttgttctaacacctttaaaaaaaattcattcttcattgatttaaaatgaatcgcacatcccttttgtgatgtgcgggaggacaaatttcctcttgttatatgttttacatatttagtctttacagtacttttttcttcaatttcagaagaggatatgtctttctatgtattttggccttatttatttaaaactttttattatttggccttattaaaatttcagggatgattcaactatatggtatttaggaagagacatactttagatttaaggacataaataggttgaaagtaaaagacaaaccatgcaaacagtacccaaaagagaggtggagtggctgtgctaatatcagataaaatagactttaagacaaaaattactacaggcaagtataataagagggctgggcatggtggctcactcctgtaatcccagcactttgggaggctgaggtgggcagatcgcttgatctcttgagttcgagaccaggctgggcaacatgatgaaaccctgtctctacccacaatacaaaaaaaccgttggctgggcatggtggcacatgtctgtggtcccagctactcaggaggctgaggtgggaggatcacttgagcctgggagaggtggaggttgcagtgagctgagatcgtgccactgcactccagcctgggtgacagtgggactttgtctccaaaaaaaaaaaatatatatatatatacatatatatgtatatatctgtgtgtgtgtatgtgtataaaaataaaagggtcaatccataagaaagacataatgactataaatatatattcacttagctgagctccaaaatacacgaaacaaaaacagcattgcaggcagaaatagacaattcagcaatcatagtttgagatataaatacttccaataatgggtggaacaaccaggcagatgattaataaggaaatagaagatgtgaacagtgctataaaccaagaagacttactagttatctatagaacacttcatacagcagcagcagaattcacattcttctcgagtttacatgaagtatcctccagcatagagtatgatgttaggccattaaacaagcctcaataaattttaaagtattgaaatcatacaaaatattttctgaccataaggggataaaatttgaaatcaataacaaggaaatctgaaaaattcacaaatatgtagaaattagcagtacacttctaagtaaacagtggatcaaagaagtcacaagcaaaatgaagaaatattttcagatgaatgaaaacaaaaatagaacacgccaaacttatgggatgcagctaaagcactgcttagagagaaatttatacctgcaaacactaatattaaaaaaaaaagaggccgggtgcagtggctcatccctgtaatcccagcactttgggaggccgaggtgggtggatcacgaggtcaggagattgagagaccaacatggtgaaaccccgtctctactaaaaatacaaaaattagctgggcatggtggcacacacctgtaatcccagctactcgggaggctgaggcaggagaatcacttgaacccggggggcagaggttgcagtgagccaagagtacgccactgcacttcagcctggacaacagagtgagactctgtctaaaaaaaaaagagatctcaaaatagtagctaatcttcaccccagcaaactagaaaaagaagagtaagcaaatctcaaagcagcgaaagggaagaaactaaaaaaggtagagcagaaataagagaaaatagagaagagaacaattgagaaaaataattgaaaccaaaaggtggttctttgaaaagcctaacaaaatggacacatctttagttagagtgaccaagaaaaaagggcagtgactcagattacttcattcaagagtgaaagagggcacatcactaccaatttacagaaataaaaaggattatgaggaaatactacagataattgatgacattaacttagaagaatatatttcaagaaagacacaaactactgaaaccgactcaagaagaaacagaaaatctgaacagacctataaaaaatagagatttaattgatattcagaaagtttcccaaaaagaaaagcactggccaagatgacttcactggtgaattctatcaagtgttcaaagatgaattactgacattcattcacactcctttaagaaatagaagaggagacatcacttttcaaagcatcgagattcctaatcattagtccattgttatcctgctaccaaagccaggtgatgtatcacaaaaaaaccctacagaccagctgggcacaatggcttatgcctatattcccagcactttgggaggccgaggcaggaggattgcctgagcccaggggtttagtctgggcaacacagggagaccctgtctctaccaaaccaaatcaaacaaaaaaaattagctaagtgtgatagcatgcgtctgtggttccaactacttgagaggctgagatgggaggattgcttgagcccagaatgttgaggctacagtgagctgtatttgcgccactgcactccagcctgggtgacagagcaagatcctgtctcaaaaaacaaaaaaacaaaaccaggccaaacatggcggttcattcctgtaatcccagcactttgggaggccacagtgggaggattgcttgcgtccaggagttcgagatcagtctgggcaacatagtgagaccttgtctctataaaaaaattaaaaattagttgtgtgtggtggtacatgcctatagtcccagctcctcaggaggttgaggcaggaggaccacttgagcctgggtagttgaggctttggtgagctgtgatggtgccactgcactcagcctgtgtgacatagtgagacctagtctcaaaacaaaaatgaaacaaacccaccaaaaacaaagcaaacaaaccctacagaccagtattccttatgaatgcagatacaaaaatctttgacgaaagtactagcaaactgaatatagcaccatataaaaaggattgtacaccatgaccaagtcatagttatcccaggaatgcaaagttgatttaatatacaaaaatcaatcaatgcaatatactataataatagggtaaagtattaaaacaacacaatcatctcaatagatgcagaaaaagcatttgacaaaatctaacactcatgataaaactattcaaaaaactaaaaatagaaaatttcctaacttgatcctaatttgataacggccatctttaaaacaccctcagctaacatcatatttagtggtgaaggactaaaagctttcccctaacataaggagcaagaagcctgtcaccacttctgttcaacactgtagcagaggatagagccagagcagttaggctggaaagagaaattaaaggcatccatataggaaaagaaatagtaaaactatatttttagataataagtcttgtacaatcagcctttgtatctatgggttccacttttgtgagtcaatcaatcatggattgagaatattttggaaaaaaacaataaaaaataacgataacaaagtacaaataaatagtataacaactatttacacataacatttacattgcattaggtattagaaataatctagagatgatttaaagtatataagatgatgtatgaaggttatttgcaaatacagtgccattttatatacagacttgagcatccgtggattttggtattagtgggtagtgcagggggtgggcagggggagtcctggaaccaatgtcctatggataccaagggatgaaggtatatagaaaatgctaaggaatccacaaaaatcagttataactagtaagttcagctaggatgtagtctataagatcaatgtacaaaaattatttgtatttctgtatactaacaaagaaaaccaatctgtctatagtggcgtcaaaaagaggaaagtacttagaagacagtacactgaaaacaccattgaaagacattaaagacctgaataaatggaaatacatcccatgttcatggatcagaaggctgaatattgttaagatggcaatattccccaaattgatctacaaactaaacgcaatctctatgaaaattccaaccggtttctttgaagaaattgtcaagctgatcctaaaattcatgtggaaatataagtaacccagaacagccaaaacaatcttgaaaaagaacgaagttggaggattcaatttccaatttcaaaagttactacaaagtgattgtaatgaagacggtgtagtactggcataaggatagacatatagatcagtgaaatagaattgaagagtccagaaacaaagccttgcatttatggtgagccagttttaacagaggtacccagacaattcaatgcgtgaaagaatagtcttttgaacaaatggtgcaaagacaactgaatatccacacgtgaaagtatgaagttggagccctatcttatgtcataggcaaaaattaactcaaaatagatcacaggcctgcatggaagacctaaaactataaagctcttaggagaaaacagaattaaatctttgtgaccttgaattaggcaatggtttcttaggtatgaaatttaaagtacaaggaacccaagaaaagattgataaattgaatttcattaaaattaaaaactttcatgcttcaaaggacacagaacattaaaagtcatgcacaaaatgagagaaaatatttgcaaattatacctgttaagggatttgtatctagagaatgtaaagctctgcaactcgaaggacaaataatccaattaaagaatgggcaaaggatttgagtaagtatttcttcaaagaacatacccaaatggtcaataagcacatgaaaatatgctcaacatcattaactagcaatgcatataaatacaaataaaatcatggtgagatacgacttcatacccactaggatggctatactggaaaagacagataataaccagcattgggaagaatgtggagctgttagaaccctcatgcactgccagtgggaatgtaaaatggtgagccacattggaagagtttgggagttcctaagataagaagttaaacatagaggctgggtgcggtgcctcatgcctgtaatcccagcactttgggaggccgagacgagtgtatcatgaggtcaggagatcgagaccatcctgccaaacatagtgaaaccccatctctactaaaaatacaaaaaaaaaaaaaaaattagtcgggcatggtcgcatgtacctgtagtcccagctactcgggaggctgaggcaggagaatggcgtgaacccaggaggtggagcttgcagtgagccgagatcacgccactgcactccagcctgggtgacagagcgagactctgtcttggggaaaaaaaagaaaagttaaacatagagttaccatatgagttctagcgagccattccacttctaggtgtatacccaagagaaatgaagatatatacccacaaaactttgtacaaggatgttcataggagcattattcactgccaaaaagtgaaacaacctgtgtccgtacatggataaataagatatgaagtatctatacaaatggaattaaggtattcagctgtcaaatggaatgaaatactgttatatgccataatatggatgaaccttggaaacattttactaaatgaaataagccaaacacaaaagccatatattatataattttatgtgaaatgtccagaataggcaaatttgtagagccaaaatagattagtgatttctaggggttggagggtgagggaaatgcaattagtggttgctaacggatatggggtttcttttgggagtgatgaagattttctggagttagtggtaatggttgtagaactctaaatatactaaaacccactaaactatatttttaaatggtgaatttatgttgtgaattatatttcaatatagctgttactgaaaaaggtttgaagcgtagaacatttataatcaaacgcataggtggaatagaaaatacatgttgagcctccatatttctttcgccttgacttaacagttatcaatgcatggtgatctttaaaccccagccccttgtttccccatatgattttttttttttcagttgagacagggtcacactctgtcacccagggtggagtgcagtggtgcaatctcggctcactgcaacctctgcctcccgggttcaagtgattctcctgcctcagcctcccgagtagctgggattataggcgtgaaccactatgcctagctaaattttgtatttttagtacagatgaggtttcgccatgttggccaggtatggtctcgaacttctgacctcaagtgatctgcctacctcggcctcccaaagtgctgggattacaggtgtgagccactgctcctggcctccccatatgatttttgaagcaaatctcagagagtatagaattccatcagtatgtatgtgtatgtctctgaaaatatatacactttaaaaaaattatgtaactacacaccattatcacatcagaaaaaagtaacaataattaatagcatcaaacatccatcaaataagcttcatagcttatgtaggatttattttgtgtcctttatcacattagaagattgtgtctcttctttatcaagtaaattccctccctgataatctgtagataagaaatcccggcagatcatcttggcagaaacaaatcattagagaacattaggcagtcatccatggactgttttggacctgtccttttcatcttcctttctaacctgaatttgttgctttcctggcattttgcacttaattttttgattatagaaaatttcaagcatatacaaattaaacagaataatattaatgacccctcattatccagtttaagcaaataccaatgttgtgtaattcttgtttcatctatgtttctgttatacttactctcccttgtgccataggcaaaaagaactctcccaaaatggatcatagatctaaatggaagacctaaaactataaatctcttaggagaaaacataagattaaatttttgtgaccttgaattaggcaatggtttcttagatatgaaacctaaagtagaagcacccaaagaaaagaaattaaaaagtattaattcgtgttcatagtttttttcttgataaaaacttgcatacattgaaatgcacaattgtacactacccgtcacctacacctctgtcacgatacagcctattttccatcttcccagaatgcttcccccaccacctaaagacaaccactgttttgctttttttgaactttagattagttttgcctatcgttgaacattataaatagattcttatggtttgtatgtcaattattattctcagcgttttggtacttttgcttagcattttaactatgagattgatccatgtttttctgtgtgtcactagttcattttttttttttttttttgagatggagtcttgctcttttgcccaggctggagtgcagtggtgcgatctcagctcactgcctcctgggttcaagctgttctcctgcctcagcctcctggataactgggattacaggcacacaccaccacacccgactaatttttgtatatttagcggagatggggttttatcatgttggccaggctggtctcgaactcctgacctcaagtgattcacccacctcagcctcccaaagtgctgggattacaagtgtgagccactgcacctggccagtgtcactagttcattcttactgctgtgtagtatttctttgtgaatgtaccataatgtattcattctcctgatgatggatagattgcttccattgtttgatcattgtgaataaagttgttacgaacattcttatacaaattttcttacggtaggttttcatttctcttaagataaatacctaggagttgaattgctgtgtcaaggggtaaacgtgtttataagaaactgcaaagcattattccaaagcgattgtactgtttataaatctgccaacaatatttgagtgttcctgttgctccacattcttgctagcatttggtaatatcaccttttgatattacccattgtgtgagtatataatatattcctgcatgtgtgtgtttaattgcagttatgtgttacttaatgacgagaatatcttctgagaaatgcatcatgattttgtcatgtaaacatcatagggtgtatttacacaacttagatggtatagcctactacacatctagggtatatgatatagcctctgggtcctaggatacaaacctgtacagcttgttattgtactgaatactgtaggcaattttaacacagtggcatttgtgtatctaaacatatctaaacatagaaaaggtacagtaaaaatatgatattataatcccatgggaccgctgttgtatttgtggtctgttgattggaatatgactgtgtgtgtatatatatgtatagacctatatatatgagtgtgtgtgtgtgtgtatatatatatacacacacacctatatatatgagtgtatatatatctatgtatgtatacctatgtatgactgtatatatacatctatataatatatatacctatatatatgactgcatatatacatacatataattatgactatatatgtatacatgtatgtatatatatacagtcacattccagtcaacaacagattgtgtcatatattctattaagttgttatgacataatactgcttagtcctgttttggacatgttgataccctgcttttctggattattgataatttggtaacaattttatgttacttttctagagtttagactaattatcttttagacgtgtgtgtgtatatatatatatatgcatctgtgtgtgtgtatgtatacatacagacacaagcacatataattgaatgcacctgttttttcttttttttgagatggggtctcactctgtcacccaagttggagtgcagtggtgttatcttgtctcactgcaacttccacctcccaggctcaagtgatccttccacctcagcctcctatcagggaacacaggtgcacaccactacatctggctaactttttgtatttttggtagagatgaggttttgccatgttgcccaggctggtctcaaactcctgagctcaggctgtccacctgcctcagcctctcaaagtgctaggattacaggagtgagccactgcgtccggcctagatatgtttagatacacaaataacattgtgttaacaattgcctacagtattcagtaaagtaatatactgtacaggtttgtattctaggaaccatataggctataccttgtaccttaggtgtgtaataggctacaccgtcgaggtggcttgtagtctgtgatgcttgcccagtgaagaagtcatctaacagtgcacctccgagaaggtatcacctttgttaaatgatggatgactagctttttattgccgttatagcaaattaccccaaacttagtggcctaaaacgacacaaaatgattttacagttctggagatcacagttttgatacagatctcactgggctaaaataaaaggccagttggcagggctgcattcttttctggaaggtctagggaagaatcctttattttagttttttataccttgccttctccaatttcaaagggctgcccatattccttggctcatggcccctttccatctccaaagccagcagtggttgtgatactccctcttctatcctcctcttttactgataaggacccttgtgataatgttgggctgacattccagaataatctcccaatctcaaggtcagatgatagcaaccttaatttccctttgccgtgtaacctaacgtatttgcgggttctgaggattcggatgttgacatccttggtgggggcgggtggcggggggcattattttgtctaccacagtccaccccctggctccccaaaattcacctctattccacatgcaaaacatattcaccccatcccaatatcctcaaaagtctcaacactgatttgtaatcttgccaaagatctaatctgtgctcattggtttacatatgaccttataatcatagtgcaaattttggtggctttgctatttttaatttaatagtataaatgtttaatattgttaggaagttttttcttttttcttttttggactactcagttgccgtagtgagaaaggggaagagtagaactagccaggaaggttttatggctaaaaaaagactgcatcgtatattctgtgaagttgttgtgacataatactgcttaatcctgttttagatgtgttgataccctgcttctctagattattgataatttgataacactcttaggttacttgcttttctgaagagtttagactaattatcttttagaatggcccccttcctgaatttttctgattgtttccttgggacagatacagtttaaacttttttggcacgaatactcattggtgatgatgcattgtgtcatctccacctggaaacccaggatgtttgcctgtcttcctgttgggaatgcaaggtttgaccactggagtcatgggtaggaaagggtggatagcaggtggtggtggttgtggggagaagcttgtagattaaagcctcagggagaaaggagcttgatcttcaaggaacggaaggaaggccgatagggttggagcagggtgtgcaagaggaagggatggttaagaattaagatcagaggtaggcaaggatgaggtcatgttaggcattataattcatctgtagtgatgagtttggatgttatggttagtgcaataggaagcaattagaaagcttttagcagtggtgggagataaggtttatgttttaaaaatattttgagtactgtttgataatgggctgtatgggggaagagtgaatgcaaagagaccacgcaggaagccattgtaggaaactagttatcaggctgggccaggtgagagacaacttgggagatagttgagaacattttttcatagcatcaagaagagttgatgttgaatttttttatagggaattagaagaataaaaaaatcgcatttttggctttagcagctgggtggatggagattctgtttattgataaagaggaagacaagggaagaataggttttttttggaaaaaagtcaagagttatattttttacatgttaagtttgagacacctagtagacactgaggtagagttgttaaatagggctggcattgctgtgcagccttgtgtaatttactttaaaaactgatgtgatcccatcctatattcacttttagatggtaaactttttgggacacagaccaccatgtctttttattcctttgttcttgagcacgatttcttgcacacagtagataggcaacaggcttttactaccaataagtactttcttaaaatagttatacattctccattttcacataacatactataatttttatttgaggaatttttctgttattgtacaattgatgaattgcaaaacgataagtaatatatgacacctggggtcttatttaaatttccttttacaatgtagtaactaagtcagtccagaatcgttaagtcttgatgggtagttgtcataattcttgagagactctgactagtctaagctaccagggtatttttatatgagggctctaaggaaatgttatatttaatttcacaaacattttgacacacttaactattcagatgatacttttagttgtatagcaaatttaaaaaatgtgtttgatatcctgctacctcaatcaactcttttttttttttttttttttttttttttgagacggagtctcgctctgtcgcccaggctggagtgcagtggcgcgatctcagctcactgcaagcaatcaactcttaaaacctttttttttttttttttttttttttttttaagacagggtctcactctatcactcaggctggagtgcagtggcacaatcatggcttactgcagccttgacctcttggctcaaatgatcctctcaccacagcctcttgaatagctgggactgcaggtgtgtgtcactgtgcccagctaattttttaaattttttgtagagacgaaatctcactgtgttgcccaggctggtcttgaactcctgggctgaagctatcctcccatcttggcctccccaggtgggattataggcgtgaaccaccgcacctggtcttaaaatttttttagttgactaaaaagtagtcaaaactggccgggcgcggtggctcacacctgtaatcccagcactttgggaggccgaagcaggcggattgtctgaggtcaggagttcaagaccagactggccaacatggtgaaaccccgtctctactgaaaatacaaaaaaaattagctggacatggtgggcaggcgcctgtaatcccagctacttgggaggctgaggcaggggaattccttgaaccagggaggtggaggttgcagtgagctgagatcacgccactgcactccagcctgggtgacagagcgagactctgtttcaaaaaaaaaaaaaaaaaaaaaaaaaaaaatatatatatatatatatatatacacacacacacacacaccacacacacacacacacacatatgaccattctaagtattttatatatattaaatcatttattcacaactccgagatatatgctatttatactaggggacagagaacacaactattaagtggtaggaggggatttgaactctgtcatttctgctctgaatcttgaaccatcttcagtagaatctaagccaggagttggtaaactatggcctgcgtgatttgtggatatgcatgctatgtagtcatacagggacccaccctgagaaaggccctgtgcttggtttggttctctgctgttactattttgaaattcttaataacttttaaacaagaggctccattgtttttttttgtcaatagtccctgcaaattatatcatcatttctacatgtgtgctaagtttttacattttaaagttttaaaaaaaatttcatgacacatgaaaattatataaaatttcagtgtgtgtaaataaagttttattggaatatagccatgcttatttatttacatattgtttatggttgcgttttttgctacaacggcagagttgagtagttggaacagggactgtagggcctgcaaaacttaaaatagttactccttttttttttttttttttttgagacggagtcttactttgttgtctgggctggagtgcagtggtgcgattgcggctcactgcaacctccacctcccaggttcaagcgattttcatgcctcaacctcccaagtagctgggattacaggcgcctgccatcacacccggctaattttggtaattttagtagagatgaggtttcaccatgttggccaggctggtctggaactcctgaccttagatgatccgcctgcctcggcctcccaaagtgctgggattagaggcatgagccaccatgcccggccgaaatacttgtacaattaacagatccaagaaaggattgtacagtgaacatctgtctagccttcatctagagttaccggttgttactattttggcacatttgctttatgtgtgtctctatctctttatcttacatgcatgtataataggtatataaaatacatctcacatgtacttttttttttctgaatcatttgaaagtttgacctgcagctcgtaaaaataaggacattctcctacataaccacatttataacactaaaaataatttcatgttgaaatgttcccatttgtgcctgttatgtcctttatgactaattttactagttttattcctttgaatcagtattccatcaaggttcatggagtgggttgctttttcattacatttagccagctgttcattcctgtttcttttaattcatcatatcattggaatgatttaaaaatcatgaaaaatttggattatggtggagcctaggagaagtctcagtcgtatctgaggccttggatttgaagaagggccaaatcatgcaagatattttatgtcatgttaaggattttggaggctcatcatagaaaacatagtgagaagctcttaaagagatgtgacatgttcagatttgcatagtacatatgacattgacttttaacctgggcaacatggcacgactttgtctctacagaaaattaaaaaaaaaattagccaggtgtagtagtgcatgcctgtagttctgtagctactggggaggctgaggcaagagaatcacttttgaggctgcagtgagctatgatcgacgcacactgcactccagcctgggcaacagagcaagactccatctctaaataaaaaagaaaacaaaatggacttttcaggcaaaatattttagcatgtcacaatatggaacaaaaagatacaaccttgaggaaaactaagtgtaaaaatactttcagagacagtaagggagagtcaatcatgaaatgagagtgagacattaaggattttttgttattattatgtgtgataatgataaagaggctctgttaaaaaatcttatctgttaaggatcaataaaataatacagcatctaggatttgctttaaaatacatcagttaaaaaaagggacaggagtatatgaagcaggaatggcaaagttctgatcattgaaactaggtattgggtacaagggagtacattatacacttctctgtttttgtgtcttgattcatttcataagaggttaaaaaacataacctctgatacctcattttttttcgatacacaaaaaatgaactggaaggttaacttgtatgtgaaagttgtctggtatccaaaacttccattttggatataacagaatagcagaaatgttctttatataatagtgtcaagatgtatataacaaaggaacttgtttctaaatatttggttaggaaaagaattcatagcaagaataacttactatatatttctgaatctcttgaaaagaacatattttaaggtatttagaaataatctttccaggtgaagtatgaaaggaaattaaaacaaaaatcttgcttttacagtattcatttaaaaactcaaatcttttaggtatggaagaaaactaactgtgacaatagaaaacttccgtacaaattacaaaactgtttaattcaaaccaccactcacaattgtacagcaactattgtagaggagatttcttgctcatcaatcagctattgtgtaagcagtatgtaatctttcctatgactacagcactaatgcattactagtactgctttcctatgattccaacaaatacaaacaatggcatctcttttggtttgaacgcagcagctgtatcctggcgacaggtgctagtagtgatcattgaggtaaaagtaagacactgttatgaaggtagagtttgatcctaagaaagataacggatgactttgtgtcaagatctttgccttctatattatgaatgttttcatttggtttattttaatgtttatttcatcatttgagaagtcaaataggcgatgcacatcagaatcacctgaggagcttcttccaaaatgcctttgtttggactctgccccagacctactgaatgaaaacttctagaggtgaataggactcaggcatagatactttcaaaatgctgtctaggtgattctgatgtgaacctttaaggaccactgttctaaaggtctcagaattatcaggctgaattacatataattcattatatataaacagataataataaagcacagtgatttttagtcctttcctctgtttaacctaatggttaaaaaggcaaggcatagttttccattggctgtctataaccctattccttattctatcactatagaacaagtaaatcattcaaaattgcaatagggccaggtgcggcggctcacacctgtaatcccagcactttggaaggctgagataggtggatcacttgaggtcaggagttggagaccagcctggccaacatggtgaaaccctgtctctactaaaaatacaaaaaattagctgggcatggtggctcgtgcccgtaatcccttctacttgggaggctgaggcgggagaatcacttgaacctgggagctggaggttgcagtgagctgagatggcgccactgcactccagcccagacagagcaagactccatctcaaaaacaaaaacaaaattgcaggccgggcgcagtggctcacgcctgtaattccagcactttgggaggccgaggcgggtgaatcacgaggtcaggagatcgagaccatctaacacggtgaaaccccatctctactaaaagtacaaaaaattagccgggtgtggtggcacgcgcctatagtcccagctacttgggaggctgaggcaggagaatggcgtgaacccgggaggcggagcttgcagtgagccgagattgcgccactgcactccagcctgggagacagagtgagactccgtctcaaaaaaaccaaaacaaaacagaacaagaaaaagatataatgaaaatgaataaaataattcaaaaagtcctccaagcgtgtgtatacattaaataaagttaggaactttataccagtaagcagataggaaataagtagaggtgaaattccatttatattaataacaaaaactataaatagaaatgaaattaacataaaatttataggacttcataatttataaaacaactataaaacttgacagaaagggggaaatatgagtaaggaatcatatctgttacatgaagactcgacattgcaaaagtataaattctttctaatgtataaatataaatgcaatgtcagtcagcattttaaagtttatataaaagaacaaacatgcaagactagccaagattttgaaaaataagagcaatgaggacaatgtcccatatcaaactttaaaatgtattgttgaagtatagagattgatcctagaacagacagatgaacagaagttttaaaaatccaaagacagactccgatgtatgtaagactttagagaatggtgaaggtgttatttaaaatcaaggggaaaaggatagttactagataataatgagagacaactggctgtttgggtaggttacatacatttccctagaataaattttagatggagtaatgctttagatgttaaaattgaagctgtgaatgtagtattggaaaatatacatgaaaatgtatgctagcttgggaccaggacagtctgtctaagcatgacaccaaagacaaatgccttgaaatagattttactatataaaaatattacccctccccctggctggtctgaaggtagtcagtgatctcagttgattgttcagtcagttacagattgatctccttgttctgctccttcccctcttctcactactgcatttaactagtcttaaagaaaaaatttcttctcccccagtaagtgaaagataggaaaatatttgaaaaaaagtgaaataactttcaaatcctatgtatttggagagcacggaaaaatgtcctgcaattccagttgaatgaaatgttgcatataggccgatctacccagacagaaagtcgattaatggttgcctagggctgggcgcagggaaagaggtaatgggaagtgactgctaatgggtatgggatttctttttgggatgatgaaatgttctaaaattagactggggtgatgggtgcacaactctgagtatattaaaaactattgaattgtacacttcaaatgggtatggtatttgaattttgtctcgataaggcagctaaacatttttttatgctgatactacctcagtagaaaatgggctaatatcataaaaaaaggaaattgaagcaaagaaacagaatagaaaacaatacagtctcttgcaagcatctccatgttattatatagtgtctcaatatttttgaatagccccatatataatatttagggtgtggtagtcactacaaaacacttatgtaggacagtgtttttatctggacttattgtttatctctttaatagttaagcaactattataaacaatcttgaagctgcgttttaaggcagaccgagcaaggacctgaaacaagttaatggcaaattgatagagcagttacttggcctgggtgcggtggctcatgcctgtaatcccagcacttggggacgccgtggtgggaggattgcttgaggccaggtgtttgagaccagactgggcaacatagcctgacctgtttctacaaaaattgaaaagttagctgggtgtggaggcgtgtgtctgtagtcccagctacctgagaggctgaagcatgaggttggagaattacttgagccttggagtttgaggctgcagtgagctgtgatggtaccaccgcacccctgccctggcaagaacaacaaaacagcagtttcttcctttttgaaggaaattctaccttttaatcctttgagctaggttttgcagctttaatggtgagcaagactcctgtctctgccctcatgtagcttgtcatattgggattattgaaaagcagatggacacttaaattacagtgtaagtgatataatttaagtgaatcctgggaactgtgggagaggatgagaaagacctctgtcttgcataggaaaggaaagcttcttaaggtaaggaatatttaaattgacaggtgaaagacgaatttggaattaccaacgtgaagtacagtttaagaagagaagagggcttctggcagagagaactgtaagtccaaaggcccaaatgcaggaaaagtataggatgtggaagacggaggcgttttaaataagggtcagatcatgggccttttgagtcacattaaggactgtaacctgaggatagtggagtgccatagaaaaatattaagtagtaggtgatactatctttttttttttttgagacaggatctccctctgtcacccaggctggggtgtgattgtggctcactgcaaccttgaactccaagactcaagcgatcctcccaccttagcctcctcaatagctgggactacaggtgcataccaccatgcctggctaatttttaaaattttttgtagagatggagtttctgtatgttgcccaggctggccttgaactcctgggctcaggtaatcctcctaccttggcctcccaaagtgctaggattacaggtgtgagccactgtacccagctgttgacagtttcttgatcatatttatgcttcttaaagaacatggtacttgcagtgtgtcgacgtcattaacttcattggggcaagagagtcctttagaaggtggttgctataatccaggtgagaagaaatgatggtccgcttttggtagttagtggagataagagtgagatagcatcaaggtatttaggaggtagaatgataataggacattgtgattgcttggatatggggcatgaggaagaaggaattcaggatgatgtctagatttatgtcttgagcaactgtgaatggtgttgctgctcacagagagaacaacagatttttggagaatttgatgcccgtttttgagttatgcatggtacattcaggtagagatgttcattaggcagtctgaaagctctgagagagatctaggttggagataaagatttgaggccaggtgtggtggctcatgcctgtaatgtcagcactttgggaggctaaggcgggaggactgctcgaggccaggagttcacaaccagctagggcaacaatgggagacccactcactgcaaaaagtaaaaaaaaaaaaaaaaaaaaaaaaaaattagccaggcattgtgatgcccagctgtagtcccaggtattcaggcggctgaggcaggattgcttgagcacaggagttgaggctgcagtgagtcattattgtgtcactgtatttcagcatgggtgacagagaccctgtctcttaaaaaaaaaagacttgagatcttgatatttatggtcttgaaggcaaattggtttttacaagtgaggataatttcttttacattttaagatagatacatattaaacttaagttgaaagagctgctcttttgttggacgtgttcttctagtgttgtgagattcaaccaaattgacacattcctttagttttattttcaaagtttttgtgctacttggaaattcattataagaaaatacttcattgcagttatccattgtcttctggatattcatttcctatttttctttgtgaaaaatgaacactgtgttcatagtgttaatatgacatttccatgtatctttgtgcacatgtgagagctagggagtgaactaccaagttgaagggtatgtgccaaatgctttctaaaggtgttatatcagtatacactcctacaagctatataggagatggtgtatgtttcatatcctctcctatgttttgtatggccagattttaaaacttttgctaatctgatggatgtgaaatggtatttcgtgattttaaatttgtgtttcttaaccgatggtgatgttgaggattttttttttttttttgacggcgtcttgctctgtcaccaggccagagtgcaatagcgcagtcttggctcactgcagcctccgcctcctgggttcaagcgattctcctgcctcagcctcccaagtagctgggactacaggcatgtgccaccatgccggctaactttttgtatttttagtagagacagggtttcaccgtgttagccagggcggtctcgaactccttacctcatgatcctcccacctcggcctcccaaagtgctgggattacaggcgtgagccaccacgcccatctgacattgagcatcttttcatgttaattgttcattcatatttcctcttctataagttgcctatttatattttcttcttatttttctattggcctgtttgtccatttctttttgatttgtagaatttgtagatagtctaatcctttgttaataaaaatcacacctcccaatctgtgggttgtattcacctttttagcgtttttttcatcctaaaatttcaccttctatgacttgaaattttaaaaaatttactgactcataaaaatacatttatcattttgcatatatattttattttttctaaataaagtttttatcttttgcacatacaaaaatttatcaaatcagtggtatgcaataaagtcatatatctgaaaatatttaaaaataaatgatacaagtgtcagtaagtggtttatctggtatctctttaataaaaagaacttaccttttttggctgaagacaatatttacttttttaaaaaatggacttggctgggcatggtggctcaggcctgtaatcccagcactttgggaggccgaggccagcaaatcacgaggtcaagagatcgagaccagcctggccaacatggtgaaatcccgtctctactaaaaatgcaaaaattagctgggcatggtggtgcacgcccgtagtcccagttactcgggaggctgaggcaggagaatctcttgaacgtgggaggcggaggttgcagtgagccattgcagcactgcacttccagcctggcaacagagcaagactccatctcaaaaaaaaaaaaaaagacttttttagagctgctttagtttcacagcaaaattgagcagaaagtacagagaattattatattctctgctctgacacatagaaccttccccactatcaacatcctgtaccagaatgatacatttgttacaagcattgagcctacattgatacattattatcacccaaagtccatggtttccattaacgttcattcttgatgtttagataaatgtataatgacatgtagctaccattataggatcatgcagttagtttcgctgccttaaaattctctgggctttactgattcatccctccctttaccccaactcccagcagctactgatatttttactgtctccatagtttttgtctttttttagaatgtcatgttgttgaaatacagtgtatagcttttaaagattggcgtcttttacttagtacaggttaagtatcctttatctgaaatgcttgggagcacaggtgttttgggtttcagatttttttgattctggaatatttggattatactggttaagcatctctaatccatgaattcaaaatctgaaatactctagtgatcattttctttgagtgtcatgtggttgctcaaaaagtctcagattttgtagcattttgtgttttctatttttgatttagggatgctcaacctgtaatgtaaggtttttccatttctttttagtgctgaatgatactctgttgtctggatgtacacaccttatccattcacctagtgaaagacatcttggttgcttccaaagctggtgtaacatccctgtacaggtttttgtgtggatatgttttcagcttatttgggtgaataccaaggagagtgattgctggatagtgtggcaagaatgtatttcgtaggctgggtatggcagctcatacctataatcccagcactttgggaggctgaggcaggaggatcacattaactcaggagttcgagaccatcctgcacaacatagtaagatcccatctctttagaaaataaaaagtatgtatttcttttttaaagaaactgcttaactgtcttccaaaatggctgtgcaatttttctttcccatcagcaaagaatgagagttccttttgctgaacatcctcaccagtatttggtgttgtccatgttctagattttgatcattctaataggtgtgtagtggtttctccttgtttaatctgcaattctctaacgacatattatgtggagtatcttttcacctatttatttgccatctgtgtttctcctcctcttttctttctttttttctttttctttctttttttttctttttttaaagagacagggtctcattctgttgcccaggctgcagcgtagtgatacagtcatagctcattgcagcctcaaactcctgggctcaagttatcttcttgcctcagcttccagagtagctgggactacaggcgtgcaccatcacgcctggcttgtctgtgtattttctttactaaggtgtctgctcaggtcttttgcccagtgggtttctttgtttgtttttgttttgagagacagagagcctcactctgttgcccaggctggagtgcagtggtgcgatcttggctcactgtagcctccgcctcctgggttcaagcgattctccgtgcctcagcctcctgagtacctgggattgcaggtgcaccaccacacccgcctaattttttgtatttttcgtagagacagggtttcgcaatgttggacaggctggtctcaaactcctgacctcaagtgatatgcccgcctcagcctctcaaagtgctgtcattatagtcatgagccatcgtgtccggcccccttttgctcagtttttatttgggttgtatgttttattgttgagttttaagagttctttgtatattttgggtaacagttctttatcagaaatatacatataattttttttggtaaatattttcagtctgtggcttctcattgccttaagcaatatttactttaaaataaatgtgagacagttttgtctgttgactatacttttctaatgaactgatgaatgttgtgacataagaaattagactgtggtgtacctcaaccaaagaaaatacggcaatagcaatacaattttaaataagcaaagactttcaaccaaaactacttacaaaaggaacaaagtttaaatgccttaaggtctaaatttaactgtggaatatgacaaaaatcacattaactgttcaaccatgaatattttaatttttcttaaatatttaaaatggaatcttctgttactctgtgtcctcttatcctgcttttcttaaaagcacttgtaataccttacatgtatacatatttcatatctgtttactaattgtgtttccttcacttagatgccgtgagagcaggggcttgttttaccgcttgctgtttcctaagtctctagtacagtgcgtgacatccagtaagtgctcaaggaattttttatgaggaaacaaaaaacacaacttatactctactatttaagttattttttaaattactacttatttcaaaggcagttacggttttaatttgttatcttcaagactgattttacaaagacttcttgtagctcaaaagggcttaaaatctctccttattactaactactgcttcaaatttcacatttcataatcttattttttattttattttttgaggtagagtcttgctctgtcacccaggctggagtgcagtgtgccatctcagctcattgcaacctccgcctcccgggttcaagcgcttctcctgcctcagcctcctgagtagctgggactacaggcacctgccaccacgcccagccgatttttgtatttttattttattttatttaacttttttttttttaatagtagagatggggtttcaccatgttggccaggctggtctcgaactcctgacctcaagatctgcccaccttggcctctgaaagtgctgggattacaggtgtgagccatcacaccctgctcacatttgataatctgagcaacaaattatgccacctaacagagtatagtataagccaattcttcttctttatttattttttgcaatttactcatgtaacaagccaattcttttttttttttttttttttttttttgagacagggtctcactctgtgacccaggctggtcttgaactggaactcctggcttcaagcaatcctcctttcttggcttcctaaagtgctgggatcataggcatgagccactgcacccagcccccaattcttatttttagccaagtgtagattcttaagcattttgctggcaggtctgtgtggtaagtgatgatataatcctttaccattatcaagatccagcttaaaaacaatttgtttttgacattcattgtgagttttttttttttttccttattactaaatagagacagggtcttgctttgttgtccaggctagtctcaaactcctgccttcaagagatcttcctgccttgacctcccaaagtgctgggattacaggcatgagccaccactcctggccttacagtgtgagttttaatgctgcatatttattttattttgttaattatctgtaagtctctccgtggtttgatctagaaatttattcatttggaattggcctgtactaggaatatgccagttagaggaaaaatattgtagattaccaaggaaatagctaaataaaatgtgtgccttttgatgtgaaaattgtttcaatgtattttttcttccaatttaaaaaattgtgtttaaatacacataacataaaacttatcgtcttgaccattttttaagtatacagctcagtggtattaagtacattcatattaggtaaaaggatgcgtattctattatatgcacacgtcatgttgtgcttatccatttttctgttggtggacacttgaattgctttcacgttttatctattgtgaataatgcggctgtgaacatgggtatacaaatatttcttcggtactcagttttcaggttttttgagtatatactcagaagtggaatagctagatcacatggtaattctgttttaattttttgaagtgttgccatagtactttccacaatagtggtaccattttacattcccaccaacagtgcggaagggatccagtgactccacgtcctcattgacacttgttatgttttttttagtagccatcctaatgggtgtgagatggcttcttagtctgttcctgcatcgatggcagaatagcactgactagataatttataaataatacacatttatttctcacagttctggagctgggaagtccaagataaagatgccagcagattagtgtctggtgagggccagctatctctgctttcaagatggcaccttgttgatgtgtcctcaatggcagaaggtggaagggcaaaaaagggaccattaggaccctttcttcagcctcttttataagagcactaatccattcatgaaggcggagccctcatgtcttcatcacttccccaaaggccccacctcttcatactgtgacaatggagatcaagtttcaacatgaattttggagagacacaaacattcaaaccatagcaggtagtatcttgtagttttgatttgtgtttccctaatgattagtgatgttgaccttcttttcatgtgctgattggccagtcgtatatcgtctgtggagaaacgtctattcagatcctttgcccattcttgtatcatgttgtttgtgtctttgttgttgagttttaggagttctctgtgtaatctggatattaatcccttaccagatgatttgcaagtattttctcccattctgtggatggattttttactctgtgtcttttgatacacaaaatttttcagttttatgaagtgcagtttgtctgttgtcttttgttgcctgtgcttttggtatcatatccaagaaattaccaaattcagtgtcataaagcttttaatctacgttttcttctaagagttttatagttttagatcttaacatttcagtcatggatctcttttgagttaatttttgtatgtggtgttaggtaagggtcttcattcttttgcatgtggatatccagttttacaagcaccatttgttgaaaggactgacttttccccattgcattgtagtgatactcttgacaaaaatcatttgaatatatatatgagggttaattctggactgtgttctattctggaggtctatatggctgtctttatgacagtattcgtctgtttgattactgtggctttgtggtaagttttgaaatcagaaagtgtgaatcctccagttttgcttttctttttcaggattgttttggctatccattgtcccttgagatttcatatgaattttaggataggtttttctatttctgtttttttttttttttttttttttttttgagatggagtctcactcactctgttacccaggctggagtgcagtggcgcaatcttggttcactgcaacatctgcctcccaggttcaagcaattctcttgcctcagcctcccgagtagctgggattataggtgcctgccaccacacccagctaatttttgtattttttgtaaagatggggtttcaccatgttggccaggctggtcttgaactcctgacctcaagtgatcctcccacctcagcctcccagggtgctgagattacaggcgtgagccactgtgcccagccaggtttttctatttctacaaaaaacatcattgtgattttgacaagaattgcattaaatctgtagaaggctttgggtaattgacatcttaacaatattaagtcttccaattcattaacatgggatatgtttccatttgtttatttcttttgtacttttttttttcccccaggaatgccttatagtttctattgtacaagcctttcaacttactggttaagtgattttctaagtgttttgactattttgatgctattataaatggcattgttttcttaatttccttttcagattgtacattcttaatgtgtatagaaatgcaactgatttttgtatgttgactatatcctgctactttgaggaattcatttattctaacaggttcctttgtggaatctttagggttttctacatacaaaataaggtcatattgtctgtaaacagaaatacttttacttcttccttttcaatttgattccttttttttttttctttttcttgcctagcgactctgactgggacttccagtgctatgttgaatagaagtgttgaaagcagcatccttgccttgtttctaatcctacagggaagctttcagtagagtatgatgttcactgtggttttttggtatatggcttttattatgttgaagtagtttccttttattcctttttgttaagtgtttttatcatgaaaaaaagaattttgtcagtatgatttttatgcatcaatggagatgatcatggatttttttcccttcattctgttgatgtggtatagtacattgttttttcttcatatgttgaattattcttgcattccaggaataaattctactaggtcatggtgtataatccttttactatgctgtagaattcagtttgctagtcttctgttgagaatttttgcatcagtgttcataagggatattgttccatagttttcttttccagtagtgtctggctttggtatcagggtaatgctggcatcataaaatgagtttggaagttttcttcctcttcacttttttggaaaagtctgagaagggttggtgtaagttcgtctttaaatgcttggtagaatttgccagtgaagccattaggtctaggacttaatttttttttctttttttgagacaggatctcactctgtcacccaggctggagtccagtggcataatctctactcactgcaacttctgcttttcgggctcaagtgatttttgtgcctcagcctcccgtgtagctgtgactacaggtgtgagccaccaatgcccggctaatttttgtacctcctgtagagacagggtttcgccgtgttgcccagactggtctggaacttctgagctgaaagcagaccgcctgccttgggctcccaaagtgctgggattacaggcatgagccactatgcctggcctgttttggagattttcgatgacagattcaatctttttactagttataagtctattcagattttctctttctttatgagaaaagactaaagtcttgataagttgtgtttctaggaattttgcatttcacctagcttgtccggtttgttggcatatacttgctcatagtactctcttataatcttatttctctggaattggtaataatgtccccattttcacttctgactttagtaatttgagtcttctttttaaaaaaaattctgtagagctaaaggtttgtcattttgttggtatttcaaagaacgagtttttggtttcattgacttttctctgtcgtttttctactttctgtttcttttatatttgctgtaatctttctttccacctgctagctttggttttggtttcatcttctctttctggttccttaagtcataaagttaggttattgatctctgagatctatctttcttttttcttttgagacggagtcttactctgttgcccaggcaggagtgcagtggcatcatctcatctcactgcaatgtctaccttcaggctccagtgatccagcctcccaggtagctggggctataggcatgcaccaccatgcccggctaatttttgtattttttgtagagattgggttctgtcatgttgcccaggcttgtctcaaacttctgagcttaagtgatctgcttgccttggctcctcaaagtgttgggactacaggtgtgagccactgtgcccaggactttcttgttttttaatgtgagcatttataactatatttttaatgtattttttcctttttttaatttaaaaaataactcaaactttttttgtgaagatggaggcttgctgtgttgcccaggctggtctcaaactcttgggctcaaacaatcctcccacctcagtttcccaaagtgctgggattatagacatggagctaccacccgtggctttttttttttttttaaactaaaaatgttctttctataagtttagtttcaaaattttatttccattcactaataagaattatttaactgcatttttttatattgcatgtacagatatttaaatttttatgaagtgaaaatgtcctttttttgcctgtctgccttccttcctctctctctcataggatccttttataaggtgggtcattaaagacatatttaaatatgttacatgacaagatttaagctataggacagataatatttaagcatttaagccaatctatctgtctgcaaaaattttagtagtttacatttctttctccttgaattctgtcagacacaacatattttgaatttgtagcgtgtcttagtttatacttccttggaagtgtatacttacgagttttatgaaggtaagttcatgactaactgtcaaagctgtcagcagacttactcaaatccaatcaatgtaaagtggtaaaatctagggccaagaataaaggcatatgaaatatttactcaaaatacaaactatctggaacaaaaggggaactgagtgtttgatcaaacctgtagcttagaagaaagaaaagaaggcttacccctgtaaactcaacactttgggaggtcagggtgggaggatcacttgaggccgggatttttagttctctcaatctggtgtcttgggatgaatagttttctgttatttagatggtaatattaggtaccaccaggaatgtgcaactatgatgctgtagaaatcaacaggtgttttaatgagtatccactgtatctgtagtcctttcctagccatggtaaatcagtggattatatctagtgataaactatagaatataaataaatgcccagcctgagtacacatgactgaagttttacagtctatcacttaaattacacaatctcctttagactatgaggatatttaaataagagggtgaggacttattgatagaaaataaattttgaagtataaagattcttgactcttgattcttgatgtgattgcattaaggttaatgtagctagattgattattcaagcagaggtaacccagttttccatttatgtttattgctgaaagacaagactgctaaatttgtaggacagaatgtataatccacctgatatggtttggttctgtgtccccgcccaaatctcatgttaaattgtaatccccattgctggaggtaagcctggtgtgggggtgattggatcatgggggcagtttctcatgaatggtttaccatcatgctcttggtgctgttcttgtgatgaagttctcacaagatctgtttgtttaagaatgtgtaactcctccccctgcccctggctcctgctctggccatgtaagatgcatttgcttcccctttgccttctgccgtgatttggtttcctgaggccttcctgaagccactatcatgcttcctatacagcctgcagaaccatgagccaattaaacctcttttctttataaattacccagtctcagatacttttttttttttttgagatggagtctcactctgttgcctaggctggagtgcagtggtgcaatctcagctcactgcaacctccgcctcctgggttcaagcaattctcctgcctcagcctcctgagtagctgggattacaggtgtgcgccaccacacccagctaatttttgtatttttaatagagatgggggtttcaccacgttgatcaggctggtctcgaactcctgacctcgtgatctgcccaccttggcctctcaaagtgctgggattaccggcgtgagccaccgtaccagacctcaggtgtttctttatagcaatgaaagaacagaccaatacatcatccttaacagttgatgaaattaattggaagtgattgggcttgtatatgtgttcctttaattttgagagttcatcagcaaagggtaacagtaaccatagccatacaaaatgaaccatagagttggattgcaatcaatcctaattttatagaaagacaagaaagcacagatctcgatctgtccgtaccttgtctcatggagagtgagagctagattagcagtccttgtatttgtaggagttagactgtgtttaagcggcaataggctggttgcggtggctcatgcctataatcccagcactttgggaggctggggcgggcggatcacttgagatcaggagttcgagaccagcctggacaacatggtgaaagccgtctctactaaaagtagaaaaaaaagtagccgggtgttgtggtgctcatctgtaatcccagctactcaggaggctgaggcaggagaatcgcttgaacctgggaagcagaggttgcagtgagctgagattgtgccattgcactccagcctgggcgacagagcaagactctgtctccaaaaaaaaaaaagaaaaaattatatattataattatataattatatttatattatataaatacgtatgtgtgtatatataaatacatatgtgcgtgtgtgtatataaactatatatgtgtgtatgtatataaatatatatgtgtgtgtgtgtgtatatatggcaatataacttttgcctcagccttctgagaaagaaaatgaagatttctttttcatccaatgaattacatttagcttcgcggaatgggttgagaatggaaaggggaggcagggaatctggttacttacctttcttcctgaatgttacaactcattttcagggtatctagttgggaacatttttattctcatgtgctgcctataattcaataattttatatttctgggatatttaaaaatattttatctcttccttagaagcacatttttggttcatcaaaaatatcaggccagaagtgtttttcaacatttctaaaattgttttcagccattttaatttgacttaaacctgatgttaattcttagtcctcttgtttgacctgtcggcagcttttgacatacttgattactccttcttccttgataacacttttttcacttcccttctctatgacaccctcttggttttcttcttattttatgtgtgtatgtatgtatgttgcctaggctggtcttgaactcctgggctcaagtgattcttgtgcctcagccttccaaagagctgggattataggaatgagccaccgtgcggggcctggttttcttcttatgtcatcagttgctgcttctcagattcttttcctcattccttttgttcttctgacctttaatgtcaaaatgccccaaagcttaagtcatctctatctttactttttattttaataatgtccagtctaatggctgccgatactatctatgtgctcttgattactaaacttatacctccaactcagacttctctcctaaactctagactcaggtgcatccacctatttgaagtcatcacttgtatatctagtagatattttggagtcaaatccaaaactgaactctagatcttctttccctaaatctgttccgcctgtagtcttgcccatctccgttgattgtaactatttttctttttgctccagcctgaaactttgaaattatacttgattacacatttacctgtacctggtgtacgcatgcatatgcttgcatatcacatctaattcatcaagaaatcctcttggttctacatacaaaatatatccagaatcttagcatttctcagcactgattggtgcttaccttgagccatcttcatctttcatctggatgactgctgtagcctccttactagtctctttgcttcttcctcttttgtttctttgcagtcttctccacgtagcagccagaatgagtcttgacaaaatactttacagcatggttcttctctggtgcagacctttcagtggttacctggtatagctgctgttatcgttgctatgggcctacaaggttctgaatgtgatgggactctccattagtattctgacttcttccgcagctctctccctttctggttctgtttcggccgtacaggcctccttgctattgaacgttccaggaatgttgcattggtggctttttctgcctgttaacacccttgtctgcatggttcactgtgttacttcaggtctttggtcaaatgtcactttctcagtgaggactattttgatcaattttaaatagtaaaactgtagccgtccctctctccccttatttcactttccttttttcccatggtacttaccaccttatcgcataccatccaattgacttattgatgatgtttactgtttatagcttgtcttccccttcagaatgtaagctctaggatggtaaggatcattgtttattttcttcttatattccaaacaatagacatttgctgccgtttgttgttaaagaaaagggaaattttttcatttgccagaatttttctaggaatggtgttttttaaaaaacaaattttaagttgctgctcttaaacttttccctgtttctgattagtataacttgtttgattcttttctttgagtgtccaaggatcctgtctgatcataaattgtatgtgttgaagaaatcatgataatgtaattttgtgctcgtggtagagcgaatacctccttagctcctgtcaaatttctgtcaaggcctgttttagaagtccaaatctgtattattctagaagagtattataaaaattttccttttctgtcaacttaaaaagttatatgtataatattggttacatataggtaaataggtgcgaccttgtatgccaaaagaggactttttccttttttcattataactttagttttaaggtttatgcaattgtttgtagttctttattcttttatttttttctggagacttttatagtatcatttatataaggctggagagggcacagcagattggaatcacaaggctggagcaagagggaattggaaagttacacataagtacgtgtgtactgagatacagggagatcaccattttgcgtgaccccaggccgcaaataacagagttgttttaaatgctccattcatcacccattcaacaaatgtttacctggtaactagctgaactagagatagctaaatgaatcatagtgtctgcttttgaggccctcagtctagacataatgaccaataatttaattatcattagtaaattgaatgtcaggcgctctgtttgaagtgtgcagagtgctctgtggaaatggtggtggtggggtgctcattctgctgaggagtagaaggtgcttcagtgttcgaagtttaccatcccaggtggtttatggtgtgaagattgtctttaaaaccctgagcctgtttattaggctcttaaatttgtattcagcttcctctttacagatcttgtcaaatttctggggcttaatggagatgaaatactgtgtaaaacggttttttaaacacagctgctttactgtcatctaatagttctgtcatttagcagtttactaagttttctccccattcaagattctgtgattctggggttgttgcttatgtactcaatgcttttctcttcatatttcacgttactgttctgtagtcttctctctttgttttggatacagagttcactgtctcccaagctggagcgcagtggcacaatctcaactcactgcaacctctgcctcccgggttcaagtgatcctcctgcctcagcaaccggtgtagctgggattgcaggcgtgcaccaccacgcctggctaatttttttgtatttttagtacagacagggtttcactgcgttggtcagactggtctcaaactcctgacctcaagagatccacccaccttggcctcccaaaatgctgggattacaggcctgagccactgcgcccagcctagtcttctcttaatatacacatgtgatatcatgcatgaaggtggcatgtagattataaaacataggaagatgtaatgcagaataacttttattatgtattaataagatgcttggttgtttatggaggagtctgggaaagttatagatgtgattgttgagcagcctgtggtatgtcgtggagagaaccctgcaaggctgagtatttggttccctacctgctgtgatttgcagggtattctgtgccttcagtaccacttccaattcctgaaaaggataatggggaacagccataaaagcaggaatatggcaggtttctgattataatgtagttaattaattagttaattacagagacggagtcttgctatgctgctgggactggtctgaaactcttgggctcacgctgtcctcctgctttggcctcccaaactattgccagtattacaggcatgagccacctcgcctggcctctgattctaatttttgacagttttgtctggaactgtccctaaatattcttatcatcttgctttgttctctcattgagggtctgcttatatcccatctttgagatacttggttgtcttttcattattatcagccacaatgttctttcttcatggaaatctcctctgccccttttatgaatcatgaagtttacaatgctgtcttctccttagatgtattgcctgtgacactctactaataacaacaaactttaactgctttggttgaaaatttgattctaaccctttaagcagtgataacttaattttcctgtcatgttgaagcctactacaatgataagaattcttggaaatggaatgattttgtagaaagtcaactttaaaaagaagaggttttttttttttttaagggaaaaagaataacttcatatctgatcacacttaaaacattactagtatttccttggattagtattctgtcaataatgattatttgccactacacatgttaaaaatgactgtatatagctactgtctttatgcagagcaaatttggaagtgactattgaaatcatatacctgttaatatgagaagctgaaggcccaggaacagaagattctatagacctctcctcccacctcaaattctccatgtaggatgattatctggaatatatatatatatacacacacatatatatatacacatacgtatttttttgttgtttttttttttgagacggactgtcattcttgttgcccaggctggagtgcaatggtgcgatcttggctcaccacaacctttggctcccaggttcaagcgattctcctgcctcagccccccgagtagctgggattacaggcatgcgccaccatacccggctaattttgtatttttagtagagacagggtttcatcatgttggtcaggctgctctcgaactcccaacctcaggtgatcctcccacctcggcctcccaaagtgctgggattacaggcatgagccactgcacccggtcctattatctggataatattttaagttcttcctttttttaaatttttttattttttaaatcatgagctgggatttaaaggggttgttgatatctgagttatgacttaagagtgtgatattcattcaccagagccatactatttgcatctcaaccttgtgctgtgatttggttgctttttcaattatactcctccatggcccctgatggtttttattttggatactgtgtattgatgggggaaaatttgaggggaaaagggttatagattttttttttcgctactttttttaaaaaaagttttttttttccccactgggaagtggcagagtaatgtttacaatctgtaaaacagaaatataatggggcttgcttagaaagatacaaacgtagatggaaaacaaaattttttttctggccaagtgttatggctcacgcctgtaatcctagtactttgggaggctgggatgggaggattgcttcaggccaggagttcgagaccagactggtcaacaagactggtcagcataatgagatcctgtctctacaaaaaataaaataaatctgttttcctccaaaatattaagccaaacaaaacacttttaaaatcccactattttcatctatattcatactccttgtcttttaagaactatgcagaggagacttttgagaagatgaatgaaacttgttaatataaaatctggtgaggttttttttatggcttaaacatttttttcctcccttaactcttttgaaagcaaaagcaagggcctggaggaaatcttacttagaagagaaacaaatccaggttctattagattggtgcaaaagtaatggcaaaaaccgcaattacttttgccccaacccaatagctttcctttgaatgcttaatcccaaataatggaatgttaggtcttgaagtgatagtcaagctgtttcagagtgagagagctgaggtctggtgtgattaaatgattttctcaggggctcgtatgagttgacagactaaaatattggtttccatttctagtttgtttttccactactccctttcctattacaggactgaatttctcatggatctagctaggtttgcttagtagatcaatttgagcacgtaggagcagttacaacatttgtaagataataaatagagaagaaagacctttgaatttcatcccttgaaacttttgaaaacaatgaaggcagagacattttatttatttatttatttatttatttatttatttatttatttagagttggagtttcactcttgttgcccaggctggagtgcaatggtgtgatcttggctcaccgcaacctctgtctcctgggttcaagtgattctcctgcctcagcctcccgagtagcggggattacaggcatgcgccaccatgcctggcgcatttttagtagagacagggtttcaccatgttgatcaggctggcctcgaactcctgacctcccgtgatctacctgccttggcctcccaaagtgctgggattacagccgtgagccaccatgcctggccagtggagatatttataaaaggttattatgtaacaaatatacagttgcttcttggccttttggctaagattaagtgtaaatataaatttagaactgtaaccttccttcatactgattctatgttggttctcctctgtttttaggctcttagaggagttggatagaaccttccttgataaccttagaaaccaagtggatttttaaatatttcatcattttatatgtcatatatatgtagtcctctagtctagattgaagttaggaagttaggagaggactccagtctgtatttgacgtgtgatctttggaaagggacagcagtattgtgtttttgtctctcttccagtaagccttttgcacgcctagaagtgttttctcttaaaggaaattagatttgctgttttaattgctgatcttaggcctgttttaactgtttttgccccttttcagactatttcaaattcattttggaagtatgtgatgatcttattactgctttcttctcaggtggccccataacatgaaaacaaaaagagattgtgcattttctttaacactatgtaaataatcatagctgacattcactgactacttagtgttttcacatgtatattaacatttgtcatacgtctctgtgggagagagtgttgtttatctatgttttagagaagaaaccgaaacacaacttgttcatcattacacagctaataagaagtatagtagcgattcaaacacaagaagttttcttttttttttttgaactttattctactgcctctcaacatagagatattgtagagacccagcatagaggacccagaacttaatcaaactaataaggggtggccattcacattataaaagtatttaatggagcacttctattaaaaagcaggtttctagagtgtgtgctgtgttgttttctggtcgaaaacagagggagtaatctcattggtataggaccttttcgtcactcttttttaaccacttaacaaatcccaggactgcccttgggtcagtgggccatccttgatgcagctgttgtcctttccttgcaaagaatagtccagcattgcccaaggtacataaggctgttgagctgaaagaggaagttgacttagggtgataggtactatgatggacacatacatataggcacctctcctgagtctctaaacggttattcaatttacatgcagcttttagaaatacatgtattatataaaacaaaagaatacaacagtttcaaaatctgcacattttgaatatttatttctatttgatgatttctttattaggtagttatgacttagagcctgaaatccacctttaatgtttgaggatatttatgtgcctattaatgatcttgaatatcctgctattggcaatttagattgcatcaccatgtgacctaattttttttaaattattaatttcattttaaggctattgccaagttggaatgaagggttttttttttttggtggtggttgttagtttttaaggattttaaatggatgggaaaaataattatttagcatacttcttctttttttttttttttttttttcttttttgagacacagtctcactctgtctcccaggctggagtgcagtgatgcaatcttggctcactgcaacctctgcctcccgggttcaagcaattctcctgcctcagcctgccaagtagttgggattacagacatgcgccaccatgcctggctaatttttgtatttttagtaagacaggttttcaccatgttggccaggctggtattgaactcctgacctcaagtgatctgcctgtctcagcctcccaaagtgctgggattacagacgtgagccaccgtgcccggcccatacttcttttttctttaaaataattttataaggaaaatgtaatgctcatgttacacatttaatgtatttagttattttaatgtatactctttttacaaacagtagcttagaaagtttattgctacaagaatatgcagttatctgagtggagagagttctatttttgagcctcattcatttcatagccatgtcttggtggtaaacttgctgttggatttttttctcttctagttttcttatttgtttttttttgagatggagttttgctcttgtgtcccaggctggagtgcagtggcgcgatctcagctcactgcaatctccacctcctgggttcaagtgattctcctgcctcagcctccctagtagctgggattacaggtgcctgccaccacgcctggctaatgttcatatttttattagagaaggggtttcaccatgttggctgggctggtcttgaactcctgaccttatgtgatccacccacttcagcctcccaaagtgctgggattacaggcatgagccaccacacccagcttctcttctagttttatgtttttaggtaactatttttcaattgataataaaaaactatgatgcatgaatagataagagaatgaaggtattgttattaaaaataaagtatctgtttttctgaattctgggcttattcagcttcttagagtacagactgctagagctaagtccaaattttattttcttttatgtatttcatatatgagaaaagattttcattcatgttcttatatttgacattcttaatggtcagtaaactttctgtaaagggccagatagtaaatattttatgctttgtgggccatatggtctctcttgcagctactcaactacgccatcatggcgtggaagctgccatagagactacggaagtgaattaacttgtctctgcttccgtaaaactttagaggaacagaaatttgagtttaatataattttcatgcatcacaaaatattattttttaaaaatatttttcagccacttaaaaatgtaagaactatttttagcttatagactttgtaaaaacaggttatgggtcaaacttgcctgttgggtaattgtttgctgacctttgtgactgtgctcattgtcttctcttttcttccctttctcttaacatctatctcccttattacttattctctgttttgctcattttgctgctcagtcatatattttatttcattattaatgtgtatataacttgatttttttaaattaaattttaagctatggagggtaggggtctataattttggcctctttattgccttgcatttttataaaagttatgtgcttcgtaaaaattggggaggattgcagagaattaatatctatcatttaatattttgaaagattgttgggtaaattcttttatttcacttattagttttttaaacatatgtcccagaatggttctatctcaatgaatagaagtcatctattcatctgcgaattgattttgttctttgtgtcatgtactgtgattgatgatatgaacagtcctcatttagtctttaccaccccctactttaaaaaaaaaaaaaaaaaagagatggagtcttgccctgtggcccaggcaggagcgcagtggtgcagtcatagctcactgtaacttgaaactcctgggttaaataaagcaatcctccgggctcaagcagtcctcctgcctcagaatccacagtagctgggattacagccacacactatgtgcctagctaacattttttatttggaattttttgagagactgagtcttgctttgttgtccaagctggtctcaaactcctggcctgacgctactttttgtatttttagtagagactggcttttgctctgttggccaggctggtctagaactcctggcctcaagtgatctgcccagctcggcttcccgaagtgctgggattacaggcgtgagccactgtgccttgctgcttacctttctttaaacatgttgttttacaaaagtgaattagtagaattgcacagtgaaataagattggagaagttacaaaaagtttatcccaacccatttgtttagtagaaaccaacgattaaatctcaaactggtcatttcaactaatttgcttgaaagaaatggaagactgagtaaagataaataaaggttaaaatgtaaatgaagagggtatctgacaattagcgtacttagtgagtttctcccttggctcaacaaacattttgtttgcgtgtctgtactgctatggggaactgagactagtgagcgaggtgcacagtgatagaatgtgtgtgaggtgctggaggggcacgggagggtacgccattcagcttgagtggttgaggggttccaggaggaccatgtcttggggagatggtgtttggacttctttttcccctttattagctttaaacgttgcttagaaatgcatagttgctgaaaatagttaaacaatctagaatttagtaaaaagcgcaaatccttatttatactttctgctatcaaatccccattcttcagagttgtagttcgtagactgataaatatgctcccaaattgagctcatgctatgcatataattttgtagcttgcttcccccccccccaatataatactctatcctgtgcagatttccatatcagtagatacagatcaacctcatttaaaatcttctgcctcacataatggtatggatatatggtaatttatttacattatttcctattgctgcacatctaggtttctaacgcgttacactgaatatcctcatacacatacatttgttctcgtgtgtaaattaagtttaaatgatgagtaggtgaagggactgaggactgatgtgaatgaaaaatgttttctaggttaaggggacaatgcatagtttgaaaaacgttgctgaagcaaatgagaaacttttagtcaggaagaagtatttctgtttctgtgctacagagtgcagcaccttccattttctccagtcatatgctagagcatctcattttatcataggcatttctttactgaataattcaaagttattttcttattttagagatttaaacacttcttaaaaataaatgttacccagtggagaagcagaatcacaagtcaataagatgattattcagaggtcacacagaggtgaagtgggagttctggaaatagagttttttgttttattttgagacagtggcacctaggctggagtgcactgaagcgtcaacctcctaggcccaagtgatccttccacctcagcctcctgagtagctgggactacaggcgtgagccaccacgcctggctcatctttttattttttgtagagacagggtcttcctgtgtttcctaggctgctctcgaactcttgggtccaagcagtccttcccctcagcctcccaaagtgctgggattacaggtgtgagccaccatgcttgttctggaaatagttttcatcctagctctgtctcctgagaatatcttactcagtgtaaatcccccattactatccaacttaaaaatttagttaaatcttaaaatacctacttgagaattgctagtttatcaagtagatatatgaaaatggcataaatgacttaaagtagatgaattacattttgttatacatactcttgagtgtaaaatgttttcatccccaaaacttagttgctgctattttgtttcagacaaatttccaattttgaaatgttgccttgtagtgtggtatgaagtgctaactgttattataattgtattctcttttgtcaataagacaatatttggcttatttagttctgcattttacataatctaacctttgctaatttttctgtattaaaattatattgctaggagaagaagagagatgaaaattagtcttaggtactgattaaaaaatactttggaaacaaaacaagggtggtattgttctgagctatttctgaaagtaaaagctcttcttggttgccaacaacgccttgcagtttggttgcatgtgttttgttatcaagaaatccaattctttgtacacctcaacttttaaaatttctcacttatttaaaaagtacgtgctaaatagctgtattttgtgttattaattggaatgatactaatgctttgagtataaattagcgtaatgtgttctgtcattgtcctaaacagtaattgtattacctgttgtattgcatgattatgaagtattgatactaaattccaaggtaattattacttcatgtgaagtgtaatttttaagcattcatatctatcttttcatttagagttacttttcaagagtaaagtgtacatttaaacaaacgaaataacttattttatatttaatttttctagggcagctttggaagaagtagaaggtgatgtggcagaattggaactaaaacttgataaggtaaattttacaagttagctttttgaaacattgattctcgtttgctgtaaataatgattagtacctacagtagtaggtctcttttttattttttggagacagagtctcactctgtcgcccaggctgaagtgcagtggcatgatctcagctcactgcaacctccgtctcctgggttcaaacgatcctcctgcctcagcctcccaagtagctgggattacaggcgtgcaccaccatgcccagctaattttttgtgtttttagtagagacagggtttcccatgttggccaggctggtctcaaactcctaacctcaggtgatccacctgccttggcctcccaaagtgctaggattataggagtgagccatcgcacctggcctggtagctttttatctctatgagggtaaatgctattattatcccagttttacacatgaggaaagtaagactagagacactaagtagcttgtgtaaagtctaatctaagtgccagagcaggaattcaaatccatgtctgacttcaaagctcactaaacatcctttatgttgttagaagctttttctggggccaggtgtggtggctcacgcctgtaatcccagcactttgggaggctgagatgggcggatcacctgaggtcaggagtttgagaccagtctgaccaccatggagaaacctcatctccactaaaaaaatacaaaattagtgtggtggtgcatgcctgtaatcctagctactcgggaggctgaggcaggagaatcgcttgagctggggaagtggaggttgctgtgagctgagatcgtgccattgcactccagcctgggcaacaagagtgaaactccatctcaaaaaaaaaaaaaaaaaagaaagagaagctttttctgtattttctaccaaaaagattgcatctttcttttttgttgcttaatggatttcatatataacctgaccattgtataaatttgggtctggccacgttcaaatgtaaatacaatttaaaatattaattccatttttaagctaataccagaaatacttatagatactcagtaatctgtatggtcatattttatggaagggtaaatgtacattgattccctccatctatattattgatgatttttttggtgtctgtccaagaaacactgtttgctatatagtaggcagaagcagtagaatgagtaagacagcttccgatccatttgtttagatacttctgaaaccactgctcatttacatgtttctctttaaatttctggagataaatcagatgtatatatttgaaataccttttctgaaaataattttctagtttaataattataattataaatggcattgctgtgtaacgtagtgctcctgagaccttaactttgcttaggaacccctgggggatcttccctggggatcccatcttgtgaaaaaacagattctgattcagtagctggagacacctgagattttgtgtttgtaaccggattccaggtgacgcccgtgctgttggcccatggaccacgcttttgagtagcaaggatataaaatatattaagctgaaggttttcaaatgttttgaaaccatgaaacacacatctttatataatataaatagtctagaaactatatttagttctatatgtaaacaaattacatcaaaattttagaagatgtttagagataagttatttttgtatagtactgtataatttttaaagccctgtaatatatagtagtatccttttaatttttacaataatcctgtagggttagataggacaagtgttattactcccgttttatagctgaggataccaaagcccaaggaagtgatgaggacttgcttcaaatcacaaagtagaagaggcacaaccagggctagaaccccttttcttttttttttgagacagagtcttgctcaggcacccaggctggagtgcagtggcgcgatctcggctcacttgcaacctccgcctcccaggttcaagcacttctcctgcctcagcctcctaagtagctgggacctcaggctcacgccactatgcctggctaagtttttgtattttagtagagacgggatttcaccgtgttggccagactggtctcgaactcctgtgctcaggcaatccgcccgcctcggcctcccaaagtgccgggattacaggcatgagccactgcacccggcccctctgtctttatgatcagttcagcgctcttcttgcgcatcactgcacttcaggatccgcgttgggggagcacctgccactgggaaaggttctgaggaacgctagctggcttccagcaagtctttgtaaaaattaatattttaattttggataaggagattatttgaaaatgccttcgttttctacttaaaaattacatgtctggctttttattactattttattttattttattttttaccctgaggcattacatttattttcaagtactctttaaaacaaaattttaaattctcaaagtagacaacagaaaatatagttttgattttatggaagatttatgagagagtatgtagaggggcaagtccttctagaatcacagagtggtataagaaggatatcttattacttatatatacataagtgatacatatattattacatatgtattatatacatgaaataagagtaaggtaataaggtagaaccacatgtaaatcatatgaaacactgtggtgggacacctcagactttaaaatacctaaacagatagaatccactgacagtgtttttgctgattattttgctgttatgagtggattcttttttcctttgtattattcacttggggtagggcacacacactgctagaatcttcagaccaaaagattcaaatctgaaacaagttattgaagtatcgacattgagtgctaagaactataagcccgttctagagtctgtcttacccaaagggctaccaagacacatggaaacctgacagcttaaaaaaatcactgttttccctcgcactaaagttccatagttacttttatatttcgtacctcttccaaattcttttttttttttttaatttttaattttttttttaagaaatggattcttgctctgtcacccaggctggagtgcagtggtgtgatctcggctcattgcagcttccaccttccaggttgaagcgattctcctgcctcagcctcctgagtagctgggattacagggacacgataccacacctggctaattttttcgtatttatagtagagacagggtttcaccatattggccaggctggtctcgaactcctaacctcaggtgatctgcccgccttggcctcccaaagtgctgggattacaggcgtgagcccccatgcccagctcaaattgttaatctattaactattatttttattttagaaactatggggagttagcatagagaagagaggctgagaggaggaagtggttgttattgaaggtagtgtcagtgaaggactaatgtgggtggtggaggggttgctccaagtctaggttaatgatttcatagctttgtgcagggcaagttccacctatagtatcattgtaaatcatgccagggacaggttaaactagcttgttgactttgcctataatgtatgccaccagtagttcattctttgtggtgaataaggctttatgagtggcattgctctacggagttcaattattgatccattcttgccaggtgttctgtcattgacagcatcatagtgcatcatagttgccatctaggcttaatttctgcatgtgttgcattgtctgactggcatgcttgttccccattgagcagatactctttaaatctcagccaagtactaccaaatgttggctctttttcttctgttgcattgtttcttgcatgtactctgatttaagctgttatagtattgtaattttgggtggggagcatagcctagtagttaagaacacaaacattggctctttttcttctgttgcattgtttcttgcatgtactctgatttaagctgttataatattatagttttgggtggtagcataacctggtagttaagaacacaaagcctggagctgctgctgggtttgagtctggctctatcatttactagcaatatggccttggacaagctcttcaacctttctgtgcctcagtttcttctctccaaaatggggaaaataagagtgtctatttcataggattattatgaaactaaaatgagataatacatgtaaagtacttagcacagttcttggcacgtggtaaattctaaataaacaatgatgctgtctcttcaacagactgttagctccttgaagagagattgtccttaaaaaggggaaaaatgggctgggagtggtggctcacgcctgtaatcctagcactttgggaggccgaggcaggcgaatcacttgaggtcaggagtttgagaccagcttggctaacatggtgaaatcctgtctctactaaaaatacaaaaattagctgggtatggtgcccctggcgtggttgtgtgcgtgcgccactgcactccagcctgggtgacagagcaagaccccatttccaaagaaaaagaaaaaaccctcatttgttttgtgtacttggtgtatacaaagtcttatgttttacttatattatttcttattattatagcaatattgcaaaattgatatccctaatttgcgcatgaaaaaacaagaattggagagtatgttactcaaggatagtcagcagataagttgtttgtattcctatcatctggcagagtgtctatgacatagtaattgcttagtaaaaagttgttgaatgaattagggatattagtttgataatttagatggacttgacatttaatcttgttgtaggtaaaaatcttccctctttgtaggtttatattattcagttagaatctcatttatcagtgtcatctaacaagtattttgacagctggcaaaatctcagtcttctctctttctgcctccctccctcttcattgccaagtccgtccttcctcctggatagctgcagcgtatatgtggttctgctgtatgacaatttcattttctctgtaactcctgtgatggtgacctctgttctacttctgatacctatttcatggctatgttctgtgcctcatcacccagggttctaatctttgaaatctggaatgctgatatcctactttctgagttgagtctccagtccttccagttctcagcctcattactgcttttgttcttcagccctacctctggtctttcactatccgcttgtgatattccagatcactttttttttttttaaattttactttaagttctgggatacatgtacagaatgtgcaggtttgtaacacaggtatacatgtgccatggtggtttgctgcacccatcaacgcatcatctaggttttaagtcccacatgcatttgtcctaatgctctccctccccttgccccgcacctgacaggctccgctgtgtaatgttcccctccctgtgtccatgttttctcattgttcaactcctacttatgagtgagaacacgcggtgtttggttttctgttcctgtgttagtttgctgagaatgatggtttccagcttcatccatgtctctgcaaaggacatgaacccattcttttttatggctgctcagataatttttaaatacacttcaatgtattcctcttttttgtaattaaaaaaagttgagataaaattaacctaacataaaatccagtatttcaaagtgagtaattcatggtttttagtatagtcccagtgttgtacaactatcaccactatctaattccaaaatatttttcaccccaaaaagaaaccctgtatctattagcagtcactcccaattctcctctccctctgtcttctggcaacctaatctactttctgtccctggatttgcctattctgaacatttcaaataaatggaataatacaatatttggtcttatgtgactagctcctttctcttagcatgtttttaagagtcatccatgttgtagcatgtatcagtcctttgtttttatagctggataatgcatcattgcatggatgtacctcattttgtttatccattcatcagttgatggacatttgagttgtttcccttttgtggctgttgtaaataatgctgctatgatccctttcagagtactcttaatgttattacatcattatttctcttcagagactttcatgtcccttccataatagctactctgcagaattctccactattttaagtctgaccatctatattatttgtcccgtatctggcctataaaaccctacaggggaagttacacaactgtttggtgaaaccaactgatggtgctacacattcctggaattcttgatataaagcagtttcctccagacccagtcaggtgcctttcttgttaccgttagtggctcttcaagacctcaggatttgccacattgttcttcattctcaacagatgaccttgtctcttcttctgcttggtgggaatgcctttatttcttgctgctaatctagaagtttaacagaatctgttcttaccattttagtttttctgcttctttgaataataaaagtatccctttttctatgcagttccaagccccttacctcctcaggactttgctttagcatctctctcctttcccttctctgccacctctatcttaagtagataaagatttttttttttttttttactaagtttgtttcttagtaaaacaaaacaaaagcaaacaacaataggaaaacctctccctctgacaaggaagcacaaatctctattgaataattaccatgtgccagtaagtttgtgctaagaatcttttttttttttttttgaatacagagatagggttgttgaccaggctggtctcaaatgcctggcctcaagagttcctcccatcttggcctcccaaagtattgggcttacaggcatgagccacgcctgtgctaagaatctttatgtgcattcccttagtctttttttttagtaaccatatatggtttggtaccattgttatgtgtgatacagaagaagaaatggaagtttgttgaggttaagttcactcagtctcacttagatgtttaagtatgacagtaggttgaacctaagcagacttagctgagaaccctatattttttgccgtaatattttactattaacctgtctctctttgtttttatggaaacttttaattatttttgaatttaatttgttgcataataccacctatgtagtacacaatttgaaggtaaaaaagtgtgtacccagtgaaaatcagtcattttctaatctctttcctagaggaatgcactgaactagtttctcttgcgcccttgtgcaattttcttttttttttgagacagcctcgctctgtcactgaggctggagtacagtggcatgatctcagctcactgcaacctctgcttcccgggttcaggcaattctcctgcctcagcctcctgactagctgggactacaggtgcgcaccaccatgcctggctaatttttgtatttttagtagaggtggggttttgccacattggccaggctggtcttgaactcctgacctcaagtgatctgcccaacttggcctcccaaagttttgggattacaggcgtgagccaccatgcctggccttttcacaaaattttctaagtatataaaagtatttgtactcttcagtacaaatgactctccccatttcaacaaaaatattagcactgttctacattttgatttttctcttaatatatcgtggatgttatttgttgttatagagctgtctcattttaaaaaatggttgaattgtattacctttcatggctatatcataatttatttatctagctgtccactgagagacgcttagcttgctaccaatattttactgttaccgcagtgaatatctttacatgtgtcatatggcctatctgtaaaatatagttgtagaatacattttaaaaagtgaaattgcgaagttagaaggtatgtatgttttaaattttgatagctctcgctaaactgccttctgtagatattgtaccaatttacactcctaccaacaatgcgtgagagtgactatttccccataactgccctctttaaaacagcatgttatcaaactttttcatctttgctgttagtaaaagaaaaaaaaatagtaatttccatttcttttattatagtgagaatgaatatcttttcatgggtttaagacacatgtatctcttttttggggggtaattatctctgcatgtatgttacccattttttctagtgaatagttggattttcaaaatgatttatatacccttttttatggtacggaaacttgtcctttgtgatttatcttaatattgttttcctatgttgtttcttttgactgtgtttgttttttccttatagaaatgtcttattatgtaattggattgatcagtttttttttgcatagtatttgagctttgcatccttctcagacttcccactttgagattattgaaaaaaaaaaccttctcttttctctttgatttctgattctgtttttatgtttaaatctttatctataattaacttgggagtctgtaatacaatttaatttctttttttatccccttcagatgactatccagtgtccctaatatcatttatcagataacttttcccccactggctggagtattactttaatcaaatatggcatatttgtatctgtttttttgactgtgtattcttttacattgatcagtttgtctatttgcatttactaccagacttttatttactatctttttataatatattttaatatcatatagtactaatgttcctaccttattactcttcaaatatttttttgctcttcttgcatagtggttactccatatgaactttagaatcagtttttctggcaagacattttattttatattgtaaatagcaaacaatttaaaagacatctgtgccagcatttctcacagtgggttttgtggaatattggtcatataataatgcttcctcttaacaagaattccatggtcacatatttttgggaattgctacatattatatacctcccctcttggatgcacattgataaatcaaaagcccttaacagtatagcaatatcttctgttgccttttctaggaatccttccctggtccccacagccctcgttagatggtcttccttttttttttttttccatgcatagttttgtcatagtagttgtgtttgtgctctgtagaatttatctacttgttagaattatagaattagagtttttgagagcagaggtgatgttttcattttctgttcccctaggtctcagggcagcagttttaatttatgctcttgagatccttcaggagttttctaaagtttttcttggctctttatcctcttcttggtgacccccctttgcatccccttagtacttttctctcctttgtctagaacagtttcacttttatctgttttttaatatttgacatttacccaagattttggtaaaagaaaatgttctgtgtctgaaagaaaggagagaaagaaggaaggaaggaatggaagaacagggagttggagggataaagggaatgaaaagaagaaggacgggagagagagaaagagaaagatgaaagaaagagaagagcccggtactaaggcttagacaatgcctggaacaataggtattagagacattttttttttttgaatacatggttgattaatcactttagctatctgcgttgatagactaatattgaaatgatcactaagctatcatacagtttacttacctttcctccaaaatacttttgttgttgttatcacacagcctctggatcctaaatggtcaacttttctggtacaactctgctacgaatttactttataagctgaaggaaaaaagaatacttttcaattagtctgttttgagtttatcgatgaaacaaattgaacttaactaggtcacctcatatagttactgccaacacttgttcaactaagtaatttgtaaaactatcttcaacctgatgaattttttttttctttttcagcttgtgaaactttgtattgcaatgattgatactggaaaagccttttgtgttgcaaataaacagttcatgaatgggattcgagacctggctcagtattctagtaatgatgctgtcgttgaggttagtattactaaaattgcagttaaaaatgaaaaaaaaaagcaataagacattaaagaattgtgcattcatctacctgatttatagttatggtgatacttaaaattagaagtagaaaagtggtcaccccttggtgctctcttgtatgattctgttttctaagagaaggtgatggttgatttgcattgcgcattatctagcatggctcttctcacctagtttctcattgttgtggttagtttattaagtttacttgctgctaggtgagctgaagcacctgtcagagggcctgagcaggaagatcaagatcatgcctactagtagctgcttataggggcacgcagagagcattaacctaagtacagcgtcttaactgtatgtatagggggctgtataggttctgattagccagcttatgctcggttagcttagattccttggtatactatgtggtgttatatttctttcatgagaaataataactggtgaagaaatgggtgtagtttgatgatgatttgattctagatgcctacatgggccatcttgatacacgcaaaacaattttaccttaggtttatatttaccatttctattgttagcataataccgttgaaggggcaatattaattctttcacatttttagggttttatttgttaccacgtgtagaggtgacctctgcagagtgtacccataaggtagtgtgagattgtcattggaaataaatgttactgtttacagtgtaacttgatcttctgtcagaaattctgaggtcacatttttgtgacctatttaagtggctcataaatgatttggttttcttttgctttttttctcatagacaagtttgaccaagttttctgacagtcttcaagaaatgataaattttcacacagtaagtgtcagtaagtaggtgttactatgaccatattaacattttagtatttttcttgagtcgcaatgttttatgaaatgactaaaagggaattacatggctttgattggtcgtcaactttttagctgggtgaatctaaaatgtacgctgtgtgtgtatttgtgtgtgagtgtgtgtgtgcatgcatgcctgtgaaagaagagaataagagtattattttccattctaatatagtgaacttaatatcattgaaggacatatacccaaaagttaaattttttccctttaagttgtggctttgtaaaatttttaagcatgtacttaagaataaagaagtaaaagtcattttaaatgtagctgtttctttttagatacttaccaatatattccctttatctaaacaattaccaatattaaagagtgctatattctttgagctatttatatgtgtgtttaagatttgtgggcatttatccttcaagaatgagggatatatattactttgggagtgtcacaaaattcctttacaaagtttgcaaaagtttactgcaaatatggcagcttataagctgtatgtttcttatattttttaaaaagcttaactgatatggctgttgtataattatttaatcagtgctttaaaatttattagccagtctgtaataaaaatatcaatacttataatcttcataaaatctgcttgtttttggttcttaatttgattttaatttttttttgttggttagcatatttaggatgcagtaatatgacaatgtttattttaattatagttcaaattttagctatgctaatattgacatgtacaagtatctgcttgagtgcctgttttcagttcttttgggcatgtacctaggtgtagacttactgggtcatatggtaattctatgtttaactttttgaggaactgccaaactgttttctacagagactgtaccattttacatttccaccagcagtgtttgagtgttccaagttctccacatcgttatcaacacttgttattgtcaattttttaaaaaaaattataaccatcctagtaggtgtgaagtggtatctcattgtagttttgatttgcatttccctaatgactcatgcagttgagcatcttttatgtgcttactggttttttgtgtatcttctgtcattgttaccattgttgtctattgaagtcctttatttatttagagatggggtctcactctgtcacccagactggagtgcaatggcacagtcatacctcactacagcctggaactcccaggcttaagtgatcctcttactgtagcctcccaattggctaggactacaggtatgtgccatcatgccaggccaattttttgtttgtttgtttgtttttggtagagatgaggtcttgttcttttgcccaggctagtcttgaactcctgggctcaagccgtcctcccgcctcagcctccaaagcactgggattacaggtgtgagccactacacccagtccctttgtcagttatttaattgggcttgtgttgttgttgttgttgttgttgttgacttacacttgttttacatagtttggatattaaacccttatcagtatatgttatacaaatattttctctcattttgtaggttttcttttttactttcttgaaaatatcctttgacacacaaaagtttttagttttgatgaagtctgaagttcagtttatctattttgtcttttgttgtttgtgcttttggtgttatgtgtaagggaatccattgccaaattcaaggttataaagatttacccttaggttttcttctaagagttttatggttttagctctagtatttgacaccaatttgaccacgtaatagttttctttttgccttctgttgaatttagatggcagtgtttggtatatttgatttctctttaataagaaagttttcttttttttatataagtgattgactgtaaattgacataatagactaaatgttttttctataatttattatcctttgaaatattcctctccttttctttaaagcagtaaatcttatgctatttctttatataataataccttgctcttatggttttaaatgtgaaaagttatgattaagataaacttttggcaaataattttttttttttttttggagacagagtctggctctgtctcccaggctggagtgcagtggtgcgatcttggctcactgcagcctccgcctcccgggttcaggtgattctcttgcctcagcctcccaagttgctggggctacaggcatgtaccaccatgcctggctaatttttgtatttttagtagagatgggattttggcatggtggctaggctggtctcaaactcctggcctaaagtgatccacccgccttggccttccatagtgttgggattacaggcgtgagccaccgcacctggccttgaagcaaggtatatatgtattatttcctttggaggaatagagattttttttgtttttttttgtttgtttgttttgttttttgttttgagacggagtctcgctctgttgccaggctggagtgcagcggcgcaatcttggctcactgcaacctctgcctcctgggttcgagggattctcctgcctcagcctctggagtagctgggactatagggacgtgccaccacgcccagctaattttttgtatttttagtagagacggggtttcaacatgttggccaggatggtctcgatctcttgaccttgtgatccgcctgccttggcctcccaaagtgctgggattacaggcgtcagccactgcacccagctgagattggtctttttaatactagtgctcttaatcttaatgtgcacctacattcctgaaacctaagcagattccacttttctcactttctttctctctccttccttcctcccttcctcctcctcccttcctcccttcctccctccctccctccctcttctttttcactattccttatacttgagaaacctcatactctctgttgactctaaaactcatgttgctttaaaaagataatttttatactaagaaaaaaaccactttttgtccgtctgcctggaggtctgaaggctgtatgttggtcagcttgtttgtgtttacgtacatgtttctatacatgaagaactttttgtctgacactatacccagaagtccagtgtgtattttgttcccttattatttttgacagcgtctcagaaattttctttttaatagatataaaaatgaaattgtgagtccttggtttactttcttttaattttcttctttttatagttaatataccatctattctatctggcctttttgttgttttgtaaccaatactttaaatttttttcagtaggaatgacttgtgtcacttgaactagaattcctatatttgtggcaaaagttcttccctcatcatagccctgttatacttcacgttaattagacgatggctagggataacacttaccttgtttactgttatactcccagtagttacataactctcattttagggaagtcatttaatttctctgacatttacattcctcctctgtaggctgggcgtggtggctcatacctgtaatctcagcactttgggaggctgaggtggtttgattgcttgagccctggaattagagaccagcctgggcaacatggcgaaactcggtctctacaagaaatagaaaaattagctgggtgtggtggctcatgcctgtaatcccagctactcaggaggctgaagtgtgaggatcacttgagcctgggaagttggggccacagtgagctgtgattgcactactgcactccagcctgagtgacacagtgagaccttgtttccaaaaaaaaaaaaaaaaaaaaaaagatttacattcctcctctgtaaaatgaaggggatttactagatgactttccattattaaaaatttataaaatcatgaggcatttattataagatttaaatttggtctcagagccatttgttaacatgtaggaaaagcctagttacataaaatgctttatttttgtagcattctctggaattctaattacatagcatcccaatataaaggatgattaggaaaaactgctttctaaaagataataaatagtgtaacctgcattagattctctagcagagctcataacagttgggctttggtatatcagtttgtgtaaggataaaagtctggatattccagaggtgtcatttaccaactttgtgggcttaaatagatgtttgaaaataataaaaccatttgtgttattagccacgtaaagattaaacatatgttggagtcagattgtccagtcatttaataaaataaatcatttagattatcatgtaatttatttatttatctgtaaaaatggatagaactcttcttattccttttagaatgagaatatcctaggtttctctttaactcatatgtttttgttgttgttgttgtttttgtgaaatggagtctcgctttctctcccaggctggagtgcagtggtgcgatcttggctcactgcaacttccaccttccaggttcaagtggttctccttcctcaggagtattatgtttaaacttcttttgttttatcacaatatatatatatcttttttgagatggagtcttgctctgttgcccaggctggagtgcgtgaccttggctcactgcagcctccacttcccaggttcaagtgattcttgtgcatccgcctcccgagtagctgggactacaggcacccaccaccacacccggctagcgtttatattttcagtagagatggggtttcaccatgttggccaggctggtgtcgaactcctgacctcaagtgatcggcccaccttggcctcccaaagtgctaggattacaggtgtgagccactgcacttggccttaatgcatatgtttttataagatgtgaacacacatgactttttcagagcaggtcaggtatgctacattctactagatattagaattggtttgaagagtggcttattttcctagaatttaagagattttggtgactccattgatgacacttttggattctaatttgctgttggtataaggaacttggaatatttatttgatatttatttgattattatctttgctgaatgcagctttaacgttgatttgctacataaattctatgaacatgtatgactctttttgttgtctgtctatcatttttgagacagggtcttgctctgttgcctaggcagtagcatgatcataactcactgcagccttgaattcctgggcttaagtgattctcctaggagcctcagccttctgagtagctgggaccacaggcatgcatcaccgtgctcagctaatttttaatttttttgttgagatggggtcttgctgtgttgtccaggctggtctcaaactcctgggctgaagtgatcatcctgcctcggcttcccaaagtgctgggattacaggtgtgagccactgtgcctggccagtattttttttttttttttttgtacagttgatttttcaatttagagctgtacacttagtcactcaactaatggttttaggcagtgagaacagggtagtttcagtgtttcacaagtcatctcatttcatggcacagattgaaaatgatagtcatgtttgtatggaacactggagaaaacttcatggggagataagggcacctatctgggtgaaaaaattttaaggttctttttaatggaattatatttttagaaaacacagtattagggaagatattatgtattgaatgtgtataacatgtccagatattttatttttatttatttattttttattttttgagacagtcttactctgtcacccaggctggagtgcagtggtgcgatcttagctcactgcaacctctgcctcccgggttcaagcgattctcctgcctcagcttcccaagtagctgggattacaggtgcctgcttccaggcccagctaatttttgtatttttagtagagatggggttttaccatgctggccaagctggtctctaactcctgacctcaggtgatctgcccgccttggcctcccaaagtgctgggattacacgagtgagccagtacgcatggtccagatgttttaaaaaataaggctgagcttgcttcaataaacttaactttaaaaaaaaaaaggtcttctatgggatgctgagacaggagaatggcatgaacccgggaggcggagcttgtagtgagccgagatggtgccgctgcactccagcctgggcgacagagcgtgactccgtctcaaaaaagaaaagaaaagaaaagaaaaggtcttctgcatgaaatattttcaagcaattcctgatcaagatttaaaattgatgatcctttcaaattattggtcattgttaatgacgagaaactgcctatataggcatattagcaaaaggcagaggaatatttgttgcccttttcccctaactctcaggagctcctctctcacatgtaattagaacttaaataatttcatcttcttaagttgtagttcaaagaggcaatcattcataaaatggaagtgctcttctttttctctgattgacacaagtaatgcttatattttctgggataaattggattttttgtttcttagatggagtctcgatcagcccccaggctggagtgcagtggcctgatctcggctcactgcaacctccgcctcctgggttcaagtgattcttgtgcctcggcctccctagtaggtgagactacaggcgcttgccaccacgcctggctaattttattttttatttttagtagagatggggtttcaccaagttggccaggctggtctcgaactccggacctcaagtgatccacccatcttggcctcccaaagtgctgggatgacagtgcctgacctggatggattttgaataaaataatgaagcctttctgcaggtttacaccgaagttgctctaccttttcccccttctgcctacttttaataattctttttttgaattcagattttagcactgactcacttagtgactcagtttcagcctcatgtttccacattctgaatccataaagtttgtcagtatatgtttttttgagacagagtcttgctctgttgccctggagtgcaatggcgtgatctcggttctctgcaacctccacctcttgggctcaagcagttctcctaccttagcctcctgagtagctgggattataggtgtccaccacctggctaatttttgtacttttagtagagatgggctttcactatgttgaccaggctggtttccaactcctgacctcaaatgatccacccgcctcggcctcccaaagtgttgggattacaggtgtgagccactgtccctggcagtatatgtgaattgtcaaaaattttaaggactgcttcatataagttaatcagatagcagggtgccagttagtaaagccattttttaaagtcaataactagtgttaaacaaatctgcaagttgagaattattcctcccaagctgtttgaattctacttttaattcataaattttagcaaaatttgttctctggaagtcagtgcacttttgtgtgaaatggaagacagtgatattctcatagtatttctttgatgatactaaatgtttaaatagtcttagattatttatcattttgataacatttaatttgggattaatatgtatcatatctacatgcatacttttatatatgaaagatcctctgtaaaatattttactagatcatcagagttttccaaataaattttttatttttatttttaaacgaacttctgggctcaagcaatcctcccacatcaccaagtgctggaattacagatgtgagccactgcacctggctccaaataaattcttaatgtaagtttacatcttgtagtcattgttagctacactatcagtatgcaaaattacagtgtttccataatatcttttttgtttcacagtttttctttagcatttttacttttatcattaggctttttttttttttttttttttttttgagatggagtctcgctctgtcgcccaggctggagtgcagtggtgccatcttggctcactgcaagctccgcctcccgggttcatgctgtttattattaggcatttctttaggtagtttgcaaaacagtcagtgctcttccgaggtactatattcagagtttatttattttgttttgagacagagttttgctctggcactaaggctggagtacagtggtatgatcagagctcactgcagcctctatctcctgggctcaagtgatccttctgcctcagccttccaaatagtaggactacaggtgtgccaccatgcctggctaatttttttttgtagagcgggggtcttcctgtgttgcccaggctggtcttgaactcctgagctcaagtgatgttcttgcctcagcctcccagagtagtgggattacaaggtgcgggctattgtgtctggctttttttcttttttagagacagagtctcactgtgttgcccaggtcgctgctgaggtcttgtgctaaagtgatcgtctccgggactcccaggtgctgaggtcggaggcgtgagtcactgtgtccagcctcaggtgttctttctgctgttagcttgagcgcagttactcatgtgcagaagcttcactcagaatgaaaaagttttgatagagtagcattagtcattatgcatgtgtttatctggcatgccataaaatgttattctcttaatgaaatgtggcaccttttctgtttcttgttctgctttggaaattaacaaagttcttgacatttttttcctgtaggctggtacgtttacagttctgcaattgtatgcagcattctggctgtagctcttaattgagtaaccttgtagttagcttctcgatctgatattattgtaactaatctcgtaaaataactttgtgtcttattttgtgtttgcagaggtttagcctgcaaatcttcctgtatgaatgtaattctgctttcttaaaatgtttcaatgtaaattttattgaaagattataaaattaaggattttgggctgggcgtaccggctcatgcctgtaatctcagaagtttgggaggccgaggcaggtgaatcacttggggccaggagtttgagaccagcctgggcatggcaaaaccccatctctactaaaaatacaaaaattagctgggcttggtggtgtgtgcctgtattacctatataaccagctacttgggaggctgagacatgacaattgcttgagcccgggaggtggaggttgcagtgagccaagatcacgccactgcactccaccttgggtgacagaggaagactgtctcaaaaataaaaagaattttgggagcattccccttgaaaaccagcataagacaaggatgccctctcccaccactcctattcaacatagtattggaagtcctggccagagcagtcagacaag

SEQ ID NO: 11 - DNA, 31285 bp, Homo sapiens
gccagtcaccttcagtttctggagctggccgtcaacatgtcctttcctaaggcgcccttgaaacgattcaatgacccttctggtgcgtaagggggaaagagctgggggacgggagacgccctaacgccctttgcctctttcagctcccttcttgggaggcaagcaggaggcgattttagggtcgggctggggctcattcagttgattgatttttctcaaatatgctctaagcatctgttacatgccaagcactaatcaggatgctaaggataccgcagtgaaacagtctccgccccgtggggcttacattcaggcggggaatactgtcaataaacagcggtaatggagaaactacagcagggcgaagggaatggacccgagacgttggtagctacttgattttcaagtccgagagggcctcactgataagaacactggagtattacttgtagtctgaacttgtgcatttcttttgtgtattccatttgggcataaaagaaggaagattagtaaaggcagtttatgggtgtaaaattagagcagcagcacttattgaaaacataaacaatgaagttatggctgatattgaccacttatacctcaagcaccgtactaaggctttacatcgattattagttatgttaatttcccaccaactctaaggggtaatcctattattattttattgataaaaagactgagacttaaatttgctcagtgctacattaccaaagtgaccggactggaatatgaacccagcccccatcgtgtgctcttaacaccgcaatgcacagcacagtaaccaggaagccttagctgtgtttggtaggcactcatcatttaagatgctgtatgcggccgggcgcggcggctcacgcctgtaatcccagcactttgggaggccgaggcaggtggatcacgaggtcaggagatcgagaccaccgtgaaaccccgtctgtactaaaaatacaaaaaaaattagccaggcgcggtggcgggcgcctgtagtcccagctgactacaggctgaggcaggagaatggcgtgaacccgggaggcggagcttgcgatgagccgagatcgcgccactgcactccagcctgggcgacagagcaagactctgtcttacagaaaaaaaaaaaatgctgtatgctgggactgtgctactagatcttgtttattccttccaaaagccaagtgaggaaggtactgatattgacctcattttacagatgagaaaacagaggttttgtatcttgcacaatcagtaagtggtagagctaaatattaaagctcatgatttattcactatcatacactatttcgtggttactcattacgtctctaagttttgtcagccaacgtgtgaatgaaaatacaactactcacaaaggaaggccaaatgagcaagtgaatcagcacaaacttattttcttagttaaaagactcaaggaccatatgatttcccgagtaatcaaaggacctactcttaagttttgtcagcagtgtggctttaaggtttttttggtttttttgttgtttgcattatagtaggttaaactggctttatcaaagatatagtatttcaggctcacagttacagaaataatactaattattaatttgatgcttaatgtgtatgaggcactgtggtgatttttcatattccagtactccagcctgggtgacagtgcgagactctgtttcaaaaaaaaaaaagcaaaaaaacccccaaaatttatatttcaacctaagatgtatttttatatctctacacatacatacgaaagaaaagtttcacaaaacaatgcctaactttgcagcatatgagtcatgctttttctattgtttttactttttaaaaaatgctaatcaagatctactcatggggctgggcctggtggttcacacgtgtaatcctagcactttgggaggccgaggcagagagatcagctgaggtcaggagttcaagaccagcctggccaacatggtgaaaccctgtctctagtaaaaatacaaaaaactagctgggcgtggtggtgggagcctgtaatcccagctactcgggaggctgaggcaggagaatcgcttgaacccaggaggcaaaggtttcagtgagccaagatggcgccactacactccagcctagacaacagagcaagactccgtctcaaaaaaaaaaaaaaaaaaaaaaaaatcatgagttcctgtctactgtttgacaaacatttaggggacagcagtagttgcctgggaatggtccaagctccttgctcttcctatttatttgcatgagactctagactgaagtaaatagcttttcagagaatagtattaatctatttgttcccaatcagctaaagctttaggctagtagtattttaattactttaagtcctaaaggccccatctcaggtctgctatgtgtatttactcagaaatgccttcaaatctgggactttagttaagtgaaattatgcagtataaacttctggaacatacaaatatagtctagtacaatttgtactttgtgtaacattggctttttgaatttcctaagcctcacattctttgtctataaattatcacacaggattcttgtgaggattaaataaaataacatctgtgaaatgcttagcataatgcctggcatttagtaagtgctcaaaaaattctagttgctctagtgtggttgcttttcttccatgtgtttgaattgcagttgacatctttaataggtctgatgtattgatattagccagagatggattatcactataaatttttattctaggctaaacattgagggatagacaattttaattactttatttctagaaactgatagtagttatctttgtgactctcttcgagtagagttgacaccaagtattttatttgctatattcaatccttagtaagaaagccatatattgcctgtaatatatgatgttcatctcaaaactgtcgtttgctcagttgcctgtgttcctttgacccggttgatataaagggcaagatgatattgttcttcatagagaggccttctttgtaatatcaaatggatgcaattttttacatttaaaaaaagcagtttgttaatgacatttttacatttatattcactttattatgacatgttttaacttaagatcataagtaacattagataatatattaatgttttctatttcctctaggttgtgcaccatctccaggtgcttatgatgttaaaactttagaagtattgaaaggaccagtatcctttcagaaatcacaaagatttaaacagcaaaaaggtaatatagatcaccaaagaacaatggttatgtgatcttataagttttaaagttatgaataacaatatttaaagatgttatagcattttttaaaatgtgaagctagaactatatttaaattttatttgatggatttatgaaagggtcaagtacagaataatgctgtcatcattacattgttatataaccaggaaaattaagcaagatacttatattgatatgtagcttcccttttggtaattaccttgacttgtcagggaatattaggaaaatcagaaaggtgttagatgtgtaaaaaaattgtatgagtaattatttgaaaatgtacaactaaggaaagaatatattgtttcatcaaaagttgtaattagaaatttggggccgggcaaggtggctcgtgctcgtaatcctggcactctgtgaggccaaggtgggtggatcacatgagttcaggatttcgagacaagcctggccaacatggtgaaaccccatctctactaaaaatacagaaattagccaggtgtggtggggtgcgcctgtggttccagctactagggaggaaagtgggagagttgcttgaaactgggaggcagaggttgcagtgggctgagatgacaccactgcagtccaggctgggtgacagtgagactgtctcaaaaaacaaaaacaaacaaaaagagaaagacaaaaaaatttggaaattgtgttttgtgtgtagttaaaacacattgacatcaaccatgatctgtacaattcatttttccgcagaatctaaacaaaatcttaatgttgacaaagatactaccttgcctgcttcagctagaaaagttaagtcttcggaatcaaaggtgaggagcttttatatgccagctggtttatcaagtgtatcatcaaaaacatctgaaagtattgtatttgattagaatgggttaagtgtatgaatcaaggttataagtaaatctgtaaattaatgaaatgagttatcattagaactctagcaagttttacatttctgcctaggtcattatgtttaaatgtgcccttagttcacaattataatggtcttcaattctcaatcacttctatgtttaaattgttcattacctagtaaacatttcaaaattatgtgatgctttgatttattaagtaccaccatttgagttgttttgtttttgtgtatttgtttgtggggaagggtaagtgtttttgaagaaaagtgggaaaaaatgccaatatctaagagaggtttgctactgagaaactgttaaggagtggtgagagattaaattcttaatagtcttgtggcttgtgcaagagctactattactcttttcataagtttataaacaggcaagctgcatagtactttttaaattttatttatgtattttttttttgagatggagtatcactctgtcacccaggctaaagtgcagtggcgccatctcagcttactgcagcctctgtccccacaggctcaagcgattctcctgcctcagcctccccagtagctgggattacaggcacgccccaccacgcccagttactttttgtgtttttgctaaagacgaggtttaaacatattagccagttgggcaggctaggctggtcttgaattcctgacttcaggtgatcagcccactttggcctcccaaagtgctgggattacaggtgttgtccaccacacccagccgccatataatactttttaaaagacagctggggggcgcacagtggttcacgcctataatcccagcactttgggaggcaaggcaggtggatcacttgaggtcaggagtttgagaccagcctggccaacatgtagtcaaaccccatctctactaaaaaatacaaaaatgtgctggacgtggtggcacgtgcctgtagtcccagctacttgggaagctgaggcaggagaattgcttgaacctgggaggcagaggttgcagtcagccaaggtggtgccactgtactccagcctgggcaacagagcgagactcagtctctccaaaaaaaaaaaaaaagacagccgggcacagtagctcacgcctgtaatcccagcactttgggaggctgaagcaggtggattgcttgaggtcaagagttcgagaccagcctgacccacatggtgaaaccccgtctctactaaaaatacaagaaaattagccgtgtgtggtggcacgtacctgtaatcccagctactcgggaggctgaggcaggagaactgcttgaacctagggaggcagaggttgcagtgagccgagagattgcaccactgcactccagcctgggcagcagagcgagacctatctcaaagataaaaataaagtaaaaaagttgtacaaattaataggttttttgatgtgaaaaatattcagagttggaaaaaggcttaggttgttcattcatttggcagttgcctaagcctcatattctgtaatatagagctatgttgttctgtatggaagcatagccacatgtgtctattgagcaactgaaatgtggctagtgctattaaagaactaaatttttaatatttaattttaattaatacatatttaaagacatactcgattttgttagtggaacgcttttaaatatttttggaacaacttgagtatgtgaatttactttctcctttctatgttttatgaaattaaatatacataaacatttctgatgaaaatttagcattgaattaagacgtgctataagtgtagaatacaaagaaaactttaaagacttagtacaaaaatataaaacatctcattgataattttataccaatgacatgctgaaaaaatatatttgatatgttgggttaaataaaatatattaagatttttactttttaaacacactactagaaaaatttaaatgcataggtggcttgcattatttttattgggcaggactattatagacactcttttcttagaaattgatgtaagtggtttgacttaaatttcttgaagaaactgttctgtaattttgtaatttataaagccccttagaaaactaaattacatacaagtttgtatggagccccaaaataatagtccttccccataaaaaatttcatggagtgtgaaattaataaacatgacactgatgtcacccccacctcctgccccacttagaaacatctgaaacagatttcattcaagatgttgatgcctttcttccatttttagatggaaaagatattctttttctagccattgtgtcagaaagtctgttggatataaaaagatatagtgtgaaaattatatgtcttatttagaataaagccaatgagaaaattagaatcagagcttatgctgtttcagtttttatttctttgcatctgtatattttcctcttcgggtatcaaagtttaagtcgatttctctttgtaagattctttctgagatagcataattaaatattcaagatgtgttgctatttaacattagagggaggcagtcagtagctttattcataaagttccacctgttcttttcactgggctgattaggaaaatcctgatttattgggttgaaaatttctaaacctaaaatgtcttgagatttttagaatattttatttatcagatgagtggcctacacaatgtttaacagtgtaatgtttaaaatagaaactaactgattggatcccttcatcttttctgataactgaaaaacaaatttggctgtcatatctgtgacatctaaatttgcttataagtttttttggcttttaaacagaaggaatctcaaaagaatgataaagatttgaagatattagagaaagaggtaagcagtgctttaaacttagtgaaaagtacacatgatagaaagagagttacacagatttaagagataaggattctgttgcagtgtgaggagtcctgcagtgaggcaaacatgccatccagaacagtgcctacaggaaaacagttcttacagtatttcacagatctatccgggctatgttaatgtggtatgctggcaacgccgagattaaagatagcccacttaatgaaaaactgataactgaaaaatcattatgtcagttgattacaattatatatgtggatcaaatatttatatctatccatcgttcacagtcttcctgtatgctaacttatgttaacacaacatagctagaggatttcttagtgagcatgcaatcctagctggttagactgtgatgaagttaggctaactcgatgcattgctctgcacaataggtataggccttcctcatgggtgaaataacatagagctgtgctgtttgatatggtagctactcaccacatgtgatgatctaaattaaataagaactcaattcctcagttgcaataatcacatttcaagtgctcagtagccacatgtgattggcagctaccatactggacagggcatttccaccatgacagaaatttctattgaacagtactaacctaaagaacccatttactttcctagcaatgctaagcagctcactgtgaactttgcttctctgcagtcttttttttctgtttccattgctgaccaactcttttcctcatggatatattctttcaatatattaaaatctttcatttgattacagtcgaatgttggctttcaaccaagagtatgtcagagtaactgtaaatgtctgctcagttgctctgattcttttttatgtattctaataatgttagctatcattttactgagggtacatgtaggggttgatacttacaggaataatcactgagtctcagtgagatagctggtaagtgagtggtagagccaggattagaactaataatttacaccagtgacttcattgggtatagaattttagggtggcaggttcccccccattatattaaaaatatcatttcattgtcttttggcttccacattttctgttgacaaatattggtttgggtttttttttgttttttgtttttttaatctggtaatagcagcaagaatgatggcttgccaatgcctagtacattctcctcagaagcccagctctgccttcttgaaataaaaaacatttagcattttaagctaatttgaatttgtgtaattgaagctagagaaaataactattataggtggaaataccttaaaagtgaataaatagcggccgggtgtggtggcttacacctgtaatcctagcactttgggaggctgaggcgggtggatcacgaggtcaggagatcgagaccatcctggctaatatggtgaaaccccgtctctattaaaaatacaaaaaattagccgggtgtggtggcccgtgctggtagtcccagctattcgggaggctgaggcaggagaatcgcttgaacccaggaggcggagcttgcagtgagccgagatcgtgccactgcactccagcctgggcaacagagcacagagcaagactccatctcaaaaaaaaaaaaaaaaaagtgaatagatagcttaattgtacttggaacttatggcaactaaagttcttatgttcttaaaatgcattaagacttttaagatgtatcataggtaaatatgattattcaaatagctagtaacattagaatatctacaagcataatgtcaaaatcagagatttttccagaaactttaggggtgattattggtagcatctccttatgttggcattctatcagtgaatcatttattatcaccttgtttttgtccagattcgtgttcttctacaggaacgtggtgcccaggacaggcggatccaggatctggaaactgagttggaaaagatggaagcaaggctaaatgctgcactaagggaaaaaacatctctctctgcaaataatgctacactggaaaaacaacttattgaattgaccaggactaatgaactactaaaatctaaggtatctgagcctcatgataatatttacaattgaataaatataaacacgttttttagggccgggcacggtggctcacgcctgtgttcccagcattttgggaggccaaggcaggcggatcacctgaggtcgggagttcgagaccagcctgaccaacatggagaaaccctgtctctactaaaaatacaaaaattagctaggcctattggcgggcgcctgtaatctcagctactcgggaggctgaggcagaagaatcacttgaacccaggaggtggaggttgcagtgagctgacatggcgccattgcacttcagcctaggcaagagagtgcgactccatctcaaaaaacaaaacaaaacaaaacaacatacaccaggcgattcagattcattttgttaagcaaacatgtttcaagaaatcctttctcagggacttgctttagagtcttgcaatggactttccagcatatagaggtaagtgaccacccaaacaacctttcaaaaatgaaccaacaggccagccacagtggctcacacctgtaattccagcgctttgggaagctgagacggatggatcacttgaggtcaggattttgagactagcctagcctaacatggcgaaaccccatctttactaaaaatacaaaaattagtcaggtatggtggcgtacacccgtaattccagctactcaggaggctgaggcatgagaatagcttgaactcgggaggctgaggcatgagaatagcttgaactcgggaggtggaagttgcagtgagcaacacggcactccagcctgggtgacagagtgagactctgtcttacaaaaataaaataaaaataaaccagcaagtcacattaaggaaaagagggataagaacagtagactggtacagtggctcatgcctgtatttccagcattttggaaggctgagggctggagaattgcttgaggccaggagtttgagaccagcctgggcaacatatcaagaccccatctctataaacaaattgaaaaattagctaggcatggtggtggtgcacaccggtaatcccagctactcaggaagatgaggcaggaggattgattgagcccaggagtttgagattatagcgagctatgatcatgccactccactctagcctggacagcggagcgagacttgatctcttaaaaagaaaagaaaaaaaaattaaatcaatcagtaattatggtgtaggtcaaagactgttctctctaccaaagtatattaaagtcaaaaacataaccccagtgataggtagaaaaatcaatatttgtgtattttaaatatgtcttagcagaaaatatttctgaattttttacgtgtttgttgtatttagttttctgaaaatggtaaccagaagaatttgagaattctaagcttggagttgatgaaacttagaaacaaaagagaaacaaagatgagggtgagtgctgcccttggcaggtttgctgtgtctggatctggggatcagtacaactttctcatttcctaaaacaggtatctttgttgtgtagggtatgatggctaagcaagaaggcatggagatgaagctgcaggtcacccaaaggagtctcgaagagtctcaagggaaaatagcccaactggagggaaaactgtaagtgagtgaatgtgaagagaaattgttaagtggaagcaattcttgatttgagtctcttcacaaattattgtttactgagacttcaaccttctgttagtacttatctcattgcctccctccagttgccctatttctctttttaaactagaatgagccctaatcattctcaaacatgttgtgctacaaagttgtatgagtgcattacttttgtacatcttctgtattattaatgatgaggaaagatttcatgatcttatgaaagtggtcattagattgaaattgagaaacactggtataggaaattgtgatttatgcacaatcctagcctttgattttgagctttaatatacatataataaaatgtgtggatagtaagtattcagtttggtgactttagcaattgtatacacctacgtaaccactaccaaacaagatagagaacattttcatcccttcagaaagttccttcataccccttcttgtccccctgctactgcctatgtcatgtccccatccccataactactttctcacttacatcatcataaattagctttgcctttttttatttattattattattatttatttttttttttagagatggggcattgctttgttactcaggctggtctcatactcctggactcaagtgataccaccctggccttcagagtgctggagttatagacatgggccactatacctggccagttttgcctttttttaggacatgcaaaagagaaagagcatgtgtgtgtgttgcttcttttgtttgatgtaatttttcaagattcatccaaaccgttctgtatactgtaatttttcctattttatttctgagtagtggttcaccttatgaatatacctccatctctttactcttctccttttgatcattatttgggctgttgccagtgtctgccattaaaaagactgctgtgaacatgttttatgtttttttatggacacgtttttatttctcagagaaatttctaggagtagaattcttgggtaatagggtagtgtatatataatgttttttaaaactcagaagtgtttttgccatttttatacaccccctggcaatgtatgatagtttcagttgttccagattctcaccaacatttaatgttgtcagtctgtttgattttagcctttctactaggtaggaagtggtatctcctttgtgattttaatttgttaccatgaatgttgaccttatttttatgtgcttattgaccattttatgtgcatatcaccttttgcaaggtgtctattgaagtcttttgtccatttcttgcattggacagtttggtggaggtaaacagataagtaattgaagaccaggtagtctgggacaaaagctttatgggcacacaaaatgctatttagtatgttggatgggtggggaaaccaggaagaccacaaaaagaatattatttctaacacttgggatactgtaatgatggttcttgtcatcataggtttttttgtcagtatatattcagaaaactttctcacttaaataaaaattttagtcttctattttgatgtaaattgtgaatttgagaaattacataaaataatagttaagagttagggctctgtagtcagcctgcctgatacaggagtatctggtacataagcattatgtaagattattaaataacgaaactagaatgtattaacatatgcaatttttgttttagtgtttcaatagagaaagaaaagattgatgaaaaatctgaaacagaaaaactcttggaatacatcgaagaaattaggtaatatgagcagtagctttaaattgaaccttatttttttaatactcagtcattttcatcatttttctgttattttccctgtgcctaaatagatgtgctttttaagataatttgttttaatgcagttgtgcttcagatcaagtggaaaaatacaagctagatattgcccagttagaagaaaatttgaaagagaagaatgatgaaattttaagccttaagcagtctcttgaggagaatattgttatattatctaaacaagtagaagatctaaatgtgaaatgtcagctgcttgaaaaagaaaaaggtattacagtgttttatagttactttgtttagataagtgttacatacaacatttaggaaaaatactactatgctaaaacaaccttttaaatataattagctatactaacattttaaatataattagctatatagctatacaacagcaaaaacctgtactgcattttagaatattttactcttataatgtttgttttctgtttatttcaatacagcatattacctgtcttgattgaaatatatacagtcatataattcttgacttttccactaggtggctgtgtaacaatcagtagataacacagaacaagatttgtgggttttattatttagcacatagtatatattacatggagtaatgatacaaagttcacagttttgttttcttctttggaaataccatgctaaaagcagtgtaatggaatattatgggagtccaggtttctcagtcttaatgttcttatctaattccagtattcttgatgttttgcgttttctagaagaccatgtcaacaggaatagagaacacaacgaaaatctaaatgcagagatgcaaaacttaaaacagaagtttattcttgaacaacaggaacgtgaaaagcttcaacaaaaagaattacaaattgattcacttctgcaacaagagaaagtaatttaccaccatatttttttaaactgttcattttgtgtcatacatttccctatgtctctgaacacctttaaattgtgtatatcctttgatctaccaattctatctttagagtcttatcctgaggacataatcatggatatgctgaggatttagctacgtattttcactacatgttcaccctagggttatgaataatgtgggaaaatgacaacagatacagcaaaatagggaatttttaaaaaattttctggctcattcttgtgttatttaggctatataaacatttacacttaccttgtaaaagactgtctaattacagaagaaacaaagcaatttttaaaatccagattatttatagaacattttacatatcagtgagaagaaagaaagtccactgaaaaattatgggcataggatggaaacagagaaggagaagttctggcctgtaaatatagaaagatactccaccttagtagtaaccaaggaagtagaaataatatttttttcacttacaaaattggcacaaattaaaacatttgataacacaaaatactggtgagagttaagccaacaggtacttacatgcactgatgtgaaatattatagtgttggacaacctacaacagctaaaggaattgagtagatctatatacactgacctggaaagatttcagcaacagagtatatatcatttatatccctccccaaatgtatatgtatatataagtgtaaagaaaaataccagaaggcatatatattccaaactagtagctatctctgcaatgggaaaactaaaattagggggggaagtcgtcaaagataatattaacatcatttgtaatgttagaattatttcacaatggtgatgtatttgtatattgtatagcttaaaaaataattttatgtaatatggaaatcaccacacactttttacataatatgtgaaaaataatgttaatatcaaagccagttgtaaaacagatatatatatataaaatataattttagattaagaagtttctgcatgtgcgttgcatagaaaaaagcctaagatgatatttgccacaatgttaacaaggtataggaaataatctatgaaaacaaatatgctatttctatattgttttaagtttccttgaatctgttgaatttaggtttcatccttctttatctgtacttttttttgtctcctagtacaacctcacaatgccattccaaattattttggtggttttctgtttggatataggaattatcttcgagtcttcatcagaagctctgttcttttcaagaggaaatggttaaagagaagaatctgtttgaggaagaattaaagcaaacactggatgagcttgataaattacagcaaaaggaggaacaagctgaaaggctggtcaagcaattggaagaggaagcaaaatctagagctgaagaattaaaactcctagaagaaaagctgaaagggtttgtattaataggatctcatgtttatgtatgacttcagatgtatttattttgagtactttttttagtattctcttatcaatcatgtgagcgtgttaggttggaattattttataattaagtagtaattattaattattttacaattaagtagtagacacagaatgtgaacacaaaatgtacatgcaaacaagtaagacagccccctcttttaagttaaaagttaaaggttttgccccctttttttaaggccaaagagagtttaaataaacaaatgacaaaagttttacacttctttactactctgctaatttctgaaatttattgaacatcagcattagaacaataatcaactcagggctggatgtggtggctgatgcctgcaattcccatactttgggatgccaaggtgagaggactgcttgagctcaggagtttgagaccagcctgtgcaatatagtgagacctcgtctctactaaaaattaaaaaaaaaactagctgggcacggtggtgtgtgcctgtagtcccagctacttagaaagttgtgggaggagaatcacttaagcccacgagattaaggctgcagttagccgtgatcacgtcactgcactctagcctgagcaacagagtgagactctgtctcaaaaacaaacaaaacacaataatgaacttgggggaaaaaaataaagaatccctcccattaataaatagcattcccatttttgtctatgcacttacatagtgtaagttatacctttaattacatttttccgggagcacaaacacttcagaaatagcaatcaaaatgcaaagcaggctggcacaatggcacatgcctaaagtcccagctactcaggaggctgagatgggaggatctttagagcccaggagtttgaggctgtaatgctcaacgattatacctgttaatagccatggcactctagcctgggcaacgtagcacaagatgccacctcaatcaataactgataaaaagcaaatgagaaaaaataattataactgggaaacattcagaagtaagaaatctcttatttacagtagaaagactgaaatcttggctgggtgcggtggctcacacctgtaatcccaccactttgggaagccaaggcagcgagatcacaaggtcaggagttcgagaccagcctggccaacatggtgaaaccccatctctactaaaaatacatagtaaattagcctggcatcgtggcgcacgcctgtaatcccagctattcaggaggctgaggcaggagaattgcttgaacccaggaggcggaggttgtggtgagctgacatcgcaccactgcactccagcctgggcgacagagggagactgtgtcccaaaaacaaaagaaaaactgaaatctcacttttttcccgaactctagttccttataatttctgccacattatgtttccttctcccatacacttatttatttcattttgttttgttttgtccatagtaattgctaattttttatttattaagagaaactattccttagcctacatattcatatttcatagttcaggaacacaggttagtgacaaacactactacatttatttaaattaaaaagtctgatttgattcttgagttcaaattgcaaatatttaaatccttgggatctgatcattaaaacacttgttgtcaaaggactgtgggctagatatgagtttgtattattgtaatatatctcacacctgtgtatctgtctcagtggatacttttgttattaatcttttctgttttcttatgattagtgatgcaaatgaacagcaaggtttttcatatccctgcttttgggggaacaatacaaaattgtaattaggggtgttgttctatactacagccaatctcagggaacaggaatcttgggaaaataagataatgtcattttaagagaggaaagaaaattgagataattttttattccaactcaaaaaactgtggtccaatggtcaagagataaggatttttattactaattctgttagctagctggttgattctgagcaaaacaatcttagtttctttgatcttctacttcattagatataaaagagttttattagatggtctctaagatcccttctagcctggaaatttcaagcttaagagaaaaacaaactaagaattgaaaataattcctctaggggacagggaagaaaatatttttattataaactctttagtcatatttgattgctcttgctgtggtgtgtatatttttgaaatccggcacttgttacagaatgaatttgatcagctatttttcttatctcagtgtccaacttagtctataagtacacaatgcttatttacaatttttagttctgtatattctttaaaagatctctcataagctcatatgcatatctaaaaattttatcaccactttggaaatatattatttccaaaatatccctgagatttaatagcatatgtatataaaaatgacttaaaacccattctgtctatgcaaaataatccattaaagaagttattaagtctttcagtaatagagtattatgtgggttattcatataatcagaataaatccacaaagtcttgtaactctgtagtttaaaatgaagtggctttaattgttcatggtatttctcaagtgtctaaatggagagaatgaaactttattcaatccagatgttttttgactggtaatcttttgcagtctttagtcctggctagtatcttaagatttggttttatagtcttttatatcctactaccttcttcacccaaatttttaaagtaaaataagcaggaaagataagttgaagctagtagaaaaatgcataaaaaacatgctttcgaggtaagtcataaattaggatctgagctatttagcaggtaatgcagtggtgaagatatgagctatatgattcacagtttcaaaggtaaatactattttctttcttagggtagtaattgtaggtggcattttatctttcaattatttctttttcttaggaaggaggctgaactggagaaaagtagtgctgctcatacccaggccaccctgcttttgcaggaaaagtatgacagtatggtgcaaagccttgaagatgttactgctcaatttgaaaggtatttttcttgggagcctgcactcttaaatatgatgtgtgcagaaaggggtgtttaccccaggaaatatgtgagcaaagcagtcacacaaaggatgattcatactagtttaaattccataatcaccaaccgtaagtgggcatttagcattatctggtaatcttattgtatttatataattcccctttataatttatagaaattcccctttctcaccatccacttcaacttttatgtgctgagccaggtgcggcagcatatgcctgtagtcctagccactgcataagctgaggtgggaggatcaagtcatgtacttagaagcatttggtgcttctgccctactctcttgatgttatcattttcataaagaattcagaagtttttatctcttgctaaacctataaagagacccacatttatactcatcctatcttcccacctattacagatgaaatgtcctagtcttttaatcttcagtgacctcattctatcattttgttttctcataatttgaaacctttttactggaatttttccaatcaatattaaaacatgttaatgtacatctgtctgtaaaatatattaattagctggccactgtggctcataccagtaatcccagtgctttgggagaccaaggcaggaggattgcttgaggtcaggagtttgagaccagcctgggcaatagagtaagaccttgtttctacaaaaaaaaatattaagaattagccaggcattgtggcacatgctacttgggaggctgagggcaggaggatcacctgagcccaggagttccaggctgcactgagctaagatcacaccactgcgctccagcctgggtgacagagcaagactgtctcaaaaacaaacgaaaaataaataaaatacataagttgttttaaatacttctctgaccctaacttccttttgtagctgtctcacaccaccagtcattcccttcttaaccccaaattctactccttttcagtccttttccttctcctcctttttcttctcttgacagagaagattgtctctatatccacttcctcacctcccatgccttctacttattttctccttaaataaaaagtttattttgggtggaactacaaattacaaaggccaatataatgaatacctatatattaatgttaacatttttatttatcacatttactttagctcattttgggggagagtttcctttcttttatttaataaatacaaaagaatgcataacatgtacataaactgtagagcttgaagataaaactgacatgcatgaacctataaaagacaaccagtaagccaaaagattttcaacaacttagtatccatatgtaagttcctctgccatcccatgaaaatgggacagataacactgtcctgaagtctacactaattatttccttgctttttcccccctgtgtattataattttatgacacgtatatccatacaaataatgcattatgtaattttccttctccttgaactttaccaaaaaatgtcatcatagtatatgccgtttcctgggacttattttttcattctgcattatgtgtgttttcaggattgaattgtgttgtctgaggctatggtttgttgatagtcactgctatgagtattttattgtatgaatataccacaacttatttattcattctttggactttgagttgtttcccatttggttagttattattagttattttgtgactataagaatacatgtatgtaagaatttctctaaagccaaaggtatatgaatgttcaactctaaaacttaatatcaaatcactttccaatgtgggagtaagaatctacactcccactagtgttgtataagtttccatttatcttctttgccaaagcttgttagacttcttaaactttgccagtgtacttagtgtaaaatggcttcttattgtggataattcatctttccttttccataaaatgcttgtttatgacttttgtttatttgtctatagggttatcatcttttcctcattgatttgtagaggttttctttatcagccatatgggttacaggtatcttctgccagtttagcttatttttttattttctttttggtttcttctgatgagtggaaattcttgatttcaatatggttaaaatatttatctgtatgtgggtacttttgcttctcatttaagaacttctttctatctcaaggtgtaaagatattcaaccagttttcttctaaaagtcttaaaatttcactttccatttttccacctagaactgatttctgtgtgtgtagcaatatagggatcaaattcattttttgttttccctatggacaaccaactgcctagtttaatttaattcattaaattgtaccttgtttccccagtgatctgttcccacatgtgatacattatgacagacacatagataaataatttataagtgtatatgttttatttataatttttattgtatcagaacatataaatcatataaatatatgtaaattttatatatatatatttattgctaatatcaatcctgtaaaggaatttcccttctcgttagtttgaagaatagtgcttcagggggtttttatctattctgtgattttagtcactatccatatactcgtggcattaaaatttatttcatcaaaccagacctttctttacagctccatattcacatatccagttacccacttgacatcttcaagtagatatcacactgtcttttaatattaacctgtccaaaccaactcttgatccttccattgctttctacccctagtctctcattgtttttattgtaatcagtgacatcatcttcccagcttttcattctgtaaatcttagagtcatccttcatcattctctcttccttacccccaatattcagtctatctcttgaattttcctactctgcttccaaaagagatcttgtgtctttccattgccagctccttagtctaagcctcctttatcactcacctgggctgataaataattgttttggagttgatccttcaattttccattcttttcccctgccctaatccatcttcctcatagctctagagtgagctacacatttaattaaacacctttttattttatttatttgtttattttgagtcggagtttcgctcttgttgcccaggctggagtgcaatggcactatctcaggtcactgcaacctccccctcccaggttcaagtgattctcctgcctcagcctcccgagtagctgagattacaggtgtccaccaccacgcttggctaattttttgtgtttttagtagtgatggggtttcaccatgttggtcatgctggtctcgaactcctgacctcaggtgatccacccgtctcggcctcccagagtgctgggattacaggcatgagccaccacgcccagcctacttggacacctttaatggttcccgtctgtccgccaggtaagcccactgtgccctgcggtgatgaccctcatgccaccagcttctgctccagcctttcttactcattaggctctagtctcacttcttattttttaaattgtgagtaattttcatgcttggtagttgatttcttttccatctctgtatgcatacttcctgcacctagtaggcacttgatttttttttctttgaatacacagcagatgccatgtaaactcattagtacttgcctcagaacactgaattcttacctgtgttaaatgcatgaatacattaaaaactttttagttttacttagaagtatataaagtgtaaactaatcagttatgattgtcatacgcaatagttagaaaactactttgacttttttttctttttaataagctataaagcgttaacagccagtgagatagaagatcttaagctggagaactcatcattacaggaaaaagcggccaaggctgggaaaaatgcagaggatgttcagcatcagattttggcaactgagagctcaaatcaagaatatgtaaggtatatagagcaaataatggccttagaaccattaagacaatttaatgttgaaagccagctagtaactgtcccttggcttgcttttggccatcttatactgcaaattaagaatttactcagttaaaaaatgacacttcttgaagagttccttgaggtttaaagaaaaaaaaaggaaaaattaatgaaagtggctataaaatgtttagtgacctcttctctctcaaaccaaaggatgcttctagatctgcagaccaagtcagcactaaaggaaacagaaattaaagaaatcacagtttcttttcttcaaaaaataactgatttgcagaaccaactcaagcaacaggaggaagactttagaaaacagctggaagatgaagaaggaaggtaatctatgattagaacctgagtgccttgttaactcagttacgatgtgattttttaaataactatgtttttctcaatttaattcttccatgcagaaaagctgaaaaagaaaatacaacagcagaattaactgaagaaattaacaagtggcgtctcctctatgaagaactatataataaaacaaaaccttttcaggtttgtcagttaggagtaaacttacttgtgtttattttagggactcactttgttccctattatagtgaggacagtgactcgggttttctgcaagatcattttgctctgcacttacagtgccaatttagctcactattaaaggtttatacattttattaaattatgcataattttttcccacattattgaagtataattgacaaatttaattgacataattttttcaatggaccctttgtggtttaaaaaaaaactttgtaatgtggaacttaaaagtttggctcagagggcttgcctggtatgagcttttgataattaacctattttaatttgtggtatgacttattgcaaatactcattgtttctcaatatactgatcttttaaaagaaaaaagaataaatgctgattttggaacttagaagtacagtattggttataatgtggtaatctaactgatacagataaaactggccagctggcttttttaccttgtttcttttcctctgttttaatgatctttaaaatgaaaaatacaaagtttaaaagattctcatagagaatctatggagagccctgagaatatgtgaacataccttgttttcatttgtgtttttaattttctttagtgtttatggtttatatgaaactagtaagatcaaactgttttaagtcttaactttatttaaaaaatctttttcagctacaactagatgcttttgaagtagaaaaacaggcattgttgaatgaacatggtgcagctcaggaacagctaaataaaataagagattcatatgctaaattattgggtcatcagaatttgaaacaaaaaatcaagcatgttgtgaagttgaaagatgaaaatagccaactcaaatcggtttgtaaaatgacttttcattttattaaagatattggagtgggggttattctaactataatacttaaataaaatgaatatctttggtatcagaaaaaaataactgtttatagaggaaaattgagctgtgatttagtggatttattttagagtgttgaccagatgggcattcaatgttctaaagttttctagctaccttcttaatatattgaaaattacttgagtaattggatgaattcattaagctttacatatctatttccatttgcaaaactgcaaactccttgatgtaaaaccataaagagaagcagtgttcaaaaatatttgggcatttaaattttttaacatatgtattgagatataattgacaacccatacaatccacccattgaaagtggacaattcagtgttttttagtatactcacagatttgtgcaaccatcaccatagtcaattttaggacattttcatcacctcaaaatgaaaccttgttatccttttcctaacactctcctatctcctcaccccaccccacccttcagccctaagaaaccactaatctactttctgtctctgttgatttccctattgtggacctggcatattcatggattcaaataatatgtggccttttgttactggcttctttcagtcaattagcataatattttcaagattcacctgtgttgtagcatggagagtactttattttttttatagcctaataattcattatgtgggtataccacattttatttattcgtttgtcagttgataaacacttgtttgcacatttttggctattatgaataatgctaccataaacattcatgtacaagtttttgtatggacatttgttttttcctgggacatattatttccctgggaaataataggagggaaattgccagatcatttgataactctacatttaatcatttcaggaagtatcagactacattcagatgagatcgggtgcgttcagggtggtatggccatagaaaggtcaggctgtattcaaaagtggctcataccaatctatattctacaggcggtgtacgagggttccaatttctccacattcttaccaacatttgttattatctgacttctttatcctagccattgtagtgggtatgaagtggtatctcattaacttaacttgcattttcttaattggtaatgatgttggtcatcttttcatgtgcttactggccatttgtatatcttcatgaaagaaatgtctgtttatactctgctcatttttaaattggattattagtctttttattattgtgagaattcttcatcaattctggacacaagtctcttatgtattatttgcgaatatcttctcccattctgtgcattgtcttttcactttcttgatgatgtcctttgacccaaaaaacttttatgacgtccagtgtgtctatttttttgtttgttcgttccttggtatctatctcctctgccaaattcaaggtcaggaagatttacccctgtgttttcttctaagagatttatagttttagctcttacatttagattattgattgattttgagttaatttttgtatgtggtgtgaggtaagggtccagcttcattctttagcatgtggacatgcaatagtccccacactattttttaaagagaatattcttgcctccagttaatggagttagcatccaattaaaaaatcatttagactgtacatgtatggatttatttctagactctcaactgtcttccattgatctatacatctatccttgtgccaccacactgtcttgattactgttgttttgtagtaagttttgaaatcaggaagcgtgagtcctctttgtatttttcaatatggttttgtctattctggacctcttgcaattctatattaattttggaatcagtttttctacaaagaaaccagctgggattctgatgggaattgcattgaatctgtagatcagtttgggacatattattatcttcactaggttaagtcttctaatacatgaatatgggatatttttccaattatttagatctcatttaatttctttcaacaatgttttatagttttcagagtataagttttccacttctcttgttaaatttattactattttattctttttgatgttttgtaaatgaaattgttaatttcatttttggattgttgattgccagtgtatagaaatacaattgattttaatatatttatcttgtatcctgcacccttgctaaactcattttagttctaatagttttttagtggattccttaggatgttcttatagatcatgtcttttgcaaatagagatagtgttacttattttccaatctggatgccttttatttctttttcttgtctaatatctctggctaaaacctgtagtataatacagtgttgaatttagaagtaatgaaaatggatggacagccttgctttgttcctgatctagggggaaagcattcagtctttctccatgatatatgatgttacctgtatgatgtatatagcgtgacattattagatgttgatttgttggccagccgaggtggcttacgcctataatcccagcactctgggaggccaaggcaggtggatcacctgaggtcaggagtttgagaccagcctggccaacatggtgaaacctcgtctctactaaaaatacaaaagttagctaggtgtggcggcgggcgcctgtaatcccagctacttgggtaggagaatggcttgaacccagaagacagaggttgcagtgaaccgagatggagccattgagcctgggagacaacagcgaaacaatctaaaaaaaacaaagatgtcgatttgtcatagatgctctttatcaagttgaggaagttcccttctgtttcctagtttgttgagcatttttatatgaaagggtaatgaattctatcaagtgcttcttctatttctattgagattatcatgtaatttttttattctgttgatatgatgtattttattaattgatttttagatattaatctaaccttctgagataaatctcacttggttatggcatataattatttttatatgttgctgaggggtttttttcagccatattcctaagatatactggtctgtaggttttctttgctttgtttttgtttttttaatgtctgtctcattttggtatcagggtaatggtgacatcacaaaatgagtgagaaatgttccctcttttctatgtggaatggtttttgaataattggtattaattcttcattgaatgtgtggtagaatttattggtgaagccatctggaccttggtttttcttgtgaatattttttggttactaattcaatatctttacttgatataggcttattcagattatctctttcttcttgattcggttttcttcttgagtagtttatgtctttctataaatgtgcctaatttgttggtatataattgttcatagtattcctttataatcttttttttatttctgtaaggtcagtagtaatggcttctctttatttctgattctagtaatttgagtcttttttttttaagtttctttctttttttaaatttttagtggagaaagaactttatttttttgtttggtttttgggtttttttagagacaggatctcactctgtcaccaggctagagtgcagtgatgcaatcacggctcactgcagcctcaacctccctgggctcaggtgatcctcccacctcagcctcccaagtagctgggactacaggcgtgcgccaccacatccggctaatttttctactttttgtagagacagagttttgccatgttgcccaggctggtctggagctcctgggctcaaggaatctaccagctttggcctcaaaatgctgggattataggcttgagccactgcacctggccaagaacttttcttttttataatttcatcttttattttagatgtgggggtacatatgcagatttgttacatgggtgcattgcatgatactgaggtttagggtatgacaggtcccgtcagccaggcagtaaggatagtactcaataggtggtttttcagcccttgtttaatggctgaaaaatccaacatccgattactctcagacattttttctccttgtgtccaaatgtataggttatacttttctgtttattggcatgccttgtaatttttcattggaaagtaaatttttagatcatatattgtagcatttctgggtacagctccccctccttttgggggctttttatttgcttgtttgcttaatgagtggctcaattattttagggaaacatatcccactacctccccagaccccaacagtattgtgcctctgatgttgctgttcagggaggtacagttttaggtgtgcccacaattaccctgggatgacacttgctttggtagggctgccttcctctctttccgtgaacatagtgactgtaaactccagtagatgctggctccttgcttgattatttgcaacagtgccttagggcataaattgctctataaactaatccaatcaaattctggctcctttgtagggattgcatacgagagcagtgctggatatttattctgactacagaagggctcgtcccagctgtcatattccctagttttctcctgcaaactaactagcctactgttcagcctgtatcttaaatctcctcccatttctctctcactataaccaccactgttctttaatggttccccaacctttttggcaccagggaccagttttgtggaaggcagtttttccacagaccggatcacccagcttgtgatgggtttatgtggatggtttcaggattaaagtgttccacctcagatcatgaggcattagattctcataaggagcatgcagcctagatccctcacatgtgcatttcacaatagggttcacactgctgtgagaatctaatgccgcagctgatctgccaggagggggagctcagggggtaatgcttatgcttcctggctcaccacttacctcctgctctgcagccgggttcctaacaggccttggatgggtattggtctgtagcccggaggttggggacccctgctttagagcacccttaggcttcagcttctccaagctctgttgcaggtgaagtcagttcctttgaaaagaaatgaggagctccctgttttatggcctacttgtcttttccgccctcctttccccctcccccgacaatatccctgagccaggactagagctgaaattggggacaatggcagttttctctctgagtgacatcctctgccctaggagctgagttttcagtggacttgtggggaagagatgaggaatagcctcaggccctcttgagtaacctcctggtgtagaaccatccccctcatgagccagagaaagagtcatcggggcccagcattttcaacacactgtgcccaaggtgagcccctgttccatgaatggggctgactggaggaagggatcccccacctcacaattgcatttgtccaggatataactgcagccacagggagctggggacaaaatgagaaactctgatgtcctggtcctcctgggagggaagcttctgactcggagttgggggaaaagagggccctgtgcttttggctgtagccgtctggcgtggactttgccttgctaagctgggagtgggaagaggggaaggagttttggcttaaacactgcagactctctttttcaccaaatttttgcagattttcttgaatagatgtttcttcatttgctatttttcccttaggtcaattttcagaggctttaactggttaatattttataacttttagtttcactagggagcaggtcagcagaactttcatgctgtcatgccagaagtccatctcagcaattacttttgagttgaacttttatcagaaaaatagctttgtagctgaggaggggcaaggagatttaaaagactgtatctcctttgtcacagctgtttcatgtcattttgtaattcagtcttaaagcctgtgtctagtagtgatttttgctgttgagtgtgataatacataaacaactttggaatttgcccgcaacattggtaacacatttcactgacatactctttaataattgtttattacctattatttctttttacctaggaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggtaagacatgaataaatgtataaaagtgtcctcttcctttggatttgcttttatagcatttagcaagtcatccattttatgaactgtgaaaatttgttgacaccttctgataaaagcagttcttactgagattgttgtgtacaatgactgttttcttcctccttctacgctttcttttctgtatacctggattctgcctgttcttcaaggcaaatctcaaatcttccttgaagctttgcatgactattttgtccctgtccacacaccccaaattactccctctataatacccttagcattttaacctaaatgtctcttaggtccttaatcattttctgatttgtagttttagagaagtaaatttcttatttcttgactgtgaatgtttgtctttcacgataaattaaagttggttgaaatgataaatctaaaaattatcttacagaatatattgcttcatctgccttaaagaagatacaaggcctgtttttagtttataatgatggataaattcgttttaatctagattactaatccttcttttcaataattcttctaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaagagtctaaaccccagattcttcagcttgatcctggaggtcttttctagtctgagcttctttagctaggctaaaacaccttggcttgttattgcctctactttgattctgataatgctcacttggtcctacctattatccttctacttgtccagttcaaataagaaataaggacaagcctaacttcatagaaacctctctatttttaatcagttgtttaataatttacaggttcttaggctccatcctgtttgtatgaaattataatctgtggattggcctttaagcctgcattcttaacaaactcttcagttaattcttagatacactaaaaatctgagaaactctacatgtaactatttcttcagagtttgtcatatactgcttgtcatctgcatgtctactcagcatttgattaacatttgtgtaatatgaaataaaattacacagtaagtcatttaaccaa

SEQ ID NO: 12 - DNA, 62998 bp, Homo sapiens
cgcccgccgggcgctctcgcttcagtcagtcgggccgcgccgcgcctcagctctggtgagtggctcggccgtcccgccggcccttctccgggagggttggcgcggtcagggccgcgggcctgtgaggggaggccggcggacaggtccagtgaaggcgcgggcgggccgggggcggctctttctgggctgggcggggcgcggggggcacgtatcggggcccgcggggggcgccggcggccgggatcctggaagtggccgcgacgccggaaggggcgtcccgtcggcggccgaaccccctgcactgccggagctgttgtttacccgcgcgcgccgtactttacccggggcgggcgggggctgggggccgcggggtccctgccccacccccctccctgccctcgggcgccagcccggcccctcgcccgcggcccgcccgggctgtgacacatcagcaccgccctcgcggctggggccccgtattgtcctccgccgcctcccaccgcatgcccagcctcgcgtctactcagcccggtggctgtcgcgcgtggaatcgcgtaagaaaagccgagtttgtggctggggagagaaggccaccgtgctgagctggatttagcgaagactggttttggggaccggagagcccaggactccctttgttggagttttgcccacgcgttgtaattaagcctcgcacaatatggtgagagtgggcgttgattctggagacaccagctttgtgctcgtgtaatgtaacacgagtgccgttgctttctcattcttacacggcagtttcatgtcattgagtagaattgtgcggaatgcttttatggagtgaggcttctgcgttaaacttgtgctgattccaggtaaagtgtagtagtaattgtgaaagaacgtgtatgaggaaaacgagctacaatgtcatgcttggaggaacaaagaatgttttgtaggatgctttgctttttggagaattgtgtaggggtagggactgttacccatggatgatgctatgggaatttgatcatgtatttgaacaccctttacatcagagggtctgcattgaatgcagttcagaaggataaagggtggaaatcccagatgtgttagtggcagagcacttgagcgcttcacatagtcaagcagagaaatgggaagaggtcggcttgcttcttcctggtctttgggtagtggtgcaagggctgggctgggcttgaaggcacttgccacttctgcctttggacatcttgaagaagcttagggaagaaaggctcccggtgagtcagcttggagtagggtgactttggcgtagtgattcttgtattgttgtttaacctatgtttctgtcaagtggtttactgttgttcggtatgttggttggttaacaaggtaggatgactctctaaaaagttgggttgctgagtcattcgccccagcttgagaggtaattagaaacagctggtgcaaatactctcatcacatgcctccactataaaaggccaaagagcgctctagagaggttgcttcagaaggctgaaggggacccagctggggttgttttgatacaggttatcagtgggtgaagtggaagagcactcttaggcagtggccaatagcactgaggcgggtttaaagacggagcctcgtgacctgctgtctgagaataaatttgcgctggagagagctaaaactggggaagaaatttgcagctaggggtaacccaataaaaaatattgtaacaaaaatatttactactcttactggacttagtttcctttttgtggtttctgttacgtggtctataagtttcaagcagtgagcttaatttgtgcgtcataaaaatttggttatgagtacacagaagggacttgctctgtttctcatggcccttggcttttcatgcatacacaagaagtttcaggagtcagaggagggtaagcaccatatgggtggaattaataggtctcattgggttaagtctcgaaagagctgtttaataaatagccaaccgtaaatacctgtctcattgtcttgattatatgacaccactgcctttacacctggtgtcattgcttcttgctttaaaaaggagcacacaacccaaatatttatatgagtcctcattgcaaacaaagtttaggaatgggaaatgtagagctgggaatttggccctttggtgaaaaaaatgatgattcctattaatggtagttcatttaaaatattctgtattaggaaaaacgatttattttgttcctttaagtctgggactagaggagattagaaatcatgaattttgtaagtattagggcctccaaggtggggtgcaaggaggttcatttggaaggaatatattaaaacttttaaaaactttaatataagaaagacattaagcttaaagatgcagactaacaatcgtgtattcatattatataatgcgcgtgcatgtcctccacccctttgttgctgggggaacatagcctgttaaccactgtcagtaacattctttcaacaaccggaatgctttttcttttaacttacggtttcctcctaagagttctttcagactgttaatattccatttaagttttattttataggtagttctattgtctgtatgttttactttagaagcttgagtgtaaatttcttgttacattgttgatactggggatggaaatacaaaaaatacagaatttcatttgataacctgtattttgaatttggagacaagcccagcggttggtttaatgtatgtgatctgaagtgcagtgatgtgtaaaagggtgcagtggaaatacttgaagataatctacacattggagtgtaatatgtatagcatatgtaaaaattagtttgtactgttactccttgaagtctgtttttttttgtttgttttttgccaagcttatgttctcttaagattaataagacgacatattcagtaaatcccttgggaagtggcatttattcagaatatcaacctcctactagtgctgggggcgggtggcggcggtgagggtggttagtatttaccattcagttaaatctcatgtgccatgtgccttctacacccctgtactgtgagaggtgatgctcagaataacagttgcaaagcccgttaaaattaccacttgtcagattttctcttcatagtgctgatctctccatgacttacgttttaggaatcaccacctctcttctaattttctgactaatgttctgttaatgagagaattgtcttaaccctaaaacctgcattccctgagcattctagacagagggtttattttatgtggtggaacgatgatttttgagattgttttgatttaaaatatatgtcaaatgaggtaatgtaccgatggccaaggtatgggtaatttgagtgcaattcgccagaatccgtgccccttggagggagtaaacatttcaggactgcagctaaaacattgacttacactctcctgaagcccaggcacctggcttacacagtgcactaacataactgaagtctgggtttgatcactgtacagttgacaaagaagcagtaagcagaatggttaaaaagtagttctggagccagactgcttaaggtcaggttctggttgtgtcacccactttaaagccttgggcaagctcttctacctggtaactagtgcctcattgtttcctctgtaaaacaggggtggtgatagtagaatctgtatcagagaggttgttgtgaggattatatgcgttaatacggggtaagtggttagaacagtgccagctttataagaaacatcaagtgttaggtgttattatctgttgttcagaatcagggaagtacttagttacacagtagtgttttatagctgttgagagctgaattgccggcattgatcacaagtgagactggaaaaacaacccggggaacactcttatgttaagtcagtagcaccatctcaaacatacatccaacttctgagggcaacgaacacaggacatagctttttacttaaaggaatcttaacagtctcagcggagtgcttgaggtagtcactaaccagttaattgaaactggcttttacgaaataaaaacacttgccattctttggctagtcttttccacgttgtagttgacattgtggcctggcagctttagtaacctgtccacccctcccttcttgttaataccagaacagaactagtttctcagtacatattcctgggccctatccagtttgttggaaacatttagaatgtaaatttgtaagctaattagtttcttctaagtattatgttttctttagatgatatgcctgtactaatacagaaaaattatccatgaaatggatatgaatacaatggacatatttatcgtatagctttttgtacctgttagtaattcagaaaggttgtgttattttgaccattctttcagccagattgtaagtttcctgatggtgagaatctgtgtctttctgttttatctcctatggcactctgaatgtgccttggctgtgtttctttaataaactgttggttgctgaactgggtggtatgatatgcgttcattctagttctgtgattttgaaacttgggaatgtttaacagattgaaggagagaacatcgtgtgtggtaccttgtaagtgtgcactgagttgaaattcttttgattatttagctttctactttctgtttttatcattggtgtgattattgagaaggcagctggaattaagtaattctagttcatctcctaagatagacataaaacttgtcttgtgacttatttttacccataattggattagaattgaattgagcaaaatataatttggttttctagatgttaaatgtcttatatgtctaatactttgaatatcactcctctagaacaggttctttgttttatttaggatcagggacaggttagaaaatattcaaatattcataggataataaaaaactgccctgaagcaaacgtgaggaagaagaaatagtggtagccagaatcttggttgttaatgaccagtgtagaaacacagtgggcatgcagtgaaattggctggcagctggttccttctcagtacgggcacaatttagaaaatgttacattaatgcagctgaaattttgtgcagatcatgttatttgaaaaataaatgtaaacactttttgcagtgccttaggaaagtcatcgttcaaactaatatttttgtaataaactagttattcccagttttttttttcttttttttttttttgagatggagtatcactctgtcgctcaggctggagtgcagtggcgcgatctcgggtcactgcaacctccgcctcttgggttcaagcaattcttctgcctcagcctccgtagtagctggaattatggggcaccccccaccatgcccagctaatttttgtgttttagtagagatgggtttcaccatgttggccaggctggtctcgaactcctgacctcaagcaatccacccgccttggcttcccaaagtgctgagattacaggcgtgagccactgtgcctggcccctaattattcccagtttctttcaggtaaagtttttttcactttttaaatttatcatttttttagatcagatcagtcagtggacagttgcactctacttccccatccctcattaaagtggaattacactaaaaaaggttttcaattcctttgtagcctggacattagtaatagcctacctctaaggctgtagagtaaatagtatagtaagggaaatgtccctccctccccctacacaccttttttccagttatctcttctttttattgatttgtctgcctccaggaccctagggaggtgtttttgtcctaaggaggtgaactcctgagggtcctattgaagaaatagggcgacctatccacccaacttcctctttactgatatcttcacatgcttattgccttattcattttctaaagtgtgccagcgtctttcagaagtcagctaaattagtgcagttgctcatccatcagacagttttgttataaaatatgtggctataaaagattgaataaatttattaggttgtaatttcattaatgtgtattttatatttaaatattattttaaaaaatgtacagtggttatctgatcttggcccaggcctcttcaatttccagtgtacctgatgtctctttatcaactgtttttctgaggtgtatctcagcctggccttgggtactcccctaggtaagagtcataattcaggttaaaagaggtaagaaaaaaaaaagcttttggcttttgtaatcttgtttttttttttttctttcacattagcaaaagactgttgaagtagagagcattttgcccagctcactcggattctttgctggcatgccttcagtttcagttgtcatccagagaagtcaaaggaaatgctgcttggggatgagcatgtaattacgattaactttccctacttcgttgtctctttgtggtaaaagactgtcacaagtgctattcaaactataggtatttttttttagatttctaaaaagtatattttgtctctgagggcctcctgtctttggactagtttgtctttttccagaccccagaaaggctgggccaccttttcttctttgagcaggttggcaacagtggtcacaaatagcagaggagctgagattctagagagctatcctaccactgcttctcagatgccagtgtggaaacagcctcttcttttttgttgaattagcttggaacagctctctaatctctgaagagtgaggaaaaactgtgtttttaagtttcaaggctaaggcactgtgttctcttttctccctgttcctgctgctgttctcccccaactcacatgaacgcatacttaactttcagtgtatgtggacagtagggttgctaaattcatgtcaatatttgtggcattcctacatgttaggcatttggtttacatttaacttatgaaacaaatgtttaggcttttataagccaggaacttttccagatattggcaataatgaacttttcagaagttacagtctaatagacaggcaaactattcccatagcatgctatagtagcaacatgtaaaatgtgctgtggaaccacagactattaaaagcctaagttttgggaaatcaagaaagccttagggatgtttagtgatgaatgcataggttagtggaggaaacaacttgtatcaactcaatttgagaagcttagctgtgaataagaggagagagaaatagattttagtagggagaagttgggtcaggaagagtgtgtgtgtgtgtgtgtgtgtgtgtgtgtgtgtgtgtgtgtatttaaaaatccagtcaatggaaaaaggttgaagatgcaggcaacgtccttgttttgtccttggcaagttcctcttatggttgcaagatggctgccacaagttcaagtgtcacaagaaaatatgacttaagtttcctggaagaagacacactttttttttttttttcctaggttgttgctatcagtgagaaaaatttttccctaaagcctcatagcagatgctaccttgtccctctctcctctcttcataggtcagcattgcacacaagccagtgcctaaatgagtcaaggtcaaggggaatagtaccgctgtgattggcataaatggatcgtgattcatcttaggttgtggctggggtctacttccttggaagttgatggcctcgggttgagagtagatacgtgagcacagtcagggtttggttagaaagtgagggggtgaatggtgttgtgcagttaacagtgacatccttgtctactagttctgccaccactacacttagatacaaacttcggaggagaaaaagaaaatgtgcttgcctttggatttggaattttaggtgactttttttcctcttatatgccatttccttctatgatcaagtagcacttttacaatcaaatcaaatcaatggtttatttaaaaattatttaaaaattgaaaatgccaattttgtcaataaatatatatagaagaaataattttttttttcaatgctttaaacatttcaaaagttccctgccattgtcttattcctttcagggagaggagaacatataattatatcttgtagtttctgattatgtgtatactaagaggactactctgtccctcagtccatagtgcacacccacctgtggtctctatggcttgcactgagtgctgaggccagcctggctcagatagaattgttagttcattggctagatgggtcaggattctttagaatgcaaattcttgaatcaggagtacaaacaggaacatcttcccttttctacacactcattcccctcctcgaagggaaagctgtcccgtagttagcttattcgtcattcttttcagactttaaaattaatgccaccttaagtttatacagtattcttgtagtactcctaacttttctgttttgctgtatgtgtacattgtagaaagattaaatcaagctaattaacatgtccattacctcacttacctttgtgtgtgtgtgtgtgtgtggtgagaacctttaaatctactctcttagcaattttgaaatacagtaggatccccacccactgttttactttcagcagtttgttacctgtggtcagatgaagtccaaaaatattaaatacaatagatattttgagaaagagacaaacatcacattcacataacttttattacagtatatggttataattgttgtattttattattgttaatctcttactgtgcttgatgaaaaagcatagtatatatatagggtttgttactatctgcagtttcaggtatccactggggttcttggaatgtatcccctgtagataagggggacacctgtgtatgttgttacaagtatgatcactgtgtaaaagcacttttgtatttcattcttgttccttctcaatcgcaggtctgggtgctttctgtgctgtgaaaggcagacaaataatgtaaatcctaaacacttgagtgttgtaaatttacaaaatgagaattgctcaatggttgtttctttttgagagtaacaaatagactgtgataaatggccagagtaggcttctgaactggtattagttttttggatagaatttagaaagacttgtactaccaatataatttttgtctcagataaatgcaatagtatttccctactcagtagttcctcagatgctatttaaactgagctatatttcagctttatttataggctgcaaattgttccttatttggctgaatcttgtggttatgatataatgaaaagtagttactgagatcactggtgcaaatctgtagcttggaaatcctcattttagaaatgattattttgactcccaagttaaatagtaaaaaatagacttatgtttttagttttagctatgtatattgagaaactgtggccctacggtggctgttagggattagtggattaggttgtttttaaataagacatttcagtttagtatctctacttgaataaaacagtttcaaatttgtgattcatatgatatactgattgccctacggtaacttctgttttatttaattaaaattgttaacattcttttttatactcttaagcacctccctccaccctcacccccctttttgactcaaattttattgtgagttggtgtatagttaggaatttgaagagcactttttttgtttattttatcttttcggttactatgcatactatgtgtgtcaactcttaaacctgcagggggtcattttggccatcaactagttttagggctttcgcctcctaaagaatatgaattatggttgtaatttttacagtttaaaaaacaagatggcatatgaagaatctttatttcattatgaaaatagaacatggatgcttaatcctctgtattgaaagtaacttgtagtgaaatacttcctagtgttctcttcttctagttgtccatatgtagtatgtataactatagaccttgatgatttaagttgagcacagtttagtgtcaggttcctttcagtgatgcatgagattggttatatgatctagtgagtgttatttagaaattaattcaccagacccgggtgtggtggctcatgcctgtaatcccagcactatgggagggcgaggcaggcagatcacctgaggtcaggagttcgagaccagcctggccaacatggtgaaaccctgtctctactaaaaatatgaaaattatctgggcgtggtgatgctcgcctgcaatcccagctacttgggaggctgaggcatgagaattgcttgaacctgggggacaggtgttacagtgagccaagattgtgccactgcactccagcctgggtgacagagtgagactctgtctcaaaaaaaaaaaaaaaagaaagattcaccaaatattgattaataaggggaaatttgttgttccacaaatgcccatttaatctgtttgtgtaatagtgttccttctcatcacacacaggatacttggggtatttcttgaactccttgttcttccatccctcctcagttttacctattcttcccccacataccacttgagtcatgtaacatgaattgaaatgtaatatttggacctgggagcagagactttttcagtctttaaattattgcccttctcaagcctttagtttccttatctgtaacagaagcgggtcatcctggatgaatgtgcttttttaattggaaattctttaggtctgtgaaattagccattattttgggcagacttgtgcaattttaatattttcattttatcttgagatccttattaagcttaactgaatttttattataggaagtgttaagccaggtaatttacagaagatcacatggttgatgatatcagtagagcgttaatctgattatccacagctgctggtagccttaaaataacctaaaacttgatttcctgttgtccctaataattctgtgtgtttaacacttcatatttttcagagggcttcgtgagacagatagggtgggagctacctacttaggctatctattcagtttcacacatgcacatttgcccttgttcacatggctagacttgacttgatgggtctttcctcctcattttcctatagcagggttctctcattttttttaaacaccaagtcttctttttattttagatttctataaaatttaatttattctttagtaatttattgtgaagaatctgctaagttttagagcccatcaacttatcatgtagtgacaaaccaattatctgctgatgactgtaggaaatatctactctaaagggggaaaatgtaattggcaatctttgggagatttcacgacaatcaaaataattgtgaactatctttttaaccaaggcacattttttgtttgtttatagttatttattccaacatttttctgattataaagtagtatgtatttatggttaagaatttgaatgcagaaacaaaaattacctagatcttaccatgctaatattttaattatatatcctaacaaggcatggtgatggtgatgagggtggcaaccaagatttctggacatactgaattggtgatgcctattagacatacaggtagtaatttgagtatgcagttggctatatgagtatgaaattcaagagagaagtcaagattggaccaaatacgaatatgagagtgttcagcaagtcagtgaagtgatcgtgtctccattgtgggtccagatgggttcacctagggagtgtgtgcaaagaagaaaccagaggattgtggtatcctggaagccaagtgaagacaaggtttcaggaaaggaatgatcaacttgttaactattgctgagatgctgtgtaagaagactgaacatttgccatttggtgatgtggaagctgttgagcttcactaaatggtttccacggagtggaggggaaaaggcttgtttgagtggcctcaaatgaaattgggaagagagggaagagacagtgtgagtataaatggttccttttggaaattcagtacaggagagcaaagaattatagatcgaggggtataaggagggtcaataaattttaagagaggatccattattcatcagttccattaaaggcaaatgcaaaattttattatgtgcgtggttttctggtggaagttcaatagatttcatcagattctgtaaggcagagaaccagtgctctagtgatttggcagttcaacagctcatttttctggaggatacccttaaaattttaactgatttaaattaatattcaccagtattaaatagtatgtgtaacatcgtacccaaacaagatgtctttctgtatttttttctttccttctcttagttttgttaaaatctttttagttcagaatattctctatcaaatgccttttctatttgaagactctcctaaaaagttatattaatacttgcaaccaagtgatcaaccatttacatttaactaaattttgctacttttgtttactatctatttaaacattttaagtttgtgtttttagtcaaagtaatacttgttggtttttgtttgtttgtttttttaagtacagagaacaaccttatctgctgcacctcaccccctaattctgcttcagagttatgtgcaatgtttactggtttctgctatttaatttttttggtggatacctctgtctaaaatgtttacacctcagtttatttatcaacctaagatattatctgttgacttggtattactgtgggtgatgatttcgtttactctactatccccccacatgtatttgtaatcttattattccacttctactgttgatcacctctgcaactccagctctaaacactttttttctatttctttttcttgtctcattaatctgaggcagtgccttttgactctgcacattgtaagttgtatggaaataccattcccattcttcctgattctgtctcccagcctgctttattttgtcaaggttaataatatttacattctatgctatagttataattaagtctctcattatttgtctattctaaaagttgaaaaaagtcacagagatgtaaagtgacatgcttaactgacagtggagtcctcaagttataaagtgctattaatcttttgtgctgtccacccataggtatccctagagcagcgctagctgctgtttggcagtttctggagaagtctttatgtccttacttgtgctccctgataacaactctgtcctcatcttcagcccctgattgtgggattttaggggtatctgagatgtaagcatttagaaagtggtgtagacaaaccgtggaagaggctgagttgggaaattttacgtgttgggggaattttcattctttgcttttttcccctcccctctttcttgtgggagccttaactgggatagtaacaattgcacccgcctctctgcccattagttgctcatcttagaaaatctacagttaacatatttagtggcgaaatacttaacactttccttatatgggaatgagatgaggatacccactgtcaccactctcactattcggtcattgcaataagggaagaaaaagaaataagcataaagacgggaaagaagtaaaatggtctctgtttgcagatgacatgattgtgtgcatagaaaatcctatggaatccacaaacagctatccgaactagtaagcaaattaaggttgcagaattcacggttgatatttaaaacgataattttgtttttacacaatagcaacaaaacaaaacaaaagagaaaatgaagtttaaaaaaaccaactctgtatgcagtaactataaacattaaatgctgaggaatatagcaaaagcttcacaagccctctactaaaaagatcataataatgctgagataaagaatgcctaagtaaatgaagagagatgccatattcatatactggaggactcagttttttagatgttggttctccccaaatagatctatattttcattgcattcctaatcagaattcaactagctcttacagtagaatttaataagaattaaaaagcccagaagaattagacatttcacaaaagaaggtatacaaatggctaataagcacatgtaaggaggctcaacatccattacttatcaagaaatgcaaagtaaaaccacagtgagataccaccatacatatcaggataggcaggattaaaaagatgacagtaccaagggttaatgagaatgtagagcacggctgtccaaccttttggcttccttgggctgcattggaagaattgtcttgggccacaaataaaatacactaacactaacgatagctgacaagctaggaaaaaaaaaaggtccatgcatgattttcatgctatctgccaccgccgatgaaacaaaacagtcctcacgttcaaagggatggacacgtcttacgtagagcattctaattaattgccatacattggaattgtcatacactgctggtagcaagataaaatgatacagtcactttggaaaactattcagtaatttctaaaaagttaggcatgtgcctataatatgacccagctcttctactcctaggtgtttacccaagaaaagtgatacacgaaatatatgtccatgcaaatgttcatcaaagctttattacaataatcccaaattcagaacaatgcaagggtacatctttattatagtagtccatcagagtcaaatggataaacaaattgtggcatatccatgtaatggagtgttattttgtaatacaaaggaacatctgatgtatgcaacaacatgaatgaacctcagaaacattaagaagtaatgtttctgagtaatgaaagaaacccgaagtaagagtacataatatgtgattctatttgtataaaaagaaaatgcacattaatccatagtgacataaagcaaattattggttacctggaatcaggcacagggaagggtacatgtcaatgcccttggaggaaggggcgtgtgaaattttgaggactgatggaaattttgtcttggttggggggggtggtggtggttttatgcacatatacagttgttaaaggtcattgtattgcatgctttaaatagatatggtttattctatataaatcatacctcaaagttgcttaacaaatagtgactgacaaaggcatgacagaaaatatgtattcagtaaaaaagctttattgatgtggaccaattctagttactagttcacattttcatagcagataacaatcctattcagaatcaagtagcagccaaatatgttaagcaaataaaagacttcattgtttcttaagctctttgtagtaagaaggtataacagtggaatctgttagtcttgttttggttctggagcttggatttcctgtgttccttctcatctttgttccagtatttacttccaagctcttctaagcttatgacctggaattatcaaagttggttttcatcatttgggaagtaaaacaccatttatttttgagctttgaggagtctataactttaacaaacttccctaacagttcacagtcttctcctctaagcttaactttagtttcataatttcgaatatggatttagacccagcaactataacaaaaggtccatgacttaactatatagtttttaatgttaggaaaagtaaatgaaaaatcttgcctgtatgggacctcacatgatgttgtaataatcatgagctgcaaaaattgtagtgattccctcccaccccatttttaaaaaagcggtggcatctttagttatataacagttctaatgtaaattaccaggttatttactcctctaacaatgtcatcatttttggtgttgctgtaagctcctctgctacttaccttagttcaaacttttttttttgtttcccattttcattcagccttttcaaaatatatttgtcagtgtaccttatccaataatacttaaggattttcttaaggctgagagaaataactttagaaaatgtgactatcaaatacagatgtttaaacagttatgatatttaagcctgtaaacggttaaagaaaataacagcttggtcatggagttactcttccaggctctcctggcaggtgagtcgggtcttaggaccttgggaagaatgttgtcttaaattactgtcctgaattaagtttccacagactttctgatgttaagtttttttcagaattacagaatgatgaaaagccatgtctttagaatttttcttatgggaatctccaccttaaatttaaaatcatttttaaaataaaggcccttaaaggagagttaagggtgtagacacaggatactgttggatctttgccatccacttgaaaaattgaatgtaaggttcacctaatttcagaagaacactcaaactttgggtatcttaggtgtattgtaacaggaactgactggcttaggggagtttgaagcttgggcttagggaggttagctttcttagcttagggagctcagaaagatgtcatagtagaggaatttccctgtcttctgagccattgaataccctgccctgaaattgagtgaggtgaaagtaattgacaggttgatgaaggtgatgttaggcagaaacagtgaggaggcaaaggtggaaattccaaatagccactagaaatgcgagaaggcaggttttgaggaatggactgggctgcagatcagggcactgcttttataaaaaggctggcacttgcccatatgcaccgttcctgatgtccactggccaccacttgtggccaaccacacacacacacacccttgactaacagaactatttgtgaaataattgttctcattaattgaatattatggttaaatgaaaattgaccaggaaagtagtttttgtttgaagacttacttcaaataaatacctttccagatgtccacattcctgtgtaaattgattataatgatcattattatcttttttacttgaggcatcattctcattttgaacatatctaggttatgttcttgaagggacagtcttttatttgtgttttcttggcacttaatgcatcatatggcccagctaacacttgtaggaagaacatttgtcatttttcaatgaagataaaaaatgtatggtagcctttttttaaaaaaaaaaatttgaggtgttatttattgtacccttctacattgagaattaaaacacaacatataatctattgaaacttgaggtagataaaattctagctctttttcacacatggaactttatacaaagttatcttctgactttctgttagatgaaatattgtagacctggttccatgatcacatgttcaccttaggtttttaagagttttttttcctttaaataaattatataatgtgataaagccacagcatcttgttttctgtatgattttgaaagcaaaaatgtcaagtagtaactatatcaaaacttaaattatgtgcattcagcagagagcagaagttatttccaaattgaggtgtaggaagctttaaaatgcttattcatcctttatcagcactagtgaatgaattggcaatttcctaaggtcagcaaacttttattttgaatgataacaatagtattatttctaagaatatagaaaaatgcaggcgtaacacaggagtccaaatttagtattaagttaatagaattttagattctggaaggctggagtgtttttaggtttgagaaatgttagaaggtgcatgatggatgttagaggacatgaaggtgccgttcttgtctgatgtagttgttacgtagttattgggtaaaaatggattgctgaccacttagatggtttccaggattaggagaaatgattttcagaacacttctgtagtgcctcatgctaatgaaagcaaaaggcaaggtgttttcatgactgtaggtcatatatattggccatgtttatagttgccagtccttgctcttttttggcctgttgttgcaggtatgtctttgacttccagagggatgagctggcctcttttttgtccctcaagtcgctggaaaagctgtccaagaaattttctctgaatgcttggctcagtggcattgttccacatatgttggaataggtgactaggctgtgtttggaagaagatctagattggggtccccaacctccgggttgcacagcaggaggtgagtggctgtccagtgagcattactgcttgagctccacctcctgtcagatcagcagtagcattagattctcacaggagtgtgaaccctatggtaaactgtgcatgcaagggatataggttgcgcagtccttatgagactctaatgcctgatggtctgaaacagtttcatcctaaaaccattgcacccgcccatgtggggaaaatttgtcttccatgaaacccatccctggtgccaaaaagttggagactgctgatctagatgatctctgttttgtttctgtattaaaaataagaaattactaattcagcagcatgtacctgtgttggaccaggtccaacaggtatgcttgggttatggcagggaacaaatcagacaaagttgtgacatttaaacagagaactaaaaggtgaggcattagctggctgaagagtagaagtccagatagtggccacagtgtatgtggaggccctgaaatcagtaggagcttggggcctgtggagcaggaaggaagagacagtgaggctagagaatagcaagaaaggggggcaatggcttgagataagtctggattaatggatggaaaacccaactacataggacttgaggacgtgttaaggattttgaagtgatatgccatttatttggaagatgacgtagggtttttgttaggaagagaatacattggagggggtcaagaggggctttaggggtataaggcttttgttaatattatcaccactaataacagctaatattatttgttgctgtagaccaagcactgtgctgtgaacccttttcccacatcatctcatataaacttcagaacatctcagcgaggtggtgttttctctactttatagatgagggaaccgagacagtgaggttaagcaacttggccaaggtcatatagctagtagtggcagagctgggatttgaacccagacagtgtaagattgtaaattctgagactctaaatcctgtggtgtttgccactgggcctgtatttttcattgcgtaggtgatgcgcctatgtgggtcttgaaattgagtggatcgcaactgggatttaaaaaaaaaattgaatggagtagaaagtatcagactacttgcaagtaataagcataaatattgatatgtgaaactttattttatgtaagtaaacttgtacatttgtgagcttgtgagctgttatagaaggttaaacagcatttttccaggcaggagctgatgatggcttggattagagttgtgctgatgccgatggagagaggtggaccccagtgctaagaggcagaggcagcaggactcagtaagagattggatagaggtgcccagctgaggaaggaatgaggagtgagtcccagatttcttgtatgaacagcatcagtcatggtgcatgctgtgctcaatccacttgaagggagactgatccttcttagaggggtcctcctggatggctgttttactacctgaatttctagtttctctcagctgcagctgacaggacttggggttggcatctcgcccaggggcagcaaatctgtaagctagctctcaacccatgagatgatgtgttactgaaaactgcctaaacagatgttgagccaataattaattctctggaatttgaggtgagtagtcagccagctggtggcaggatgagaagcggtgggccacagatgtatgtagttgactactagcagctctagggtgaaggtgtaggaattatttgtgtggagtcaccttgagattcaaagaacctttagatttccgtttctaaggcccagagtcattctctttctgaagctcaggtccaattttttttttcttgctctctctgcggtccatatctgtattctcaagcataaccttttagtcatatccagctccccacattgctgcagtgaatctccatactgtgcgttcagctagtactaactggagacagaatgatggagtagttaaaaaaaatgtctggtggcaattctccatctttgtcttattggtcttttgatgttggccaagatacttcttactgagccttggtttccacatctgtaaaattgggatgatagaggagcatcacagggctgttttgaggcataaacgagagaaactctatctagcacttagctcagtgcctggtgaagaattacagcttaataatcttgccattgatagttaacatctttaggatagtctctggagagacttaaacgtgttcattaacaaacattatgggaaggagccagcatagagggagaggttggatatctatgagacagggtcttaagagaaggtattggatcccagagaagcaggcatggcacgggattaagagaatacattacagattgttttcaacagaagagggaacctgatggaggtggtaggaggactgttttttctgaggttgggtcccagtcatggtgatttgctaggagagatgctgatatcaggaggagaaaagtggcaaggtggaaagctattatagagaacaggagacagggacataccagaaaactggtgaacagtaccaagagcctgcgactgcacattgtaaatttataatgacaccagtctgtgtatttctacagtgttttctggcagtgctgtgttcaaaagaatgatgagctatagaagtaagattagtatagttttgaagggtgtgcatcctagataccaggaaagaataaggaggctgggagcgtgggtacagggacatagtagggcaggtggtcagccatggagtccggcttggttgggagggcagtgtgctctgggcagggtatagtcttgaagaaagaagagggcagtggtctgtgtgtggtgccacccacaaaagatatataacttctttgattgatggttttccctgttattcttaacactaatttcttgtgttgataactgaagtattaagactaattgctaaaaataaatttatattctcgtatgggccaaaactggagttagttctagtgtttaattttgaagttaccagtgatttcgtgtggtatgctgaatcagtaaataagttgtgatccttaaccttgggactgaacttcagtagtccttatttctcctttcatttttgtttggagtgtgtagcaaatctgaaagcagtaccatttactcattcactgaccatttgaaggcttcccatgtgtcaggagaacagaagtgaatgacgcagggatgataccgtgaggcatcacacggataaaggccaataagctcctcacagtatcatcctttccggccgtagggtgctggaagacaatattagaacttctcttttaacctgttactttgaacttctgtgtttctcagaacatatatatcagaatagtagcacatgtctgaaaaatatagataagcatacacgtattgggggtattcttgtttttggcagtagtgtgtatgtgatcaaaaaatatttggaggctattatatgttagtatgtattttaaaaaaatataaaattataactttttcttagcattttgagaaaacctagtttctgcatgtaattaatgaggtagttttacttgcctgtatttgtagtgtgaagtaaatcttactgtataaaaagacttactaccaagatctggcttgacacatttcagtcattttcttcttggtgctggaggaactttaccttttgtagaacagtgtcccttgttataaaacactaaattcacttgccatctatcagatgttgaggaatggggtgtggagaatgtggaacagcacatgcctgttttactatcagtctcatcccaaggtgtgacctctggggaccttccttcttacctctctggctgtctctcctgccttctctctctctctcaactgtctcaaaacaataggattgggatgccaccagaaattccctgctcccatctgtttgctcagagtaggtggttactcagtgtgtaatgtctcactttcagagagccatgaaatccttggttcaaaaagttccctcacaccaagaatcttttccgtaaaattagttagaaaaactgctatcaagaacctattttaaatgaagtatattgaataaatgcctctaggttgttcctctggaggttttttattttcatttttgttttaatgagtatgtatcttagcctgtatttgacactgtcattttttaacaagatgttatttaagtgaaatcttgcatgtgtgtttgcaggttgatgataattagaagcatgctttccactgaacttcccgacaacatttgttatgcagaatgtctctgagtgagaactcggtttttgcctatgaatcttctgtgcatagcaccaatgttttactcagccttaatgaccagcggaagaaagatgtgctgtgcgatgtcaccatctttgtggagggacagcggttccgcgctcaccggtccgtgctggcggcatgcagcagttacttccactcaagaatcgtaggccaggctgatggagagctgaacattactcttccagaagaggtgagagatccatgtttttggcaattttaatctacttttacttaagttttttatggttcataatgttgaaaataaagcacagtctccttgtcaggtggctatggagcatttcccaggttctgtgcaaccccttttttttttttttttagtttttttaatgtaaaatcattaattttgaatgttggttaacattactgagcagttggatataacataacacccactgttatgttatttttgatgaaatgaccaaatcaggacacgcccagtggattgtaggcaattggaaaagtcatggttttgagagtctgtgctgtgtgacattctcttctaggggccctttccagtgatcagcaattgtagctatgtgtgttagtctgttctcgtggcgctaataaagacatacctgaaactgggtaatttttaaaggaaagaagtttaatcggctcacagttgcacatggctggggagacctcacaatcatggtggaagacgaaggaaaagcaaagggacttacgtggtggtgggcaagagagaacttgtgcagtgaagctcccccttataaaaccatcacatctcgtgagacttattcactatcaccagaatagcactggaaagacccgcccctgtgattcagtgacctcccattgggtccctcccatgacgtggcaattgtgggagctacaattcaagataagatttgggtggggacacagccaaaccatatcactaggtttagggttctgtaaaacgtccgttttcccaagacatctcctatgaaaaggaggcactccatgagtgttctgtctccccttctttcttgacttagtctttatgtattgattagaaaaaataaacagtgttgcgtcatttttatatagccttatttttacatacatctttttctctggtctgttgtggagctcaggctaacaaatatttgggtccttgttaatgtcctgcctttcagaggaattctcttttgggtggggatgtgctggctgtgctgactcctagcagcatcccttgctttagttagtaactgctactagcagagtatcaaggctgtggcattgggacacaaatagaagttaggaggaatatggagaaagaatgtagaaatcatttgagtatgacaggtctatgtgggatattcccagttggatacggttggataaactgtaaactaagtctacagtttagcttgttgctgtccatgcctacttctgtgaaactgcagctacggttttgggaacaggttgtctgttagttttgtagcagaggtcagagtcaatggtgcaatatcaagaaaatggtaaaaaaggccaacctatgaactagccattgttttaaaaaaagaacaacacattttataatggagatgtattaactatggttcatattttcaaattattgaatgagactttacaagtaaagcaaagtttgattcgtggatttaggaggaaaggtatgtgcatacatgcatgtgtgtatgcattcattcattctttctaatgtgtaaatcataagttttcaaatatttgaagtgtttcattatagtgacaatgtcaaaataccttataactcactatcctaaagacctttttagattattttaacatatttaaaaattttaattgaaatttttatcgagtgtattagggttctccagagggacagaactaataggatatatgtatgtatgaaggggcgtttgttaaggagaattggctcacatgttcacaaggtgaaggcccattataggccacctgcaagctgaggaggaaggaagctagtagtggcccagtccgagtccaaaggcctcaaaagtagggaagccaacactgtagagccttcagtctgtggccaaaggcccaagagccctcggcaaaccgctggtgtaagtctgagagtccaaaggccaaagaacctggcgtctgatgtcaagggcaggaggcatccagcaggggagaaagatgaaagctggaagactcagcaagtcacctatcccacctttttcctcctgttttgttccagcctcgctggcagctgagtggatggtgcccacccatattgagggtgggtcttcctctcccagtccactgactcaaatgttagtcttctctagcaacgccctcactgacacacccagaaacaagactttacagccttcaatccaatcaagttgacatttaatattaactgtcacactgatgttttcatgtacagatgtaagaaacaatgcagagttccttttcactttgtccagtgtccgccattgataacattttgcaaaattgtagtatagtattacaaccaggatattgatacaatctcccatagcgttcagattgccacaattttgcttgtactagcatgtgtgtgtgcgggttaagttctatataattttatcccctgcgaaggtttgtgtatccaccaccatagttaagataacagccgggcccagtggctcatgcctgtaatcccagcactttgggagggcgaggcaggcagatcacctgaggtcaggagttcgagaccagcctggccaacatggtgaaaccacatctctactaaaaatacaaaaattagccaggcgtggtggcgggcacctgtaatcccagctactcgggagactgaggcaggagaatcacttgcagtgagccaagatcgtgccgctgcactctagcctgggtgacagagagagactctgcctcaaaaaaaaaaaaaaaaaaaaaggaactgaacttgccaacacaaagatcccttgtgttgtccttttataaccacagacatctcctgcctacactccatgccctcatccccttgcccccttcctccgtgcctaatccatggcaaccactaatctttcttccttttctaaagttttgtcattctaaaaatgttatataaatggaattatgcagtatattacctcttaggattgatgttgtttgacttagctgagattatccagcttgtgtgtatcagcaatttattcctttttattgctgagtaatattctgtagtatggatgtaccttgtgtgtgtgtgtgtgtgtgtgtgtgtgtgtgtgtgtgtgtgtgtagctttttacctattgaaggaaatcaggctaattctggtttttggctatcacaaataaaattgctgtaaacatttgtgtactggtttttgtgtgaacataaatttgcatttctctgggataaaagaccaggagtgcagttgctgggttatatggtagttgcatgtttagttttataagaaagtttttttcaaagtgtctgtaccattttacattcccactagcaatatgtgagtgatttagtttatcggcattctcattagcatttgatggtatcactgctttttattggagcctttaaaaagcctaaacatggtttagcatgtttatgtttttaagaagatcacagccgggcgcggtggctcacgcctgtaatcccagcactttgggaggcctaggcgagtggatcacgaggtcaggaaatagagaccatcctggctaacgtggtgaaacccccgtctctactaaaaatacagaaaaattagccgggcatggtggcaggcacctgtagtcccagctgctcgggaggctgaggcaggagaatggcgtgaacccgagaggcggagcttgcagtgagccgagatcgcgccactgcactccagcctgggcgacagagcgagactccgtcttagaaaaaaaaaaatcacaaatattaatattatcttgaccactcttataagaactcagtggtttcaaattaattttgtgcttttaatccaggatgatgccttctgtgtactggagttggttccatttgcctctcactttaagaggcaggtttaatgtaaatgtgcaagtttctacttaaaagttttgttacttcgagtccatgaatttttgctgaaacagtaccgaggcatgatttttataacttctcttagatcacttttaaaaatctgaatctttaaaacttttactgttaggaatttttgacagtaaagttaatagttaccagttagtatgcatttaccatggatcaagactttgtaactgctttacaaatactgttttatatcctttaaaattctgcttttgtagcttgtagcagttggagttgtttggaatacagtggccatgtggagctgggctagcagtagactcactatgtgtggcaggtagtgttcatcctgctctaattcatagatgattttttttttcactatcatgggaaaattgtggtaatgtcttacatctttaacttatgtgagtaaaccataattcatgtgcaattaagagaggactctataaaatagtgtgtggtccctgtgaaaagcatgcttttccaggatctttttcttttacatttcttagaagaatatgttttcttcaaattaaagtacatattttataattatcacaaataagttacatatctctctattcctcttctacttattttgtttttatgtactagacagctttcaaatgatgtgtttgtttttattttgtgtatcaacaggtgacagttaaaggatttgaacctttaattcagtttgcctacactgctaaactgattttaagtaaagagaatgtggatgaagtgtgcaaatgtgtggagtttttaagtgtacataatattgaggaatcctgctttcagtttctgaaatttaagtttttggactccactgcagaccagcaagaatgcccaagaaaaaaatgcttttcatcacactgtcagaaaacagaccttaaactttcacttttggaccagagggatctagaaactgatgaagtggaggaatttctggaaaataaaaatgttcagactcctcagtgtaaactccgcaggtatcaaggaaatgcaaaagcctcacctcctctacaagacagtgccagtcagacatatgagtccatgtgcttagagaaggatgctgctctggccttgccttctttatgccccaaatacagaaaattccaaaaagcatttggaactgacagagtccgtactggggaatctagtgtcaaagacattcatgcttctgttcagccaaatgaaaggtctgaaaatgaatgcctgggaggagtcccggagtgtagagatttgcaggtgatgttaaaatgtgacgaaagtaaattagcaatggaacctgaagaaacgaagaaagatcctgcttctcagtgcccaactgaaaaatcagaagtgactcctttcccccacaattcttccatagaccctcatggactttattctttgtctcttttacacacatatgaccaatatggtgacttgaattttgctggtatgcaaaacacaacagtgttaacagaaaagcctttgtcaggtacagacgtccaagaaaaaacatttggtgaaagtcaggatttacctttgaaatccgacttgggcaccagggaagatagtagtgttgcatctagtgataggagtagtgtggagcgagaagtggcagaacacctagcaaaaggcttctggagtgacatttgcagcacggacactccttgccaaatgcagttatcacctgctgtggccaaagatggctcagaacagatctcacagaaacggtctgagtgtccgtggttaggtatcaggattagtgagagcccagaaccaggtcaaaggactttcacaacattaagttctgtcaactgcccttttataagtactctgagtactgaaggctgttcaagcaatttggaaattggaaacgatgattatgtttcagaaccccagcaagaaccttgcccatatgcttgtgtcattagcttgggagacgactctgagacggacaccgaaggagacagtgaatcctgttcagccagagaacaagaatgtgaggtgagcaggaatatgttcttaattcattgttttaataaccattaattgggatttactgtggatcagctccctttgcatcattagggatataatcaggttcagggagtggggaggaaactcatacaaaattaattgtaagactgtgtgatagggctgggcgcagtggcccacaactgttaattccagcactttgagaagccgaggtgtgggtggatcacctgaagtcagaagtttgagatcagcctggccaacatggcgaatctccgtctctacaaaaattagctgggtgtggtggtgggtgcctgtaatcccagctactcgagaggctgaggcaggagaagcgcttgaatgtgggaggcggaggttgcagtgagccaggtttgcaccactgcactccagcctaggagacagagcaagactgtctcaaaaaattttttaaaaacactgtgtgataaataccaaaagagagagatgaagtttgaaggacttctgttcattcgtttccagtagatatattaaccataaagtaggttcacacattggctgtgttcacacatcggccatttaattgtttaaatcaaatgccatgctgcaagacaaaaaagaataatgattctatgctcattatttgataactcctggaaaaatgcagcatatattcagtcttgctcattgccaacaagaacctctagacctgggacatgtccctgagcagtggtttaacagtgattagttgtaggaatgtgacttctagtggagtaaagtttattggatctagtttttcatggccattgatttttaaattttcctttggccatttcaactattgatgaatgtcttaatttagcatgagttacatgtagctggtatgatattaatcaaagcaagcttgatttgtatattctgtttgtatttgatagatcctttctgtaaaatattacttataagtccaataatgacaagggcctgttagttccttccaaaaatatattaattaaaatattttttcttttttttgtttttatattttatgattttttttgcctttcaatagttggcttttctctttataatcacaatttacattctttttaaaaattatttttctattttatccattgcattttttcccctttcttgggctttatttgttttttgtaagaatacttaacatgggatctacccttataacaaaattttaagtgtacgatacagtattgttaagtataagcacaatattgtacagcagatctctataacttattcttttatgactgaaacttaacccatccaattgcaattccccattttttccctctccctagcccctggcaaccaccattctactctctgtttctgtgagtttgactgttctgtctacttcgtataagtgaaatcatgttggatttactctcctctgtgtctggcttatttcacttagcatgatgcctcccaagttctccatattgtaggcaaatggcaggatttccttctttttatcaggctgaatggtattcctttgtgtatatacaccacgttttctttatccgttcatccatccatggacatttaggttgtttccatatcatggctattgtgaataatgcggtaacgaatatggcggggagtacagactgggcacagtggctcatgcctgtaatcccaacaccttgggaggctgaggtgggtagattgcctgagcccaggagtttgagatcagcttgggcaacatggtaaaaccccatctctacaaaaaatacaaaaattagccaggcatggtggcatgtgccagtagtcccagctacttaggaagctgaggtgagaggatcgcttgagcctaggaggttgaggctgcagtaagccatgattgtgccaccgtactcctgcatgacagagaccctgtctccaaaaaaatatgtgtagatcagtgcagatatccttttgagattgtatagaaattgggatagaggcctatgttttctttaatgtaaaataagttctctgaaaaacttagatgtataccttcatcttcctaggtttgactataattataaaatacagcaataattagtaatatttatttcatattctaggtaaaactgccattcaatgcacaacggataatttcactgtctcgaaatgattttcagtccttgttgaaaatgcacaagcttactccagaacagctggattgtatccatgatattcgaagaagaagtaaaaacagaattgctgcacagcgctgtcgcaagagaaaacttgactgtatacagaatcttgaatcagaaattgagaagctggtaagtgtaaaagtttcttgttactatttaaattccaccactttcttttttgtcaaggaaatagtttttaaatttctaggtcagatataatgctcaattacttattttaatatgtatcaattaccattttatcatttttaccatgatatgctgtgatatgtaagtgctttttaaaaagaaggttttcaaattaagaatgactttactgtctacctaatcattagtggttgtgaatagattcaagaaattataaagcactttaggttctctgttttgtgtctatagaagttaatattccaggtgttcatttaaatgaactgtggacctgaataacttgttttggttgataccaaaaccagaccaaccaggatctttcatctaaggaaaaaaattctgatagatatggtgatatgaattgaaaatattaatatctaatgggatcctaagtgagaacaatgcttgcttttgaatcttttctttttcttttttgagatggagtcttgctttgtcgcccaggctggagtgcagtggtgcgatctcggctcactgcaagctctgcctgctgggttcatgccattctcctgcctcagcctccggagtagctgggactacaggcgcctgccactgcgcctggctaattttttttttaatttattttttgtatttttagtagagatggggtttcactgtgtgagccaggatggtctcgatctcctgacctcgtgatctgcctgtctcggcctcccaaagggatttcaggcatgagccaccgtgcctggcctgaatcttattttctattccagcatcaagacacaaattaactgaaaattgattagtttactcctctttcttttttccgttggtggaaggaagcattgtatgaaagaggacaactctgatagtacaggccagctaaagctaagatatggtaaaagatagcaaggaaacagcctagaagtagtaaaaacattgcttgaatattcaattttgtgtctattaattgttgaaagtttaaaagttgggattgtggcaagttttcaagcgtgaacattctagctatgaatggcaattaaacagcaacaatttagggaaaaaaattgtgcctccaggagaagttgaaaaataaaaaattattatttatatattgtacatatactttgtgtaaaaagataaaaaatcataactatattaaagagatgaagcataactaaataaaaaatagaggaactagatgttttacaaatagaggcatgagagatgttaaaaaaaaaaacaaaaaacccaaacaccgacatgatattgctgaatagttaaaattgttaaaaccaaggaggaaaagttttcaattctatagtacttagtacttttagagtgtgtatcagtaatacctttaataaacactggtgttctttcttattcagttttgaattaaacccttacctgcctttagaaggagtatagcattttgagcttcagtttttattctgtgctgcaatacagagatgctttttacactgttaggttatgcgaagctagtggaatgaaatctacataaaattgtactactgaagttcttagttatgcttcttagttctttttcttgctctttctcgtctgccagctataatttatagtagttcatagagtttatccagttttcttactcctctaaaaataaaaataaaagcgaaacaagactattctagtttatttcgtaactttattttataaatggatactaagcaaatatgtttgagagtagctattatcctttagaactactctatttcttggctcaagggttttatttttttgatacaaatcagacattggtttgctagattattgatattgctactaaatttcagatatctaggatgaagaagccttgctatctttgggctttcttctccctctgcctttccttcttagagaggtggcagatacagtggttaaaattgtgggctctcaatcagatgcttagtaactttgggcaggttaatttctctgtgacttggggttttcatcggaaaaataggataatactagttcctactttatagattaggtgcttatttgggggaattaattgagttaatccatctgaagaacttagaacaatgcctggcacgtagtaactactcaataaatactatgtattttttattattttccattttctactttttaaaaaattttatttggtttatttatttatttatttttagacggagtcttgctctgtcacccaggctggaatgcagtggcatgatctcggctcactgcaacttccgcttcccgggttcaagcgattctcctgtctctgtctcccgggttcaagcaattctcctgcctcagcctcctgagtagctgggattacaggcacgtgccaccacacccaactaattttttgtatttttagtggagaacaggggcttcaccgtgttagccaggatggtctcgatctcctgacctcgtgatccgcccgcctcagccttccaaagtgctgggattacaggtgtgagccattgcatccggtctccattttccctttcttaattgaccttcttcctaatgtctctgcctaaactgtaaactctgtgtttggtatattgcttctgtcatcatagtaaggttcctttcatatggtcagtgaataactactggttaattttcaatacaaagtaatattttgtttctcaacagtttttatgaaatccaaaatctgaatggtcagtatcctgtttaactattacattaatttggactctttggcttcaagaaacagacttttgattgaagaatgaatgaatgaatgaatgaatttgttgtagggagataggtacctctcatttagaagctagacaatggagccaggcctcataaataacagggaacagaagtggaagactcctgggaacccagggacttctctgtgcacccgcttcgctctctatccgagagtggctttgtgtgtcactaagtgcacatgggaagggtggctgtggcacaatgcctgaataatttcactctctccagggactaatccagtcagagactactgttttagtcagttctgaattcccaaggagagcatcttactggctgaattcactcaggtatcctcttctgtgactagcgagcaagaacaaaatagaagagtcaagaccctcctttctgggcaggcacagcagacatctgatagtgtctcctgcacctagataggcgccagtctgacttctaaaataaccccagagaagttgtgttggaatttttgtatcagagtgactcatttgtgtttcatcttccttgaagtctctactcagtccttcacactgctctcagttctagtgatttgtactggcaaactccagttgcagcgtgaggggtacattacaaatttctgtactgcgtagatgtctttctcagataaacataaacagaaaatatgctgcttattagctaatacgaataagaaagctggcccgtctagaaggaaaagaatttgacgtttaagatagttattatggtaagaagtttacttggaccctggttgttgggtgatgttatggatcttgtcttttgtaaacagaaaactaggagggttacagccagaggtttatacttagtagcatggagagttgagaaagaggaaggaatgtgaacagatatttgtgtatattttaatctcattgagatgttactttttgaaagtaacatggccaataaacaagcagtattcttagtctttatagtctaaagattataacaaacctatttaagggaaattgcttgtttaataattaaacagccatttgcacatagtgaatgactggttggctttaacatattaatagattcacagtatttattgctcaggtctaaaaatattcatgcagagggccctatattctagttagtttggtcttaggctattggctgtttgttttcctagaaagaaatcttggaactttttgcagttcgtcctgagggcaatggcataatagattctggatggatcagcatgtgataaaaaggggtttgattacaatagaataattattctaaaatgtttgcaaagtgggttagtattataattatgtataaaggaataaaggacacttttattaaagtctcagtgtgttgggacaaagggagatgtgagttagcatttagtaaataaggtatttctcaacaagaagttctgtcagagtctaatagaacctttgaagaaaaggtgtttatttatttggtggaaaaatggatggtattgactttagcatttattttgaattttatagtatgttagaggttaagcattaatttagcattgcttttattacaagaactgaatgcgcataatgcataagccagtaacatgactttggttttttttgttattttttttattttttttatttttttttttgaggcagagtctcgctcttttcgcccaggctggaggtcggtcttggctcactgtaagctccgcctcctaggttcacaccattcacctgcctcggcctcccgagtagctgggactacaggcgctggccaccatgcctgggtaatttttttatatttttagtagagacggggtttcactgtgttagccaggatggtcttgatctcctgacctcttgatccgcccgcctcggcctcccaaagtgctgggattataggcgtgagccactgcgctcggccgacttttaaaactaacaattataaagtctttggattcagcttctgttcagtgtttaacttatgaagctcttgtctatgtagctttctttacaaggtccaagtttattcttttctggaagattaattcagaagttagaaaatatacatatctctgataaccattttaacctcagaggtaccctgaaatgaagggagcctcgctttttgcagaaaaatatttaccaaaatgtatttcttttagaaagtatcaaatattgttttcgatatcaacttgtaagtgatcagcaatcagaatattcacaaacacttgcgctcagggttgaggtgttcagacaccattttatttcattacttttgtccattatgatggcacagaagtaaaacgacctcatccgtccttagtgatttgcattttgtggtgaagattatattttattaaaaataaacctgtcctattcacaactagtcacaatttactggctgctcaaccaaagcgcaccccagtggcccttccggaacctgccctctgtcattccgtgttgtcgttgagcagcatttcttgaaatgtggtgtgtgtcccattggcatcatagttatcttggggtgccccttaaggtggacatttcttagtctataccagagctgttgttaaggccctggaccttgcatttgatacaagtccaagataaatgtcatgtacgttttaaattctgagaactcactgcatgatagcactgaggtcagacggaggctttggagacaaatgactggaaagcctgcctggccactgggtagctttgtggtctggggcaattgcttaacctccagtacccacattcccccgttactaatgtgggataagagtaacagccacagcggggttgatgcaaggatctgatgagatcagggatgaaaagctgtttgtactgcccagcacgtgttcagggctcaatatgtattagttgtactttaaataaaagtggttctctattcttcctataagtatttgctggtgaccctacatgttaaatgttgtgcttggtaccaggatgtcagaaatgagtaagacagaatcctcacttacttacagtctcatagggagtcaagttcaagtgtgttcattttttcttgagcttcatgtcagcaccccccaccccattctaaaaatttcaagctttcagaaaagttaaatgaatgggtaccataagcaaccatatactctgcatgtagattctttgatttttgacattttgccacatttgctttatttctctatcttgatctttccgcctttgtctctccacctcagatcatctgtctatacctgttggtttgtcagtctttgcacctctatctccgtctatccatcttggtccttttttaaccccacttggttgatcttggtctctcaccccttggtgtcactgttgttcctgtcctgctgtcttgctggctgtcattcctcactctggctctcttcctctccttttattttctgaattgtttgaaagctaccatattatgacacttcatccttaaatgtttaaacatgcatcttctaaaaagaggcattcttagatatgactaatacctttattatgcctgagaatttcaacacatcctaaatattatatctagtttttattcaaattactctgattttcccatctttcatagatgcttttttttcaaacgaggatacagtcatcgtataatgcatttgattaaacctgtttagtctcttaatctagaacaagtactctcattgttttaatgacaataactttttgaagtatccaggctggatttctcataaatgtcttactttaagttatttgtctgattgcttccccatggctttaagtcatttctccatccctttacttcccgtaaactggaaatgtttgagttgaggagactgagtttaaacattcactggtgttgtcctttatattgtgtcgcctagggaggcaggaggtccagtgtcagtattgtcgtacctgggtagctgggaagtgccagattgctccattttcaaagtaatattttttcaacctgtgttgcttagttatctatgatgtgttacttgggcactttataattatcccgttccccaatactcctgcatcctttagaatatgttgatgaccttcactgtgattaccatgattacaaaatcatgatttttctaaatctttcattctatttacattattttagttggtattcctgattaaaaaggattgttcttcctttctttctcttttatttttttatttttttttgaaacagagtctcactctgttgcctaggctggagtgtggagtgcagtggcgtgatctcagctcactgcaacctctacctcccaggttcatgtgattctcctgcctcagcctcccgaatagctaggactacaggtgcccaccaccacacctagctaatttttgtatttttagaagtgatgggttttcatcgtgttggccagcctggtctcgaacacctgacttcaagtgatctgctttcctcagcctcccaaagtgctgggattacagacatgagccaccatgcctggccttttcttgttttctcttttccctccctcccactctttggaatcacagtggactcatggattaattttttctgattcaatttgttaggataagtaatagtcattattctttttgatgttgacatttttcaaatttggcctgggagagcccgttcaagccagctcctgtcctgttgacataaccatctagcacttgccatggtctcactttttaacctctattgtttcaagatttggaatcacccatttctttaaaactcctggtttcttctagcagttatattggactttggaaagcctacctgctgctggagtattattccttctgggcctttttcagtggacagagctaggaaatatatgcatctgtgtataaaataaagttcattatatcatgaattcatatatatcaggcttcagtaaatgaaagtaaaaagtacattagaaatcctgagtttatgtagtatttccagtccaaatttagcagtatagagcttttgtcttcacttctgtgtttatgtttaatctctcatcatttacaggaaaaattttggctccaattacattagtgtattgtttcctttataatatacagtaagttctcacttaacatgaaatgatggataatgaaaccagtttttttcctcatcaactttataatgaaaggatgttgtaaaaatgagaacacttggacacagggtggggaacatcacacaccggggcctgtcgtcgggtgggggagtggggagggatagcattaggagatatacctaatgtgccgggtgcggtggctcaggagttcgaggctagcctggccaacatggtggtgcaaacctgtaatcccagctactcgggaggctgaggcaggagaatcgcttgaacctgggaggtggaggttgcggtgagctgagatcatgccattgcactccagcctgggctacaagagcgaaactccgtcttaaaacaaaaacaaaaacaaaaacaaaaacaaaaaaaacgagttaatgggtgcagcacactaacatggcacatgtatacatatgtaacaaacctgcacgttgtgcacatgtaccctagaacttaaagtataatataaataaacaataaaataaaaaagaaaggatgtggaacaaaatgtttattgaggacctggtgtgcgttgtttctcttaaagtcagtttccaaaaacctgtcgatgattttaagtgagggcacactgtataaaaagtaagaaaattagacaatcagtattactattaacagtaaacaaattgagcagaatttgagatttatttgcttttttatgcttaaatatttcccagtgtgaagctttaaagttatttgaaatatttgtgttaccaatttggcatacaattaatttttttttctatttatattactgggatttactctacattttttgagacagggtttcactctgtcacccaggctagagtgcagtggcacagtcatgactcactgcagccttgacttcttgggatcaagcaaatcctctcatatcagccttctgagtagccaggactacaggtgcgcaccaccatgcccgggtaatttttttgtgaaggtgaggtttcgctgtgttgcccaggctcctctcaaaactcctgggctcaatcgatcctcctgccttggcctcccaaagtgctgagattttaggcatgagccaccatgcctggcctacatttttaatttgttttattttgaatgtaaaacgtttatatggttcaaacattaaaactatattttaaaaaatatatactccaaatcttgatctcatcttctccttataccctattcatagctacttcctataggtaaccattttcattagtttctggatttttttttccctgtgtttcttttctaaaaatgtgttaacattttatgtctactcttattatccatcctgctgcatggaagtattttatatacatttttctgtactttttaaacttaagaattgatttataggaaatattttttcttagttcagagaggttgtcattcgttttccagctccatagtactcagtagtgactgtaatacagttcaaaccagtcttctgtgggtggacagttgggatcctgcagtgaataactgtatactgtttcatgtttaaggagctgtgtctctaggacacattcctagaagtgggattgttggatcaagggtaaatacatacataattttattagatattaacagattcccctccttaggaattgtcatatttggccttccagcagcagtatatgtgtgtgtgtctgtccacaccctcagtcaagatttgttgtcagcttttgggttttttccagtctgatagtgagataccatgatatctcgtggtagcttttatttttatcttatgagtgaaaatgagcatttttgcttatatttctcagtgccatttgcagatttctctgaactgccgttcagaggttttacttactaaggaactattagtgaccattttctaacagtgagtactctttaccctatcataaaattgtcacttgtacttttggtgccaaattcttctatatctttattgggtgagttatatttatgatctttaaaaaaattatatttgaataaatattgtgcactagctattcaaaataaggatttagatgcaaaggtttttttttttttttttttttgagacagagtcttgctctgtcacccaggctggagtgcagcggcacaatctcggctcaccgcaacctccgtctcccaggctcaagtgattcccctgcctcagcctgcccttttagctaggtttacaggtgtgtgccaccatgcccagctaatttttttgtatttttattagagacagggtttcaccatgttggctaagctggtctcgaactcctgacctcacatgacccgcccacctcagcctcccaaagtgctgggattacaggcgtgagccactgtgcccagcctgtaaagattttttgttggtataaaatccagaatggtaccagaatgccaattttattcctttttaagaaatagctctaattaaaggtgcagcacttcaaacgtgatttatacagttgtttttataggaaaatggaaatatattgtagggataggtagcaggacactaatagtgagtcccactcatgactgtaagtagtgactttgggaggtatcttaaatactgatgtcattaagtaattaacttgaattacttgtattttacttttagttattaagctgactgctattatagtaaatatgtgtcttaaacttagagtgaaatggaaactgcttagaagcttagctgtgtaggagttaaagtgcaggggaacagatgggaacatttaatttatagaaataattctggtggagttctagggctgtgcctatttgttttagttgttgtgaagaagcaagccatcttgtatacttaaagaatgatgtcatccctaatttagtggggtgggaggagtgagagtatttaaagatcatgtggatattaagatacagaagtcataaaatatttgtaatcttcatagtatctgtaggttaagtagtggttctaatttctgggaggaagctcaagtactccttattttgttgaaccatatttaatttaaaagaccaaccagcagttgaaaattttctattgctgtttagaatagattcatcccaactttggtagaggagtccatggctgaatattgccatgagtgaagaaagattctttctcactttcttctggaagctttgttttcatcctcctttggattggcttctgagagaccataaaaagaaatgggtgttgattgcatttaatggttcctactgtgaacaagcagtaggtaccgttcttgccctttcagtatctgcagactcattttatcagaagagtgcaactgataaactttgcataagagaaaatgtactggccaaacattgattttgcttacatacacatacttaacacgcacattcttgacctacatctatttaaaaaaaaaaaaaaaaagaacttgtatataaaaatctgaacagattggagaatactttgccatataaaaatttagtattttgtatttattgtatattttctcaaaatattacaaggctttaaaatattttagaaataacaataattggattcatacataattttatagtaatacttttgtataaaaccataacaatacttttgtataaagcaaaattcgttttacccttttagtgacttttatgtcataaaagactaaaggatggcacttatagattagcactatgaactaacttgtctcaaggttaactggcagcctcaactctccagaacctgtcaatgaacagaaagcaaacagaacaacactgacttgttgagagttgtgataaatttcataagaaaaacgtttgactttctagcaagtgtttatttactcttttcttataaataccttgattatttggtttcctggctcataatagattagaagcaataagatgttagaacaagaaggatgaaatgggatgataatagaaaagacatgctgtcagcagtgataagtgacatggacaggaaggcaggaaccagaaaaacttttgaaaaattctgtggtagactttcttataggggtaatatcttaaaattataataataacaaaaatggtaattagcaagcacaaaattacccccccgaattcttcacactttagtaactcacccaccggctgtctctaggcatcttaaattcagtcccatcccttcagtgggtttgatgttgcttaaatcaagagaggtgttgtgtggattacatagctgagattgcatgttggaaaacatttagcacaatatctgtcagagaatctgctcaacaaatgctggtcattagttgaatcttgcaatgctttgagtctcagtaattaagttatgctaactgtacttttactttttttcttgtatcccatccaaaatgccatccatacctgttatgtacagtctgtaaatccagaaagctccaaaaaccgtatgtttgtcacaaactcttttgaccgaaaaactgccccaaattgacattagactacatagtctttatcctactttcttcattatttgctattttaatgtttacctagaaatgtaaagatagttgatagggaagtgctgccccaggcctgctagagaaattatgtgtgcacccatactgtctttccaaaacctgaaaaatgctttgtgccaaaatacatctgccccaagagttttgggtgggagattctgggcctttagtatttaatgtataattgaatggaattgaaaggataaactccatgtgatcttacttgatgagaagcccctgtatattatttgatcgccttggaaatgttgattgagctaataaacacaagccattgtgttctctttccccacttcacagcaaagtgaaaaggagagcttgttgaaggaaagagatcacattttgtcaactctgggtgagacaaagcagaacctaactggactttgccagaaagtttgtaaagaagcagctctgagtcaagaacaaatacagatactcgccaagtactcagctgcagattgcccactttcatttttaatttctgaaaaagataaaagtactcctgatggtgaactggcgttaccatcaattttcagtttatctgaccggcctccagcagtgctgcctccctgtgccagaggaaacagtgagcctggctacgcgcgagggcaggagtcccagcagatgtccacagccacctctgagcaagctgggcctgcggaacagtgtcgtcagagtggtgggatctcagatttctgtcagcagatgactgataaatgtactactgatgagtaaacttgcattcacttccttcaaaccatctaattttctcctgaagttttggcagcgtcttgaaagcctaatatgaccatctgttgctcaacaatactgtttttttcctttagtagtttaccataagggaatttcctttaagtcaaccatgatttctccttgatttctacaagagacaaagaaatgattttgcctcctggatatcagaaaaatccatgtgaaaatgtagtaaacctttaaaactcatgttttaaagaataataactctagtaataactcttcctgctattcagaataagtaggagaatgaaaactgcagcatatcagacagcaatttaacagcttgaaacatctacagatagttcctactaaaagaagtggcctgcagaagtttaataatttgacttttttctaatattttagtttgaaagaaaatttcttcccaagcaatgctaatagagttctattcttagaagcagggtgtcagctactgggaatatttttgtagagctgcattgtgaaaaaaagatggtcttacctgaatcttagggctttgttcttcggctcctaaaatcaggctttaagctacattgggaagatttagtaaataggcaagtggttggcctaagacgggggctgcttctcctcttcagtatggactctagaaagtctggctacatgaatagatttaagtgtcactttccctccctgccccccgcttcagtctctaccatatctggtcccatcatggacttcctatttcctggcatttttgtccctttggaagaagaaataggactcagaatacagtggcatgagtgattacactggcagcattatctcaggctccctagaatctggagagcttaccaacatgtaaagctgttcatttttccaccgtgggtcaccaatgccagaaaaccagacatcacggggaaagaatgttgcttactttttaccaggagtgcagttcatttttttcaccctgtttttgaagtcgtattattcacttgtaaaaatgattgtaacagataaaaaatgtatctgcagcaactctgcaggtttgtgaaataggatgaaactcaatctttttctattgtgggtttgcatttgaaaagcaggttgaatccttgctctcttctccaaatttggtgtggtataaagacacacaaatcattttaacttggacatttaaagatcagtcttagtgtttgttcagtcctgttacaaaatagataactgagcacctatcgcataacattttgcggtggcttttagccatgctggggttagatgtgtttgagagtcaaatgaaagctatggatcttctcagcaattaaaaaaaatgcatatattcacattcacagaaacattggcagaacccagttttaatggtacagaggagtagtttatagtgttgatttcaccaaaatcagagggctgaaagagacacttctatagactgcatcctgagcctagtgcagggcttgtctagctaatgtgggcagccaccacccactgtgtatgaacaagtctgaagcaagttggccttgcccttgagagtatatggggaccagtcttcatgtcttggagtaatttgtcaaatgttaccctttttgatcagggtgtagggggaggatattgctagtatattttcagtggtttgtatgttctctctgtcactgacttatttgtaagagaaaattagttggacttgtttattttctagtagcttttataagtacactcaagaatttgtcagggagaataattctgatagtgcatcccatactgcaaaagaatttgtgtgtgtgtgtgtgtgtgtgtgtgtgtgtgtgtatgtgtatgtatacatatatatctctccatataggtatttctttgatacttgtaattttaaatttcagcttcacgatataaaataatataagaacttctggtttacaaaatgtaaaatcttaagccaatggaacccttgatttcctacctcagtgtacacccaactattggttgtatcagtttgtgtatgtgcaaatgtcaaataatcttttgctttaattgctactgtacttgctttgaaagattacctactattttatgataaaatgtagttgtctccagagcttaaatataatttgtaaagcacttggtttaaatttctctctacctataaacagtttagcattaagggtttctattaatgacacagaattattggccaagtgtaatttcttaaaatttagcattactttaaatagccagcatgtaatacaagtaactacactacctcatatctacatgattttcaagttgtaatgcagatggacagataaaaaagattttacgtttgtcttttggccataagtgggaaagttttctgtatattgcatagcattacacatttatgcctattttaacattaacttctaaagaagttttttctaagaaaatgtttcaaggcaatattttttttgaggctgccgaagacaaatgacaggattatgagtatacagtgtatgccttttccttcatgcagaattttgaaatgttttcagtttgtatattgcatattcacatgatcattgttcactattttatgaactggccttctcaatgtttgatgattttttaaaagctgttatgttgaattcagtaaaataacattaccttattttttttcttattcaaattctggaactatagcaaataattcgttaaattgtcatattcaaaacaaatgtggatacagtcttggttctccatctgtaattttttttaacagtttgctatagcttactgcttaactaattttaaataaggaaataagtatgttagatgcagtagacgatacaggttgcatgtggacactcagtcacattaacaacttgggaaaaaaatggcaatgttacggtgaattctcaggtgaacttttttcagttataaaacatctattttgaatctgtaaatattttaaatgttttattaaggcatgtaataaactattctttgaaacttgttgggtagaatgaaaattaaagccataatggtagaagatggcatactgattataaaagaagcagaaaaacattgatttttttatatctttcataatataattttctaacaatgcaataaaaccactaaacttttgtgtccatattttactgagaccatgtttcattaaaagcatagtttcatagtatttaatttacatttctccctaatgttcttacccaaatgtacctgaactaaaaaatgttagatgttggtgataagttgacagttaaataaaattctctaaaattgcttctaattgaatagaattgtacattccattttcattttctcacttcatgtggatttactcagtttagtcttttgatcggtaattagtatatctgaatttgtaggagagaatctttccttagttgatgataatcatgcctcaaaaaaaaaaaaattccagcattcaggtgttttaggaagcacagattttagctttgcttctgattttacttaatgttagtttggatagagaagtatagggactcttaaggggtattatctctatcagtcattaagttttaaaaacttatctgccgagtcagctctttgtatcctattcaatttccaaccaggcccttctgaccaagctttgggcagctgctcagcggtattggccatccagggcaaagtcttctggtctaatcatagtgattctcagctggggatgattttgcttgcctaggggacacttggcagttcccagagacacaaatctcgggggcagggtataggatatggcttctaggggcagaggccaggacagccctcacaacaattacccacccagggtatcgatctggctgacattgagaaaccctgactagaccaacgatggaatcaagatgacttgtaagaaagtgctcagttgtgtgagatagtgtggtggctgcaagagttcaaaggagacagggtgagaaacgtgggatttcaccaagctttgaaagattgtagtctgaatcgggagaagatggtctctggggagaggaggccacttggcacaaataagcctggcgtgttaaaggaacagaaggaggttgtcacagtgagagggagaaggaggaaggcccccacttgagtgttcaccagtgggtgtcccagcatcttgccctacccagattgacttaagttatcgaaggtctgaggttagactgtaagggctttaagagcaacagaagtataggtagtaggtattgagggtttagaggaaggccaaaaatagcaccctttccctggccagagttttgaaccatttgagaaataaaaagtaggtgaagtccatatcgctgatggaacccagcttggaaccatggctttctagctgtttagcccagtgaacctgctaaaagtgcattctggaattaggcagacttaatccatccaccggtcaccttggacgaccccaaaaggggcagagctcttagaggagcagaaaaatgtaaacagggagcaaattccacaagtaaggggtgggccgagccaagtagacttaatgacgctaaaaatttactcattagaatcagggactactacatcagggccaggacaaagtacaaagtggaagtacaaaggccagagggtgtttcttgccctggagatttaaactagggaagtcttagggaagagtgttcccctttcatgctccccagtttaagttctcttgaaacattggcccattgctcaaccagggctgtgactgatggcctggaggaggagagcatctgttccagagggcagacctcctctcacctttgaggccacttcccaacaccagcctttgcaggtgtgactggcttgggctgtcagtgaacatttggtctcagaaggctctggatccagcagtgtactagtaagtaaatgaattcaaaggctactctgtaccaaagactgaacatttttctcatccctaattctctcctacctcatcgtcccgtgtagcatgtagcatatcagatgttctgcattgagattagatcccaacataacattcccataagaaaatgcatgaaagtccaggaataaaatgctagcaacataatgatatccaaatttgaatggaagtttaacttttattattcaacttttagagaaaaaaattcaaagattaagtccctttggattaaaaaaaatctaaaggcattaaagtctaaaggaactaaagcaaatcaaattattttgtccacctgagttcgaagtacaaaactttaagaaaaataaatcccaagactatcctgccagatttctcattcagatcagccttggccagaggagtttttgatgcctaggtccagttgagattctttcaagaggctgtagctggagttgtctttaagagagtggttgttcctaccgtgctccagaaggaactaggtttgaggctgagtctctgatgtgctcactttagagtcagaagagttaaccacaaaattatcatagccttggccccacaaccacccttgtttcgaaacaagctaattcccaggtactaaagcagtcatcccatacaacactgctcccacagctcagtacctagtgctgccagagaccatagtagaacctcaatagtatctggaaaaaaaaaaaatcttggtttcagttccccaaagatgccccagtgttctgtaactcacaactcgtgatcctaatttctattggaaggacgctcaaaaagggcttaattttggccgtatacactgatcattcctgggggaaagaccaccattgcatgacaccttaatttacatttccccttccaacaagctgtttctggtacctggactgttgagtgagggctccctctaggggctctgagccaacatccctgtatacaggcgttttcaggcctgagccagaatgcatgtttaggcctaagaaagttgcctcctagggatggaggaggcgtcttaaatctatctttacggcccggcagggtggctcacgcctgtaatcccagcactttgggaggctgaggtgggcggatcacgaggtcaggagattgagaccatcctggctaacacgatgaaaccccatctctactaaaaatacaaaaaattagccgggcgtggtggcaggtgcctgtagtcccagctactcaggagactgaggcaggagaatggcgtgaacccaggaggcggagcttgcagtgagccgagatagcgccactgctatccagcctgggcgacagagtgagactccgtctcaaaaaaaaaaaaaaaatctatctttacatagatttaagcagtccagaatcaactacagatgaaccacatggatccaaggtcccttcatggttccctccttgtgcctgaatgcagaatggaatttggggtggctgatacagcaagggccacagtggcctggcgctaccagttagaagctagaaccttacaagcactctgtagtacgttggaacccagctgccttgaaaatcggtgaaaatcagtacctattatttttcccagctacacctaaaaggcctgtgaagtctgcttttcccctggaaactgcagcagtggcatcttgaggccacctgccctgccaagcacctgtgggcgctgggcctttccctgtgaaactgctatgttgctgttgatggagaggggcccaccggcggctgctgcccacatttaatttattccatgttgcacccactttctagggcctcttgcagtccgtgagaggtgtggagggaatttctgccagttgggtttaagatcatgggtagtacattccagaaagtgggtgttgactgacaggcatcagggggaagctaatgtaaggattttccccattgactttccttgcctcagttaccactgagtaccttccacagcctttgggtgcaccaggtaccgtgttctaagaatataatttttcttggacagctgctgtcttggctggggattggcttgatttcaaaacaggtggtgcaaatgctgtgataatcttgtgagtgtctcattaatgctgagccacttagactcttggcattgagccagttaaactcctgagtccctgaaggaattgcactatgagaggcgctccatatctcttctgaagtccttgcgcctttcacttaagatgcccctccccaccagcctctccaaaggcctaaggagaccagttagggctccacagaaagtcattctctgaggaaaaacaccacaagccacaacgatcctctagattcaatatgctcacagcctgctttaaaacctcttacccagaccaacgtcactcctgtaaaaacccacttggcctaatacaaacctccacatacaatcgaaggtaaaatgtcacggcctctactgcaccccgtggttcacaagactcccaatcacatgcgtctcttactacccaaactctgctcttctggttttgatttttcaatgtctgtatacaatgccgccctgccaaatgttgggtttccaaaggaacattgcatattcctttcctgagctatgaagaatttgagagagaaaataaaggaatggtagatgggaaaccaaaacaaaacctcagttgctgataatggagtagcttagcgtgagagcctagtgcaaactccagaatgagtcaagttgaccttatcaggttgtttcttgttagagggaagtaacttttccacccttggtttccatgaagggagattttcctctgggcagcatagcaccacctatactccgctaatcagcatggtggtgtggaggcgtagagtgctagtggtgctatttggagacgggcacatcccaagaggaagaatggccatgcagggcagaggacaaccagttattttcagatttatcaatcagccagcgcactccatctctgcagggatgaggggagcaaagaggttgagggaagatcatgttccaaggtcagagtgtagaaggtgaagggaagaatgtggaaaggaattacgtggaggcagagtctgggggctttgagaagcttgcaagaagagaaagagaaagataccccagaagaggagcagactcccatgaaagccacgaacttgccctctcatctgcacactccactactagcgggaacataggttcaggtttaaaagccaagcctgaccttgtgtttaactgcaaacacttctttttcctcttcctcatcttattcttaaagtataaatgcaaagatcatggaaaatatttaaaaattgagcacattaccttttcattttaaaacagccatcctttaaaacagacaccattttcattctgcactcttagtttatacttaatcactgtcccgaaagtcagctgttttctaaacagttaatttccttctttcaggagaccggacctaaataattttccagataccatcttgatatgcaggtttcccatgtgatgtgaatctcttggcaggagatcctgttaacaatacccagcacgctatatgaaaatatccactataacttaagctttctaaagtaatacctatttggtccacctcagaaactgacagtagttctgttttgagctattaatttcagagaatcttcctttgtgaaataagcatgcttatgttttccttgctttgatttaaatgatagccttaactgctgggcacaggactactattaaaaccttaagaataagattttctgaagaaggaactcgttttttaagcactgtgttttcatctcatttgagcgtttactctgggctttagaagacctcatctattatgctcaacatctgatatttgaggggttctgtttcagggttctgtggaaaatctgatgtgccaagaagtgttccataccattctgagaactctggatacctgctcagacagctctgtttcagctaaacagtaacatctgggagggaagcttaatgtggaatcaaggatgaagtttaacacaggaatgagaagtagagcacatagctgctaagataaggtaggagaatttggctagtaaaagcacttaatggcctgaacttgtgtttactagggcctgggagagcagacagctgccagcatacttaaaataggttgagtatgaagtatgcacttaaggactaaaagaattgcagaaatttaagcaatgactcagttacaaatccaagccccttcagaaagtacaggaactatggggaggaatagaaagaacataaacctgcagtgagacagacctagttttctttttttttttttttgagatggagtctcacttttttgcccaggctggagtgcagtggcgcgatcagagctcacagcaacctctgcctcctgggttcaagccattcttctgcctcagcctcccaagtagctaggattataggtgtgcaccaccacacctggctaatttttctatttttggtagagacggggtttcacgtgttggccaggctggtcttgaactcctgacctcaagtgatccgcccgcctcggcctcccaaagtgctgggattgcaggcgtgagccactgctcccggcctagacctagttttgaagcctggttttgatgcttagccacagtatagccaaaggaaaattacttaatgtctctcagatagaatttccttatatgtatgtctttcatgttgggacttctggtcctcgatagcaaagtaagactgactcaaacttctactcacacctcgtgaaaattcaaatcaattcaccgcattgaatgccttctttaatttgctctgttgcccaggctggagtctcagctcattgcaacctttgcctgccaggttcaagtgattctcctgcctcagcttcccaagtaactgggactacaggtgcgtgccaccacacttggctaatatttgtttttgttgttgttgttgtttttgttttttttttttgagatggagtcttgctctgttgcccaggctagaatgcagtggcatgatctcagctcactgcaacctccaccttccaggttcaagcaattctcctgtctcagcctcccaagtagctgggactacaggtgctcgccaccacacctggctaatttttgtattttttagtagagatggggtttcaccgtgttggccaggccagtcttgaactcctgacctcaggtgatccacccacctcagcctcccaaagtgctgagattacaggcatgagccactgtgtccagcctaatttttgtatttttagtagagatggggtttcactatgtttgccaggctggtcttgaactcctgacctcatgatctgcctgccttggcctcccaaagtgttggaattacaggcaagagccaccgtgcctggccggttacagttttctaagaaatggcaatggaaggcctcactgagaagatgtaagaactgaaggaggtgaagtgagttttagtggttacacattgcaaattatttttggctaagttgtaagtaaaaaatagaggaaataaccaatcttgtatggttgtagtaagaatcaaatgaaacaatgtatggaagagtgtctaccagaaggccccatgacacagctagcacgcaataagctttcatcgtcttgtatagaatggtaccatccaattcagtacccactagccacatgccacgtgtcacaacccccttcttttcttagtacctttttgtcagaggtcccctctctgttcctccaacttgccaaaattcacctccatctcctttgcagcatttgagaaggaactggccaagaagtgtttttggaattcttagctgaccacccacctccagcctacagaggtggttgaaaagactaagaagagttttttggagaagatagagaattttgttagaaaatgtggtagtgctgggactgtaaccttcttaatcttagtgaggggggctatgagatgcccactaaaaaagccttgacatgagtcacctagagtttgggagacacaaaggactggcaccttatgcataaaaaatattgcttgagtagatggatgaaactcctgtggcagcagaatagagtggcatttgggaagaagaagaattggcactggtgggggtaaaagttataggacttcagccaccagatgtggaacctaaatgaggactgttcgtctgaggtcatttccaaggggatcctattcaacagggcttctgccagggagggaggttgcctttgaaagagaaaatctgagatttaccctcaggtacagaagctgagggattgctcatggtcaaccaatggagctctaaaagatgagcgggaagctgggtgaagaggaagcatgttttgagccaaggcaattgcatatgcaaaggctgagggatgagagagggcctctcatggtttatttgtagagctgaaagatgtttggtgtggttgcatgccatgtatgtgtggccggggataatgagggctccaggttggaggagtgacatgtggtgagtcaggagaggggtgagaagagtccagaccttctcaggtatatgataaagtttgacatttatcttaaggacaatgggaaacttttgaaaggtgtgatatgatcagtcctgtgtttcacagtttgttttggctgcagtgaggagagtggattgtggagtgggaagagtggaatgggagataccagtaagaaaccacggctgtagtcagacaagaagttaggtggactggaccagggatgtgttcgtgggaaatcagaacagtggccagattcatgaaacatggcagagatgactgtcctgaggtagaagaagagctggtaaaaaagatagaaccacagacgatccccaggttcctttcttgaacaacagagtggaagatgtttctgttcaatgcgatggtgaacacgaggtcagagcaggtttgtggaaccaggtgttaaattcagtgatgagtgtactgcaggcaaggcatgctgtgtggcgcccatgtggttgttgacatgtaagacttctgctcaggaggaagatttgggccaaagctttacatttatgcctttggcatatggtccacttttgaagctatgtgagaggaaaagcttgcctgaaaagtgtgtgtgtggtgaacagaggagatagcccaggacagaccccaaaggaatactgatgactgggaaagaagaactcataatggagataaggaacactagaggagaaggaagatcagaagcaagcaagatcttgcagcagcaagatttattgtgaagagtgaaagaaaaagcttccacagcatggaaggggaccggagcgggttgcccctgctgactggggtggccagcttttattcccttatttggctctgccacatcctgctgattggtccattttacagagcactgattggtccattttgcagagtgctgattggtctgtttttacagagtgctgattggtgcgtttacaaacctttagctagacacagagtgctgattggtccgtttttacagagggctgtttggtgcgtttacaaacccttagctagacacagagcgctgattggtgcgtttttacagagtgctgattggtgcgtttacaaacctttagctagacacagagtgctgattggtgtgtttacaatcctttagctagacagaaaagttctccaagtccccacctaacccagaaggccagctggcttcacctctcaatcccccctctaaacaggacaccccaactgctgctgggaattgggcgatgactgctctagctacttcctgctggatagaggcaaagaagggtccctgcagttgcagtgtcttccagaggggaactctctaggccagtgaaagggccagcgggtcggtccaggggtcctcggtagaagttgttagtttagctcatttggggttccattcgtaagaccatctgtagcttgatggcctcgattctagaggaaacagatttgacaaggaggttaaaaataagggtccgaaggcgagtaatagcaagatggctgccacaggacctagaaaggggagaagccatgttgcccaactccagaggttggtataagagttttgaaaggcgttgtctgatttcagaagccttttcctgtaagcgccaggtggcatctcttactatccctgactgattagtgtaaaaacaacactcttcccctaagaagatgcagagtcctcctttctcagcagtgaggaggtctaggcctcagcagttttggagagtcactgctgccaaagagtctatttgggattgtagagtaaggatagatttcgttatttcttgcaaactatctgagaaatcctgtgagagtgtgtggtagtaggataatgaagtggatatactggctattccggttcctgtagcagtagccattcctaaccctattaagtagggtattagttgtatggctctgcactgacggacttgagctttgaggggaacagatagggtctgatttccataaaattagaagttagtacaatacatgttacactgttaacttttagcaaacttttgttgaaaaccttgtaagtttggggttttaatttttctttgctattaataaaacctcattcagtccatattaacttagaattggtatagatggctccttcctgatactgtaagtactttaaggtttggctgagtgcaaacagctgcatgtttgaacagaccaattattaggcaattttcttaactgcttctacaagagtttccttatcacttactgaatacccattgtgtcttttttccttagtagttgaggaggaaccgtatattatcctgtcctgaagggagttcctcctagatctggtcagacctttgtatggtaattaattaagatttagatcccctgttaggaaacctgctgggttaaggatttttgataggaaggctatgggttgtcagtggcttcagtgctttcgggctacgcccttgtttacactgacaacaaggtgatattggagtgttacagggttacagagaagaccttcaattatcaattataggttttaaatttaccctggcttttaatggaatagggtacactgtttttcctttactacttctatctctctctttctctctctttgacttcttctttgtctctttctttctctcttcctttctgttgcctctgccagctgcttatgttgctgttttcccctctccttccccttttgatggctttggcagtgtaagactgccacctccttgggtttttacactgcatgcaataactccatggtttctttgtgatatttaatgggcgttcccccagaggttagtaactccctttctttccatattgcagcatgggcatgtaggattagataagcatacttgctatctgtatacacatttattcttcttccctttcccagttctaaggctcgggtcagtgccactagttctgctaacggggcgctggtccctgggggaagaggcttactttcaagtactgttactgtggcataacctgcccttcgtatcccattctccacaagtgaacttccgtcggtatataggttaaggtgaggattagctacggggacttctaagagatcatgtcaggcggcctaagtctggactacaatttgttggcagtcacgctcgattggttccccatcctctgggagaaaagtggcagggttgagggccacgcatgtacatatttgaagcaccagtccctcaatgagtagcgcctggtatctgagtaggtggttgtctgatagccataaacttcctttggcacctagtatgccatttacatcatgagtagtccagacagtgagatcctttccttgtattattttgatagcctctgacactaagatggccaccgccacaactacccttaaagagtgaggccagcctttcgctactacatcaatttccttacttaggtatgccactggttgtggggttgccccatgagtctgagtaaggactccaagagccatccttgctctctctgtgatgcataaagaaaagtttcatcctgtgggaaggcttaaggctggagcttgagtttgttccttccaatgcccagacttcagggttgattccctcctcaagtaggggacaacaaatgggtaactcgttccccatattcatgtagataataactccagctttggctactcctactggatctagtggagtcagcgtgatccgcttctcccactcacctagtccccacacgccctgagagctagtccctgtggtctgatgtccacccctcacttcttctgccctttccttatacttccctgctggagtgactggaagtggggatgctcttccctggacacaggggagaaggagggcccctggggttgtcacttcctctgcccttttgggtggggcaggaagggcacatttgatgttagcaattcagcgtaaaagtgaaaactaatttggcctcaagatttaagagtcatccaaacaacagttacagggctaatatctttaatctttacacatttgacaatatccaataaaaagaacaccaaactacatcaagacaaaggagcaacagacatgggcctgcagaggacaaaagagaaaacaggagcactcaataaccaggaactcagggactttggaggcaacctgtgtgggttaaacatgcttttgaagatttttatcattatttctcattagaaatataaaaagtgggctgggcgccgtggctcacgcctgtaatcccagcactttgggaggccgaggcaagtggatcacgagatcaggagttcaagaccagcctggccaacatggtgaaaccccatctctactaaaaatccaaaaattagttgggtgtggtggagggcgcctgtaatcccagctactggggaggctgaggcaggaggattgcttgacctcaggaggcagaggttgcagtaagctgagatcacaccactgcattccagcctgggtgacagagtgagactctgtctcagaaaaaaagaaaagaaaagaaaagaaaagaaaagaaagaaagaaagaaagaaagaaagaaagaaagaaagaaagaagaaagaaagaaatgtaaaaagtgctaaatagaaagaagtaaaaaatatatcaaattagaaaataaaaaatgagggggagtgaaactggcattctaacacaaggggggtagtatttaaaatagcttttatgctttggggaagcagtttgatattttatttaaaacattttaaactagccataacatcagacacagtaattgtatgccaaggaatccatcctgaagaacaataatcttaaattttaggactattattaatccataataataataataaaaatttcttcttatatcaagatgtccatcatagcatttatcatagtaaataattttgaatagacctttagaaatggaaaaaagcaaagcactatattgtatctctactcaaactaagatttgacactgtactcggctctttttataatttttcccttaatcctcacagtaaaatcaaatgtttgacacaatgattgtctctttatgagtttttagctaacaaaatgtttatggtaaacatggaataaaatgaaaaatactcatgacagatgctaaacatgaaagcaagtgatttatgtatctagtatgattataaccaggtatatcgaaatctctctgtgaataaaaaaaattgaagtccatctggggtgaacagttgttatttattaaaatttgcttttgcgagtactcatgaatcttgagacaataaccaccaccacgattataaaactatcaaacacgattttaagcaaagaaagaaatggggaaaaccgtgaaaggaaaataaatctcaagactccagaatcactaagccaaagggaaaagtcaagctgggaactgcatcagacaaacctgcctcccattttattcctaaataaaataactacaaagaaaaacaataaaaataaaaaagctacatacctccctcacaatttgcccgtaaggaaattccttgtgagcctcaaagatctttaccctaaaacagttctgttgaacttcatcctggccatattaattgataccttatcttcacaggcccaggacagaggacagacagaactcttgatcattgctctgctcacctgtgacaaatgcatttctcattgcttcctctgacctattgtttatgtaaaaatgcagattcactgagtcagactaaggcatcagtgactattcctctattcattccacctcacatgtattcagtgaaaggctgatcgaagaccccaaagaatgaaaccttttgtcccttatctacctctgacctggaatcccttacttcgagttgttccacctttctggaccaaaccaatgtacctcttatgcatattgattgaggtctcatcaatgtataaaatcaagctaaaatgtataaaaccaagctgtgccctgaccacttgggtacatgtcatcatgtacccaagacttcctgacgctgtcataggcacgtccttagccttggcagataaactttctaaattaattgagacctgtctcaaatactttgggctcacaaaacgtagctgtccatcaggcagatatctaaaagcaagaagtgatattttactcagctaaaagctgctattttgtcggcggcctcagaggccttccacaatgaactccctccccaaccctctggcctcattcccaggcccctgtcctctcctgggaactcctgggaatgtcatgtttgccccattgtcatcttgtcagtgaggctcccctgactgccctcattaagactgcatctggccaggcgcagtggctcacgcctgtaatcccagcactttgggaggccgaggtgggtggatcacctgagctcaggagttcaagaccagtctggccaacatggcgaaaccctgtctctactaaaaatacaaaaattacccaggtgtggtggcacacacctgtaatcccagctactcaggaggctgagacaggagaatagcttgaacccacgaggtggaggttgcagtgagctgagatggcaccactgcactccagactggggcaacagagcaagaccctgtctcaaaaaaaaaaaaaaaacaaaaaaaaaccccacatgcttcctccttcctaccattctacctccaatccccatccccatatcctgccctcttgttttctctctttgtaatgcctgccacctcccaacatagtatagaatgagcttgtttacttagtctagtgtttaatgtctgtctcactccactagaatgtaatcatcgcaaggccaggagatgcgtttggtctgtgctgcatctcaagcaggacaatggctggaacatagtagggtctccaaaaatgtttgttgaacgttgctgatggcggcatcctggagtaggaaaaagactgaagagtggaaaaagaaatcctgacatgaattctgggcaaaggcaagcagtagctgacttggaaaatgattacagtaggttttgtgccatttgagttatcagtattgcagatgtttttgcacctgctccaccaacaataattgggttaaggcttgcagctgggatattatacagcttgctttatctaggttttgttttgcttgcaaatcaatcaatacttacaatgattttaacaaggggaaagagccgtagttgtagaccttggagtgtatttttttttgtctagctttaaaaaaaattgttaatgttttgatactgtaactctttttagtagttgtggctttgcagaccttgctgcactttgatctttttctcgttccagctatagatggcagcacaccactacctacgatccgatcaccagcctgggtttgtaagtcagagctgttggtcaggagatggcagctaatgagtaatcagtccaaactgaatggcaaattaatgtcttcattaagtgaacaaaccagcttcctccataaacaaggtcagagtatttataacccagtgtatttcataaaagcaaaaacgcatctccatttacataactttactatggagctcatgatttatctgcacaaagcatatgcaaaatctcacttgtataccgtctttaataaggacccatgccattctgatgtaattattaataaagtcacacttgataagc

SEQ ID NO: 13 - DNA, 470 bp, Homo sapiens
gttcctccatttatcgtttcttcgtcatgtcgggacgcggcaagcagggaggcaaagctcgcgccaaagccaagacccgctcttctcgtgccggtctccagttccccgtgggccgagtgcaccgactgctccgcaagggcaactatgctgagcgggtcggggccggcgcgccggtgtacctggcggcggtgctggagtacctgactgccgagatcctggagctggcgggcaacgccgcccgcgacaacaagaagacccgcattatcccgcgccacttgcagctggccatccgcaacgacgaggagctcaacaagctgctgggcaaagtaaccatcgctcagggtggtgtcctgcccaacatccaggctgtgctactgcccaagaagaccgagagtcaccacaaggccaaaggcaaataatgtctccatagaatcactttccaatacaacggctcttttcagagccaccta

SEQ ID NO: 14 - DNA, 71260 bp, Homo sapiens
cactaccagccgggctcaggcctagctggccgggctgccgcgaacttcctcccggcgcggcccgtgccccgccggccgcctgcgaacacctcggcctccgcctcccctcaggtagcaggctgcggggcgcggggccggctgccctcccgcagcaaactttgcttgctgctgaatattgatgagagcgatcggctcggctgggaggtgctgccgcggctgcgggaaggagcgcggcccgggcaggcggcggcggcgtcggcagcagccatgtttttcgagctgtagcagctgctgctaccctgactgggcttcgctggccgcctcggtttctccctctgccgggtccaggcctcttcgccctgcagctgcggatccagcaggcctgcattcaggaaggcgagctctggggtgcagccgcctcggccggctcgcctgcggcctgcgcaccgccgctgcaaaggctccggcgctggctgggcgcagggtgcagcgctattgtgaccgctgcgccctagcgagccaggaaggggggggtacctttttgtgcagggtccaggagcccccctcggaccccgcagccttttgcttttgagagatccagctgctcgacccctggcgagggagggggaggactagtcctgtttgagaattgggaattttgacgggcagaggggttttaattttagttcatcccaagtgtccaccagtctacagaggaggaaaaagagacgggctgtttctatgtagcaggatcggcccagcttcgggaaaatggagttttcagaggctcatcgaggccattttttcatctccagtcgggggaactttttctgcccatggaagtgcagcagaaaggcatagaggccactaggccttgaagtggctgccattttaaagagtcgagtcagatggcctattaactcagattaattgctgtgcttttggattccaggttgatgccggcccaggatggatcagacctgtgaactacccagaagaaattgtctgctgcccttttccaatccagtgaatttagatgcccctgaagacaaggacagccctttcggtaatggtcaatccaatttttctgagccacttaatgggtgtactatgcagttatcgactgtcagtggaacatcccaaaatgcttatggacaagattctccatcttgttacattccactgcggagactacaggatttggcctccatgatcaatgtagagtatttaaatgggtctgctgatggatcagaatcctttcaagaccctgaaaaaagtgattcaagagctcagacgccaattgtttgcacttccttgagtcctggtggtcctacagcacttgctatgaaacaggaaccctcttgtaataactcccctgaactccaggtaaaagtaacaaagactatcaagaatggctttctgcactttgagaattttacttgtgtggacgatgcagatgtagattctgaaatggacccagaacagccagtcacagaggatgagagtatagaggagatctttgaggaaactcagaccaatgccacctgcaattatgagactaaatcagagaatggtgtaaaagtggccatgggaagtgaacaagacagcacaccagagagtagacacggtgcagtcaaatcgccattcttgccattagctcctcagactgaaacacagaaaaataagcaaagaaatgaagtggacggcagcaatgaaaaagcagcccttctcccagcccccttttcactaggagacacaaacattacaatagaagagcaattaaactcaataaatttatcttttcaggatgatccagattccagtaccagtacattaggaaacatgctagaattacctggaacttcatcatcatctacttcacaggaattgccatttgtaagcagtttttggtacaacttaaatatatacatatatgtatatatacaggccacttaaagggaaacttgtaacaaatttgtttttggttgcttatcagttcacagctgaaatcctattgctaatcataagctttgggcaaaattttactttgatttttaaatttatctctgttgtatgaatttggttgttttaagctttttccaaataactcttcattgagagtaggctaatgcttttaaaggcatttgattgagttcaggtttaatttctcaagttggaggtatacatatatgattaaaaaaaaaaaaaaaagatgggttttggcctgccagcaccatgagtgcaggtgaaccaatttagtacttggagtcctgttgctatatgtggcagattatttttttacttgatgacttgactcttacttcaggttgaagggcattttgaacacagattaaagtggctaagatgaagttttcttggacattgtcaaaatctaaattaggctagtttttctgaactacctgttttgaaggtatagcatcctgtgcttttgataactgccaccattagctcttttttttttttttgaggtggagtctcactctgttgccaggctggagtgcagtggttgatcactgcaacctctgcctcttgggttcaagcaattctcctgcctcaccctcccgagtagctgggattactggtacccatcaccacgcccggctaatttttgtatcaccattagctcttgaagtttttctagttttgttttgttttattttattttattttaacagaaccctaactaagacaaagttttatatttatttattgtttagagactggccttgtcatgttgcccaggctggcgtcgggactcctgggctcattcgatcctcctgcatcagctagaactacagtagtttcagattttgaagtgtgtatgtgtatgtgtgatatgtatatattccgtgtgtatagaaatggagagtatcttatttgagttgttgttttcagtaatgctgtcaagtattgttagagggtgataaatgataacatttgtttttatttgagcttatgaagaatttcttgactttctagctaaatgatcagttcacttctcttagcctcaattttattgcgtctaaattccagaagttcttgattgctataagattccttcagctttaaatattaatatttgatattgattttgtttctgcccaaacacattgtttggtcaccgccggtaatgttagcaaagagaattttttttggccaacaaatgtctcataccacattcagtttttataagaaaaacttttatggtatgttgttattctgagttcattaaacattcgctttaccttatatccctgctgttctttaaagttacagagggagaatgtgggtgtgtcacttttgtttctgttgatttgtatcttaattatgccttggtactccttggtttcttggcaattgcagatttaaaaaaatttgctttagtggttatcttgagtctgaattgtcctacacattagggtgggtaggctgttttgaaaacctattggcagctcagacaaatcctttttcttgggttcacgttgaaatttattttatatatatatcgtgtctttgtttttgcacataaatttaaatctgagaatggagatagatgtttctctagaagcatacaaatagaattgtaaacctgtttctcgtcaaagagatgttagtggagtattggttctattaaaaaaaaaatgaaggctgagtgtggtggctcacacctgtagtcccagcactttgggaggctgaggtggacagatcacctgaggtcaggagtttgagaccagtctggccaacatggtgaaactccgtctctacaaaaattagccgggcgtgatggtgggcaactgtaatcccagctactcgagaggctgaggcaggagaatcgcttgaacccaggaggcagaggttgcagtgagccaagattgcgccattgcactccatactgggaaataagagtgaaactctgtctcaaaaaaaaaaacaacaaaaaaacaaacaaacaaacaaacaaaaaactgaaaatattggagcctttagatagtaggttacatgtctaaaatgggagttagcaaatgtataaatgtagaagtttttttttcagggagaaattgaaattgctcaaagactttatcaccttgaagaagcaagtatgtagtttatttatttttttgagacacagtcatgctgtcacccaggctggagtgtagtggcgcgatctcagctcacttcaaccacctcctcctgggttcaagcgattctcccacctcagcctcccgagtagctgggactacaggtgtgcaccaccatgcctgactactttttgtatttttattagagacgaggtttcaccatgtgggccaggctggtcttgaactcctgacctcaggtgatccgcccaccttggcctcccaaagtgctgggattacaggcgtgagccaccgtacccatcccctaatttattattttaggaatttggttcaaagttgtgattgaaatctattgcctttatttttgcctttgatatttttaaactgaagacatttttttttttgagacgaagtttcactcttgttgcccaggctggagtgcaatggcatgatctcggctcactgcaatctccgccttctgggttcaagcagttctcctgcctcagccttctgagtagctgggattacaggtgcgcaccaccaccccagctaatttttgtatttttagtagagatggggttttaccatgttggcccagctggtctcgaactcctgacctcaggtgatccacccgcctcagcctcccaaagtgctgggattacaggtgtgagccacggagcccggcctcagactgaggacttaaaaagtgaggtcagggtgggcatggtggctcacgcctgtaatcccagcactttgggaggctgaggcgggtggatcacctgagatgaggatttcaagaccagcctggccaacatggcaaaaccccgtctctactaaaaatacaaaaaattagctaggcatggtggcaggagcctgtaatctcagctatttgggaggctgaggcaggagaatcacttgaacccgggaggctgaggttgcagtgagctgagatcgccccattgcactctagcctgggcaacaagagcgaaactccctctcaagaaaaaaaaaaaccatcctggccgacatggtgaaaccccgtctctactaaaaatacaaaaattagctgggcgtggtggcaggctcgggaggttgaggcaggagaatcacttgaacccgggaggcggaggttgcagtgagccgagattgtgccactgcactccagccttgagacagagggagactccatctcaaaaaaaaaaaaaaaaagcggtcaatcttagaatgcaaagttaggtaagcaatacagcttgagaaaagtgtaattaaaaataacttttctatgtagtcatgtgatattaatgtattcaacttgttcacagttgatttaagttattgatatagtaggtattgttactatgctgggaattttagaaaatccttagcaaattgctatttgtctctttttgtctgtaattttggctgggcttggtggctaacacctgtaattctagcaagttgggaagccgagacaaaaggattgcttggggcccagagtttgaaactagactgggcaacatagtgagatcctgtctctacactcagttggttgtggtggtatgcctgtagtcccagctactcaggaggctgaggcagtagtaggatcacttgaggccagaagtttgagactgcagtgagccatgatcatgccactgcattccagcctaggcaacagagcaagatcctgtcaaaaaaaaaaaaaaaggagaaaattctcttggcagtgggtaagagtagttattagggttgtagatttcctgtctggaattagagaaagaagggtcatattttctgttattttgtgtatctacctctaagtggactgtttgcctcttgtcacgaattagtagcctcttcagtttaccatcatgtgctcttattttctctgcatacagtgaagtgattgtcattacaatttataatcctgacctggtacttttatatttaattgggctgatattttctaattcttcccagtgtacaaaggttttatgctttgttgttgttgttgagacaggctaggtgctttggatgtggagaattaaatgagcatggcattttcagaggatacttgttggagattgcttgggtaggatggatgtagtcaggtaatggggcctagaaattcagactgaagcatttggtattgatgtgatgggaactggcagcccttgagagattttagctgagaagtgatgtaaaatctgtttggaagactttgagtagaggagattagaggcaaggttaggatgtagggtatgttgcaatagtaattaagacttaagaatcggcccagtggcatgtacctgtagtcctagctactctggaggccgaggcaggaggatcacttgaggctgcaattagctgtgattgtgcctgtgaatagccactgcactccaacctaggcaatataatgagattctgtctcttaaaaaaaaaatgagcacagtgagtactctaaagaaagggggtaaatctaaaagattatttcaaagggagaaaattggcagctttttgggggctacctgatctggaggcagattggagtctggatttgaggaatggagagagatgaggcagatgatgtctaaggcttatagttttgctgcctgagacaaaaatgattcctcagaggttccttcctcttctctacccatcatcccacaattttctactccctccttagctatcttggaagaaaattgatctcttcacacctgaggttctgctctctctccgattccctcctggctgggtgaccttttttgtttgtttttgtttttgttttgagacagagtctcactctgtcacccaggctggagtgcagtggggcgatctcggctcactgcaacctctgcctcccaggttcaagcaattctctgcctcagcctctggagtagctgggattacaggcgcccgccaccgcaaccagctaatttttatatttttagtagagacggggtttcaccatcttggccaggctggtcttgaactcctgacctcgtgatccacccgccttggcctcccaaagtgctgggattacaggcgtgagccaccgcgcgcagcctttttttttttttttttttttttttttttaagatgaattcttgctctgttgcccaggctggagtgcagtggtgtgaccttagcccacggcaacctccatctcctgggttcaagagattcttgtgcctcagcctcccaagtagctgggattgcaggcgccctccaccatgcttggctaatttttgtatttttagcagagagaggtttcaccatgttggccaggctggtctcgaacccctaacctcaagtgatccacctgcttcagtctttcaaagtgctggaattacaggtgtgagccaccacgacctgcataccacttctcaaacagtccttttttgcgtccttgttctctttttcttcctctttctctgcagtctcattcactttcattgattctgctgctactccactctatgaaactctcttctgaactgacttcaaaccaacaaattctacttgtcaactaagctgctcctctaccttgtgttatattcacctaaaatgtaatattatttccttttttatttttcctttggacagggtctttctctgtcacccaggctgtagtgcagtggtgccatctcggctcactgcaacctctgccttctgggttcaagtgattctcctgcctcagcctcctaagtagctgggactacaggcgcccaccaccatgcctggctaatttttgtatttttagtagagacagggttttgccatgttggccatgctggtctcaaactcctgacctcaagtgatacgcctgcctctgcttcccaaagtgctgggattacaggcatgagccactgcgcccagcctattattttcattttgaacccatctcttttattgccaaacacgcatttacttctgtgttcatgatgacatcattatcctattcatctcaaagctggaaaccttgcagtcaatcatttaaatgattaaaatacatttgagtacctcttgagccaggcactgccagtataataaaaaataaaaaaattaaaaaaaggaaagagatagtttgcttttaaggaacttcactgtgtggcaaaaactagtgtaaacaatgacaatacagaatactaagtggtctggtaggtgttatgtatgcagtactttgggagtgtggaggaaggcatgcctagaataatcagggaggacttcacagagtggttatttatagtttaagcagagacataccagtaagagggaatagcatatgcaagtggccagaaatccttggctagctatctgggaggagtggggttgtcaggagataaaggtataaagataggcttatatgccgtgctgtatagttgaatgtttttactattacaaaattttacagatgccctcagtttctccctttattcatttttctatgacatctttattgttggtcttcatttagtctttccttccagtctatcctgtgtaaaattacttcctacttccaaaatgagaaatactgggtctctacttaaatttgtaacctaaatgcctcacacctcattttctgaacaaataaagcccaaattcagtgtcctttttgataggatcctgtcctgacctttccaaatctgatgctagagccttgtgtaccctgagttcagccaaactgaactcttaatggtcccttgctccatactctccccttgctcatgcctttattctcctggtctgattcatctttgcatcttaacagtgtatagcatggtgccttctttttactggggacatatcgagttaatgaatgaatgatgctattacagaggtacagtttgggaaggggagtgagtacattttagaaaggtgataagtggattgtcagccttcatcattttcaatggaccaaattactaaaactttacaggttggttggttttttttcttttttcatttcctcatgtactcaatttctaaggctttttgaatttgagcttcctaatatctcatgcattaatttttttctccattctcaactttcactcttttaattaaggataataatttttttttttgagatggagtcttgctctgttgcacaggttcgagggcagtggtgcgatcttggctcactgcaatctccgtctgccgtgttcaagcaattctcctgcctcagcctcctgagtagctgggattacaggtgcatgccaccacgcctggctaatttttgtatttttagaagagatggggtttcaccacgttggttaagctggtcttgaactcctgaccttatggtccgcctgcctcagcctcccaaagtgctgggattacaggcatgagccactgagcctggccaaggataataaattataatggttttaggttggacatctctgactgcatactgcactgtgtttactggaagaagtcccttaatgtctctaaggcccatttcctcagttctaaattacggctagtaccttcattggagggttgttaagtctatgatacaagataactttttttttttttttttttttgagacagagtctctatcgcccaggctggagtgcaaaatggcacgatcttggctcactgcaacctccacctcatgggttcaagttgattctcctgcctcagcctcccaagtagcttggattataggcatgcgccaccatgcccgactaattttgtgtttttagtagagatggggttcaccacgttggccaggctggtcgaactcctgacctcaggtgatcgacccacctcggcctcccaaagttgctaggattacaggtgtgagccatctctcctggccatgatacaagataatttatatgaagtaatacactgctggttctgaagtaggtgtgcagtaagtgatgcctactgctgcatgccaagagtcaaatgtatatttgaaagagttgtgaatttcaagaaagatatttttgagtttttttttttttctttctgagacagggtcttgtactgtttcccaggctagagtgcagtggcctgatcttggctcctggctgggcccaagtgatccaccgccctcagccttccaacgtattgggattacgggaatgagccactgcatttggctaagtttttgtttttttttttctctatttttccaaacttatttgattagtaagataaagacattaactgctgttgacagtttccatttttaattagtaatcaggagcatttgttgtatttttgtttgataatcagaataatttaatttgtgcaataggatcaatagctttctgtattccaactgttaagtggtgtaagtttattacattgttgctttttgcaggttgtcctttgttctagatagaaatgtttaatttattcttcctggttttcaggggagcccattgaaaggagatccagtctctgaaatttagtggtaggataataacaattgaacagttacttttgaatctaatttaaataatctcaattgtagccttttaaagcaattcctatgaacctttttgaatttagaaaagtaatacttggccgggcgcggtggttcacatctataatcccagcactttgggaggctgagggggtggattatctgaggtcaggagttcaagaccagcctggccaacgtagtgaaaccctgtctctactgaaaatacaaaaaaaaattagctgggtgtggtggcacgtgcctgtagtcccagctactcaggaggctgatgcaggaggatcgcttgaacccaggaggcagaggttgcagtaagctgggattgtgccactgcactccagcctgggtgacagagtgagactttgtctcaaaaaaaaaaaaaaaaaagtcaaacttaaaaatggaatataaaaatctcttgatttttgtcagttttcatatactccctcatttacactcttaatattctattagaaattgtctcttctctctacacacccctttttttcccttttggttaatatgttaagacatcttttcatatgagcatgtaacatgtaacaagattttttttttttttttggacagtgtctcgctctgttgctcaggctggagtctagtagtatgatcacaactcactgcagtttagacctcctgtgttaaagtgattctcctactttagcctcatgagtagttgggactacaggcccatgccaccacgcctggctaattaaagaaaaaattatttggtagagacagggtcttgctatgttgcccaggctggtcttgaatttctggcttcaggcaattctcctactctgcatgagccacctcagccgcgaatattttcttattatgaaatttttgtttagataaatgttgattcacatgcagttgtaacaaattccatggccaggctgggcgtggtggctcacgcctgtaatcccagcactttgggaggctgaggtggatcacctgaggttgggagtccaagaccagcctgaccaacatggagaaaccccgtctctactaaaaatacaaaattagccaggcgtgatggtgcgtgcttgtaatcccagctacttgggaggctgaggcagaagaatcacttgaacccgggaggcggaggttgtagtgagccaagatcgtgccattgcactccagcctgggctagaagagcgaaactccatctcaaaaaaaaaaaaaaaaaatcaggaaattccatgggctaggcacagtgacttatgcctgtaatcccagcgttttggaaggctgaggttggaggattgcttgagcccaggagtttgaggctacagtgaacactgactgtgccactgcactccagcctgggtgaccctgtctcttaaaaaaaaaaaagaatacagagaggtcccttgtatattttgcctggttttgcaatggtaatattttgcaaaaaatatctaataccacacaaccagaatattgatgttgatgtacttcaccaatcgttttttttttttttttttgagtcggagtctccatctgatgcccaggctagagtgcagtggctcaatctcggctcactgcaacctccacctcctgggttcaagcaattctcctgcctcagcctcctgagtagctgggactacaggcgtgtgctatgacgcccagctagtttttgtatttttagtagagacggtgtttcaccgtgttatccagggtggtctcaatctcccgaccttgtgatccgcccgcctcagcctcccaaagtgttgggattacaggcttgagccaccgcgtccagccagtcttacttaggcattgacgttcatgtaatttatccatcttattcagatgtccttaaattttatctttttccttaaaagaaatctgtatttctatcaggacattctggatgtccccagttttactggtagtctttcattgtgtgtatattaagttctttgtttttatcacctgtataggttagtatatccatgactcccgtcaactttctaaatgttcgctgggtgcagtggctcatgcctgtaatcccagcactttgggaggctgaggcggctggatcacctgaggtcagtagttcgagaccagtctggccaacatggtgaaaccccgtgtctactaaaaataaaaaaaaaattagctggatatggtgggtcatgcctgtaatcctagctactcgggaggctgaggttggagaatcgcttgaacccaggaggcggaagttgcagtgagctgagatcgcgccgctgcactctagcctgggtgacagagtatgtctctgtctcaaaaaaaaaaaaaaaagttgctaaacatttctaataccataaggatccctgctgttgccagccgttttaaaactacatccatcgtcttcttggcaaccttccatctctttttcgtatgtgacagcgtcttgctctgccgcccaggctggagtgcagtagttgcatctcagctcactgcaccctctgtgtcccaggcttaagcgatcctcccacctcagcctcctgattagctgcgactacaggcacttgccaccatgccccactaatttttgtatgtttttgtagagatggggttttaccatgttgctcaagctcgtcttgaactcgtgagctcaagcaatccgcctgccttggcctcccaaatggctgggattacaggcaggagccaccatgcctggcctagcccctccatctctagcctttgtcagttactaaactttttttcctgaagttttgtcatttcacaaatgttagataaacatgagtcatacagtatgcagccttttgggattgtctttttttcccttagcataatttccaggggattcatctaagttgttgactaaatcaatagttgttttttttgtttgttttttttttgagacggagtttcactcttgtggaccaggctggagtgcaatggcatgatcttggctcactgcaacctccgcctcccaggttcaagcgattctcctgcctcagcctcctgagcagttgggattataggcccctgccaccacacccagctaatttttgtatttttagtagagatggggtttcaccatgttggtcagggtagtcttgaactcctggcctcaagtgatctacctgcattggcctcccaaagtgctgggattacaggtgtgagccactgcgcacggccctagttttttcctttttatcactaagtaatattccatgatacaaatataccatggtttgcttgaccgttcacctgttgaaggacatctggggcaatgctagcttttggtaattaaggtaaaagtactatttatgttcatttatggggttttgtgtgactgtaagttttcacttctctgggataaataccagtagaacaattgcagtattatatggtaatggcatgttaagttttttttttttcctgagagggagtttcgatcttgttgcccaggctggagtgcaattgcgcgatcttggctcgctgcaacctctgcctcctgggttcaagcgattgtcctttctcagcctcgcatgtagctgggattataggtgtcaaccaccacacccagctcatttttgtatttttagtagagatggggtttcactgtgtttgccaggctggtcccaaactcttgaccccaggtgatccaccctcctcagcctcccaaagtgctgggattacaggcgtgagccacggcgccccgccaatgttcagttgtttttttgtttttttgagacaatctctctctgtcacccaggctggagggcagtggcgcgatcctggctcactgcaacctctgcctcccggattcaagcgattatcccgcctcaggctcctgagtagctgggaccacaggtgcacaccaccacaccaggctaatttttttatttttagtagagacggggtttcaccatgttgggtcaggctggtctcgaactcctgacctcaggtgatccacccacctcggcctcccgaagtgctgggattacaggtgtgagccaccacgcctggcccaatgttcagttttataagaaactaccaagctgttttccctagtgtctgtaccatttacattctcactagcagtatatgagtgatccagtttcttttattttttgttttttgagacggagtctcgccctgttgcccaggctgaagtgcagtggcacgatctcggctcactgcaacctctgcttcccggcttcaagtgattctcctgcatcagcctcccaagtagctgggattacaggcatgtgcaccatgcctggctaattttttgtatttttagtagagatagggtttcaccatgttggccaggctggtctcgaactcctgacctcaggtaatccacccatcttggcttcccaaagtcctgggatttcaggcatgagccattgcacctggccgagtgcttcagtttctatgcatcctcaccagcatttggtgtggtcactattttaattttagccattcgtgtagatatgtagtaatgtctcatctcattatgttttgtttttttttttgagacggaatgttgctcttgttgcccagactggagtgcagtgatgccatctcggttcactgcaacctccacctgctgagttcaagcaattctcgtgcgtcagcctctggagtagctgggattataggtgtgcatcaccacgcctggctaatttttgtattttttagtagacatggggtttcaccacgttggccaggctgttcttgaactcctgacctcaggtgagctgcccacctcggcctcccaaagtgctgggattacagttttgtatggtggattccatgcagagagagttttttctgtagtctagattagcagtccccagcctttttggcaccagggaccaaattcctgggaaacagtttttccacaggtgggagtgggatggtttggggatgaaacttttccaccttagattatcacgcattagttagaatctcataagaagcgcgcaacctagatcccttgcatttgcagttcacaatagggttcatgatcctctgagaatctaatgccacccctgatgtgacaggagtgggagctcaggcgataatgctcccttgtctgctgttcacctcctgctatgcagcccggttcctaacaggctgagaggaccagtaccattctgtggcctgggcgttggggacccctgttctagatgatccacattcttttaaatgcctatatacaaaccatactttctttatttcttttctttttttgagacagtcttactctgtcacccaggctagagtgcaattgcgtgatcttggcacactgcaacctctgcctcccaagttcaagtgattctcctgcctcagcctcccgagtagttaggactacaggtgtgtcccaccatgcctggctaattttttatatttgtattttttaatttttatttatttatttatttttttgagatggagtctcgctctgtcacgcaagctggaatgcaatggcacgatctcggctcactgcaacctccgcctcccgagctcaagcgattctcctgcctcagcctcctgtgtagctgggattacaggcacccgccacgacgcctggcttttttgtatttttgtagagacaggttttcactgtgttgtccgttctggtctcaaactcctgagttcagggaatccaccgccttggcctcccaaagtgctgggattacagtcgtgagccaccgcgccctgccacaaaccatactttgaaaacgttgcttccatttttagataatttgttaggaaaccaataaaatcatacatacttgtgattttcccttagtaaaacacaaattttagtgttttttgctgttattattaatacttctaaagttcctttcacattgctagtgaccttatataaaataccataatgctcttctagcaattgctggaaagataaaatctattttagagaatgaacaattatattttcacattagattaaattaaaagtaattactggttatgtgatattccctcacataccagagtgagtctgaaggtagtctttctttgtaaattatgaggctatatttcctgtgttatctctgatttctcttgatgctgtaattggagttgttgggtctccctggtgaaagtaggtgatgtgcaagttgtgtctatacccagtgaaaataacagacattaatgctacactaatttgtcattggaattttacattcaaaagcatttctttttaaaaatatgattgtaaattggtaatttatagttgtatataccaaaggcatttctttaacgttatagttggttcaactgaaaatacgttaagtctgtttttataattagtatattgaggaacagcacttccatcgtgtcacaatatattaagaattgccagcagggcacggtggctcacgcctataatcccagcactttgggaggcctaggcgggaggatcacctgaagccaggagtcgagaccagcctggctaacgtggccaaacccctatctactaaaaatacaaaaattagccaggtgtgatggcgggtgcctgtagtcccagctactcgggaggctgaggcaggagaatccagaattgaattgaacccaggagacggaggttgcagtgagccaagattgtgccattgcactccagcctggacaacacagcgagactcagtcttttttatttttatttttatttttgagacggagtttcgctcttgttgcccaggctggagtgcaatggcacagtctcggctccctgcaacttctgcctcccgggttcaagcgattcacctacctcagcctcccgactagctgggattacaggcatgtgccaccacgcccggctaatttttgtatttttagtagagatgggatttctccatgttggtcagacttgtctcggactcccaacctctggtgatctgcccgcctcggcttcccaaagtgctgggattacaggcatgagccaccgtgcgtgtccttttttttttttttatcttttgagacagggtctcactctgttggctaggctggagtgcagtgatgcagtcacaactcactgcagcctcaacctcccagtctcaagcaatacccccacctctgcccctttgagtaggctgggactacaggtgtgtgccttcatacctagctaattttttttgttttgttttttgagacagtcttgccccatcgcccaggctggagtgcagtggtgccatctcggctcactgaaagctccgcctcccgggttcacgccattctcctgcctcagcctcccgagtaactgggaccacaggtgcccgccaccacacccggctaattttttgtatttttagtagagacggggtttcaccatgttagccaggatagtctcgttctcctgacctcatgatccgcctgccttggcctcccaaagtgctgggattacaggtgtgagccactgcacctggccatgcccagctaatttttgtatttttttgtagggatgggatggcactatgttccctaggctagtctttaattcttgggttcaagtggtcctcctgcctcggcctcccaaagtgttgggattacaggtgtgagccactgtgccgagccaggttgtgtgtgtgtgtatgtatgtatgtatgtatgtatgtatgtatgtatgtatgtttgtatatatttatatttatttttttggaactgcatctcactttcatccaggcccgaatgcagtgacatgatctcagctcactgcaacttctgcctcctgggttcaagcgattctttttttttttttttttttttgagacggagtctccctctgtcgccaggttcactgcaagctctggctcccgggttcacgccattctcctgcctcagcctcccaagtagctgggactacagatgcccaccagcatgcctggctaattttttgtatttttagtagagatggggtttcactggggtttcaccatgttagccaggatggtcttgatctcctgaccttgtgatccgcccgcctctgcttcccaaagtgctgggattacaggcgtgagccactgcgcctggccatttcttttttttttttggcaagtgattcttgtgcctcagcctcccgagtagctgaaattataggcgtgtgccctcaacgcctgggtaatttttgtatttttagtagagacagggtttcaccatgttggacaggctggtctcaaactcctggcctcaagtgatccaccctcctcagcctcccaaagtgctgggataacagctgtgagccaccgtgcccttcccaggttttatatttattcttttttccttttaaattatgtttttatttaggtattgtacgtaaagtgcttttctaacagagctttggggcagaagtgttagggcaggtcattaaaccactgaaattagttctttggaggagaagataattgttagagttgtaagtgaagtcttgatagataccttatcaatttcatagtaatgtctgtggaatttctttttctgttttttttttttttaattatttcttgaggattaactgctgatagtggaatatcatatatatagttggctcttgatgtacttatttctggatggctttccaaaaggattttaccattttacacacagttctaaatagtatatgaatttagcatttgtcccacacttagatagcactgatttttttttttattaagtgggtgcaaaatgctactacaagattgctttaattactacagttttattgatgaaaatgatttctacttgtttactgtttgtatttttttctaggagttttgtgtctatattctttgctgatgtatctttttggatttaatgttttatacatattaaatttctgtctcattggatataaatattttcccaatctggttttcattttagttaatgattttctgtagttgtatagtcaaagtttcatttattatatagctagatctgtgttttcgagtgatttattgattcaaagcttattgtgcttctagatatttgataaactgactttagactcttgtaaaaatttgaagaactcatatctactacagtcttactgatttaataggggttttaatatccagtactatgctaataatttttatagtgtttttacgacaattttttgagaacataagtttttagagctgtggatggaatgttttctgctctatcagttatcccttctgcgtaacagacccctaagtgtagcagcttagaggagtaaatatttattatctcacattttgtaaggaatcatggagtggcttagctggatggtgctggctcagtctctctaatgaatttacagtcaagatgtctgccagggctgcggtctctgaaggctgtaggatccctgtccaagacggctcactcatatggatgctagctctttgtatgaggcctgttctttcccacttgcacttctccataggcctgcttactgtatggtagctggcttttcccggagtgagtgatccaagagacagggacagaccaagcaggaagatgcagtaactttttatgatgtgtattctattggctggccacacataccaagcagatagggaagggattacacaaaggcatgaataccatcaggctgggataattgggggccagcttggaatctggctaccatatccaaccaaataagaaattaatagttttaattaaaggaaaaggattatattaaatagacattcgttagtttttacttttaagctgacccaatcatttttcagattgaagttttgaatagatatatgattaaaaaatacatgaaaagttaaccagtgaagtgacctctgtgccatgtttgctcaggtaacgcacctccaattcttgtgctttcccggagaccaccttttttaagagaaaggtagtggactgtgcacacttggtcttcctttttcacataatggtgtatgttgaaatctttccattttagagcatagctttccctttttaattttattattattattatttttgagacagagtctccctctgtcgccccagctggaatgcaatggtgcgatctcggctcactgcaacctccagctcctgggttcaagtgattctcctgcctcagccacctgagtagctgggattacagtcgcctgccaccatgctcggctaatttttgtatttttagtagcgacggggtttcaccatgttggccaggctggtctcgaactcctgacctcaggttatccacctacctcagcctcccaaagtgctgggattacaggcgtgaggcaccgtgcccggcaattttttttttttgagtcagagtcttgttctgttgcccaagttggagtgcagtggtttgatctcggctcactgcaacctgtacctcctgggttcaagtgattctcctgcctcagcctcccgagtagctgggactacaggcatgccccaccatgcttggctaattttgtattttagtagagactaggtttctccatgttggtcaggctcgtgtcaaactccctacctcaggggatccgcccaccttggcctcccaaagtgctgggattatagacgttagccaccgcgcctggcctaatttttgtattttcagtagaaatttttgtatttcactgtattggtcaggctggtctggaactcctgagctcaggtgatccacccgcctcggcctcccaaagtgctgggataacaggagtgagccactaggtgtgacctaatttttgtatttttagtagagatgggatttcaccatgtcggctaagctggtctcgaactcctgacctcaggtgatctgcctgccttggcctcccaatgtgctgggattataggcataagccaccgcactggctttttttttttttttttttttaaacctggatggttttattttgcatgaatgtatagatatttcctgttcatacattctgaaagtgaacaactgtatatatgcaatttatttttattcttatttatttatttgtttattttttgagaccagagtctcactctgtcgcccaggctagagtgcaatgacacaatctcggttcactgcaacctctgcctcctgggttaagcaattcttctgcctcagcttccccagtagctgggattacaggtgtccgctaatttttgtatttttacaaaatacacccaggtaattttttgtaattttggtagagacaggtttcaccatgtcggccaggctggtctcgaactcctgacctcaggtgatatgcccgactcagcctcccaaagtgctgggattacaggtgtgagccactgcgtctggcctgcatggggattcttaatgaagattaattattgtagttgagggggaaaaggaataataaatatttattggaccctaaataccttcgaatatggaataccctaggtattctagggcatttagggaccaataaatatttattcctccgtactcttccctcgctcttttcagatttttttttttttttttttttttttgagatggagtcttgctctgtctccaggctggagtgcagtggcgcgatcttggctcactgcaacctctgcctcctgggttgaagtgattctcttgcctcagcctcctgagtggctgggactacaggtgcataccactatgcccagctaatttttgtattttttgtagagacaggctttcaccatgttggccaggatggtctcgttctttagacctcgtgatctgtcttcctcagcctcccaaagtgttggaattacaggcgtaagcctccgccgggccttttttagatttttaagagaatttttgttaaagcatgaacttaaaaaatcagacttggcttggagcggtggctcatggcctctagtcccaggactttgggtggctgaggcaagtggattgcttgagcccaggagttcaagacctgccttggcaataatatcaagaccccctcttcatgaaaaacaatcaagctaatacttgatactattttacataagaattttttatagtatgtcatgttttaatgtatattggttatatagttgcaaatttaaaggcatggtggtggctcatacctgtaatcccagcactttgggaggctggggcgggcagatcttctgaggtcaggagttcaagaccagcctggccaacatggtggaaccccgtcttaggctgaggcaggagaatagcttgtgcccaggaggcagaggttgctttgagctgagatcgcaccacggcattccagcctggaggacagagcgagactctgtctctaaataaataaataaataaataaatgtatactaactgcattagcaagactccgtctctaaataaataagtgaataaataaatgtatactaattgcattttaaaaatcaaagtataggccgggtacggtggctcacaactgtaatcctagcacttttggaggctgaggtggatggatcacctgaggtcaggagtttgagaccagcctgaccaacatggtgaaactttgtctctactaaaaatacaaaattagctggtgtggtggcgcatggctgtaatcccagctactcgggaggctgaggtaggagaattgcttgaacctgagaggtggaggttgtggtgagcggagatcgtgctgttgcactccagcctgggcaacaagagcgaaacttcgtctccaagaaaaaaaaaatatataattcacataagataaaattcaccctctttggccaggcgcagtggctcatgcctgtaatcccagcactttgggaggtagaggtgggcagatcacttgaggtcagggagtttgagaccagcctggccaacatggtgaaaccccatctctactaaaaatacaaaaattagcccggtgtggtggcatacacctgtaatccacctactcaggacgctgagtctgcactcagtccctgggctacagggtgaaactgtatctcaaaaataaagaataaaatgcagctacttaaagggtgtagagttgaacaactgttaccactgtctaattccagaacctttcatcaccccaaaagaaaacccattcccagcagtcatttcccattaagtctcctctagcccctcacaaccactaatctaattcatgtttctatgtatttgcctattctaggcgtttcatacaaatacagtcatataatttgtggcctttcgtgtctgacttgtttaacttagcataatgttttaaggcccatttatgttgttgtatgtatgcatacttcattccattttactgctgaatattgctttgtactgatgccactttttgtttgtcttttcatcacttgacggacattttgtttcttccactttgtggctgttacaggcagtgctactgtgaaaatttgtattaaagttttagcgtgaatatatgttttcagttctcttgggaaaatacctagaagtggtattgtcggatcatagggtcattctatgtttagcattttgaggaacagccagactgttttacatagtggttgcaccgttttacagtcctactttagcctatatgggttctaatttctttctttctttctttctttctttctttctttctttctttctttctttctttctttctttcttttctttcttttctttcttttctttcttttctttctttctttctttctttttttagaacagagtctccctctgtagcccaggctggagtgcagtggcatggtcttggctcactgcagcctccgcctctcgggttcaagcaattctctgcctcagcctcccaagtagcttggactacaggcgcccgccaccacgcctggctaatgtttgtatttttggtagtgacagggtttcaccacattggccaggttggtcttgaactcctgacctcaggtgattcacccacctcggcctcccaaagtgccgagattacaggcatgagccactgcatccgggcgtgggttctaaattcttaatattctcatcaacatttattgctgtctttttaattttagcctgtaatcccagctactagggcgactgaggtggtagcatcgcttgagcccaggaagctgaggctgcagtgagccaagattgcaccactgcactccaggctaggtgatgaagtgagacttcatctcaaaaaaaaaaaaaaggaagtaatggcaaaaactggaattattttgcaccaacttaaatatttagatctttaatacctttggaaagttttttatatatagtttgtgtgtgtgtgtgtgtatatatacacacatatatatatacacacacatatatacacacatatatatgaatgattttatatatatatatatatatatatatatgaatgatatatatatatatatatgaatgaatgaatgagatggagtctcactctgtcacccaggcaggagtgcagtggtgccattttggcttatggcagcctccgcctccggggttcaagtgattcttgtacctcagcctcccgagttgctgggattacaggcactcgccaccatgcccggattttttgtcttaattcatgaaggatgaattaagtctgcagttgttctttttccctttttctttccagtttttttttttgtttgtttgtttgtttttgagacacagtctcactcggttgtccaggctggagtgcggtggcagtatcttggctccctgtaacccatctccctggttcaagcgattccggtgcctcagcttcccaagtagctaggattacaggtgtgtgacaccacacctggttaatttttgtatttttagtagagacgaggtttcaccgcattggttaggttggtctcaaaactcctgacctcaggtgaaccgcccacctaagccttccaaagtgctgagattacatgcatgagccaccaagtctggcctaagtctgaatttttttttttttttttttgagacggagtttcgctcttgttgcccaggctggagtgcaatggtgcgatcttggctaaccgcaacctccgcctcccacgttcaagcaattctgcctcagcctcccgagtagctgggattgcaggcatataccaccacgcctggctaattttgtatttttgttagagatggggtttctccgtgttgagactggtctcgaactcctgacctcaggtgatccgcctgcctcggcctcccaaagtgctgggattacaggtgtgaaccactgcacccggccgaatatatttttttttttttaaatggagtctcgctctgtggcccaggctggaatgcagcggtgtgatcttagctcactgcaacctctgcctccctggctcaagcgattctcctgcttcagcctcctgagtacctgggaccacaggtgtgcaccaccatgcctgaataatttttttgtgtttttgtagagatggagtttcaccatgttggccaggctgatcttgaactactgacctcaggtgatgtgcctgcctccgccttcccaagtgctgggattacaggcatgagctactgtacccggctaagtgtacagtgttcttgtgatgtctttgtctggtgttggtatcagggtaatactgtcttcaagattacccttgaatgagctttacttcattttttaatgtgtttttttttcttttcttttgttttttgtttttgagacagagtttcactctgtcgcacaggctggaatccacactctaggctcgctgcagcctccacctcccaggttcaagagattctcctgtgtcagcctcttgagtagctggggttacaggcacgtgccacgacgcccggctgatttttttgtatttttagtagtgacgggctttcaccatgttggccaggctggtctcgaactcctgacatcaagtgacctgccttcctcagcctcccaaagtgttgggattacaggagtgagccactgtgccccgcctgcaattacttcttaagttctcaattaaaagagagtttatcaaggactttttttggtaattttgcattttgaaaattgctaacattaactgggacagcccttttatttatttatttgtcactcagttgtttttttgagttgcctactatgtcccaggcactggtaagataggagtatcattgtacctgaggcagggcaacatgtgcttgcttgagaggagcatgatctaggattataaggactgcaacctccccttcccaggttgaagcagttctcatgcctcagcctcccaagtagctgggactacagccatgagccaccacgcccagctaatttttgtgtttttagtagagatgaggtttccccatgttggccaggctagtctcaacttctggacctcaggtgatctgcccacttcagcctcccaaagtgctgaaattacaggagtaattttattctcccaaagctgctgctttgggagaataaaaagttgagtatgggccaggcatgggggctgatgcctgtgatcgcagcactttaggagactgaggtgggagtctagcttgagcccagtagtttgagacaagcctggggaacatagggagatccggcctctacaaaaaaaataaattagctgggtggagtggcatgtgcctgtggtcccagctacttgggtggttgaggtgggaagatatctgagctcaggagttccaggctgcagtgagctctgattatgcactccagcctgggtgacagagtgagatgctgtctcaaaaaaaaaaattcagtgtggcgtgattaggctgggagggtggggcaggaagggatgacattggaggggtaggcaaggtgtagatagacctttccctatattctcctatttttaaaaaatttttttctaaatagagatagggtcttactattttgcccaggctgggtctcaaactcctgggctcaagtaatccttccatctaggcctctattttttgtgcaaacgattgaaattatattttttttacctgaatttttcctgtgaacattgggttatttataaacctgttttctgtttctttctttctttttttttttttttgtttttgttttttgagatagagtccagcctggagtgctgtggcatgatcttggcacacttgcaacctctgcctcctgggttcaggtgattctcctcctctagcctcctccacgcctggctaatatttgtatttttagtagagatggggtttcaccatgttggccgggctgttcttgaactcctggtttcaacagatccacctgcctcagcctgccaaagtgctgagattacaggtgtgagccactgttctaggcacttgtttctgtttcttaattttggctgctactcagtgggaaaaagcacagattgaatctaattgaggccgggcgctgtggctcactcctgtaatttcagcactttgggaggctgaggtgggcagatcacctgagatccagagttcgagactagcctggccaacatggggaaacctcatctctactaaaaacacaaaaattagttgggcgtggtggctcatggctgtagtcccagctactcgggaggctgaggcatgagaattgcttcaacccgggaggtggaggttgcagtgagctgagatcaggacactgccctccaggttgggcaagagagtgagactcggtcttaaaaaaaaaaaaaaatctagttgaaaaatgtcatcgggtctttccaaatttttactaggaatttgttaaaattaaccaggctggaagtcattatagtttgtttgtttgtttgtttgagatgggggtctcactctgtcacgcaggctggagttcagtggtaggatctcggctcactgcaacctctgcatcccagattcaagcgatcctctcacctctgcctcatgagtagttggaaccacaggcatgtgtcaccatgcttttgtagagacagggtttctttcgccctattggctaggctggtctcaaacttgtgagctcaagcgatccgcccaccttggcctcccaaagtgctgggattacaggcatgagttaccttgccttgcccattatagcttttttgaggctgggtcttactctctgtcatgcaggctggactgcagtggtgtgatctaagctcactgcctcctgggctcaagcagtcctcccacctcagcctcctgagtagctggcacaggcgctacctcacccatctaattttttattttttttagagatggggttttgccatgtttgcccaggctggtctagaattcatgagctcaagtgatctacctgcctcggcctcccaatgtgctgggattacagacatgagccactatgttcagccatacctggctaatttttaaaaaatgttttcaagagacagggtctccctgtgttgcccaggttggtctcaagttcctgggattactgctggccttcaaaagtaaatgtgaaataattagttaatttctccctcagttgacaaataatgccaaaagtgataaagattaatgaaatgtctcttttttttttttttttttgagacggagtctcgttctgttgccaagtctggaatgcagtggcacgatctcggctcactgcaacgtccacctactgggttcaagtgattctcctgcctcagcctcccgagtagctgggactacaggcacgcatcaccatgcccggctaatttttgtatttttagtagagacggggtttcactatgttggccaggctggtcttgaactcctgacctcatgatccacccaccttggcctcccaaagtgctgggattacaggcatgagccaccgcgcccagccatgaaatttcttacgtagaaaggcagcttgggattgtagaaagaatgtaggctttggagttggacaggcctccatttgagaccatacttgagtcccgtgcttgccttagacaaagaacctctcaaccttagtttttaatctataaggtgttttgaaaattaattcctagttcagtacatggcacatggtaggtacctgctgctatccataattctcttagttaatatattcggtgccacatgccaggcagccaggatctgtactaagcacctaataagtattatctcatttaatcctcaaaagaaccccacctgagttgctagacagccattatttcagggttacacattaggaaattgaagcttagagagatttaagtggttagccaagtgatggtgctggtattccaactaaggtcatctgctttcagagcatttactttctgttaggctgcctctcctgttgcaaagtactaagaacacaactacataatgtatttttagtggattcttgtctttttgtaaatagaaggttaaaatgagaggaattttttttttgtttgggagacgtggtctcgctctgatgagagctagaaatttgattacttgtatttctggtctgcataaaaatttggcctaaaaacatcaatagaaaggcaagtgtcatctgcaaatctgtcccatcctgttcttcacaggaaaatgtaaccttttttttttttttttctttttttgagatggagtctagctctgttgcccaagctggagtgcaatggcatggtttcccgctcactgcaacctctgccttctgggttctagcagttctcctgcctcagcctcctgagtagctgggattacaggcgcctgccaccatgcctggctaatttttgtatttttagtagagacagggtttcaccatgttggccaggctggtctttaactcctgacctcaggtgatccgcctgcctcggcctcccaaagtgctgggatcacaggtgtgagccactgcgcccgggctcaaaatgtaacgtctgtctagtatgaggatttatttccttgtctgacttctgagttgtaatcgtttattaacaatcacattgtaagtttatctatgaagtaataaaatgttctttctgtatattatactggaaatgaatgcttcattcaaaaaatagttttatcttgggaaggtagccactttttaaaaattgaggtaaaacggccaggcacggtggctcacgcccataattccagcactttgggaggccaaggtgggtggagatcacctgaggtcagaagttcaagaccagcctggccaatatggtgaaactccatctctactaaaatacaaaaattagaccggcatggtggcaggtgcctgtaatcccagctactcaggaagctgaggcaggagaatcgcttgaacccaggaggtggaggttacagtgagccgagatcctgccgctgcattgaagcctgggtgagaagagcgaaactctgtctcattaaaaaaaaaaaaaaagaggtaaaatttaaataacttaaggctgattgtattggcttacacttgtaattccagcattttgggagaccaaggcaggaggatcacttgaactcagaagtttgagaccagcctggtcaacatagggaaacctcatctccacaaaaaataaaaaataaaatataaaaacttcaaaattaaataagttacagttcaccattgtaaccattttattttatcctatttattttgagacagtcttgttttgtcacccaggctggagtacagtggtgggatcacagctcactacagcctccaccttccaggttcaagtgattcttctgcctcagcctctgtaactgggattacaggtgcttgccaccacaccctgctaatttttgtattttgattagagacagggtttcaccatgttggcccgattggtctcgaactcctgagctcaagtgatctgcctgtcttggcctcccaaaatgagccaccgtgcctgtccccttagtctactttaaaattcaatttgccttttttttaaattgtaagaattccttatatattttggatattaaatccttaactagggatatgattcgcaaatttttttcccccattctgtttctgtaggctctttgacattctttttctttctctttttgagacaaggtcttactctgttgcccaggctagagtacagtggtgtgatcatagcttactacagcctcgacttccctgggctgaagcaatccttacctcccacctcagcctcccaggtaaccaggactacaggtgtacaccaccatgcctggcaaatcactgttgttgttgttgttgttgttatagccataggctcccactgtgttgcccaggctgggctcaagcaatcttctagccttctagccttggcctcccgaagtggtgggattatgcgcatgatcgctgctcccagcccacaatctttttttttttttttttgagatggagtctcgctctgtcacccaggctggagtgcggtggcgcaatctcggctcattgcaacctccgcctcccgggttcaagcgattctcctgcctcagcctcccgagtggctgggattacaggcacgtgctgccacgcccagctaatttttgtattttttttttagaagagatggggtttcaccatattggccaggatggtctcgaactcctgacctcatgatatgcccaccttggcctcccaaagtgccgggattacaggcatgagccaccgcgcctggcctcccagcccacattcttgataattttctttgcttctaaaagttttgcttttagggttgggcaaggtggcttatgcctataatcctagcactttgggaggctgaggtgggcggatctcttgagctcaggagttcaagaacaccctgagcaacatggaaaaaccgtgtctctacaaaaaatgcaaaaattagccaagtgtggtggcatgcacctgtagtctgagctactggggaggctgtgacaggaggatcacttgaattggactggaggctgcagtgagtgaaaatggtaccactgcactccagcctgggtaatagagtgagatgctgtctgaaaaaaaaaaaaagttttagtttttttgggtggggggattttaacttcacctattttttttgttgttgctcagttttgttgttcaatctatgaatcctttgccagatctgaaattatgaacccttatccctaaattttcttataaaagttttgtagttttagctcttatatttaggcccttgataacattttgagttactttttttttttttttttccctgagatggagtctcgttctgtcgcccaggctgtagtggcgcgatctcggctcactgacatggctgcttcctgggttcaagcaattctcttgcctcagcctcctgagtagctggggttacagtcacgtgccaccatgcccagctaattgttttgtgtaattttagtagagatggggtttcagcattttggccagggtggtcttgaacacctgacctcaagtgatctgcccacctcggcctcccaaagtgctgggattacaggtgtgagctactgggcaaggctgtgccagaccttgagttactttttatatattgaatgaggcataagccaaagtttattaggtgatccagttttctcagtaccatgtgttgaagagactattattctttttccattgaattcaaaagagactaattttttaacattcctttgaaatgctattctttttccattgactattgttttctccgtgtcaaaaatttattgaatatggccgggtgtggtggctcacacctgtaatcccagcactttgggaggccgaggtgggtggatcacctgaggtcaggagtttgagaccagtctgtccaacatggtgaaacccatttctactaaaaatacaaaattagccaggcttggtggcgcatgcctgtaatcccagctacttgggaggctgaggcaggagaatcgcttgaacctgggaggcagaggttgcggtgagccgagatcgcgccattgcactccagcctgggcaacaagagcaaaactctatctcaaaaaaaaaaaaatatatttgtgaggctttatttctgaagttttaattttattccattggtctatatttctactcgtaggctactagtacacactgtttttgattactgtagctgaattctgcttctgcgagttcttcagtcttattttattttccagtacagatggtctcagatatacgatggttttacttagagtttttgaacttcatggtgggcttatctggacgtaagcacatagtaagtcgagcatctgcagttaacaatggttcaacttaacgatattttcgacttatgatgggttaatcaggatgtaaccccattgtgagttgaggagcatctgtattgttttggctgtttaggcttcctacagttgcatatgatttttactttttggcggaggtgtccggtattgaatgaacctagggcctcatgcatagagttccatatgaatttgaggttagctttttcatttctctaaataggccattggaattttcatcgggattccactgaatctgtaaatgattttagggagtattgccattttaacaacacagtattaaaaattccaagtaatgaacttgggatgtcttcccatttctttaggtctttaatttcctttcaataatgttttgtaattttcactgtataagacttttcacagcctaggttaaatttattcataggtacaaacagttgttaattcccacagttttacttaatgattttttaactttatgatagggtttactggaggattgaatgcattttcaacttatgatatttttgacttatgatgggtttgttgggacttagccctgttgtaatttgagaagcatctatctgtgtgtctttcttttggatcctgttaagtgggattttttgctcagtttcctttttggattgttcattgctttttttttttttttttcttttttccggagacagagtctcactttgtcgcccaggctggagtgcaatggcgtgatcttggctcactgcagcctctgcctcccgggttcaagtgatttctcctgccccaccctcccaagtagctgggattacaggtgcccaccaccacgcccagctcatttttgtatttttagtagagatggagcttcaccatgttggtcaggctggtctcgaactcctgatctcaggtgatccacctgccttggcctcccaaagtgctgggattgctggcatgagccaccatgcccgaccagtgtgtttatacctgtagcgtaaaaatccatgcttcaggatttgatgagtcttggaaagcattttctgcatcctgctggttgtggaagcgtttttcctgcaaaaaagtagttgagatgcttgaagaagtggtagtcagttgcagagaggtcaggtcaatatggaggatgaggcaaaacttcgtagcctaatttgttcaacttttgaagcattgtttgtgcaacgtgtagttgggcattgtcatgaataattgggcccttttagttgaccaatgccggctgcaggcactgcagttttccttgcatctcattgatttgctgagaatacttctcagctgcagtggtattcagaaagctgtagtggatcaaccagcagcagaccaccaagcagtgaccatgacctttttttggtgcaagtttggtttgggaagtgctttggagctgctgcttaagtctatccactgagctggtcattgctggttgtcagataaaatccacttttcattgcatgccacagtccgattgagaaatggtaaacgacgactttttttttagtttttgctcagctgatgaggcacccacttattgagctttttcacttttccaatttgcttcaaatgctgaacgaccgtagaatggtcgacgttgagctcttcgacaacttcttgggtaagttgtaataggatcagcttcgatgattgctctcaattggtcgttgtcaacttcccatggccggctactactcctcatcttcaagggtctcgcctgcttcgcaaaacttcttgaaccaccactgcactgtacgtttgtttgaagttcctggggcaaacgtgttgttgatgttgtgaattgtctccactgctttatgacccattttgaacctgagtaagaaaattgctcaaatttgctttttgtctagcatcatttccatagtgtgaaataaacataaaataaacaagtaataagtctttagcaaaaataacataaagcaagaaagtgcccattaaaatgatatataacataaccacatttatttaagaatgtattccaatatcaaattgcaaattccaacagtgcaaaaactgcaattacttctgtaccaacctaatagtttgcttagtgtttttatcatgaaaaggtattagatttttaaaatgttttttctgtctgttgaggttatcatgtgttattttgctttgttgtattattgtggtgtataattttttttgagacggggtcttgctctgtcgcccaggctggagtgcagtggcgcgatctctgctcactgcaagctccacatctcgggttcacgccattctcctgcctcagcctcccgagtagctgggactacaggcgcccgccaccacgcccggctaatttttttttgtatttttagtagagatggggtttcaccgtgttagccaggatggtcttgatctcctgacctcgtgatctgcccgcctccgcctcccaaagtgctgggattacaggtgtgagccaccgcgcccagctgtggtgtataatttatttttttttctttttttggtgggagtcagtaccctttttgtttttgtaaagtatgcatgattttatttaatttttttttttagagacggagtctcgctctgtcgcccaggctggagtgcagtggcgtgatctcggctcactgcaacctccgcctcccgggttcaagcaattctcctgcctcagcctcctgagtagctgggactacaggcgcatgccaccatgcccggctaattttttttgtattttagtagagacggggtttcaccatgttgcccaggctggtctccaactcctgagctcaggcaatccgcctgcctcagcttcctgaagtgctaggattacaggcgtgagccactgcgcctggccaacttcattttttatttttttggaaagtgtacgtgacttcctattcatccatttggaagtgtacaattcagtgcattacatgtattcacagtgttatataatcattttctataccaaagtttttcaatatccccaacataaactatccattaaatagtaattcctaatagttccctattcctactccttggtaacctaaattctttctctccctttgaatttgcctgttttattttagataatataagtagtatcatataatatttatctgtttatatctggcttattaacataaagtggagccaattttagcacatttttgtcacttcaaaatgaaaccttcttgcttgataatttaccatgttaaaaaaaaaaaaaaaggaaaccgggcggggcgtggtggctcaggcctgtaatcccaggactttgggaggccgaggtggacagatcacaaggtcaagagattgagaccgtcctggccaacgtggtgaaaccgtctctaataaaaatacaaaaattagtagtgcgcctgtagtcccagctactcaggaggctgaggaaggagaatcgcttgaaccaggggggcagagattgcagtgagccaagatcacgccgctgcactccagcctggcgacagagcgagactccgtctccaaaaaaaaaaaaggaaaccttgtacgctttagttaccatcctcctacaccttaacttccctgcccctaagtaaccattatactattgcctgtctctacatccctctatttgagactcatatgaatgaaattatataatatgtagacttttgttactgtttttttctattagcatgatgttttgcaggtttatccttatttagcatgtatcagcggccacataatacttcattgtatggatatttcacattttgttatccattcatcagttgatggtcatcatcccaaacaagaactctgtacttattgaatgattctcctttcctccctttgtctattttggccattttgtagtaactctatttgcctatcctaggtattttatttaagtggagtcatacagtatttgtctatttgtgtctggtgtatttcacttagcataatgctgtcaaggtttttgcatgttgtagtgtgtatcaggacttctttttcatggttgaatgatcttccatcttgtaaataataacacattgtattatccatttgtgatggacatttgagttgatttcaccttttcgacaatgtaaataatgtcgctatgaacatgggtgtgcaaatatctgtttgagtctctgccttcagttctttttggtatatgcttagcagcagaatagctgggtcacatggtaattccatacttaactcttagaggaagtccgccccttcctttcttaagtctttgctgtatacctttgaagggtttccctagtttatataattgcttgtgatagtttttcccctatttattgactgttttgggggagatactggcccttgaagttcatgacgactccatttcctctgatgtcactataaacacttttgactgtggcagcctttgctaaaaatatttttggatcctggatgtggtagttcatgcctattataatcctagcactttgggaggccaaggtgggagaatttcttgagttgggagttagagacacttttggagtttgtttttttataattgtcttttttttttccatctcagtcttaaagttatttcttcaaagacataattgtgcttaggctttgatgctttcatcaggtaaaatgaaataaagactgaatctgatgaataaataaaactagtagataacagcttctaagtgtgactttgaagtaacatgaatggtttttatcatatgatacatagaaatgacttcttagtggtaatatatggcaggatttggcaaactagcctgcagtccaaatatggctaaaagctgtttttgtacaaccagtgagccaacaatagtttttacatttgtgaatcgctgaggcaaaatccaaaggaaaatattttgaggccgggtatggtggttcacgtatataatcccagcattttgagaggttgaggtgggaggatggcttgggcccaggacttggagaccagcctaggcaacatagtgagatcctgtctctaaaaattttttttaaaaactagctgggcatggtggtacataccttgtagtccctgctagttgggaggctgaggtgggaggatcacttgagtctggtatgttgaggctgtagtgagctgagatcctgccactgtactctagcctgggtaacagagcgagaccctgtctcaaaaaaaaaaaaaaaaaaaaagaatattttgtatcatgttagaattaaattaagccgggcgcggtggctcacgtgtaatcccatcactttgggaggcctaggtgggcagatcacgaggtcaggagatcgaaaccatcctggctaacacagtaaaacctgtctctactaaaaatacaaaaaattagccgggcgtggtggcaggtgcctgtagtcccagctactcgggaggctgaggcaggagaatggcgtgaacccgggaggcggagcttacagtgagccgagatagcgccactgcactccagccttggcgaaagagctagactctgtctcaaaaaaaaaaaaaaaaaaaagaattatatgaaattaaaacttcagtaactacaagaagtctattggaatgttgccactaatatgttgtctggctgcttttgtgctgtgatgggaggattgagtaatttcgagtgtatgtcttacattgcagaatctaaaatatttactatctggcttttttttttttttttttttttttgcgacggagtttcactcttgttgccgaggctggagtgcaatggcacgatctcggctcaccgcaacctctgccttctgggttcaagcaattctcctgcctcagcctcctgagtagctggggttacaggcacgtgccaccacacccagctaattttgtatttttagtagagacgggatttccccatgttggtcaggctggtctcgaacttttgacctaacatatctgcccgcctgggcctcccaaagtgccgggattacaggcatgagccactgcacctggcctactatctggctcttatacagaaaaaagtttatcgacgtgtgtgattgtcacaggttattattgattggtcttctgagaacaatagtcattcatatgtgttctaatgcgactgccaaaatattatttcataagcacatttaatatgttaacttttaatggatgaagcagtaatttggtagttaaatgaacattaattcaacttgctttggttagtgggaaggatattttagtgttattttcatattcacattatcctgctggtcagcattcctttttattctcctccttggtcgtcagaaaagaggttaaaaaggccgggcgcggtggctcacgcctgtaatcccagcactttgggagtccgaggcgggtggatcacgaggtcaagagatcgagaccatcctggccaacatggtgaaaccccgtctttattaaaaatacaaaaattagcagggcgtggtggtgccccagctacttgggatgctgaggcaagagaatcacttaaacgcgggaggcggaggttgcagtgagccgagatcgcgccactgcactctggcctgggcaacaagagcgagacagattacaggcgcacgccaccttgccaagctaatttttgtggttttagtagagacagggcttcgccatgttggccaggctggtctcgaactcccaacctcagatgatcgcctcccaccttggcctccccaagtgctgggattacaagcgtgagccactgcacccggccagaagttattatataatcaatgcaccattgcccaaaatacttatctgaattttttttttttgacacggagtcttgctcttgtcacccaggctggagtgcaatggcgtgatcttggctcactgcaacccctgcctcctgggttcaagcaattcttctgcctcagcctcctgagtagctgggattacaggtgcccactacaacgcccggctaatttttctttgtatttttggtagagatggagtttcaccatgttggccaggctggtatgaaactcctgagctcaggtgatctgcccacctcggcctcccaaagtgctgggattacaggtatgagccaccgtgcctggccttatctgacttttttttttttttttttttgggacagtctcgctctgtcacccaggctggagtgcagtggcgctatcttggcccactgcaagctctgcctcctgggttcacgccattctcctgcctcagcctcccgagtagctaggactacaggcacccgccaccacgcccggctaattttttgtatttttagtagagacggggtttcaccgtgttagtcaagatggtctcgatctcctgacctcgtgatccactcgcctcagcctcccaaagtgctgggattataggcgtgagccactacacccggcctgacttttaagccattgtatttattatatcattgatttagttttgggcaaatgtggtcacagaagatttggacaaatgttgtcacaaaaggttatgcttaattttccgtaatttatttcggcagtgagtaggaagaaaatttgaatgcgtatatgttacagacagtctttttgaggctggggacgtggctcacacctgtaatctcagcactctgtgaggccagtgcaggaggatcgcttgaacccttgagtttgaaaccagcctcggcaacatggcaaaacctcatctctaaaaaaaaaaattttaaatttagccaggctggtggcatgtgtcattagtcccagcgacttggtggggctgaggtgggaggatcacttgagctcaataggtataattttcagtgagctgtgattaggccacagcacattagcctgagtgacagagtgagaatctgccttaaaaaaaataaagtatttgaaagccttcttcagaggttattcttggaaaagcaaataatattatagccttgagtataatagtgtcatatcatttaagccatatggaaaataatactttgtatgaaaatagtaacatctagagtagttttattaataaaatactctccagatggcaagtgatagatacatcctgtttcgattttacaacaaagcatgtttgtgatataaacattattcgattgcaaaaattcttttttttttttttgaaatggagtcttgccctgtcacccatgttggagtgcagtggcgccatctcggctcactgcaacctctgcctcctgggttcaagtgattctcctgcctcagtttcctgagtagctgggattataggcacatgccaacatgcccagctaatttttgtagttttagtagagacagggttttaccatgttgaccaggctggtctcgaactcctgacctgaagtgatctacctgcctcggcctcccaaagtgctgggattgcaggccttagccactgcgcccggcccgattgcaaaaatcgtaacatttcagtgacttcagtgttttgaaattgagggattaaaatctaagatctaaatattcgattcttcttccttttttttttttgagatggagtttcacgctttttgcctaggctggagtgcaatggcacgatctcggctcactgcaacatccacctcccaggttcaagcaatttttgaatcccatagtgctgtgttgggattacaggtgtgatccaccatgcctggctattcttttttttttttttcttctttttaaagagacagtatcttgctctgtggcccaggctagagtgccgtggcagtcatggcttactgcagtcctgaactcctgtgcttaagcaatcctctcacttcagccttctgagtagctagtaccacaggcacacaccaccacacccgaccccattattgttctattgatgtttataactgtataattagtatataatctgcatttaccagaaatctgtaaaatctggttatgtcattacttttcctgattattggtacagttaaaacctagaaaggctcattcatataagggatacattgtgttggaagagcttataacaactttgttttatattttgccaaaaagcctttggattctttagctcgagggtgtagtccagattccaggtccaacttctagagttctggaggagtggcagatatccatttcttggggatcagtcagaagtgagctcattaattaattggaaactttttgttttggatgtttcagtggtaaatgaaaacaataccccctactagaattattgtgaggattctgttacattatgtgtgaaagaactgattacaggtgtcacaaattactttcttactcattaatttattaattatgtgctatgcactgttttgttttgtttttgagacagggtctctgttgtccaggctggagtatagctgtgcagtgtttttaagtgctgggaatactgtgatgagcagaatagacattgtgtctgccctcatggatccttcagtaaagtgagaaaggcaaacatcaaacaaggattgggcctggcacagtggctaatgcctgtaatcccagcactttgggaggctgaggtgggtgggtcacttgaggtcaggagttcaagaccagccttgccaacctggtgaaaccccctctctactaaaaatacaaaaattagccaggtgtggtggtgcatgtctcccagctgctcgggaggctgaggcaggagaatcgcttgaacccaggaggcagaggttgcagtgagccgagattgtgccactccactccagtctgggtgacagagcaagactctttctcccaaaaacaacaaaaaacaaaacaaaacaaaaaaacagcaacaacaacaaggattgcttgagcctgggaggttgaggctggagtgagcgatgaccatgccactgcactccagcctgggtgacagattcattcataccctgtctttcaaagaaaaaaatatcagtattagattgtatgttcacaattatatgtgtgagaacctatatgtatgggaactctttgtgccaaccagtgcccagagttttctctctgctctgattactctctcaactctctcaaattgccttttaaagaaatctttatttctgttaagattttagagctatttgtttttggtttttgcttaattttttgcatattctgttaatgcaaaaaattgcattaaattattattattatttttgagatagaatcttgctctgtcgcccaggctggtgtgcagtggagcagttttggctcactgcaacctccaccttccgggttcaagtgattctcatactacaacctcctgagtagctggaactacaggcatgcgctgccacgcctggctaatttttttgtatttttagtagagacagtttcatcatgttggccaggctggcctcaaactcttgggcctcaagtgatctgcccaccttggcctgctaaagtgcttgaattatagatgtgagccccactcctggctgcattaaaatattttaatagacatttgattgattgattgattgatttatgagatggagttttgctgttgttgcctaggctggagtgcaatggcgggatctcggctcaccacaacctccgcctcccgggttcaagtgattctcctgcctcagcctcctgagtagctgggattacaggcatgcaccaccaagcctggctaattttgtatttttagtagagatggggtttctccatgttggtcgggctggtcttgaactcccgaccttaggtgatccacctgcctcggcctgccaaagtgttgggattacaggcgtaagccaccgcacccggcctttaatagacatgttttaaatttataaggattaagaaaaacccctaaaaataaaaaacaaatttataatgattttatagttaaaaggttttgttgttgagacagggtcttaccctgtcactgaagctagagtgcagtggagtgatcacagctcactgcatcctcgacctcctcggcttaagtgatccttgtttaatgtttgtttttaagaacattaaaaagtgctttgttgaaagtgtttggtttagcacatttttattgattactgagtaggtgctggagtttaaaacatgaataagacaaaaaaaatgaatagaaaataagattattgcctctgctgttgagactcttagagtgtggtattaatatcaatgtaatgtgtcaagtgcagtaaaaagaggtatgcacaaggggatccagagccttaagtaggggtaaagtagacccaagagatgtttctttgagctgagttatgaagtataagtagctattagccagataggaaaatgaagcgtgccttagattgtaaagtatgatcaagtgcatggaggtgtgatagcataagatttatgtgaactacaaagtgtaaatcgtgtgatggaacttggtcatagtttttcctagggtaggagtcagattaggaagggctttatttttcatcctaggaccttggatttaagtgttttttttgtttgttttgttttttttgagacagagtttcactcttattgcccaggctgaagtacaatggcaggatctcagctcaccataacctccgcctcctgggttcaagcaattctcctgcctcagcctccctagtagcagggattataggcatgcgccaccacgcccagctgattttgtgtttttagtagaaacaagggttctccatgttggtcagactggtctcgaactcctgacctctggtgatccgcccacttcagcctcccaaagtgctgggattataggcgtgagccactgtgcccagctagttttgttttttaaatttttatgtttccaaataaatcatacacagagcacaagtataaaacatagaaaaaaagatggagctgctttgacttggaatgtggagcagccagctttcttatcaccctcttgggtagcctacaaggggctctcatgagcactatctcagaggaacacaatttgaaaactacctctgtgatggaatttcaacagaaggattttgagaagtccagaggaattgattaactaatgattaattgtaaaatgcattcttagagttggaaataagttggtgtgatatgtgggagatggggaagggggccaatcaggtatgtctgggctattaagaaaattgttacttctattctttagtctattaagatataattaatatttttattttttatttttttgagacttgccctgtcgctcaggctggggtgcagtggtgtggtctgggctgactgcaatctccacctccaggtttcaagcgattctcctgccttagcctcctgggtagctgggattacaggcacctgccaacacgcctggctaatttttgtttttttattttttattttatttatttatttttttttttgagacagagtctcgctgtgttgcccaggctggagtgcagtggcacgatcttggctcactgcaacctccgcctcctggattcaagtgattctcctgcctcagcctcccaagtagctgcgattacaggcacatgccaccacgcctagctaatttttttgtatttttagtaaagacagggtttcagcatgttcatcatgtttgccaggctggtctcaaactcctgacctcaagtgagccgcccaccttggcctcccaaagtgctgggattacaggcatgagccactgcacctggcctactcaccgtttcaatgaatgtcataccttggtatctcgagggtcttgctatgttagtcaggctggtcttgaattccttggctcaagtgatccacctgcctcggcctcccagagttttgggattacaggcatgagccactgcctgtaaacttgtagtgactttgccctttgcttagtctgttaattactgagagaggtttttcccaccctgtgattataattttgttatgtgtcctggtatctcttgtttttctttttattatttatttatttattttatttatttgtttattttgagatggagtctcgctctgttgcccaggctagagtgcagtgacatgatctcagctcactgcatcctccgcctcccgggttcaagcgattctcctgcctcagcctcccaagtagctgggattacaggcgcatgccaccatgcctggctaatttttgcatttttagtacagacagggttttgccttgttatccaggctggtcttgaactcctgacctcatgatccacccgcctcggcctcccaaagtgctgggattacaggcgtgagccaccgtgcccggctgatgatgatattttaacagatgaagagttgcattttgtagatgagcaaaaaaatgtggtttcttttttttttttttgagatggagtctccctttgtagctcaggctggagtgcagtggtgtgatctcagctcactgcaaactccgcctcccaggttctcctgcctcagcctccctaatagctgggactacaggcacctgccaccaaagtacgagaatcacttgaattcgggaaggaagtttgcagtgagccgagattgtgccactgcactccatcctcggtgacagtgacagagcaagactgtctccagaaaacacccaaaaagagagaaagaagctctactgtgcataaaatactatcaaatggcattgaatgctacagagaaatcaggaaaggaagagtcaatcgtcaatccatgtgggaaacttcattatgggtttttttttggttttttttttttttttttggcaggttctcaccttgtcacccaggctggagcgcattggcacaatctcatctcactgcaacctccaactcgcgggttcaagtgattctcctgcctcagcctcctgaatagctgggattacaggtgcctgccagtatgcctggctaattttttgtagtttttgtagagatgaggttttgccatgttgtctaagctgttttgaactcctgacctcaagtgatctgccctccttggcctcccaaagtgctgggattacaggtgtgagccactgtgcttggctgcattgtggtcttactttaagaaattgctgtggtgggttctgtgctatttcctgtaatcccagcaccttgagaggccaaggcaggtggatcacttgagcccaggagtttgaggccatccggggaaacataaaaatttaaaaaattagccaggcgcagtggctcacgcctgtaatcccagcactttgggaggcccaggtgggcggatcacgaggtcaggagatcgagaccatcctggctaacacggtgaaaccctgtctctactaaaaatacaaaaaattagccaggcatggtggcgggcgtctgtagtcctagctactcgggaggccgaggtaggagaatggtgtgaacccgggaggtggagcttgcagtgagtggagatcgcgccaccgcactccagcctgggtgacagagtgagactccgtctcaaaaaaaaaaaaaaaattagctggtcatagtggtatgcacttttagtcccagttacttgggaggccaatgctagaggaccgctggaacccaggaggcagaggctacagtgagttgtttttgtcccactgcattccagcttgggcaacagttgagtgagactctgtctcagcaaaaacaaacaaacaaaaaacagaaattgccacagccattctgaccttcagcaagcagccatgaacactgaggcaagaccctccatcagcataaagcttgcagctcagatgatcattttttagagacagggttttgctctctttcccaggctcaagtacagtgataaaaccgtagcttgctgtaacctgaaaatcctggactcaagtgattgttttgcctagaactacaaggttgtgccagcacccccaactaagtctggctttgttttttcctcccctcccttcccctcccctccccgctttttaaaatttttattttatttttattttttcaaatgggatctcgctctgtcacctaggctggagtgcaatggcgcaatctcagctcactgtaaccttccatctcccgggttcgagtgattctcctgcctcagcctactgagtaactgggattacaggcgcctgccattacgcctggctaatttttgtatttttagtagagacagggtttcaccacgttagtcaggctggtctcgaactcctgacctcaggtgatccgcccacctcggcctcccaaagtgctggcattacaggcgtgagccaccgtgcctggcctctttttttgtttttttaagtaaagatgaggtctcacttatattgccaagtatggtcctgaagtcctaggcccgagcagtcttcctgccttggcttccgaaagtgctgggattacaggtgtgaacccccacaaccagcctcagttaaggggtaaaatttttttgtttgtttttttagtgatgagttcttgttatattgcccaggctggatattcttttcttttagcactatatattttttcccccaaatttatacattgaatacaacaaagcattcttaatttgttatttttaatatataatgctattgtacacagactattgtgtagtgtaaatctaacttttatatatgtattgtgaaattgaagcattctcgtgactcactttatcgcaatatttgcattgttgtggtagtcttgaaaccgaacctgtagtatctccaaggtatgcttttgcaagtttttgtatggacatgtgttttcattattcttgggtattgtatacctaggagtagagttactgcatcatatggtcattctgtgtttaagaaaaaattttattttcaatgtttgtgtatatatatttatgatatacatgagatattttggtacagacatgcaatatgtaataattacattagggtaaatggagttaccatcccctcaaggatttatcctttgtgttacaatctaattataccctttttcttattttaaaatatacagttaaattattatcaacctgttgtgctatcaaattctagttcttattcattatttctaacttttttttggacttactgaatcatctgttcttttgttttctttaaccgtcctcacttccatctttctacttcccttcctagcttctagtaaccatttttctgttgtctatcagcatgagttctattgttttaatttttagttcccactaataagtgagaacacatgaagttggtctttctgtgcctgacttatttcatctaacataatgatctccagttccatctatgttgttgcaaatgataggatctcattctttttcatggctgaataacactccattatgtatatgtaccacatttgctttatttattcatctgttgaacacttaggttatttccaaatcttggctattgtgaacagtgctgcaataaacatgggagggcaaatgtctatttgaaatactgatttccttttctgtatatagctagtcgtgggattgctggatcaaatggtagctctatttttagttttttgaggaacctccaaactgttgtctagatttgtactaatttacattcctaccaacaacgtatgagggttcccttttctccacatccttttattcttttcttttggataaaagccattttatctgtttgagatggtatctcattgtagttttgatttgcatttctctgatgatcagtgatactgagcaccttgtcatattcttgtttgccattcgtatgtctttttgagtaatttctattcagattttttgtccatttttaggaaaactttaatttgattgttatatttttcttttagatttgtttgatatcctcacatagtctagttacttgttttgggtttttttttctcttggagacagggtctcactctgtcacttaggctggtgtgcagtggggcagtcatggctcagtgcagccttgacctcccaagctcacgcatccctcccagtttaccctcccaagttgctgaaactacaggtgtgtgctaccatgtctgcctggtgtgggtgtgtgtgggtgtgtgtgtgcacgcaaggatgggatctcgccaaagttgatcttgaaatcctggcctcgagcgatcacccaccttggcctcccaaagtgctaggattgtgcaggcctgagccaccacgcctggccttttcttgtttataaatgagattatgtatttatacttgggttgatttgatgacgttattcttaaatatgggtagtttaagctgtggaaaagttttagtaggctttggatatcatataaatcaagcatctaaacggatgtgtttttgtcttatatattgctgtcgtctctttataacaacttaatattatgggagtttttggtaactaaaacaataactgagtccttagagttgcgataatttctatgataattgttatgtaaagcattagtacttcccccacttcccctcgtctttacctcaagttgtgtatcactatagattctcagcaagtttttctaaaaaactgtggctgggtgcagtggctcatgcctgtaatcccagtactttaggagggcgatttgggtggattgattgagctcaggagtttgggaccagcctgggcatcatggtgaaaccctgtctctacaaaaaatataaatgccaggtgctgtggctcacgtctgtaatcccagcacttgggaggcggaggctggtggatcacctgaggtcaggagttcgagaccagcctggccaacatggtgaaaccctgtctctcctaaaaatacaaaaattagccgggcatggtggcaggcgcctgtaatcccagctactcgggaggctgaggcaggagaatcgcttgaacccaggaggcggaggttgcattgagttgagattgtgccattgcactccagcctgggggatgagagcgagactgtctcaaaaaaacaaaaccaaatatatatttgcttttttgtttgtttttttgagacagagaccaaatatatattatatatatatataatatatatttgttttttattataatatatatacattatatattatatattatatatattttatatattatatataatatattttatatatttatatattatatatgtatattatatatatatatatataaatttatatatataatatataagttttatatatttaaatatatattatatattatatatttatataattaatatatataatatatttatatattttatataattatatatatttatatatataaataaatatatataatatagttatatatttatatataactatattatatattatatattttatattatataatttatattatatattatatattatatattttttatatatataatatataatataacatataatatatgttatatataatatattatatataacatatattatattatatgtatatttatatataatatatatatgtaaatcagcccagtgtggtggtgtgcgtttgtagtcccaactacctgggagcctgagggggaaggattgcttgagcccaggaggtggaagctgcaatgggctgtgatcacaccattgcactctagcctgcattacatagggagaccctgtctcagaaacgaaaaagaaaaaattgttgcactatggctattttttaatatttagctcaactgtaatttttggatatgtctgggaagagattgatagccaatgactatattcaatttacattaaaatagcatatcccatatgaccaggaacatagttgaaccggtttaggtttttttaaaaaatcctcagaagtgcaacataggtttgatttttaactgttgctagaaaaattcattagtgaaagtaaagatctcgtccaaaattcctttaaacagaacttttggctcaagagccacttcttagttagagttgtagagatgtcttaagcctttagtgattttcgaagatggtagtgacgagcttttctgggttagtttaatataaagtgatacgtcactgtcagtgaaataaggaatataaggtggccgtggtggctcaggcctataatgccagcactttgggaagacaaggtaggaggattgcttgagaccaagagttcgaaagcagcctggggaacacagggagacctgtgttctgggtgtggtggtgtgtgcctttagtcccagctattcgagtggctgaaatcaacgcgccactgcaccccagcctgggtgacagactgaggctgtgtctcaaaaaacaaaccaacaatcaaaaagaaaatgggaggttttaaatctagttagcttttaggttggatttaaacactttgcaaacaaattctagccatatttatttctaatgcaaaaaacatggtctttagagttattcagatatggatttaaattctaatcgttacaattgtgacttaacttttttttttttttttttttttgagctggaatctcactccgttgcccaggctggaatgcagtggtaagatcttggctcactgcaacctccgcctcccaggttcaagcgattcttctgcctcaacctcccaagtagctgggattacaggcacacaccaccatgctcggctaatctttgtatttttagtagagatggggtttcaccatgtttgccaggctggtcttgaactcctgacctccagtgattctcccaccttggcctcccaaagtgctgggattacaggcatgagccaccgcacccagcctgtgacttaacctttttgagcctcagtttctttatctgcaaaatcgagataatgctgtcttgtaaggttgtgaggggtaagcaaaataatgtatgtgtattagttttggggggctgttgtaatgcaataccacaaactagctggcttaaacagcagaaattctctctcagttcgggaagctagaagtacaaactcaagttgtcagcacattgttttgaggactgtgagtgtgtatctgtccctgtccctctcctaatgtctgacctcaggctttccttggttaatagattgtgttctgtctgtgttttcacgttgtcttccctctatttgtgcctgtctttgtttccaaatttctccattttattaggaaacagttgcactgaattaaggcccacccttgtgacttcatctggatcaactgcaaagaccctactttcaaataagatcacattcacagctactgggttagggaggagtatatcttgtgtgtgtgtagagtggcagtgtacacagaattcggcccaataccatatataaaaaaggcttagtaccagtatattatttccaactggacctatagacattagaaaaagccattctgaaatctgccagtcctgccagtctaagcctggaagatgccacttctttacttacattttctctgatctcttttcccaagtgtcttgggatctggaattgtgacttattcgtctttgtgtgtcttgttgagctttgtacataggtgtttactaagtttgtgtgtagttgaattatgggcttaaatggatttattttagtgtctgtctctgcaagataaaatttttaagctggtcttaaagtcgtcttgcttttttacacccttgttcttattttcatgtttagaagcttttctgtggtctggaattcttgcctgtttctaagtttatttattaagatcagttggatttggtccttattgtctatgaacgaaagtattaatgtgtatttatatagatttatttttccagtgggtttgcatatgttattttatttggtcatgtaaatttttcaagatagaagaaagtaaataggggtttgttaaagtctttactcattgtaccatcaattaatgaaactttaaaatttgtgtttctcaatggccttgttatttaaaagtttttttaaggtcatcattattgcttcagcctagtttataatggatcatacagtgtatgtatagctctgttatctttaagatatgacatcttagcatatttcatagagttgtaatagcataattttttttggttatatagatgagaggtttctgtgttggccaggctggccttgaacgcccagcctcgcctccttatgcaccaggacaacaggcctgagccaccacggctcctagcataatttttttaaacagatctcttggtggatattaacttttgtcattttaaaaaaaaaatgctttaacagcttgggcaacgtggttatattccatctctacaaaaaatacagaaattttccaggcatgttggtgagcattggaacactgagatgggaggatgggttgagctcaggaggcgaagattgcagtgagtgaagattgcaccattgcactccagcctgggaggcagagtgagaacctgtctcaaaaaaaacacacaaaaaaccaaccaaacaaaaacctgctttaaatatcttaccctagaattaggaattataggaaattactttgaattatttttggggcttaaaatactgggagctgaattactagttactcattttgatggtgtattatagagtaggtgttactttcccaattttgtggcttaggaaactgagaccaaattaacagactttttgaaggtgacacagtttgtgatggagtcagaagagaggatttattactactttctctggttctgtggttctggctattgtctttacctgataccactgacattctttctcctctgtctattgaatgcatgtattttatgattatacttccaaaaatacaatgtaatctttttgtagtagttctctgaggagaagacagaaccaacaacatgtgctagattggttatagttaaatttgtcataaagcatataataataatgaggttttgttgttattggataacaggagagtggtttaagaatttaggctctggagttgtatctccccaggtttgaatccttggttctgtcacttaataactatgtaaccacaggcatgtagtaaaataatgggtaataatgtgtttacttgaagaacagtgccttgcatgtagcaaacatcatgttacttaatgtatttgaagtcatttaggacttgaataaataagcaagttccatatttagcagtgccaaataaatcatatttaaataatcaaaaatcaaattatataataaatttattggaacctactcagattgcagttttcagtacagataaaatatttgtctttcccatcgattcttggtatctcttaaagtttcaaagtcaattaactttgaagtcgtattctttttgagaatttacttgataaccatcaatatggtcccttagatttttttaaagacagatctcactctgtagcacaggctggagtgcagtgggcatgaacatggtccactgtagcctcgaattcttgggctcaagcagtcctcctacctgtctcccaagcagctgggagtacaggcatgcaccaccatgcccagctaattttttaaattttttgtagagactgggtctgacatgttgtccaggctgatctcagactcctaggctggagtgatcctgtcacctcagcctcccaaagtgctggaatttataggcaagagccacagcatctggcccccttagggctttttattttattttattctttttacttttgaggcagagtctaactctgttgcccaggccggcgtgcagtggcgcaatcttggctcactgcaacctctgcctccctggttcaagcaattctcttgcctcagcctcccgagtagctgggattaccggcatgcgccgccatgccctgccaatttttgtatttttttctctttttagcagagacagggtttcgctgtgttggccaggctgatctcaaactcctggcctcaagttatctgcctacctcggcctcccagagtactgggattacagatgtgagccactgtgcctggccccttagagctttttaaaagaaagtaagatgtagttcttgtttcattttctagtagctctatatacaggaggaactaatcccaggttttttttttttccgagacggagtcttgctctgtctcccaggctggagtgcagtggcgccatctcggctcactgcaagctccgcctcctgggttcacgccattctcctgcctcagcctcccgagtagctgggactacaggcgcccgccaccatgcccagctaattttttatttttagtagagacggggtttcaccgtgttagccaggatggtctcgatttcctgacctcgtgatctgcccgcctcggcctcccaaagtgctgggattacaggcatgagccactgcacccagccttttttttttttttcttttttttttttgaagagtctctctgtcgccgaggctaaagtacggtggctcttggctcgctgcaacctccgcctccagggttcaagcgattctcctgtctcagcctcccaagtaactgggtaggattacaggtgcccgctaacacccccggctaatttttgtatttttagtagaacaaggtttcaccatgttggccaggccggtcacgaactcctgacctcaggtgatccacctgcctcggcctcccaaagtgctgggattacaggcatgagccactgtgcccagccaatcccagtatttttaatgagatttaacttctgtgagtatttagaagaattctttgctgttttctctggggcttatgtctgaaagtaaagtgttagctgggactacaggcatgtgccaccactcctggctattactattgttaatacgctaatagaaatattggtttgaaaagcatgtagaatatcacatgcagaagggtctgaagtctcttgatattattaaaaattcttcctataattttttctccattttttttttccctttgtgttttgatccaaggactagatcaagggtgtcttttccttcggatgattttctttattgtgtgtgtttttagttctttaaaaataaagccagcttaattttattttcaaaatacggatagattcattatataaaacaattataagttgagaactatgtataaagggctatgttatgaacaattaagatggaataatttagttgtacttattttgtaattctttttaggctagagtgttttcattctcaatttttcatacattgctttttcagaaggctaataggaatgacaataatgtttcaaaatattttgattcttattgatgccccatgttttgtctgtctaaagtgtcaacctaagaaaaagtctacgccactgaagtatgaagttggagatctcatctgggcaaaattcaagagacgcccatggtggccctgcaggatttgttctgatccgttgattaacacacattcaaaaatgaaaggtaatacttgcagtgattatacatgttaaaggcagttgcctttagaataactcaatttttgttatcttaataataatatatttttttccttggaacattttgtgaatgaattggtgttacatattttatcttttggggcttttaaaagttcgttttactctatgatttaaaccttctctcagttttttttttttgtttgtttgtttttgagacggagtctcgctcttgttgcccaggctggactgtagtggtgcaatctcagctcactgcaacctctgacttgtgagttcaagcgattctcctgccttagcctcccgagtagctgggattacaggcatccgccaccacgcttggctaatttttgttttttgtttttttttttaattttttatttgagatggagttttgctcttgttgcccaggctggagtgcagtggcgtgatctcagcttaccgcaacctctgcctcccgggttcaagcaattcttctggctcagcctcctcagtagctgggattgcaggcatgtgccactacgcccagctaattttgtatttttagtagaaacggggtttctccatgttggtcagactggtctcgagctcccgacctcaggcgatctgcctgccttggcctcccaaagtgctgagattacaggcatgagccctgcaccaggcctaatttttgtatttttagtagagacggggtttcaccatgttggccaggctggtcttgaactcctgagatgaggtgatccgcccgccttagactcccaaagtatggggattacaggcgtgagccactgtgcccggctgatttaaacattctcaattattctgttgatgccaggaaggtgttaggccatttttctaatgtttacattgtccggaatcaccttttagtatatttacgtatttctactttaatcaggtttgtatcattttttataatataaaagctgaaacaattgtaaatgtttattaataattttgaagtttaaaattttaatttggagtatttcctttaaatgctattgtttgtttttcagttgattgttgtgtttgaatcttaggtaccttagttttaaattactctaaaggatggggctgaaacttgatttatttttattttattttattttagagaagaatttctgctctgtctcccaggctggagtgcagtggcgtgatctcggctcactgcaagctctgcctgctgggttcatgccattctcctgcctcagcctcccgagtagctgggactacaggcgtccgccaccatgcctggctaatttttttggtatttttagtagagacgggatttcaccgtgttaaccaggatggtcttgatctcttgacctcgtgatctgcctgcctcggccttacaaaatgctgggattacaagcgtgagccaccgtgccgggccaatttttgtatttttagtagagatggggtttcaccatgttggccaggctggtcttgaactcctgacctcaggtgatcctccttcctcagcctcccaaagtgttgggattacaggtgtgagccactgcacctggcctgaaacttgatttgagctgtccttttttctgttaggatggtagtgattttattttagttttaatatatgtattttagtttctgaaagtcagatgttggtgagattcagaaaaatcagcttactctctgctttgctgtgatccgccacattcttcactcctttcaacaggcaaccaattgatattaatttttgttgttgttgttgttgttttgttttgagacggaatcttgctctgtcacgtacgttggagtgcagtggcgcaatttcggctcactgcaacctctgcctcccgggttcaagcaattctcctcctgcctcagcctccagagtagctgggattacaggtgcgtgccaccatgcccagctaatttttgtattttagtagagacggggtttcaccatgttggccaggctggtctcaaactcctgacctcaagtgaaccacaggtcttggcctcccaaagtgtttggattacaggcgtgagccaccacacctggctgatattaatatatttttatatacataatgttttttcatataaattatatttttatttacatgagtaaatacatacttcttagtcatcttccacgtctttcctttatcacaaacagaacattgtatattttgcagcttgccttttccactttgtggagatttttttcatatttttattatttatgtatttgtttatttttctgagacaggatctcattctgttgcctaggctggagtgtaatggcataacaacgcctcactgaagccttgatctccagggctcaaacagtcatccaacctcagcatcctgaatagctggaatagctggaatagctgggagcacagacgtgtgccaccacacatggctttttttttttttttttgggtggagatagtgtctccatatattacccaggctggtcttgaaatcctgagcttaataagggatcctcccaccttggccttccggagtgctggaattacatgtgtgagtcaccatgcctctttttttttttttttttttttttaaaaaggatgatttctccaaagtagaattcctggatttgattttatattttgaataatgaggtgcccaaaaacctttataaattttagtgtctttttttttttttttttttttttttgaggcagagccttgctctgtctcccaggttggagtgcagtggcacaatctcggctcactgcaagctccacctcctgggttcacaccattctcctgcctcagcctcccgagtacctgggactacaggtgccagaacctagcacagtactaggttttgtgtctgggcgcagtggctcacacctgtaattccagcactttgggaggctaaggcgggcagatcacctgaggtcaggagttcgagaccagtctggctgacatggtgaaaccctgtgtttactaaaaatacaaaaattagccaggtgtgttggcatgctcctacaatcccagctactggggaggctgaggcagaagaattgcttgagcccgggatgtggaggttgccgtgatccaagatcacactactgcactacagcctgggtgacagagcgagactctgtctcaaaagaagaaaataacttagtgtgttaaaaatttaataccttgaccagacacggtagctcatgcctataatcccagcactttgggagtccgaggtgggaggatcacttgagcctaggagtttgagaccagccttggcaatacaatgagacactttctctttaattcaaaaaaaatgttgataccttatcctttgtgacctgtctggatatttaaattctactactagaaaactctgagtccttcttttctaacctccctgtccctatgactgctggtttcttactcattagggtgtctctctctctctctctcctcgtctctcttttgattgagggtctcgttctattgcccaggctagaatgcagtggcgtgatcatgactcattgcagccatagcttcccagggtcaagcgatcttccctcctgtgccttccaagcagctggggctacaggcattcgccactatgcctggcttagtttttaatttttttgtagagacagggttttgccttgttgcccaggctggtctgaaactcctgggctcaagcgatctgcccgcctcggcctcccaaagtacttgggattactgacaggagctaccgcactcagcctatttatagtgtttcttatgcatactagttgagtccatgctatttatttgacaaatagtaaataccttgtatagattgagtactgtgctaggttttgggattcattattgggccatacatctatactgcttgctctcatgagaaattagaatctagtataagggacaagacaccagaaaataatcaaatgcattattacttaactgagaagtctgtccaaggaacaattttgatgcctattcagtgatataacagggataactgacctggactcttcatcagtggtgtttgctaataaagttatctctgatctgttacttgagaggatgagttgggagttaactagggaagagagaagaagatggttccaggaatctgcagctcacagagtaagggagggtggcacagtatgaggctgggaagtagatatgggacaaagtgttcagtgccttgttgactttgttaaaaaattttgttatttttatctcagaaacaatgtatataattaaaaagtgtttagcaggagccgccatgctctgatctgttcattttaaaagttcactgtggctggattgttgaacatgtgttagaaggggaccacaaataagtaaaaagagacagttaagtcattattagtgattatggtgtgatgaaaattgcgaatagaaaataaaaacagatgaggaggtaaaatgcatctgatgtagtaatgcattggataatgttgactgagggagaatgaagtcctgaggctttcagttctcaggtttccatatcataggatggctcccacgtttttagcttcatcactggatggctgaatagatcgtcatttactgagagaacaccagagcatctataactcagaaaggacatattcttgttcatattagttggagccatgggcaaggcatgggtgagattttttgggacaaaagatactatgagacaaaaggtacattgaggaagacatcatttgacatctgtatgaaagagactgagcttgctgaaaaagaatgatgaaaaagaatcagatgaaacaggtggaagaggaaaagtaggagaatgtggctagagtacagtagtatgtactggggatatgttctaagattctcagtggatgcctgaaactggatagtactgaatcccatatatataatgtttttcctgtacatacatacctattataaagtatcatttataaattgggcattgtggctggttgtggtggctcacgcctgcaatccagcactttgggaatccgaggcgggcggatcacttgaggtcaggagttgaaagccagcctggccaacatggtgaaaccctgtttcttctaaaaacacacaaaaaattagctgggcgtggtggtggatgcctgtaatcccagctactggggaggctgaggcaggaggattgcttaaacttgggaggtggaagttgcaatgagccgagatcataccactgctctccagcctgggcaatggagcaagactccatctaaaaaaaaaaaaatagtaaataaaaaataaattgggtattgtaagagatcagtaacaactaataataaaacagggcgggtgcagtggctcacgcctataatcccagcacttcgggaggccgaggcaggcggatcacaaggtcaggcgatggagaccatcctggctaacaaggtgaaaccctgtctctactaaaaatacaaaacattagctgggcagggtggcgggcgcctgtagtcccagctacttggcaggctgaggcaggagaatggtgtgaacccgggaggcggagcttgcagtgagccaagatgacgccactgcactccagcctgggcgagagtgcgagactccatctcaaaaaataaataaaacagaacaattacactgtaataaaagttatgggaatctgtcccctaccttcgaccccaatagcttattttactgtatcacaggtaactgaaaccatcgaaagtgaagtctcacgtgagctgggaccactgtagtttaaggacgatgtggtcaattttgctgagtgttgcctagagagcaaataaaatgtccattagggataagaaggtggagatcacgagtaccttttttgttgttgttggtttcattgaggtagaagttagattggactgatttgaggcaatggagacagagacagagaagggaggatgctgcaggcagataggtatataggattcagaaggatttttattttttgttgttattttttattttaatattagtcttatttttgagaaagagtcttgctctgtcactcaggctggagtgcagtggcacaattacagctcactgcaacttccatctcccaggctccagtgctccagggctccagcactccttccacctcagcctcctcagtagctgggactacaggtgtgcaccacaacacttggctaatttttatattttttgtagagacaagatctccctatgttgcatgaactggtcttgaactcctggccttaagtgatcctcccgccttggcctcccaacgtgctgagattacaggtgtgagccactgtgcctggccaatttatttttgactctagagacagggaagtttcaagatgaaggtgctagccaattcggatcccaagtgagggctgtcttcctgacttgtagataaccaccttgttgctgtgtcgtcatttggcagagagcgaaagtactcactgtggcatcttcttttaaggagactagttgcatcatgaggtcacctccatcatgagggacctattactaatctagtaatagtatttagtattcttagtatatttagtgtataaaattagtaaatctacttactccaaaggcctcacctgtaaacaccaacatatgggggggtcaaggcttcagaataatgcatttcaggaggacacaaacatttagtctgtaatagccctttttcatccttcttgaatgacagtcttactaactctgagttttaaattgtcgtcagtaagctgaattcatatccttagtgatagtctttatccaggctttagatttgtatactcaactccatacttgaagttttcaccaagatgtcaatttgaaaatatattcatcaccctaacatggaaccccatactctttagcttcctctgtctccatctttccacacccatacgtgtttgccttaagcaaccactaatgtactttctgtttctgtggatttgcatattctagacatttcatatgtagtaggtccccaatttgagttagaatttttcgaccttacaatggtgcgaaagcgatacacattaaatagaaatggtacttcaagttacctgtagaaccattctgtttttcactttcaatgtagtattcagtaaattacaggagatattcagcagttaattttaaaataggctttgtgtcagaaatattgcacaactgtagaccaatgtaagtgttctgagcatgtttagcgtaggctaggtgtattaaatgcattttctaattattattttttttttagaggcagggtcttgctttgttgctcaggctggagtgtagtgacgcgatgtcagctcactgcaacctctgcctcttggactcatgtgattctcctgcctcagccccccaagtagctggaactacaggcaagggccaccatgcccagctaatttttaaatttttttatagacagggtctccctgtattgcccatgcttgtcttgaactactgggctcaaacagtcttcttgccttggcctcaaaaagtgtttggattataggcgtgaagcctctgcgtctggccagccttcatattcaacttaatattttcttttcttttcttttcttttcttttctttttttttgagatggagtctctctctgtcaccagactagagtgcagtggcacgatctcagctcactgcaacctctgacatcctggttcaagcaattctcctgcctcaacctcctgagtagctgggattacaggcacctgccaccacgcccggctaatttaatttttagtagagacggggtttcaccatgttggtcaggatgttctccatctcctgacctcgtgatctgccaacctcggcctcccaaagtgctgggattacaggagcgagccaccacgcccggcctcaacttaatattttcagcttataatgggtatgtcatggagcatctgtgatttgtttataatttttccacaaatctgttgtgctcctcaacttacaatggggatacgtttccactaggaatgcattggttctgatttttcccatatccccatcattggttatttgacttttaaaaaatagacaaaacataaatttaatgttttttttttgttttgttttgttgagatagagtcctgctctgttgcccaggctgtggcaggatctcagctcactgcaacctctgcctcctgggttcaagcagttcttctgcctcagcctcctgagtagctgggactatacgagtaactgggactacaggcatgtgccagcacgcctggctcatttttgtatttttagtagagacaggatttcaccatgttggccaggccgttcttgaactcctgaccttaagtgatcctcccgcctcggcctcccaaggtgctgtcctgcctcagcctcccaaggtgctgggactacaggcctgagtcacctttcctcgcctaatgttttcattgtttcaagtaggcagttcagtagcattaagtatattaacattgttgtgtagccattaccactattcatctccagactctttcatctcccaaactgaaactctgtacccatttaccaacatcaccatagcccttggtaaccactgttctgtgttttttttccttataaatttgactattttagataccacatataactagaatcagacatttgtcctattgaccccttacttcatttatcataatgtcttctaagttcatcaatgctatagtatgtttctgaatttctttctctctctctcaatttttttaaaggctacataatacgtcattgtattgtaagtaccacattttgtttttccattcatccatcagagaacatttgggttgttttccttttggccattctgaacagtgtttctataaacattgtatagtatctggtgtttttgtatttttttttttttggatggagtttcactcttgttgctcaggctggagtgcaatgaggcgtgatcttggctcactgcaacttctgtctcctgggttcaagtgattctcttgcctcagttgggattacaggtgcataccaccacacctggcattaatttttgtatttttagtagagactgggtttcgccatgttggccaggctggtctcaaactcctgacctctggtgatctgcctgcctccacctcccaaagtgctgggattataggtgtgagccactgtgtccaacctaagcatctgtgtcttttttgttgttttttatttgttttttgagacagagtcttgctctgtctcccaggctggagtgcagtagcgggatcttggctcactgcaacctctgcctcctgggttcaagcgattcttctgcctcagtctcccgagtagctgggactaaaagtcagctaaaagtcaaagctgtaatggctaagatcttaacatgccatgcaaactcttacaagtctggttgctgcccaacctttattagtttcccttttcttctagtttatgatagtgtttagaactacttgtagttttgtttagttttattcattcatgcctttgagggttctgtgccctcatactataattctatctttaactgtttacttttttttttttttttgagatggtgtctcactcttgtccaggctagagtgcagtggtgggatctcagctcactgcaacccccgcctcctgagttcaagcgattctcatgcctcagcctctcaagtagcttggattacaggcaagttgcaccacgcccggctactttttgtatttttagtagagacagggctttaccatgttggccaggttggtcttgaactcctgacctcaggtgatccgcctgcctcagcctcccaaagggctgggattacaggcatgagccatcccacctggccaaactgtttaactttaaaagttgttcagcctggcgcggtggctcacgcctgtaatcccagcactttgggaggccgaggcgggcggatcacctgaggtcggcagtttgagatcagcctgaccaacatgaggaaatctcgtctttactaaaaatacaaaaaattagttgggcgtggtggcgcatgcctgtagttccagctacttgggaggctgaggcgggagaatcgcttgaacctgggaggcagaggttgcagtgagccaagatcatgccatagcactccagactgagcaacaagagtgaaactccgtctcagaaaaaaaaaaaaaagttgttcaagtacttcatttgtctcctcccacttataattgagtggttttttttaagaaataagtgtttatttttgcagttgtcatgccttttgtactgtaatcatttatatatgacttatctgtcagacagtgagttcttttttctcctcacgttgctggcacatcagaagttcttgatctgttaatgaaatttatttatttatttatttctaagacaggggcttgctgtactgccagggtggagtgcagtggcgtgataatggctcactgtattcttgacctttgaggatgaagtgatcctcccttctcagcctcccaaatagatgggactacaggcacatgccaccatcctcagccagtatttttatttttagtagagatagggtcttgctatgtttcccaggctggtctcgaactcctgggctcaagcagtcctcccacttctgcctcccaaagtattgggattacaggtgtgagcccctacacctggccagttcaatgtattgactcatgggagagtgatttaattctcaaattgactttaagaacctctgtataggtacacacatgtgtatattaaccagttccagttcctgtaggtgatttttattgaaggatttaattcagtaggtgggaaataaggagttcattttttttttcagtttgtttttaaaatgaaccagacaacacaaaatttaactaagttttagtttcattattaagctatgttttttaatagaaaaactaccatgtgtacacttttgaaaccagcatttacagagaagttaccgttgacagttcagtttataaatcccttctctcctttgtctttcttttttcatttttcattttgcattctgagggaagtaggcattccataattcttccaaaggttatttggattcttttctgtgttttgaaataagacatggttgttacaagggaactagatgtgagttaaaatgaattttcgtataaaatgatttttatttccttttattaaaagtgacaaattgttaaacatgtgttgtcctgactttcttttgtgacactttttagtgtaataaaagttgctaataaaattgtaaatgtgtggaagataacatatactagatgaattataatcttttctagatgggatttgtattttcatatttttaattgtatgtatagaactttagataaccaagaaattataggctaaactggatttatttttggttttattactggtaggctttcctttttcttttaaaatttccctaatttgaaatattgcatttcactttctttgcaaaaccagtgtttgaccatgcgcttgttctctctgaagttattgaacttactatatctaaaataccaaaaccatacattattttgggggtgtggttgtggggaggaatccatgcaaagcaccttgtgtggtgctcgtctatgagtagctacactataaatgttaacagatcatacatgttgctttgctgaaacatttcttcttctttatattagcctagtgtttttcacgttttcttgggtttttttttgtatatatatttttgttgctgtgggcttactatatacatcttctgtatttttggaacaatgaaattatagactgatagtgaaggaaacttacctgtctactatcttaatttcttctttgtagttaatctacatttagctggttttgaagctataccacgtcatcagactagactactgattctttcataacctcctgtgtattttcttgccacacatatataatacttaaaattttccttgtgtatgatctattctaggttgtctagttcagtgggcatgttagttgtttccagacagtcttctttggcggcaatgatgtggctgttctcttaatgatgagaagtaatttctttgatctaatgattctggttctcttacccttacctagtttccaaccggaggccctatcggcagtactacgtggaggcttttggagatccttctgagagagcctgggtggctggaaaagcaatcgtcatgtttgaaggcagacatcaattcgaagagctacctgtccttaggagaagagggaaacagaaagaaaaaggatataggcataaggtaggaaacgaaaaaggctttttattgagtgacagaagcaagtaagaaaaagaaagaaaatggcctcttatttattttcgagacagaactttgctctgtttcccagattggagtacagtggtgcaatctttgttcactgcaacctccgcgtcccaggttcaagtgattctcgtgcttcagcctcttgagtagctggtattataagcgagcaccaccacgcctggctaacttttgtatttagtagagacaggatttcgccatgttggccaggttggtcttgaactcctgagctcaagcagcttcccaaaatgctgggattacaggtgtgagccactgtgcctggcccggccttttaaaaatcattatctacttgggagttagcagagaggaggcagggaagaagcattatatttttgaaatgtaagttatttcctttggtagtagaatatctgtgagaaaagagctagggagcagatgcaggtgggttttttttgtttgtttgtttgtttgtttttcctccccagtgggctggggctagcttgtgacatatttatactaaattttttgataaattattttagtcaactttactgtgtcactcagtagtgaaaattatgacatagcgtgaccattcttttgttatcttttatgcatgatgaaagtatcattaaaatgaaatattctgcttcttgccacttggactaattatttctgttaatgagaataatgtggtttttttgtttgtttgtttctttgtttttggagacagagtctcactctgtcacccaggctgaagtgcagtggcacactcttggctcactgcaacttccgcctcccaggtttgagccattcttgtgccttagcctcccaagtagctgggattataggtgcccgccaccacacctggctaatttttgtatttttagtagagacaggttttgccatattggccaggctggtcttgaactcctgatgtcaggtgatcaactcgcctcagcctcccaaagtgctgggattacaggcgtgagccactgcgcccactgagaaccataaagtttttaataattttcttttttatgtttgtcagtgcttaagtctaaag

SEQ ID NO: 15 - DNA, 4499 bp, Homo sapiens
agctgggggcggggccggaagctctttccccgcgactgcgccacgtctgaggcggctgtggccgcgtcggtgtccgcgtcgaggagccggggcagggcacgatggcggactgggctcggggtgagcgcgggagagcggagccgttgggggcagggccgggccgaaaccgacgccgctgcctgtagagccgcgtgcgcctgcctctggcccagctggggtgacctcggccgagaggaccctgtcaggggggcggattcggatccttccgggtccgagcagggccgggtttcggccggcactgccgttaggaccgaaggcgcgcgtggcggcccagcagctccagcgaggggtcgcgcagcagcggggtctccccactccccgccgccccctgtgagatcgttctgcatgggttcggggtgagcgggagtcggcattcgacaggtcccgaggccaggccctaggagtagaggctgtgctccgctggtgtccaagcaggactcttactttggcctcggtggccccatttcccctcctggagcccgtgttcttgtctgcaaagtgggatattgatgcctgtctctgtgaggtgttatgatgattaaaggaatttataaatatgaagtggctggaaggacgctggcatcccttcctgacactgaagctagggaggaggtggttctcacgcacctgatgtgacagaacttccttatcccctggcccagcctgtcacaggccaggcctctgcgagcactctgccctgggtgttgcaggaagccccatgcgggatgcagaccaaggatcccgctcctggtcgacctcagctcccgtctcggggaaattgggaactttgctcagccattttctgtgcggtaaagggccttcccaatgttctgtcctggttccttgccacctcttcaggacctagctcaaaggtcgtctctgcaggagcctttctgctgccttgctgggtacttttcccaagtcttttctatgctcttagcagagtttactctttttctataagaatgggctccacatacacagatggtgacctccctggatgcaagtgtcacatcatactagcaccccagggctgggtccagtttttgctacacagtctcagaaggtgctggttggaccgaacccattgtgggtgcttgcccatccccaccttgatgtgtacacaggacatgtgttcacatgacaggcccttacacacatcgtcctttatgcagcctgtctcatgtgcaagattcacctgctggaaccttggttagggccccctagatttctgactcacccagatgtggttggagtgagaggggtcaggggccgtgctcaccgatggatgcaacccttcagcccctctcttttctcagctcagagcccgggcgctgtggaagagattctagaccgggagaacaagcgaatggctgacagcctggcctccaaagtcaccaggctcaaatcggtcagtggtggtctgtcctcttacctccacctggtgcctttggggaatggggatcagagggaaggcagagggcccagaggagtttcaggcagttttccatcctcatccaattcgtggctgtgctcacctgcatgaggccccagctgacacctggacctttctgtctgctgcagccccactgtgtctggcagagttgttggcagggtttatctggtctggggagggtgagtgctgtattatgtgtctgctctggcccaaccctgccctctctgtctgctgaacagctcgccctggacatcgatagggatgcagaggatcagaaccggtacctggatggcatggtaagggcccacggtgtgcgtgtatcagtgccctgccctagcactacctgctgcagagcctgcagtgtctccttcagcactggtgcgggtgggtggtcaaatcaccacttctgtgtgatcttgctgggattcctcccttaggactcggatttcacaagcatgaccagcctgcttacagggagcgtgaagcgcttttccacaatggcaaggtccggacaagacaaccggaagcttctatgtggcatggccgtgggtctaattgtggccttcttcatcctctcctacttcttgtccagggcaaggacgtgagccagtgggagctggtgtctgtgggtgccaagggcagccagggtcttccctgcctggtgttttgggctccagaggacttacctacaaaatactcctttgcaatgataattgtgggtcaggaatcttcttcctgtgtggcaggaggctgcggctgcctgtgacctgatgagctcatgttggctggtcccatgtgtgaaagggactctctcggggaaaccaaggcccagcccctcccccctcccccaggtgctagagagccaggcagagctggggccacagcgtgtctggagaagccaggtctgagcagagcagctggtgaatcccagacgtggccacctgtggcttgcagcccttctccccgcgcttgggactctgacatcttaaggctgcacggtcgtgtccttgtctgggtgaggccatgtctgtgatccaaggttcctggaactgacacaggaaggggctgtgaaccctaagtgggtgtcatctcctccgaccgaggcttctcaccctggagatggcagttactcctggccatggttgctgagcatgggcagaccagtggaggccaccctactgtgttatctgcgccttcgatgaagtgagacccttggggagaacgggctgtggatgaaggagtggactgcagccttggcctagccactgggctgggatcttctgggtcatgtgactgtgtatccaggagcagaaacttgtattctcaggattcaggatctacccagcaccaaagatgtattttcaggagaacagacctagaaatgggcctgtctggcatttcagagtcaggcaaagcaggcagggccagggagcttctgtgggtctacacaagaaggttcctgtgagggctatcagttgttgccttctagcttgctggtaactttggcgcctccgccaagccctgccagactcccctggctgtgatggcattctgtgccatcctccttgtccccagcctctgcaggatgccctccctacccacctctccctgggccttccctgtccactgggctggattcatgttcaaaccactggactggcagggcaacgacttcttcccacctcaagatgaggtcctcgcccccttgtcttggcataaaaacacctttaaagcatgagccatgtgcttctttgcccttctctgtcctgttccaatcttctgcctcccagtcactccctggggactatgggatcactgtccccccacctgtgtggccacaccatatgtcctgtcaatccagaactgcctctgagctccaggctgaccacagatcagccacagcctgatgcctgcagccccactttgctcacccttcccctcccctcctccttccttccacacagcaagcctacctttctccatccatgctcaccatagcccccttccttgtgacctggaccctccattgtacctggctgagactgtcagcctcctggaggagtggggtccaccttcttcttgccctatgcagtgcaagctcacttctcacccagcaaggttgactcatctgcctccatgtctctggggctttgctgttgccctgaaacctagctgggctggtcttgctcccagcttgcttccccctcctcggatgtccctttgcaggcccctgtcgttcctccggcaccagtgtccttggctgccatggcaagctcatcaggggcttgtaccctggtcaccaagcatggtagcagctgcctgcattgtatctccatctggtcactgcaggtgccaacccttcatcccccatgttttcctgggccatggagggctgacctccgtttctggggaatgtggctgagctgtggtaaccagctacaccccaggtgctctttccatggtggtgcctgctcatcttgctgatgcaaactaggaagttaggctgcatctcggagtggctttcgctggagaggtgctttgctgtctctcagactcagtcactgtgttccctccccgcctctcttatctccatggctgtttgcagctctcccaggtactttggggtctgagctggaattcctttgtggtttgctcttctgcttctcactcttgtattaagaaggattccacaaagggagagtggcatccctgctgctgctgtgccagaccagagtttcctgaggggccctgaccctaaccctccagctcagccctgtacacctgaccctgtaaatgagtggggtttgctgactgtaatccctgacaccagtaaaaccaaaaggactcttgggggctcagtgtgagagccagggttacctactctgccaagtgaggacaaactgctaggctgtatcccataatttcaggatgagaaacattaacaataaaaatttgtagtaaacataacctcatgaagaactaa

SEQ ID NO: 16 - DNA, 2946 bp, Homo sapiens
gaatgctagttatttgtcagatacatgttttgcaaaccatttatctgtatttggtttctttttgttatcttagcagtgtatcctgaagaatagttttaaattttgatgtaatccaaaatatttcggttgtttgtgttctttgttatcctatttttgttgttgttgttttatagatatgggggtctcactacgttgcccaggctggtcttgatctcctgaactcaagtgatcctcccacctcagcctcccatccttgtctacctaattaggctttgtgtaactcagtgttgcaaagctttgacatctgtttgagttaatgtttatatatgttgttacttaagggtttcacattaaatttaaacatacttatattttataaccaaacaagtcatgttggggcatactcattaggattgagtgctttcttacaccaaaatacatgtatacaaagatttaaaacactttcggccgggcgcggtaatcccagcactttgggaggccgaggcgggtggatcacaaggctaggagatcaagaccatctggctaacacggtgaaaccctgtcgctactaaaaaaatacaaaaaattagccagacgtggtggcaggcgcctgtggtcccagctactcgggaggctgagacaggagaatggcatgaacccgggaggcagagcttgcagtgagccgagatcaccccactgcactccagcctgggcgacagagtgaaggctatgtctcaagaaaaaaaaaaaaaaaacttttataataacaactgtaaatagttcaattgacagtcatttgtaagatgtttaagtaaactgtgaaacagtaagtaaatggatgaaaacacactgattaaaactgctgcttttatccaacaagatggatgaatttcccaggaaagaatacttgagttcaggcctgttcaagtcccaacctgtttgtggtttgaggttgctctctgcctcgtagagcaaagtggaaaatttatcttctgggaggacagagttttcttctctgaaaaagtttcctacatagttggctttggcatttgcaaggaatgaaaggtcagggattgaggcctcatgagtctggatttctagctgaggttgagagaaaaggtagtgattgtaaccagaaaatccagagtgggtgtatttacctccagaactcatcacttaaaaaaaaattttttttgaactgacatgcttgaggctttttcttttttttttttttgagatggggtcttgctctgtcccccaggctggagtgcagttgtgcagtcatagctcactgtagccttatcctcctggcctaagcagtcctcctgcctcagcctccctggtggctgagaccacaggcgcatgccacctgtgagtttctagagatgaggtctccctatgttccccagcctggtcttgaactcctgggctcaagtgatcctcctgcctcggccttccaaagtgttggattacaggcgtgagccactgtgcctggccagagctcatcactgttaactcagcctgggtttttcacagcagtcatggaaatagattcattaataatagtaacaaatatatagtctccctctcaaagaaaccttgagtggcagtggcataccagatacacagtaggaaatactgtagaattatgttgttaagttcataaccaaacatcatacatgatgataaaagacaagataatggccacatttatgcagtattaactgagagggcaaatttgtgcctgagaagctattgggaatgttctctctctttgcattactaggaattacatgggaaacacatgtagacagtcttcaggctattaagatttgtccacttaatctttacttatacatgaataaaaaatgggaaaacatgataaatataataaactaatacactcaaccctgccccttgattatataatagaacaaaatcagcatgcccggcatgagcctgccagattgccaattccatcctccaccttcagaggatgccgccatccagaattttgccttactcattttactttcttcatagttcgacaccttaaatgtatattactaatagtagctttgcatttttggctgatttaaaaattgatataaatgaaataatgctgtagagatgctttttggtattaagtggatatactgttattcttaaagatgtttgaaatgaatatacctttctaaatatctttttaaaataatacattaaatgatactgctttagaattcatgaactgcatctcatgagaatatgtagagatgacgtgggcaggtaaagtaaaacttcaggttgaatatcctatgataatttaaaaatgacaaaatagtgtggtgaataatagagcttgagcactttaaggcaccgtagggaccccttcaatgtaatgatgacagtgctgaggtgcagagaagttaggtaatcagcccaagccactactctaaggacagaccctatctacttttcctaatttgtcagaagactgcctatgatactactaataaaaagtcctatgaaattggtattgtcattattttacaaataaaataatcttcaatttttgtttcctctatgcatgggttacttagtattttgtaatttgaatttcaagcataattaaaaagaaatcaggtatctaggctgggcatgatggctcaagcctgtaatctcaacattttgggaggctgaggcaagaggatcacttgaggccaggagtttgaggtatcttttgttgatctctacactgattgtattctctcttttattctatgaaagttaaagattttttctgatactacatattgtcagttttttaaatactcagtttgtgctaaaagaaaacattcggcaactgatatctgctgttctgtatgtatctgtcagtccagatttgtccattatggtgtatgaatctaatagaacctcaccaatgtt

SEQ ID NO: 17 - DNA, 16164 bp, Homo sapiens
cggctggctgcggcggccggggaggccggggaggccgcggcgcggtcactgcgagccgagccgagccgcgccgagccgcgccgatcgccatccggcctcggcactcgcgcgcgatcccggccggcggcgcggcccggcgggccaggcggcgccacagcccatggagctcgagaacatcgtagcgaacacggtgctactcaaggcccgggaaggtgaggcggccgggtgggcggccgggcccgggtgcgtggagcgcgagtgcgctgcgtctgagctccgcagggctacccagccgtcggatcccctaggcccgcgggccctgcgccttacaccccgcccagacacgagcctttccggcccgtcgtcttcctcctccgcacctgcccccgggattcggggcccaggaaggggcgggggtcaggccgccgccctcgcggcgggtgggggtgaaggagtgaaagaaggtgagacgaagagggaagggtgggaccggagccccaggagagcctgtctgagaggcaagcctcctccaggggagaggtgtaaagatgccccacgtgccaggggcccagaccccagcaccctagcctaatcccgcgcaaagttggcgataggtaaagctggagaatgaataaacggaccctctgcgtagcacagcccacctgacttggggaaactcctggccacaaatgctacttataggactgccacttgctccgtgcctcaggacactgagggcagaggtgaatggatatttgccctcagggagcccatggtctagtggggctagcggacacagaaagaagtgggagcagagcatgctgctctgtcagtattgtaagctcagaggtctggctggggaaaccagtctggtggaccgagtgtgtgtgtagctcctcgtggctcccaccccagatgttatcaggcacttgctctgtgcaggtcctgggagacacagaaggaccagatcgggtcctcactgccttgtggtcagtctgcccccacctgccacactccacctcagtaacatgatcactgaccacccactctgccccaccttttccagggtgctggggaagcagcagtaaacaagacccatctttttggaactccagggcaaggagggagattgtgacagtttttccaccctttgctgggcttccaggcttaaaaagtcatctgcttcacctttctaccatattttacatgtgggaagctgaggctcaaaccagggattagcatcagtcacacagcaagattgtgattgactcgggcctaagacacaggatgaccggcacagtctataggaagcccagaggaactttcagctgggtgctacacctggcaccccgtgcccaccaagtgctctggcgaggtgcagcccagaaatggcatggcaggctgggtcctcattgcctggggagcctgtcttatcccctgtcccttatcgagcccatgggctaggccttcctcccagcctctgggggcatctgccgattctgttctgcctcgtcatccaaccagccagggaggaggggtggggagggccgaaacaggccttcttccctagggctgtagccagttaaggcctcaggcctgctgatggcactgcctggccggagagtgtgggtacctttggacaagctttgtcaggccatgggcaaggcacagggtggtatggccagactggggactggtacctccactagagaacccttacgacaacctggctctgcccctcccacctgcatggcttttttttgagacagagtctcactgtgtcacccaggctggagtgcagggctcactgcaacctccgcctcctgggttcaagtgactctcctccctcagcctcccaagtagctgggactacaggtgcatgccaccacacccagctaatttttgtatttatagcacagatgggtttcaccatgttggcctggctggtcttgaactcctgacctcaagtgatccgcctgcctctggcctccctaattgctgggattataggcatgagccaccgcgcctggccgacctgcatgactttaaacatgtctcttctttctcaacttcagtacccctttttgtggaacggttgggggtgggacataaagactaaaggaaaccctgattgtcactgagtcctgagcccaggcgcctggacgggctgcatcagaaccacctcatgaactggcttttcatgagcttgaggctggggcccctgacggcttctcaagtgatctgaggccccaggtggggtttgggaacccttggtgtgtgtatacagttggcacctaatagatgccagccatgtttggggtgggaaaggagcttgggttgtggccatagggagctgggtacgaatcctgtacccaggattggtctctgggcttggtcatcttgggtatactctgggcttggtcatcttgggtgaattgattcctcacttcagaatctcagttttcatataaaattgggcctgctctggcagagttgctgtgaggatggagtgggacaacgctggggcttgagacctccctcagtaccccttctcttcccaggcactcagaggcatggggagggggcccagggacactgaaaggggacagggagggtggggaagagctccactgactgggcagcccaggacaggatatttgcatgtgactctttgctgctgccttgatgtggctgggaggggggaggaggaagtaactgagggtgggaggctggcggatggagggttgggtgagggacctgtgggtgtgggggaggagttccccttctgggaaggccttgccctgggttgaggggtgggtgtctgttgctcactcacagtgaagcaatgactgcagggcatgttcgcaggaggcctctagcaagtttctcaatgggcccctgcagtacttccttctccaggcagcttaggtcggggagtcatctagggacctagccttgccccctccctagaaggcaacttctgcccttgtaccacctgccctcacccaggccagatggatacaggactagaaagccagaggggaaactgaggcccagcatgagaaagtggttgtctaaggttgccatggcgttgttggagttggggttcacctcttgactcagccctacttgatgtggacagtgtctcccattcactacgtaacacacatggagaagctgaggttcacagatagcgagtgatgggccacagtgtgaatcagagattcagacccagctctgggaggctcaggccccttccaccctcctcaacctggtggcccacaggccacacacatttggctagctccctgacacattttatttggctgcagtgagtttttttttttttttaaacaaaatgggggccaatattttatgttagagtctgcaattccggctgcttttgaaaaaatcagaagagctggccacattgagccagaaaccctcctagcagcaatcaagcaatcagctggcgttctcctgcagctggccctgtcagagaggccttcgctgttcctggtcatctcacatctggcccacgtttcccacacctgttgggctctgcaggcaatcgaactgctgctgtgacctcagctgctgcagatggggtgtctgcgaggtcaagcaagacaggcaggggaccggggaagccccagtgtgcaggggacggggagtcctgggtgccagcccccttgcccctgcctcatttgagcgtctgatatctctgatgtggggcctggtgatagaggcctgggagcctccttgtccccatgctgccctgtgcgtctctcaggcctgccccactggcctagaatctctccctcccgggccttctgcacttctcagcactgtgacgtccttctcccctttcttcaccgggggaactcctacctggcgggaagcaactggggctggacccattgttggagctacttggaacactgtcctcccgcagcgacctcactgcctctcttggctctcccagtgcaggagcctgaagcaggagaagcacgtgtgtcctggaacgcagcaagggcgtgctggagcgtgcagagggaaggcctgaggtgctgttctgcctcagctctgccttggctgggccctagaggccgtggaccgcactgaggacccagaggcagttctgaggcagtgggactcgagacccagtgtcctattgctcccacaggtggcggtggaaatcgcaaaggcaaaagcaagaaatggcggcagatgctccagttccctcacatcagccagtgcgaagagctgcggctcagcctcggtgaggcctgggcagagactgggggtgctgaggcgaggggccctgctggggccgggggagcctcccctgagaccttgccccggagcagaggggcagacttgggggctccagtgagcaggaggatgaggactgcaccattcagcccagtttcagttcctgggcttgggacgggtggagagcagacagcaaacagggtcacaccgagggtggttgaagcgggtgtcgggaatagggcaggggcagattggggcagttgattccactttgaaaaggagagccagctagggtgagcagggcccacaggacagagggagcagcagctgggccagcccacagactgactgccttgggacccccaggctggggcgtagcctcccaggcccagccctgaggggtgcccagcaaatccttgaccagaagccctcagcctgggcagtgtgacagggttactcctgggaggggacagaagggcccaggaccccagttcctgccaatcttggccaaggccccaggtctgagcagcacccaaggttgctgaggcccccggtggcctgcacgtgcgcagagcacacccgggctgcttccacctcctgggaaggaggcccagctgagagcctgccggaagccacagcttcctctcgcactttcgccaggcaggcagcaggtgtgggcctggccccggctgggctgggccggaacctcacggaccgcacccaaccccagtaccgtgacatacgcaagtcgtgtaaatcaggagacaatgcagggaggtggatggaggcctgggctctggagccagactcccggctgtgtgacactgagctagtcagttagcctctctgggcctcacagccccaaaacagctgtgcccacctgagggttgtggtgagggttctgaagaagattgtggctaccacactgcagagctggaagctgttgtgggggcccagggcctggtggtgtgggcacatgccccacccatgtgctctcgggctgtggacccagcagcttccatcactgccaacagagcgtgactatcacagcctgtgcgagcggcagcccattgggcgcctgctgttccgagagttctgtgccacgaggccggagctgagccgctgcgtcgccttcctggatggggtggtgagtgcagcccagccctgcccagccccgcgggtggccgaggtcctggccccatgtgcccctcctccccacacctgctgcttgccctgcccagacctccagcttctttgctttccaccctgcaggccgagtatgaagtgaccccggatgacaagcggaaggcatgtgggcggcagctaacgcagaattttctgagccacacggtgagtgagcagcgatggagagatgatgggagccaccagagccccgtgtcaggcacaggagtgaccacagtgtcaggcttctgagggtggtctcttcatacagacacatgtaacacacagcctggacagagagtgccctggagctgctccaggcagcacggcgggcatgcagcccagggtatgggctgggcttgggccaggcggcctcccagtggctctgctgcgctctgcctcatgggtgggcagcaggaaggacttcagcaaccaggctggctggcacaccctggcctgcagcctctcatggcaccagcccgagttgcctgacccctctcccctggaagtgggcagccatccaagggagcccctgcactgacctgtctggggcttgttcccagggtcctgacctcatccctgaggtcccccggcagctggtgacgaactgcacccagcggctggagcagggtccctgcaaagaccttttccaggaactcacccggtaagcctgtccctgcccacaagcctggaattatgcccagcggagggggcttctgggggccaggaagactgtgaacagctcggtggctggtgagggagctcagctgcccagccctggccttgcccctgctgtgtgacctgagcaggctgcctcccctctcagtagcacccacagcttcagcacaggctgtgtgtctccccgctcaggggttagcaggaggactggccgacgacgatacctgtgggctaagcctgtacagaacgggaggcctggcccagcaagccaagagcctgaggtgtcaggggctggcgggtgagctgggcctgcctttcctcaacaggctgacccacgagtacctgagcgtggccccttttgccgactacctcgacagcatctacttcaaccgtttcctgcagtggaagtggctggaaaggtgagctccctgaaggctgggccgggacaggccaggtcgccggggttcttcataggccttgggctctcctgctcagccagcgtttgcttccccaccccttgccacaggcagccagtgaccaaaaacaccttcaggcaataccgagtcctgggcaaaggtggctttggggaggtgagtggccaggccagagcccctgggagagtgaatagggtgggtgtgttgggacctggaccaccccctggatgcccagcaatggcacagctggcccccattcgcccctgtctgtctggccacaggtgtgcgcctgccaggtgcgggccacaggtaagatgtatgcctgcaagaagctagagaaaaagcggatcaagaagcggaaaggggaggccatggcgctgaacgagaagcagatcctggagaaagtgaacagtaggtttgtagtaagtacagaaggagactctcccttccccttggccacactggcgcaccgaccgtccccaccccccaggccccaccctcccatgtgggatgccaggaagggcgggtttggggtgttgacaccaggcttggggagcaggctgggcccaaggagtggcaccgagaaggcttttttgggcagccctgccgccaagcgccccgcagctcctgcctgagggctcgggtcccctcggccacaggtgagcttggcctacgcctatgagaccaaggacgcgctgtgcctggtgctgacactgatgaacgggggcgacctcaagttccacatctaccacatgggccaggctggcttccccgaagcgcgggccgtcttctacgccgccgagatctgctgtggcctggaggacctgcaccgggagcgcatcgtgtacaggtggggagggctcggccaccccaggggcttagtccttccctgccagcgactgcagctgggcctggacgggggtggccaaggctgccgatcaggccagactacagaaggacattggtttgggggctgtggcaccggcttaactcacacgccaggccaacctgagtagcccagacctaggctttgggctctgctggacccacggggtatcctgactttgtcacccctccaccccccaccgtgtgaccttgggccaggagctccctgctcccaacactgcttccttttctaggaagcagagactataattcctacttcccaggttgttagaagtaggcccaacttcctactggaggggcccagtgagctaagtacagagtgcctggcacatggggctgggtaagagagaaccctggctctgattgttgccgacttcctgtgaacctcacaacagcctagtcaggggacggatgagtagtcccatttgatagagaggaaaggcagagtcagtcaccaaggggtggagactccttggtctccactggggaggcccctccggggtggagctgtcttccactcatctagagagtcctgggagtcctggctctagatccttcctctgctcccttgagtccgggctgttgccagggagagcagggctgtctgtcgccctggcagcaaatgagtctcgcaccttgctccacacctggcccccggaggcgagtgagctgggggggctggccccttctgactccctggcaaactgagcagcatctgaccctgctcttctctctgcacagggacctgaagcccgagaacatcttgctggatgaccacggtgtgtaagggtgcctggggtgggtcagggtggggtgagatgcagaggcctggcctgttaacgggtccacctgtttctccacccacactcaggccacatccgcatctctgacctgggactagctgtgcatgtgcccgagggccagaccatcaaagggcgtgtgggcaccgtgggttacatgggtgagtcttctctgcccggcccactagcctcctgggttccctcactatccacccacccagccacacccacttctgtctgggagtcttctctcaaaaggggcctcagtagaaagggcccatgccgatgctcctcttctagaggttaggagaccaagactcagccggggccgcacacagttgtgaagccatgtcgttcatttgctgaatacttattaaaccctgctatggctgagcctgcaggtggctaccgggggatggaggagagagacccaaacctgtttccgtggccccagtccctgccctccctgtgcccatctgtgagggaggccagtggaggggccaacatgaggccccacattccacctggagaccgagagacgcaggaggcagagtcctggctctgcaggctccgcctcttgccggttgcgtggccttgaaccagacactccgctgctcccggcctcactctgctccactggaaaacactcatcatacctgcctcccagggctgcctggaagatgaaaagggagagttcagggaaaactccccacagggctgccctggcaggtaggaggtattcagaaaataggagtttccttcttctcgctgatattaaatccagaagttgcaaaatggtagccacatgggcccaatttggcctacatttgtgtttaagtcaaactgtttttagtaagccagatggtttcacatacaaaatacagatttctgacttcttgtgtaaaatctgaagacccggggaccctgggcgcggcctcctgcagggccgtattcaccccgcttgatggggcctgtgctctcctactggccaaggtcccccctggccagcgggtgtgagtgtatcccagacctaacgtgcactggcgttcctggggcctgagggtccactgcccgcctcctgcccagccctaactcccatgccgcccgcccagctccggaggtggtgaagaatgaacggtacacgttcagccctgactggtgggcgctcggctgcctcctgtacgagatgatcgcaggccagtcgcccttccagcagaggaagaagaagatcaagcgggaggaggtggagcggctggtgaaggaggtccccgaggagtattccgagcgcttttccccgcaggcccgctcactttgctcacaggtacggcagctcacagaagcctggccagccagggctggggtggatgcacctttccctccctcccacccactcacctgcctggcctgcctggccgactcacccctgccacagctcctctgcaaggaccctgccgaacgcctggggtgtcgtgggggcagtgcccgcgaggtgaaggagcaccccctctttaagaagctgaacttcaagcggctgggagctggcatgctggagccgccgttcaagcctgacgtgagtgcagcccactcctgctgagggcggggcccagccagggctggggctcaggggctcttgtagtatcagccaggatgcttccagtgcaagtggcagaaaaaacaatctagtggcttagccacagaaataaagataattcacaaaaaggaaaagccccaggatgggtctggcttgtggcatgcctggatggggcttggagcctctgacaatgtcctaggaactctctctccttcccctcactgtaccgttgagtgtgtagtcttcatattggggtagctctccccatggtgcggcagcagtgggccccagcagctcagccaccacagtagacagagagcttctcttctcttttctcttctcctctcctctccttccttccttcgttcttttttcccttcttttttcctttctttcctttcttccttttcttttctttttggagacagggtcttgctctgtccccgaggctggagtgcagtggtgagatcttggctccctgcaacctctgcctcccaggttcaagcgattctcctgcctcagcctcctgagtagctgggattacaggcgcccaccaccatgcccggctaatttttgtatttttagtagagatgaggtttcaccatgttggccaggctggtcttgaaatcctgacctcaggtgatcctcttgcctcggcctcccaaagtgctgggattacaggagtgagccatcgcgcctgcccttgcccaataatttcaaaagaaatcctcatgggggaaaagaagtcccaaagctgatgcccattgcctctcattgctcagaggcccctcactggccacacccagatcatacacccacccgaacctgcaccaatgggggagctcagttccccagaggaaaactacaatgcaattgccagcagtgggaggggctgttgggctggccatccttctgtgggtggtcacttttccttatggagtctcacctgttaactgagcatctcagtgggccaggcacccagcaggcaagagtatcctctagttgtcagagtccgggtggcagaaaaccaacctaaactcacttaagctcaccgtggagtgtattggttcatttggccagaaagtcccaaagtagggccagctccagggtttcctgctgtgtgccacgattctccagctcttgcctggccttcaacctgttgactctttccctccccctgaattaggcttctctgtgtgacagtcatagggaaggttctgattggctaagatgaggtcatgtgctttccccttcccatgtctatgaggactggtcctgtaattaacggttcaccaggaacactggagaggcccgaaggatgggcagggcaggccaggttgatagctgtcaatgacacacacgtttattgattcagcaaatagctgagtgcccatttatgccagaccctggagataatgaggcccactggagccagtcctgcccttacattctagtgggagacacacccaaacaaacccgtaagccagaaggaattccaggtaatgttaagtgtgacaaagaaaactaaagcaagcggctgggtgcggtggctcacgctgtaatcccagcactttgggaggctgaggcaggcggatcacctgaggttgggagttcgaagaccagcctgaccaacatggagaaaccccatctctactaaaaatacaaaattagctgggcatggtggcgcatgcctgtaatcccagctactcggcagactgaggcaggagaatcgcttgaacccaagaggaggaggttgcggtgagttgagatcgcgcattgcactccagcctgggcaacaagagtgaaacttcatctcaaaaaaaaaagaaaactaaagcaagctacgaagatggcagagaatgatggtggggggagcgcttttagacaccgtggtctctggggaggtgatgctggtgcagaaatgtaaaatatgtgaagcggagagccatgccaaggtttggggtgtgagcattccaggcagaagaaacagccgggtattgcagtcctgaggcaggggccagccctgtgaggtggagcagccgcgaggacacctgtgtggctgagtgagcccgtgcaggcaaagaggagtgccggcaggttctcagcaagatgggaccgctgggggaccctgggcaggaatgtgaggtgtggggagtgggccatagtgggtgtgagtggaagtggggaggccagtgagggggctactgccctgagtgactgcctcacatgggcctcactggaaccgctggccaggctggtctcgaactcctgacctcaagtaatctgctcgccttggcctccatacctcttggtctatacctagaagtagaattaccaggtcatatggtaactatgtttaaccttttggggaactgccagactgttttccaaagcaaaggtgggccctgtcagaggcacttacttgaactaagagagcctgactttcatcagctcgcccctgaggctggcactgccactcagtctgttctgtttcctgtgtacatcatctcatttaaccttgaaataactacactgcctctggatcttccattcaaagtcggagataaaatcagtgccctggagtttaactttgtggaagcagtagatgaaaaagcaagcttgatgatatttttttaacagctctattgagtttaatttatatgatttatataccatacaattcacccatttaaagtgtacaattcggctgggcgtggtggctcatgcctgtaatcccagcactttgggaggccaaggtgagtggatcacctgaggtcaggagttcaagaccagcctggccaacaaggtgaaacccccgtctctactaaaaatacaaaaattagctggacgtggtggcgcatgccggtaatctcacctacttgggaggctgaggcaggagaatcgcttgaacctaggaggcggaggttgcagtgagctgagatcacaccattgcactccaggctgggcaacaagagcaaaactcccatctcaaaaaaaaaaaaaaaaagtgcaattcattggctttttaattatgcagtcagcaccacgataaattcttgagtgtgttcattacctgccccactctgcaaaaaaaaaaaaaacccatacccttagcagccattccccatgcttccctcccgctgctcctagcaatcaccagtctactctgtgtctctctctgtttgcctactctggacatgtcatagctatggcatcacatagtatgtgatcctctgtgcctggcttctttcacttagcatagtatcttcaaggttcatccatgttgtagcatagatcagtgcttcatacctttttaaggctgaataatattccattgcatggatagaccacattttccttacctgttcgtcagttggtagacattaagattgttcccactttttggctgttattgctgctgtgaacattcctgtacaagtttttgtgtgtgcagatgccgccatttctcttggtctatacctaggagtagaattactaggtcatatggtaatgatgtttaagcttttggggaactgccagactgttttccaaagcagctgtaccattttacatgacaatgattttaattgacatcttaattgaaggatttagaaaacaatgttaagataaaaaaagaaggtggccgcctggagctgaggtgggctcccagtgtgggtctggggaggtggagcagtgggagaccgtgccagtcctctgattggctgggagagaagacggcaagtcccaggtcatcgcagggcggggagccagggagtcaccagctccaggctctgcgtggtggtgcccagcggaggggccggctgagattcagcctgtactccccgccccaactgcatacccaggaagctgtgggcaggcgaaggaggtgcctggcattggcctttacacagcctcacagtcattgagcagtgaggaataacgtacgcagttcacagaggggaaaaccaggcttcggagagaagggcctgccccacttaggaagtgcgtggggcacctggtttctccaaatcagagagctgctggtgtcaggcagcactaggccaagacccgaggcagaatcagggctgagctgccttcgcgtgtgcgtgtgtgtgtttcctatctgaccgttgcctctgtcccaccagccccaggccatttactgcaaggatgttctggacattgaacagttctctacggtcaagggcgtggagctggagcctaccgaccaggacttctaccagaagtttgccacaggcagtgtgcccatcccctggcagaacgaggtgggggcctgccctgctggtggggtgggctccaggaggctgccctggggacagctgtcacagccgcctgctcctcagcagatggtggagaccgagtgcttccaagagctgaatgtctttgggctggatggctcagttcccccagacctggactggaagggccagccacctgcacctcctaaaaagggactgctgcagagactcttcagtcgccaagtaagccccagcagcggcctacctgggcccctaacctggctccaggggacggtgggtgggaggcagagccggtgcccgcatgcgctgggagtgggcgtcctccagtcctgttgtggtgcccagggtctctggcctcattcccgcctgtcccccacccctggctgggctcatggcctcttttctctttccagaggtgagcagtgtgggctccccgtgggttggccttgctgcctggcctcggggagccacgggcagcccttccatggcaaaggcaagatgtgggagaaagaagtctggtgcccgccccactccccctgcccactgctttgatcccctgcaccctggccccttcgagctgccagctttgcttcgcttgtctccccgtgccctgtctctgccagccccaggggagagggctgggcagaggccttgccctggcagaccgtgggatctacccagcccccttacttcagtctgttgccggcagcctctgcaatgacgcccacccacgtgtggcctgagctgctgctccaggctccttgtggagaggcccctccccagagtgcacccctcaggcagctcctggcctgccctggcagggtcggccccatgtgacgtccctcgtggttaatggcacctgctctgcctctctccctccctccgtgtcttccccgtccctccaggattgctgtggaaactgcagcgacagcgaggaagagctccccacccgcctctagcccccagcccgaggcccccaccagcagttggcggtagcagctactccgagcgccgtttacagttttgcacagtgatcttccccattgtccactcaagtcgtggcctggggaacacagacggagctgtccccagtgtcctccgtccctcagcccctggcctggctgagtttggcagggcctgggccatccctgggacaaaggtgcgtcccttcagctcttctccgtggagctcggggctttctgtatttatgtatttgtacgaatgtatatagcgaccagagcattcttaattcccgccgcagacctggcgcccccgccttggctcctgggggcagccagccctggctgggagagcgggagctggcagaggagccactgccaaactcaaggctcctctggcccagcttggatggctgagggtggtcacacccctgagccttcagcactgtgctggccaccccggcctctgagtaagactcgtgcctccccctgctgccctgggctcaggctgctaccctctggggcccaaagctgtcccttctcagtgcttgtcagcgctgggtctggggcctctgtatgccctaggcctgtgccaaagtggccagagattgggctgcctgtgatacccatcagcccactgccccggccggcccagataggtctgcctctgccttccagctcccacagcctggtccctgatactgggctctgtcctgcagacacctctttcagaaacgcccaagcccagcccctaggagggggtggggcatccctggtcaaccctcaaacattccggactcccctcataacaatagacacatgtgcccagcaataatccgccccttcctgtgtgcgcctgtggggtgcgtgcgcgcgcgtgtgtacctgtgtgggtgaaggggatagggcgaggctgtgcctgtgccccaggtcccagccctggcccttcccagactgtgatggccatcctggtcccagtgttagggtagcatgggattacagggccctgttttttccatatttaaagccaatttttattactcgttttgtccaacgtaa

SEQ ID NO: 18 - DNA, 18710 bp, Homo sapiens
caggcggcccccgggagagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcggtaagccccggccgcgcagggcgccgcgcgcagtccagccggcccggccctgccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggcccgtaagttctgctccccgccgccgcttccgagccgcggactttcccctcccgccgcccgccgcctgcgcagcgcaacccagcggggctcctgcggccgacgggaccgcagaggggcggccgggaccccgcgcgcgctaaccgggcgccccgggacatctcggcacccgctgagcccgctgggaccccagggggtcgcctccccagctccccaaggcgccgtcccgcagccccttccgtctcccctgcgcgctctcccctcgccgcccctccctctgactcggtttcccctctcccccggctccgcggtcgccctcctcctggactgcttatttcgtcctcggccactgcctctcgggctcgagctttctgcttcagagcaggagagaaacggagcgaaagcagtttctgtctccccggggtctgactcggtcccccgcgctcggttctctgtcccctccccctcccgccattgttcccggcaggaggagtgcgcggcgcaaacttgcgagttcccccagtctttgcccccgcagggccgcggacggaggtggtggcggagttcccgctgcccacaagtctggcccgaccttctggggtgggggcctgggggcaggggccctgggccggagaacccggggccgcctaacggctcggagctcaccgccgggggacaccggcgctgaggcctgggtctcagaaagtgggtgagtgtctggagcggggacatcagggacagattgcagggggaggggcgaggctgagagagtcccccgtccccaggctggaaaggggcgggcagaaacccaggccgcgccttagcccagttagggggtgggtaggggacgcacaggtggagacgccccccactctccccaaagtcgcgcgatctgcaggaagggtacagtgtggggccactggccgggcgctgggtgggttagggcccctgccgtgggcagaacactcgcacctacccgggggaggctgtgtggaggaagggccagaacgccgcgcccaccccggcgcgccccgctgggcggggcggggcggggcgctcgccttgggtcccctcgctctaccttccttcgccctgacccagtctcgggcttccgcctcttcctggagcccggggggagtgggtttctccgccggagagatggaggctggggcaagagcagcgcggaggccaagaacccccaggctcctccaaagcccagagcggctggccaaggccccctcaccgccccactaccctgcacttcctgattggtttctttcaaacaaacttcttgacggggcgggcctgcggggagaagtcaccggggctgcccaccccaactatgtggtcccttggacctccacccctgacggcctgtggagaggggaccaggatctgcggcccgcagatcccagggacgcgggggtcgttttgttgcagagccaggagggggcactgtccgctccttagcctcagccccagacttcgagaaaggagagaaaagatttttcttgttgggttgttaggaaataagactattctccaggcttctgttgtcccatctgtaaaatgggtcgtcttgttcctgaggccccctctgtccccaccatcccaggaggcccctgccatggccgcttctttcccagtcacatgtcgtcaacttcctccgtgcttccaaatttggagtggagggctaaggccgaaagccccttcacccatgtccagctgtcatgacctgccagttctaggactgcgacctattttctgcacagctctgcctccaggccccttgtggcttctccagctcacacccagcctcccaatttcttttgatagccccacctctgtgggaagaagggcctgcccctcttggggtatgggggaggagggggctggatttaacaggaatgccccatagtcacacagtttggggctgttctttacttttgcttattgaacaaaatgtttgtgagcattacaccaaaaatggcttatggagcaaagtgccagggacagtttcaggcactggggagacagctgtggacaaaataaaaatttttgtcctcatggagctgatgcttaaaagcagggggcagggggaggcaattccctaataaaaacaataagcaaattatatagtgtactgagaggtgaaggggaaaagttgtgttgggggtattgaggccagggaccgggttgtcattttaaatagggtgtcagggaggtctccctgaggaggtaacttttgagctacagccttgagggagatgagggagtgagctgtgtagacagctagagcacagcccatgcaaaggccctgaggctggaatgtgcctaccctgcagctagcagggagtgaggggctgaggaagagtgagtgactgagaagggatgaattcctcccctttcacaggtgagggaagtgaggctcagagacagtatgtcagtcaccccaggacacacaggccaggagaggcagctgcagggcggggtgcctgatgttctgactcctggtccacgatacctccccggcaccctgtgtctcactgtttatcctgctacactggctggacccctcccagggccagcgcagcatcgtcctcctgccccaaagtgacccttgctctctctcatcccacttccttcctatgaccagtcccttctgagcacccaactctgacctggcacatgatccctagaaggggacctgctctgaggcagatttggtcaagggggcaactgaggcaaggaagtagagtcttctagtctaaaaataatgagcagcattattattgaacattaactacaaaacaggcgctgttctggatttttttggtgcatcttctcactggtgagaggttggtgtcattattacaccccatttaacagatgaggaaactgaggcccagggaggcagagtcactggcccaaaggcatacagctcatcagtggtagagccaggatggagcacaagccttttaagtcatgagctagtcctttaaccactaagccagcaccccaggattggggagacactcagtcctggactatggttgtggcccatcttatcctgcgaaaagggcagggacccttccacctgcctcccccaactcacccagaagacaaatcaccgcttgcttttgaagaaacgggctcaaaatgtggagcatcccttcgaggaagctcctgtcctttcctctcccttcctctcccaccctcttctcccctctaagttcctgaacagccacggggtgggggaggggcatggggagagtggggtgcaggtcggagagggaggtgcctgctgcattctcaccagacccctagcccgataggatctggaagtcaggctgtcctgatgacgacaccagctgcccttgagggccctgacatggtcactgggccaaggggcaggctggcctattctcagagtcgaaaaggacaggaattcttcatgttctgcccatgtgaatgaccgtcgagacaggaaaaacctcccagtgacttctgagcggtgatggaggccatcagagggcctgatccccttgcccacagcagcagcttcagacccccgggggaggagcccaggaatgcctccttcttgccacctgctctgccctgacctctcgccctcttcagcacagtaaggaatgttcatatttgtccctaaagctttggaaatgtttctgatgaaaggttgggctttcctctgcctttctggaaattgggccccttcaaaaagaaagagtaggaagataggacctgtgtgccagtccaggctgaggggtggcgggtcttggggatgaggcagcttgagctggggcccagcagggacctggagtgtggccgctgtgaggcagggctgggaggggccctagagaccacattctcattttcttagacaaagaaactgagccccaaagacagggcctggcttaccagtgatggcagaatctgcctgtgacctcagctgtcctgtctccgagcccagtgactcaggacacactgccaccttccagctccaggacaaaccttccactaccagatctcagggcacatgttcctggaggttcttggaaatggggcgtggaacctttctcaactgcagagctgtgtcatggagacgggggttgccactgccacgggactcgcatcctgcgcctgcctctcccggccagttccgctctgtcctcactctttgcagcagcctggacactgagcccagtggtgatgctgagatgatgaggaagacggatgctgcagctccgccctccactggctcaggatctgcttgagagacaagactgactaaggcagccccagcctttggaataatgatgctctcgagggatggcctgatagcaagccagctggagccagccaaggcccatccaccgggtagcctcgcctcagcttcctccttagctgtgggcctccgatgaaacctgcaccccagaggccgctgtgaggatgtcagtagtgcagccgctttcataaagcctcttttgtgtcccatgacttctagattatctctctagcccccggacagccttgtgactcagggaccaccgccccatttacggtggaaggaagggaggctccttcaaagaggagtttgtctgcccaaaggcacgagcctagtagtgcagagccaagatctgaacacaagtcccttagtccctaagcctctccagtacagccattgacaagtggattcactgcctgatggcccaggcaatagattctgggctaggggatctctagactccatcctgcccaaggggccgacggcagccctgggagggaccgcagctggagcggatgacgcaagctctggaccttctattccgtcccgccctccagggagcagagattctttctcctgcctccccttctctctggccgggggcctgaggctctggctctcactgccagcaccccgccccccaactctgtgttgccctgtcccagaccccatttccagctattttgtactaaagcgataacagaacaatgggtctccctgcatccctccccaagtcctgctggagtcgcagggccttaacccaagggaggctggaccccagagaggagtccagatgctggcgaccaccagggactttccgggggagttgccatggggaagatgggttagagctcagttcacgtccaccaaacgcccccccacccccaccaccgcacacattgcacacacacatcagcttctcttaggatgtccagttaaagaacagttaccttggcttgaattccagctctgccacttacctcaagggacactcgaataagtcacatgagccttcgttttctcatgtgtaagatgggggtgataatatggccattctcatagggttgtggtggggatagcaggggattcatggtcttgaagtacttgccccgctcctcccagccccggggtaggtggccctgggggcagtcttccttatgaggggtggaggaacaggtgtgctgcctgcccctatcacagaagctcttgtttggaaaggcagtggctccttggctgaggtgtgcagcagcagtgactcccccttgactcacagggaggcttggccactgatggatgttctgggccccttcctcttccctccctcatcttccccactcccccagccagtcaggtttcctaagccagccctcacgggcatagtcttcatgctggggacagctcggcagtccatctgtttctatagaaaccaggcttcctgggaaagagacagggggttggggaagtcctccaggatctgcatgggaatgacgcctcagtcccatctgatctggccagggcagagcctgggcagccaccttattcatgttattaattgctgtcctttacagagtacacaccagaggccaggctcctcagctgcactttcttatcatcacacatcacaaacctgtgggctttgtacagaagtagtagtctggtttcacagatgaggacatagaggctcagagaggttaagtaactttcctgaggtcacagagcaataaagaggagcagggatttgagcccaagttttcccaatcgttacaaatatgcttaccacctccctgtctgtcatcctcttctgactcttgtatccccaaaaagcccctctcttcctggctggtttagtcttggggactttgcttgttcccgcctcgcccctgggaagcatgtggaggtgctcttccctggcctcagattccacagcagatggggaggtgggagggactgcagggagtcagatcttggctgaagagggcctcttagctcctcccgactcattcattcaatcacaaatgcctgttgaactcctcctgtgcccggagttgtcccaggctcagagaacaagacccaaagaaatccttgccctggggcactcccctgcgagtgatgccacagctttctgaggaggtggggcaatgtcagaggccagtgttctcatccagtcctctaaccttcacggctgtccagaccccccactgccaggtcctctgccaagagcatttgcaccccatctcctggagtcttcagcaccccatgagtaaggcaagtaaggcgctgtggtgtgatccccattgtattgagggctgagactgctcgcttaaggccacctgaccaacagagagtggccacttttgaacccagttctgcctaattggaaagccctttcctgccctatgccaccagcttccatgtggcctggggcacagcctcccctcagcccgccacgtctaacctgtgggcttctgagtgtgctggttgggcttagcctgacagctgctcattccacctgtgttgacaaagtgcctgctgtgcaccccagcctcacggggagatacacggaggagcacagtacaagccataccttcagactggttggtcttggggagtcaaactgccgtgaaatgaccaggagtagaggctataagtggccagtggctgcagacactgagacccgtgagagtccagaggaggatgaggacccagtgccctgggagggccctgggaagaggggctgtgtgcaagatagcctggaggaacaaggagcatggtggggggacagagtgtcccagggaccttctcacttgtgtaaagggtcagcaatgagaaccactgttgaaaggtttgctggctgatcgggaatgtgggcgagagcagctggcagggcagaagggaaaggttcaggatcccaggcctgggccctaggagccatgtcctcccttcttgccagacaggtgatgtgggtggaggagtggctgtccttgctgcccctgcccccagcctcctgcagcctggctcctgggggaaacccccgggggcccttcagaaggcagtggggcagagcaggaagcttcacagcactgatggcaggctttttccactgtgcacggctgagtggagaaagggaagtggaaggagggccagactcctccctgggcagggcactttccccatgggtgcccacgtgcactccttctttctctctccaccagcacgtctgcgaggtgagcgttctcactacccccatttcacaagaggggaaactgaggctaggagaggtgtagtgacttgcacaaagccatgcagctggcaagagggcagagccaagactcaaacccaggtcccctgcccccaaagccggggtttggccatagtgcacggtggagtcttctgtcctcacttaggcctgaaataaacacctggagtggccctgaaggggaggaaaggtcaaggggagacctcaggggtgtgtgcagcttgcctcgccagtggggcaggtgaggggctgctgggtggatctgatcattgcagggcccagtcctgggggtgaagtaggggtggagcgccgttctcagagcagttatctgtgctggaaggtgggtgtggggccctcctccctggaggtcaagattccattttctctgtggggccacatgggccctttgtgagtgatgccctccctgctagggtgggcttgggaggtgggcacagtggttcccaccagctcagatgtctgatggcagtgcccgtggatgaagattgtcccacccatgagtaattctgtccaggacactgtagtgcccactcttcccagccccagcaggtgggcactgacacgtcccacagccgttgatttgcagcagctgttgttgactccgtcctgggatgcagaggggaatgctctgtgtgtgtatgtgtgtgtgtgtgtgtgtgtgtgtgtgtgtgtatggtgtgtgtgtgtggtgtgtgtgtggtgtttgtggtttgtgtggtgtgtgtgtatggttgtgtgtggtgtgttgtgggggtgtgtgtgtgtggtgtctatggtgtgtaatgtgtggtgtgggtgtggtgtgtggtatgtggtgtgtgtgatgtgtgtggtgggtgtgtgtagtgtgtgggtgtgtgtggtgtgtggtaggtgtgtggtgggtgtgtgtgcgtggtgggtatgtgtggtgtgtgtgtgttttgtgtgtgcattgtgtatggtgggtgtgtgtgatgtatgtgtggtgggtttgtgtggcgtgtgtgtgcacgtattgtgtggtgtgtgtagtttgtatggtgtgtgtgtggtatgtgtgtggtgtgtgtggtgtgtatgtgtgtggtgtgtggtgtgtgtgtggcgtgagtatggtgtgtatatgtggtgtgtgtgtgtgtgtactgtgtgtgcagtgtgcgtgtgtgtgcatgtgttggtggagaggggtcagcaggcagaggaaagcaatgcatccaatgcctggaagcttctgcccctcggaggtgggccgtggacacagcctgggcctggtgggcagtggctgagcgccagccttgtgcccggggactgagatctggggctttgcccagtggggcggagaagttaagaagtgttagttagatccatttcctactcctccatggcctccatcctggtgccactgccacatgggaggcctggggagggtggcagtgtctgtgtctgataattgcctgtcttcactggggacttgctgtgggccaggcacttccccatggcttcatggagattacagcttttattctcacagtatctctataagataggacaccttattttcccaactacacctgggaagactgaggcacgtagaggttaagtgactgacctgcccacgggcacacagccaggcagtgatggatctgggattcaaatccagggagcgtcctcagcagttaagcacttacccattaggccttctggcttgagcagtgagctggctctttctaaagcactgtctgtccattattttgtttctcctgagaccagctgtaggggaaaagtgaggttggctgttttcgtttcacagatgaggaccccggagctcagagaggaaaagtaacttgctctaatcagtggctagcagatcagcgccccctcccccggccaaggctgggagctctttcaggatagggggcctgtcccaccacccatgtaccttgctcacagtagacctcactaagtgcggattcctcaggcaaatgtgcaggtgttttgctgagtgctctgagcttttctttttgccccgggctccctaggaagtgggaatgatggctccatttcacagatgaggaaaccgagactcagagcacaaggccacacagcaggaagaggtaaggcaggactgagggaggcagcacgtctggcctgggagaggggttaaccagccaggaggagctcgtagaagggctgaaataaagaccgaccttaccgagtgttggtgaggatgtggaggaactggaacactactgcattgccagggacacgcagtggcatggctgctctgggaaacagtttgatgctttctctgaaagtccaacagggatgtaccacacagctcagcaattccacccctggcatttacatagagaaatgaaaacttacggtcccacagaaacgcgggtttgtagcagctctattcataatcatcaacaactggaaacaacccacatggccttcagtgaccgaatggataaacaagctgttacacgtaccccagggaatactgctctccaataaaaaggagcggactcttgatacacacagtgacttggaggaatctcaaaggcattctgctcaatgacaggagccagcctcaaaaggttctacgctttatcattccacttacatggcatatttgaaaacacaaaagccatagtgtcagagaatagatcagtggttgccagggtggaggtgtgaggggagggagtggccagcgccagggagtttttggggtgatggaactgctcgttgtcttgatctggagctggtggctacaaaaatctatacgtgtgctaacattcaaataactgcacaactgaagcccgtcaattttgctgtatgtattaaaagataaaaggccatggggaggctggaagaggaagggcgtgggccaggcaacatccttggctgaggaacaggtgaaggacccggttctcaccagtggcttagtgactttcagggcagcctcgcctggccacgggagggacgtggctaattgtagcttctatctgggttcaccagaaggcagtggctagcagctgaggtgtcaggacggcgtcctgggccctccaggagccgggtgatgaaaggttaggccctggcttccctggcagggtagggttggcctcctgtcctgatggctggcacacaccgaagcattaaccgggagtctcttgtgtgccgggtgtgggactgccgtcacagttaccacccgccgctgtctcctttcaccatggggcctgtgtgtggggaggagaaaggcgtatccactcctttttgtggatgaggaactaaagccagggggcgtaggagggtagtttggcctggaaatgacatcacactcactaaagaccgccaatagcaacttttgcagttttttttcccaatgcgacatggtatactgcctccctagttgatccggtctacagccacattattcacagaccccacagtttgaaactgtgttctgatatttgttcgggtgctttattttaagacaccaggaggctcaaaaatgggaggtgacccggggacatccccgcactctgcctctggcagccctggctggggcaggagggtgagatttgcctggggccacagggcactgagacagcagggtcccctgctagagggcccagtggcttctgaccctgtctgtagatggggatggcttttctgccttgccagagggtgggtgcaagtgggaatgagattctggaagtggtccgaggtaggaagtggcacgaccgttattcaccttggttggcattgaaaccccgggagcttggtttcctcatttgcagcgtggccgtcaatagcgcccatcttgcagggcagctgtgattagagaagccagggccaccccggagccagcctctgaggcttcacctcaccccgtttacactgctgtctcctctgcatagatttggctgactgaggacgcgacaggtactcagcttctttctgcatctcagttgcccagcacaggggctggcacgcagtaggtgctcccaacctggtccaagatgttgctggcggtgggggagtggggggctggggaggatcatgggcagacctggggtgccgggaggggctggtggggggctgatggccgggagggcaaggcctgagcagggaatctagaccaccttagtgtccccgtcaacacccctggcagccttctctggctctgctgggtatgagggcaccccctccccttctttggtcttggcaggtttgaaggggggtggcagggagacgggagaggggctcaccggcttgcaggattgggcagaagtttggtgggggcccaaaccccagaactcagaagcccctgccccaggcttggacagaccctccccttttctaaacctcatttgccccatgaatccaggctcctttcctccccatccccccaggaagcttggatgtggccgccatccagacccaaatgccctctcctgggccctatgcctccagggctggctctaaggcaccatgcaacctgtcagatggggtgtgctgtgtccacctacagcagaccagctcccagagcctcaggggcctggagagcatttcctcaacccatttgacaaggaagccagctgtactccccctactgccctgggctcgtggggaggcctcagcaggcctggtgtggggtgtggccttccgctagtcaggccccttcccctagggtctggaagctgggtaggaactgtggcctgaggccggtgtctcccctcagcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaaggtggggtgcagagcaggggcctccggcacccactggggaggccaggctgacccaccattaggggagaaggttagcccaggcccaggtagccgcaggagttctaggacttagctgattttcctagaaatgtaacagcaatgccaggggaataacgagatcattagaattaagtgcctattacgtgcccggttttccagcagttgctttttaaatcttcttgttggcactagaagatgcagatactgtaaaatcattcacccattttatagatgaggaaacaaaggctcagagaggttaggcaacttgcccaaggccacaccggtaagtggcaggaccaggcttcaagtctgcatttggcagagccctgagctttcatacgtcaccatcatattttcagcttcttttaaatcctagtgtcaaggggaagcaggagagggggtggcctcatgtgaccctccccacctgggggaacctttggccaagctgaggtgcccaggctggtccctgggtgtgcagggctctgggaggatgagcgagtgggggcgctgagagctgccctcaccctggttgcctctgaccccctctgtccacagatcagccaggtcttaggcaatgaaatcaagtttaccattcgggagcctttggggctcaggtgagcatttacctgactttttgggggaggggaaggcctgcggcggtggggcagaatgcataagacctcacctcatttggcctggtccctggattttattttgtctcattaccttccccaaagctgccatccctggggatctgggctggagaggggagggtcccctggggcagggctgtgatcttctttccacgcctcccagggtctggcagttcgtctctgctgtgctcttctccggcattgccatcatggtgagcccccacccccagcccctgagatctggccccgtgtggctccctcagcccttctctggctcaccagaggtgcctcctccatcctggcccctcgtgcaggggcccatctgtcaggctctggggctgcctccgagaacctgactcctacactgccacgcctgtgccttctccaggagcacactagatcccatggtttgtggcctgactccttctcccaggaaccctggagttttctgtcctggcatgggggcgggtggggacaattgggtccagaccctggactgcccccaaggatgctgatcctgctcctggcggggaaggaagacgtctgtgggaagcatcagctgtcaccccccaccctctcccaagcgggacctctgagcccctctcgctgcccgcaggcgcttgccttccctgaccagctctatgatgcggtctttgatggagcccaggtgaccagcaagacccccatccgcctctacggcggtgccctcctcagtgagtactgctggggcgggccctgggggaggcgacgggcagctgggagacccagcggggctgaggagagcacgggggtccgtgcccgggcaccccttcctttcttcggccagatgctgcgcccacaccccggcctctgatgaagctctctgctggggatgtgctgccatcttgtggccattggtggaatacacccagtgggttggagcttgcagtcgccaccatctgcaaggagcgctcataagtgtgtgcactgcctctgggcgttgtggtacagagatggaggaagcccaggcccagcctctaggaattcacagcctagaggagaggcagatcaattcagtgtctgcaaaacccctcgcaccccccctattttatccccagagccacttctgtttgaaccacttctgtttcctctctaacctgagatgcacacgttaggatttggaattacaatttttaaagctcagcataggtaatatgcctctatttctacgaaatattctatggctccctattgcctacagaataaaggctgagctcctctggagttagggttgctggaataaaataaatgcacacccagtggcatgtctggtaccagcagacactgggtgggcggggcctgctagaggccaagtcagtggtcttctgctaaaaagtatggttcatccccctcccccaggggacttccttaaagcgagtccttaccgggctcaggttttctgtctgggagtccgtgtaaaagaaaacccaatcataggaccaggtaacccattaactcatgaactccatgaacacagcatcctcctgacagaaccggacatgggcaggggccaggggctcagtcctccccctttataaagagatcgagtctcaatgcggggaagtgactcgcccagtgtcacatagggccttggaatgacaggagcaggctgaagcagcagcattgagtctggaggggacaggatcggggacagacagctttgatttgagaaatgtgaataggggcggaggcgtggagtccaggaccccagctgtcttgcagcagtggccagaggaagcaggagcagtcctcctgccctgctgggagggagtcagctgtcccacccccagcccccttttcatcccccgccccaggcatctccctgatcatgtggaacgctctctacacggctgagaaggtcatcattcgatggaccctgctcaccgaagcttgctatttcggggtccagttcttgggtgagtcctgaggtgggcagtgagggaggctgatgggccgcttcgcccctgacctgcctgctctagccacctgggtgtgtgggaagtgatgaaaacctgtctgtggggggctagggaggggatagagggataaggactcacctggctgtgtttacttgtgtgcctgcacacctgtgcacacatgcctaacacacgtgcctgtagcttcccaaatccacacacttgtatctatggccttgcacacacatgtacctgcggcccccccacacccactgcccactgtacccagcacgtgtgtaataacacgcattcaattttgcccacctgctgtgccccagttcctgccacatgggagacatcagagcagaaacatctgtggggttggcaggggcagggggcaggtcctgtgcttcccacctgggaggatcctgggctcagagcaaagtcagggagacggccacaccagcgctccgggctaggggggcagcgctgggacacatcccctcctctgaccctgtggccttgctggactctctcccacagtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaggctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatca

SEQ ID NO: 19 - DNA, 33329 bp, Homo sapiens
gcggaaaccggaagcggcggctgtccgcggtgccggctgggggcggagaggcggcggtgggctccctggggtgtgtgagcccggtgatggagccgggcccgacagccgcgcagcggaggtgttcgttgccgccgtggctgccgctggggctgctgctgtggtcggggctggccctgggcgcgctccccttcggcagcagtccgcacagggtcttccacgacctcctgtcggagcagcagttgctggaggtggaggacttgtccctgtccctcctgcagggtggagggctggggcctctgtcgctgcccccggacctgccggatctggatcctgagtgccgggagctcctgctggacttcgccaacagcagcgcagagctgacagggtgtctggtgcgcagcgcccggcccgtgcgcctctgtcagacctgctaccccctcttccaacaggtcgtcagcaagatggacaacatcagccgagccgcgggggtgggtacaggaccacgtccgggactgtggctcaggagagttgggaaaggaggagggtgtaatgatggtcagcgctgggggcctcagtttccccaacagtaagaaaaaggggttggactgagtctgtagagttgggtcatcagaaaaagggggtggcattatggggcttgggatttgggtttttgcttccaagaatgctgttggacatctttggttcatataggtgtgattggttttcttgggggtcctgattccccaaccctcttgctcttcctccacccactccaccacggcttcttctcatcttcacctggagttgccaggaaggatccttttctgaaacaagtggggtggagacactggtagtggttagaaatttgagctttgtagccagaaatgttcatgtccaccaacttctaactatgtaaccttggattaattatcttctcagaaccttagtttcctcctctataaagtggaaagaacatctgcctaatgcggctgttggaagaattaaaagagatattgcctgtgacttcatcttagtgatgtgaacagtctggagctagctagcggccaggactccagttccactctgcttattagcggtatactatgggcaagttacttacattctctgtgcctgtttactaatctgtaaaatggggataaaaggaggttttagaaaacaacacatagtaatacctctaagtaaatgggaggtaaatttttaagaaattgtaagactgctcttcattcttcataccttaagggttctctaggtgtgtggtagctgctgtgaggcacttaattttaaaaagaaaaacagacaattcctgctcctaagtactttataaagtttagactaggaaaagattagagtgtcagggttggtgggagtcacgaggtgtgggccggatatgcttggtaaaggaaaaacatgaggaataacattgggattggagaatgagaaagttcctcttgtattacggggacagcaagtagtctcatgaaaatgtggttggaattattccataaatttaaacttgtctaaacttgtttatagttgcactaaatataaatttgtacctagttggatcctgctttaagtcagcctgttatttaaaataaatctgtcatggctgtgtgcggtggctcatgcctgtaatcccagcactttgggaggctgaggcagggggatcacctgaggtcaggagttggagactagcgtggccaacatggtgaaacccccgtctctactaaaaatacaaaaattatccgggcgtggtggcacgtgcctgtagtcccagctgctctggaagctgaggcagaagaattgcggtacacgtctgtagttccagctactcgggaagctgaggcagaagaatcacttgagcctggaaggccaaggttggggtgagccaagattgcactactgcactccttcctgggcaacagagtgagactccatctcacaataaataaataaataaaaataaaataaaaatctgtcattttacataactggggaatttatttgcattaaataaattctgtggtcaatctctctgtaaagagcatgtttttttttttttcttttttcttttttttctgagacaaggtcttgctctgttgcccaggctggatggagttcagtggtgtcatctcggctcactgcaatctccgcctcctgggttcaagtgattctcctgcctcagcttcctgagtagctggaactacagatgtgcactgccacacctaactaattattgtatttttagtagagacaggtttcaccatgttgaccaggctgttctcgaactcctggcctcaagtaatccacccacctcagcctcccaaagatttgggattacaggtgtgagccaccacacctggccaaggacatattttcgaggtaaataaattcaggcttacatgcggtattttccaggcacacttccattgggtatagcaaggaatatatatcttactatcactttaaaataaagtacccaagacatgtccctgtcaactacagcaggatacgatatagcatcatattcagtgttgagtggttaagatgagttgttttagggttccatttactctaaagaacaagggctattgtgggcagaatggccagggatcatgatgcaaagtttgggtctttgaaggcagcaaatgcttttctcatgtgtgtaggtactgtggaattaaagagaggctaaaaatagcacctcaaactctagggtgcagtattatgggcatcacccaatctgcatgtgaatttccatatgaattccccactacccaaaggaggcttcccagtgggggagttgtagaaacccccttcctttccctcagattctaccagcaacctgggtacccagctcaactcaccctgatgtgaaaggaagtggataaacaggtgaaaagaggcagggaaactttttttgtattttctctccaactcatcctaggccttggtctcggctcgccttatttccccagtagagctggatatgattcattagctcaaaagtgtgacatctacagttctgaggtactttatagatttaaaaggctatatggactggtttgggagttgaaccatcatgtataataatgaacttatgaggccaggtgtggtggctcgtgtctgtaatcccagcactttgggaggccaaggcaggcagatcacctgaggccaggagttcgagaccagcctggccaacatggtgaaaccctgcctctactaaaaatacaaaaaaaaaaaaaaaaaaaaaaaattagccgggtgtggtggtgcgcagctactcaggaggctgaggcaggagaattgcttgaacccgggaggtggaggttgcagtgagccaagatagtgccaccactctccaacctgggggacagagtaagactccgttgcaaaaaaaaaccaaaacaaaacaaaacaaaaacctatggaaaaatgtgtcatgagtgaacttgaaggaattagttgtctcttggggaggtttatttatccagtgtagtatattttcttttctttttcttttttttttgagacagagtcttgctctgttgcccaggctggagtgcagtggcataatctcagctcactgcaagctccacctcccaggttcatgccattctcctgccttagcctcccaagcagctgggactacaggcgcccgccaccacgcccggctgattttttatatttttagtaaagacggggtttcaccgtgttagccaggatggtctcaatctcctgacctcgtgatctgcacacctcgacctcccaaagtgctgggattacaggtgtgagccaccacacccagccctttttttttttttttgagacggagtttccctcttgttacccaggctggagtgcaatggcgggatctcggctcactgcaaccttcgcctcccaggttcaagcgattctcctgcctcagcctcccaagtagctgggattacaggcgcccaccaccacgcctggctaatttttgtatttttagtagagacagggtttcactatgttggccaggctggtctcaaactcctgacctcaggtggtccacccggctcggcctcccagagtgctgggattacaggcgtgagccaccacgcccagcctatccagtgtaatgtattttgtttgactcagactcagtcttttattgaaatcagtttttagcaagcacctactattcttgaatattgggctggtaaaaggataagaaggaaaagaagggtaagattcaggcctcaaactatcagtatagttaggggaaataaaataccttatatggggaaataggaaaatatcagtgagtgttataaattgtaccatagcaatttagaacaaaagagtgaaaggaatgccaagttaaaggagggaacagagccagatgcagtggctcatgcctgtaatcccagcactttgggaagccgaggcaggtggatcgcttgaggccaggagtttgagaccagcctagccaacatggcaaaaccccgtctctactaaaaatataaaaaattagccaggagtagtggcatgtgcctgtaatcccagctactcaggaggctgaggtgggagaatcacttgagcctgggaggctgaggtttcagtgaaccaagtttgcaccactgcactccagcctgggtgacagagcaagactccatctcaaaaaaagaaaaaaaaaatgacggaacagagcaaggctggttcatcaggggaaacctacaagctgaatctcaaggcattctttctacccttctttagtgtgaatggacatggattgattgagagaggagaggagtataataaggagaaaaaaagaatcaaagccagaaactagtaagctatttatgtggtacagcaatataattagtttaactataatagaattccctgataagaatcctaggttcttgtcacttccttttagaatttctgggagagggatcgcatatagtttcattatctcaaggtgaaaaatacagtgatttctgaaacctgaatgatagaactgagggattccctcttccttagagtcatactttctccttttagtttaaactgatagggacatagtttcattgtgattcagcattatcggaatggtcctgaggatgcttttgccccctcagattctgaattggtaggctctgtcctattctacttggtttgtttaaaatttagatagtgtttaaaatttagatctatagatccatccatctacctatctatctctatctatctatgtatctgtgtatctttgtgaagtgctagtcatttgggttatgtatttggtgagtattcaatatacttttactgtagattattaaataatgaattctgaggactatagggagaaagccagaacatagtgtaataatctgtgtctttcattagagatcagaaaatgtaatatttcttctgcattcattcaaaaaaattattgagtacctattatgtacaggttgtggtagctactagggatatagcatgaatgagcagagcttgtagtctgaagacagacattaagcatctcattatacaaataattatttaattcatgtgtgataagtgttgctgattaaaaaacccagatgctaccaatgcatatgacaagagtgctgatcttgagtatgactggggggtaggtagaatggtcagtgattaaagcagacacctacaatttgagagaacacaggcaggggagggaaggtatacatgtaaagaaatagcaggcatgaagactgagatgggaaggagtttgtggtgtatctgaggtctagaacacagcacagtgagcaagaaggaaacccgtggtctgagcctaaggaagtacacaggtgccaggtcatgtgggccttgtagggtatgttaaggattttagactttgattttaaagcagtatgacgttagtgaaaggtttaattctgtggaatgacataatcagatttgtactttaaaaggctatgctggctatgtgacagaaaatggagagggtaggggctggggagggtaggggaagaagatatgtggggagatgaattaggagactgttgcagtggtgtgagagacagtggtgtctaggctatgtgggggccatcatgatgtggagaaatgggtggatttcagagatacttaggaggcagaaattacaggcttggaggttaattgaatgtggggagtaaggaaaaggtagtgatgatttccagggttttaataagagcagcttaatgaatagggttgtcatttactgagctggagggaggagtctgtttagtgggcgaagatcattaactcagttttgaacgtgttgattttgaggtgtttatgagctttctaagtggatatattgattgcctatgtggttgaatatacacatctagaggactggactagagataacacctttgggagtgtcggcataaaaatggcatttgaaattatgacatgggtgaacatacctgaagaatgagtaggaacactaagagtttaagattaaatagagggtaaactctcaaaggtgactgagaaggaagaattggagagataaagaagaatgaggagagcatgatgccctgtaaatcaaggaaaagggaaggggtggttatttgtgtcaaatcctgctgagagaattggagatatatctgtcaacactggcagtattggtgacactaacaagagtgaatttgatggagtccttgggtacgaaagtgagatcagagtgggttgaacagggattggaagatgaggacatgggaagagtgaacctagacaactgctgaagagtttggccttgatggggagataagaaagagaagtcactaaagagcaatgtgggactcagagactttctttcatttctctttctctatttttttttttttttttttttttagacagaggctcgctctgtcaaccaagctggagtgcatggcacaatctcggctcactgcaacctccaccatcccaggttcaagcgattctccagcctcagcctcctgagtagctgggactatgggtgtgcaccaccacacccagctaattttatacttttagtagagatggggtttcaccaggttggctggactggtctcgaactcctgaccttaggtgatctgcctgcctcggcctcccaaagtattgggatacaggcgtgagccacggtgccaggctgactttctatcatttctttccattcccctgtccctccattcctctgtcctgccttcccttcttccttgtccaagatgggagagagctggacatgtttaaatgttgatagtaagggtcctttagagaaagtgaagattctgtaggagggagtgggaagcagacaaggtcagtttccagaaaaggcaggatagatgggatctagggcatcctcagagagatgggccttgaaaaggacaggtgccttccccaccttaatgggagggtagaaggagaggttgcatgtaggggtaggcaggttagagtttcagctcgaaggcttctgttatccaggaggctagatcttcttttgagagtaaagagtgggagagagatcagagtttctgggagagtggagaggatttgaaatagcggttgtaaaaaggagagaatgagcagacagaaaagtgaggagtacggtttgggattatggatttactttggaattaatctgtgttgttaattttttgccagcagctcctgacttcctgggtgcaggcatgatcaaaggaaatggctggcttcaagatggttagggttctgctaagtagttaggatagatttgagtattaagagttctaagtataagcaaggaccattgattttttggtcacttggcgaggtgttgggaatacaaagatgtgacagtttccattttaaagggacatctgtccagaagagaaacctaaacatatataggtggatatcatgctttaagaaaccatgcatcagggtaatgacgcatgggtcccacattgctctttagtgacctctctttcttatctccccatcaaggccaaactcttcagcagttgtctaggttcactcttcccatgtcctcatcttccattccctgttcaacccactctgatctcactttcacactcaaggactccatcaaattcattcttgttagtgtcaccaatactgccagtgttgacagatgtacctccagttctctcagcaggatttgacacaaataaccaccccttcccttttccttgatttacaggacatcatgctctccttatttttctttatctctccaattcttccttctcagtcacctctgatagtttaccctctacccagctaacactacctatttcatagagttgttatgaggattaaataaggaagttggaacatttggaactggtaagtagtaagtacctcatcatcgtttggattattaatcatttcctttctgtcctcactgttgccatcatcctttcattatacctgatctatggaagtagtgtaatgagtctccctgcctcctcaccctacatatcacggcctaaagatgtattcctcaaactgcttttcatgacaccctcctcataaatcttaaagaatttctcactggctaactctcatgaccctcacggcctctcataaccttgttctaacttagccctttaatagccctactttcatagactactgaatactctccgaataccacataatcattatcactttcaccccatgatcatttaattcttctattttcgaatcctcttctcttcctcaatatagggcttagttcatatcctgcttccttcatgaactctttcctaatttctcaaaactacattgatatcttcctgaaccgaactgttccacacattgaacactcatacaggctctactgtattgatttttaaaatagccagtcacccacttatgaagattcaacttaaccaactaatgacacttatccaactaaacctacttagagcacttcaggttggcagcatggtagctaggtgaaatagcatatatcagtcactgtgtgccagacagtgtgctgagtgattaatgtatgctatttcatttaatacagtaactgtaggacccctgattttgaaactgaaccttagcgaggttgggtcagctgcccaaggtcactagctagtgacccaggcttgtattaatacaatattattacttctacttaagaagtgataataggccaggcatggtggctcatgcctgtaatcccagcactttgggaggccgaggcaggtggatcgtctgaggtcaggagttcgagaccagtcaggccaacatggtgaaaccccgtctgtactaaaaataaaaattagccaagcatggtggcatgtgcctgtagtcccagctgctcgggcggctaaggcaggaggatcgcttgaacccaggaggcagatgttgcagtgagctgagattgcgtcactgcactccagcctgggcgatagagtgagactccatctcaaaaaaaaaaaaaaaaaagtgataatagaaaattttcttctatggctggtattgctcagaaggtaattctaaaaaagagttttaaaatgttctgttcatggccaggtgcagtggctcatgcctataatcccagcactttgggaggccgaggtggatggatcatttgagttcaggagttcaagatcagcctggccaacatagtgaaaccccgtctctactacaaacacaaaaattagctgggtgtggtggcatgtgcctgtagtcccagctacctgggaggctgtggcatgagaatcgcttggattttatattttaaagcagaaattcttccttttctccctcttttctccttttttccatttcttctcccacatgactgaccatttgtttcccaggagttaccactcttttattattcatcacactgtataactccttgtctgtgtaactgcgagaggttctcaaagccccagaattgatggcattcttttatactttttatatcctcagaacttcaggatttttatagtgcctagtaaatagtaggagttaaataactttgaaagaattaagggtcagcaggacttagttccttgcttggggcacgaaggaaaggaaatagataaggatcaaatgatttgggaacttggatttattatttgcatagcatgagtttctttcattattaaaatgatctacaaaagcatatttttccatctgggtacaaactatttagataacaaagattttcttcctttgcaagtgaacctagtaccaataaatgttagctgctaattactttattatcattgtttttattaatgttaacatctgatcatatcaaacaaaatgttaaaaagcttataataaatgttatttttgtaaggtttttgcctcaagttgtttgcaaagtctgaaaatactcagattgtatttttctgtcttctttttgttacagaatacttcagagagtcagagttgtgccagaagtctcttaatggcagatagaatgcaaatagttgtgattctctcagaattttttaataccacatggcaggaggcaaattgtgcaagtaagtaattctttcattttcatgttgcagttatggttcagtagtacagatgtcagattttattttagtgaattttgggatctttgaagctggataatactttttattgctaagtttaaataaactgtcatggacaccatggtttattaatggcaactgagcaaatagcgaaaggcagaaaagtgtagcagttactatgagctttggatttagatagacttgggtttgattctaagctctgccacttactagccctaacctactagctgtcagatatgggagaaaaactttgcctcttggaagttcagtttcttcatctgtaaattggtggtaatgatagaacctatcttatatagtcgccttgagaatgaaatgaaataaattgtgtaaagcacttagctcaatgcctgacacgtatttagtgttcaagaaatgttaactgtttagtataataataattatgatgtttacagtaatctgtcaagtggtgtgtggcaggcggcggggtgggatgatgacatctgttctaccttctttgcaggtttgtgtgtaattgtgtaataaaataagatctatttttagatattctttggaaaaattaaaatcacttccaattcagatgatgttttgaataccaactatgtgctaggcagttcttatttttcaagtcttataatttaatgagtgagaaagatatatttacaaatacagcctaggacagacacataaatgctttaataaagttatagagtccttggaggaagaagaaaataaatcttactggggagaatttgaaatgacttcctggaggagctaccttttgaacctaggcctgtactattggacatgatttcaataagtagagatgacgccagtgaggcggctcacgcctgtaatcccagcactttgggaagccaaggcagaattgcttgagcccaggagtttgagaccagcctggggaacatagtgagacccccatctctacaaaaatatatattttttaaattagatggacatggtggtgtgtgactgtagtcctagccacttgggaggctaaggcaggaggatcccttcagcccaggaattcaaggatgcagtgagatatgattgtgccactgcattccagcctgggcaacagagcaagaccctgtcttaaaaaaaaaaaaaagtagaaatgagagaaggacattgcaggtagtcacagaggtataaaagggcaacagatgttccaggaagcatagtgggaggtaaagttagcaagggaaagtaggaccttgactgacagagtagtatactatttgggccaacattttttatactgcttagaatatcagcatattattaagaaggggttatagaccaggcatggtggctcacacctgtaatcccagcactttgggaggccaaggtgggagaattgtttgagcctaggagttcaagaccagcttaggcaacatggcaaaactttgtctcaacaaaaaataaaaaattaactggacttggtggcatgtgcctgtagtcccagcaacttgggaggctgagatgggaggtcaaggctgcaatgaatcatggttgtgccactgctccccgctctgggcaacagaacgagaccctatctacaacaacaataacaaaaaaaaaaaaaaaaagaaaagaaaagcttatatagtattctcctattatgattatatagtattctattagccatggtttcacttgctgtagtttcagttactgcagtcaactgcagtccaaaaatattaaatggaaaatttcagaagtaaaccatttataatcttaaattgtgtatgattctgagtagcataatgaaatcccatgccatcctgcttcatctacttgggctgcgaatcatccatttgtgcagcatatctatactgtagatgctgcccctcctgtgaggcactcaggagcatcttggttataaggtcaactgtcatggtatggcactacttgtgttcaggtaacccttagtttacttactaattctttaataatagtaacataattattagtttttgtttttaatctcttactgtgcctaatttataaattaaactttatcatgggtatgatatagaaaacagaaaaaaccatagtatatagaaggtttggtactatactagaaaaaaaaacatagaaatagaaaaaaacgtagtatatagaaggtttggtactatacttggtttcaagcatccattgggagtcttggaatatatcccttgaagataagagttgactactgtatgttgtagtatctttgggatttacaatgcacctggaatattaaatgcattgagatttttttaaaagggtttttttttggctcagtggggaggctcacacctgtaatcccagcacttcaggaggacaagatggtagtattgcttgagcccaggagttcaagaccagcctgggcaacattttttgtagagacagagtctctacaaagaaaagaaaagaaaagaaaaaaattagctgggcatggtggcaaatgcctatagtcccagctgcctgggaggctgaggtaagaggagtgcttgagcccaggagttggaggccacattgagctatgactgtgccactgcactccagcctaggcaacagagcaagaccctgtcttaaagaaaaaggttttttaaacatcatttaacctagcactttctaagcctttaaaaaaaaaaaaaaactacaaagatccttttttcatggaacctcattggaagagagagagaccagtaagaagtttactgctatagtttaggcaagaaggaaagaaaatgtgaagtagggaggggccttggaaatagaaggatagattaaaaatttgtgtacctataagtcattaagtagcttagcttttatcaagacttgtctttttgtttagttcatatgaagaaaaactaaaatgggataagaagccccagccagtttttttcccttgtcagtatactatggtatattgaatactgacttttaaaattttgtttccgaagcttgactaacacaacttttttttttagcatatcctttacttttcagagtaaaattttctagtataaatatgattgaagagcatttgcttaacatatgtagacctgtttttaagtattcttaagctttttagaaaaatccattaacatagaaaaatatgttaattataaataatttaaaatcagttaattggaataagtggatatatactgggattcacttctttattttttaattttattttaagactagtcaagtgcagcagtgagaagaggggaaagagtagaacaaggagttcgatctgtaaccaactgtgaacaattaattgagataactcactaccttcagatgagccaggggttcacttcttttgacagatgtgactaaatttatatacttagaagaggcagggcattttttttctttaaaaagtgtttttgtttgtttgatttttgagacagagtcttgctctgttgcccaggctggaatacagtggcacaatctcagctcactgtagcctccacctcttgagggctcaagtgatcctccagcctcagcctcccaagcagctggggctacaggcagcacgaggatgcctggccaatttttgtgtttttaatagagatgctgttttgtcatgttgcccaggctggtctcggattcctagactcaagcaatcctccttccttggcctcccaaagtgctgagattgaaagtgtgagccactgtgcctggcttaaaaggtgttttgtaaaaaagatttcactaattcgaagtacagaccttttttccccagttagttgaaaagaaaacgttttaccgcatactcagtatggcaggtataaaatgctttagaataaattcttagggtattttgttcttctgtgaggcatcctatcttgaaaatattccttacattgaacttctgaggaccaaataaaatgctaagcaattagatatgacttacttaaaagactcttcccaattaaaattaatttggcccagacatatggtctcaggtaaaagaagcgaggtacagagaagtatgatattttgtgttctaaaaatacatatgtattttgagggagggcagttggatagctgtgtgggcaggaaagaaaggaagatttagttttcaccgtatttgcatttgtaccctttggattttatgccatatacatttaatatgtattcaaaaatatatagaaatttaaaaaatttaacagaatgttcaaatctgtgatgagtatttgtatgttagatgtggttagagagattagctatttcattttccagaattacgcattaaaaattatcatcattcatcatcccatttatgtggcagaaaagtggaagagtaaatcccatttgtgaagaaggaaccctcatgacctagtcacttcctaaaggcctcacttcttgatattattgtattggccatcaagtttcaacatatcaattttgggagacacattcagaccataacaggggctattagaatttttgtaaaataatattattaaataacagaaaaaaatgtaaaaacatgaaaggtaaaatattactagaaagaatattattaaaatgagtatactgcccaaaactatctttctgttctgcttaatttagcttgaaataggggtggcatctagtctctgcagttattattcatgaaaggaaggctaggaatccaagagaggagagaatgccatccatgtactactcccatcccttttcttctcagaattcctgtgtcttcaaatggtattagtcttggtaggaatctggttattggaaattgatggaaggtcaaaagaagtgttaagagtgcaactttttctactcatactacaaataacatggaaactagctgtttctgatggagaatgactgccaaaaagtaaagagagtatattaaaggtttctcagaattttaaaggtgtgtattgttgacatagggatagccttgttattgagacccttcttgcttatcttgtgcatacagcagttaaataatcagcagaatgaccagatttgatgagttcatgactgctttagtgttttggttctttggtaagcagtatccagtatgaagcattattataatgagataggcctcaaaattatcagttcagatatttgttcttacacactgaaaactctttctttatgagcaacctatatcttcagtgatacaggtgatctgggtgataattaatgagcataatgatgctgttgaaccactgtgtaatcccgatgtatattctgattcatcagaggaaaactaactttcagttaacacatacaatgtatgtcttgatgctttaaaaagcaacaacaatagtacttaatgattaaccagaaggtcaattaaccaaaacatttttttttttttaagacggagtcttgctctgtcacccaggccggagtgcagtggtgcgatctcagttcactgcaagctccgcctcccaggttcacgccattctcctgcctcagcctcctgagtagctgggactacaggtgcccaccaccacgcccggctaactttttttgtatttttagttgagacggggtttcaccgtggtctcgatctcctgacctcgtgatccacctgcctcggcctcccaaagtgctgggattacaggcgtgagccactgcgcccggcccaaaacctttctttcccatattttatccagagggaaatgtactaagcgttataatcatattatttgtatcttataatttaaagtatcttagttttcatatttgttaaacttaattaggtcatttaggtacaaagttgccgtagtttatttttattttctgaagcttaccctaaattggtgattatctctgctattttctataaaactagttttgaaaaacagcaaagatctttgtaaaattcctaagagatgccaaatgctttatttaaagatgcataattcctgttatgataatttagtaggtttctctgtgaggtcttaacttgaatccttaatacctttaagaatgcctcttgaggccaggcacattggaggctgcaatgagctgagattatgccagtgcactccagcctgggtgacagtgagattcttctgtctcagaaaaaaaaaaaaaaaaaaaaagattgactcttaagctgatgcctgagccttctctgagaaagccactctgctaatctgcccttgatgaggctccattgattatctaagatgaaggaaattcataatgaccacttcacttagtgcttaaaggaagctttattattattaatattctttaactcaccaatttctaaaacatacagcttctcactgtttataatcttaagctcccaattcctgcaaaaagataaaaaaggaatttactagagatctgttatttcgattcagaaagtcatggctttttaataatgaagactttttaaccccattatataaatgaactgctttatgctttatgttaccaccatctaatgatcattgaaaaagttttgatggtaatgcattaatgtaattattaataaaagaaattaagttcttttgttcttcagagaagctttctttataaattgcttttgcaaaagaaattatttgttttaattaggtatcttgcatagaagaaatttgctattgctctctcatgataatgcactttatactacttttgctggcagtatgtggaccccttttatccctatattgttatgtcagttgtcacgacatagctcattataacacagatgtacaactgttgtgaatgaaattgtgttcccttaacttccctgcaacacatcaactacaaaaactatataattgtttttgtaaacatgtacaaaaactatgtaattgtttgtttttatttatatcaactctgcctcatccctaaaaggattgcgggctacttcatgatgatattaaactagcattaagaggggcaatgagacaagttcttactctttcatgcaggttggaatgcagtggcgcaatcacagcttattgcagcctcgacctccccaagctgaagcaattctcccctctcagcctcccaagccgctgggaccacagatgcacgccaccatgcctggctaattttgtattatttgtagagacaggttttcaccatgttgcccaggctggtctcgaactcctggactcaggcaatccacctgcctcccaaaatgctgggattacaggtgtgaaccaccatgctggcctatttttatatcaatggcttattaacttgtggtatgatcatcagcatatcacctatttctgtggcttagtttcctaatttgtagtgatccctcagattttttaaataagggtgagaagttagaatgagattcatgttctggagaagataaagcttcagagaatgtagagtatgtgagttcagagaggggacaactcctgaaataggtttaccaagaggatcctgtgtacaatgggtgcagaaggagccctgcacaagggggctgtacaaggaggtgaatggggctgaattccagcttagcttctggaggcaggaatgaccttttgtaatttatctacccagagggaatatctttttctgatttgcacaaaggagctttactgtgctgtctgcccctgtctaccaggtttaggtttcatctcagttgctaactctgatcagttggtggggactgcctgaatccctgtatggtgtaagatatctatgggtagtggagggagtaggcagtggcatgtatttgtagattccgagtcttgaacttttaatggtttagaatgtagatataaatatgtttattttgcagtgtttgagagtgcaggctcaagaatcagactgagtacagagtctagctttttacttaccagttttatgtccttgggcaacttccttaatttatctaaacctatctctgttccttatttataaaatggagataatgataatttttccctcatggaatcactgcaagaattaaatgggcaaatgtgtttaaagtgcagtgtaagcatagttcttagaacatagcaagtatttagtaagtgttaactttcgttgtagtaattgttgtctgtcagagtacatggatgtcccttagtgtgtcatatcctagtgtctacctagtccgtctctcttttctccacaaattctacttgccttgctgcctttctcctgggtaattgcaatagctttgcatgttgtctttccacttccagttgagagagatcctatctgatggccctgaatttctaaataaggtgggcataatacaaagccatctgttgaaattaaggggaacaagagtagggctgggactagagatgagaaaatatgtggaacatcccttgcagagcaattaggagggcatctacaaggatcattttgttgccccgagatcagaacacatgaatttgaattgagtcccttcattatcattttagaatttctgtagtagtattctgtaaccagactgagagtacagaaagtagatggggactgtccagggatgaaaatggctgtgaatatgtggaagataaagagggcaaggattctaggagagtcagatggaaacgactgaccacaagttccaagatctggaaccaggcagttgaacctcgattggagatagcaggctgagaacacaaggagaggtaaagacaaaggtttacctgaggataaagactaggttccctggctgagcgcagtggctcatgcctttaagtaatcccagcactttggaaggttgaggtgggaacatcacttgcgcccaggagttcaagtctgcaatgagctggcaaattgtgccactgcactccagcctgggcaaccgagcaagaccccgtttcttaaaaaaaaaaagaagaatagattattccctgaagaagggaaaatggatacataaattgtgatatacacatacatagaaaataaaagggatgagtgaacttgagctaactctaagcaagaatagccagttgcagagaaataccatttatgtaggatttttaaaaatgtaaaacaattttgtttctagactttacttgaagcccccacgtcagtattttaggcaaaattctcaccagtttgtttctctgggctcccaactcgtgatggattagaaagagcgaattttaaaagttaccccattaggtacaataaatgactcattagtgaagttggaagatgcagagaactatgaaatttgacacaaaaaatgataaggcatatgagtttcggtaaaattaatgcagggtaaacagtcttatgcctaaatagcactgttaaggcagcatttgatagctgatattccgtgattatgaccttgtgccatcaaaagtccatttgaattttatttggtatatttttatgaaaagagagtatgtgattattttaacatgttcatgaaaatggttatgacttttttaacttttggaaaataaaaggagtaagcttcatatatttggaaaattcatgcttgtttgaataaagaattactgtagtgtgaaacgaagctgatagcttaagatataaatgacaacatagaattgttccttgagttatattaatatactttttgaatttttttgacagattgtttaacaaacaacagtgaagaattatcaaacagcacagtatatttccttaatctatttaatcacaccctgacctgctttgaacataaccttcaggtattttatatataatatttaaaattaaaatgctgccttgtacaaaggaataatgtgcagttccaagtttttagagcactaattattgatatttatctaaattcatgatgtaaaggagttagtggacctggatttctgctcttaagtaagttcttctacttacaaatcatgaaaacctcagttctctcattgtaaaatggagataatatctatcctgcctatcttaaagtattttgtaatgagaatctggtgagataatgattgtgaaaacattgattgaggtgtgtgattgtttaattaaaacacaatggttttcaatctgacttacgtaggtattttgcagtgtagtatgattctgtctataggaagtttattctttgcctgaaatttgcttaagtatgttttacctaccttaaaaagcactgtttagtaagataactttgagtattgaattatgataataaaaggtagctttaagaatcttaaccttgtagattattgccatctctatctctgactcttgaattttggtattggaacttgcccggtcgtggtgaaggacgaggttggaactctggttaaaatgtagttttgaaacttacataacaagtaagtaatccccatagtagatgtacacatgcttagggtataagcatgtatgatttcttctgtaataaatgtggtaacactgaattatgaatttccttgagaataataaaaattgggccaggtgcagtatctcatgcctataatcccagcaccttgggaggccaaggcaggcaggtcacttgaggtcaggagttcgagatcaacctggccaatatggtgaaaccctgtctctactaaaaatacaaaacttagccaggcttggtggtgcacgcctgtagtgaagtagaggttgcagtgagttgagatcgtgccattgcactccagcctgggcgttgcagagagactctgtctcaaaaaaataaaataaaaaaaattaggtgaacatttctcagaatttgttctgcagcatgttaatagatgtcctatcagaaagggtttagtattccattaaggttgggaaatgctttactacaggacttcagagcctttagtggactgatgtgtgttgtaacactcaaatagcaatttttctataaagtcatcccttttatatatggcttcactttccacagtttcagttacctgtggccaactgcagtccaaaaatattaaatggaaaattctggaaataataagttttaaattgtacaccataaacagtcttcttttcatttaacttagagtacttgtatgagtttggtagatttctagaagtagaattactatattggcagcctaagaaaaagacactagagaaaattatctccaaatatgatgagtttattagggaataagaaagaagtatggtaatttggaatgcactggcaaaccaccagtacatccagtgagggaagggtaaagggaagcttttattagcaaaaagggagaggttcacacaagctgcttggaaactgagttcattggttcctgaggctcaaagccaagttgtcagttcattggtggcgatgccattactgggcaagtgttcttttgagtgcatcttatctgaattactgcagtcctaaagaatggcagtgataaaccatgtgaaagcaggagttgcaatgaagggcgtgaaaggatttcttgtggggtttttagaaagtctttggaaacaaggactctttttgtctctattttgtcttggtctgtcaaaaggtgatttcatcctaatgtctgcaactttcacattattaaaagatatgtgcattttaaatttgaataaaaattgtggccaggtatggtggcacctgcctgtaatcccagcactttggaaggttgaggtgggaggatcatttgagcccaggagttagaaattagcctgggcaaaatagcaagaccgtgtctcaaaaaaaaaaaaaaaaaaaaaggttaaattactccccatctagattatgtgcacaattttagttaaatggattatgtgctcaatttttttttttttttttgagacggagtctcgctctgtcacccgggctagagtgcagtggcgcgatctcggctcactgcaagctccgcctcccgggttcacgccattctcctgcctcagcctcccaagtagctgggactacaggtgcccgccaccacgcccggctaagttttgtatttttagtagagatggggtttcaccgtgttagccaggatggtctcgatctcctgaccttgtgatccgcccacctcggcctcccaaagtgctgggtttacaggtgtgaaccatcgcgcccagccctgtgctcaatttttaactaagtgcacaattgttctgtgaaaaacaagcaatgggctatttcttgtagcagactaaggagagacttagtttttctgtcaagcagatggtgagggtaacattgttgggccaacatcagtgtaattactttgatttttctcttttctctttcatcccaatgttcagttaatattctttcttcatactacaaagtaaagaataaagggcatagaaagcaaaggtgtgaactgactgtttagcaaacttattcttgaaaagacaagtgtcagtctagaagtacaaaatattgagatttagtagcataatattttatgtacctccactatcctcattttaggttatacaattctttggtatttggccctttttgttgactagaaaggcctggattatgagccttgtgataagagagttgagtggggatgcagttttggtgccttttccctttccatttaaaaagttctgtctcagtaagataaactatggtgttcaagtcagcataggcaggaacctattttatttattcagtgagagtaggatagataagtgagggtttgtgatgatgagataatttaggaaattttgtatttagttactagtcatttggcatatgaattattgttatcctcagttaacattagctaatgcagcagttttgaaaatttagaggcacctagaaagttccaaacagtttgccatctgcttcacataccgggtctctaatccttcggacttataatacaggtagaggtcgttttattttatagatgataaaactgagactcagagtgatttagtaacctactcaacatcacagcttagcactttaacacaccatattgtttcccgtcttctagaagcgtaaatagcttacattaaagagatattgtatataatgtttattgtatatattacatgtgcctttgtcattttaggggaatgcacatagtcttttacagacaaaaaattattcagaagtatgcaaaaactgccgtgaagcatacaaaactctgagtagtctgtacagtgaaatgcaaaaaatgaatgaacttgagaataaggctgaacctggaacacatttatgcattgatgtggaagatgcagtaagtactttgcttctgatgtgatacatattttagagtgttattgaatgtaccttcagtatgattattatttttggtgatagggtggaatctgcatattctgtcctcaaccaaaaataactagttataaagtagtaaagttttagaatatcctggtctgttaaaccaaaatggatatttccttagtagtctcatggttaggataaaaataaaacagaaattaattaggtacttcataagtgagttgatgctttggtacattttaatctttttaaatttgaaaatatgtgccatttgcagaggtgtaggtattgttatatgtttatatttcagtttcttgtgcacttgttgctaatttaagaagtttctgagctgggcacggtgactacacctgtaatcccagtactttgggaggctgaggcgggcagatcacgaagtcaggagttcaagaccagcctgaccaacatggtgaaaccccgtctctactaaaaatagaaaaattagccgggtgtagtggcacacgcctgttatcccagctattcaggaggctgaggcaggagaatcgcttgaaaccgggagggagaggttgcagtgagctgagatcgtgccagtgcactccagcctgggcgacagagcgagactccgtctcaaaaaaaaaaaaaaaaaaaaaaagacgtttctggatttcactacatgtttcagaagccattcctcaatcacttcctattccattgttttattttcttatatctattaccatctgaaaatatttatttatttatttttagtctgtcttcctcactaaaatataagccacatgaggacaaggacttaggctttttttgttcactattcagtatttaggacagtatttaggacagtctagcatataatgggcttaataaacatgtattaattgaatggtcaaaaaaaatttttttttctccattttatagcctgcctttacatagggtgccactagatggcaatcatgcctttttaggcactatgatgctggagttttggggcattagaggaaactgagaaattattggctcaaagtagagaacttgaggtcagaattaatgagcttaagaattgagaatgtgtgaattatcacagcagctcagagggaactataagaaccaataatattcgagatggtaaaaagtacttaaaatgaaatgtacagtgtggctttttgtttgtttttactgctccattcctattgcctaaaacagtacctggtttctagtaggctctcaataaataataaatattttgtaaatgaataaaacagggcctaactatattcctcttcatataagttctttgtttgaatgtacaaatggttgacattctagaatactttggtcagtattatggacttagaatatgaaatttctgtatggatataaatttctacaatgactgtattttgaaccaggtttttttcctggcagaagaagttgtcctcaactatcagtaggtttttagaggtatgtattgagtctaaattctagattcctgtttagttattagcaaaataattataagaaattgaagacaagttaaatataaaatagaaagatattgtttgctcttgttccagatgaacatcactcgaaaactatggagtcgaactttcaactgttcagtcccttgcagtgacacagtgcctgtaattgctgtttctgtgttcattctctttctacctgttgtcttctaccttagtagctttcttcactcagagcaaaagaaacgcaaactcattctgcgtaagttttttacaattatttattttatagataaaagcctgtattttaaaaatttaggcctgttttagaaatgatagctactctgagaactcaaagtagattagcctaaaaggactctctgctttaagttttacaatcatgcttactagtgaaagagatctgtgaaaattttataagtgtggacaataaaaagttaaaacagggctaggtgcagtggctcatgcctgtaatcccagcactttgggaggatgaggtgggcggatcacgaggtcaggagatcgagaccatcctggctaacacggtgaaaccccatctctactaaaaatgcaaaaaattagccgggcatgatggcgcatgcctgtagttccagctactcgggaggctgaggcaggagaatcatttgaacttgggaggcggaggttgcagtgaaccgagatcgcaccactgcacgccagcctgggagacagagtgagactgtctcaaaaaaaaaaaaaaaaaaaaaagttaaaacacagtgtctttcagatgattaaattgagaaagctagattacccctggaataaggttggcaacaacagaagaataacaacagaggctttgcactcctaacatggcaatagcagggagatacagacagctcttagacccatcggagtcatggtagaaccacctaagtgtggcaggcaggaagaaactatagctgacataacagacagtttgtttgtgaacaaattggaatcgtagttccaaggagattacttgatataatagtatatgctcaatacatattaattccctttctttctccctatgaaataggccagagcaaaagaagcactaactagagatcccatccagctaaggaagagtggcttctaagtcacgtggctttcttgtttattatcagaatgaaagtacaggcttatgccttaataattttagtttttaaaaaagagaactgtttaggggaaaaggttaattttcttttctctcaaatactatttgtagtctaggaatgtctgatataaaaattcttttccctataaatttcgatcactacttcatctaacttcacttctaatatatctaatttttttaaaaaaaggttacctgtagatcagtttgaactgaatttgtaatgttttgtcaccttaaaatgctagctactagaggggagagtctttgtcatgggtgtatttattaaaggttttttgaaggctgccagcattctgtaaatatgcagtagctcaggtccttaaagcacttacttagaataatagcaaaatattgtgggcacctcaccattgagaaactatttttcagagcttggtatacttttaaagtttagcatcttatttgccttgctaatctatttaactttatggaaagtatttactgcttctgatcaggattttttgtttgctgtcaaagtaaaagtcactaccagtgtcactatttgctatggaagccacaaaccttgtagtcatttcttaattattttctttcttttatttttccattcccacattcccctctcatccccttttaattcattagcaagtatgctgccagttctgcttagtccgtctctctccctccactggtaaaccctagcccaaaccatcttcatctcttatctgtactaacgcaagagccccttaactggtatccctccttccatttcttgatctactaaaatccatacgccacatagtggctagaataattttttaaacacaaattcaccatgtttctctactaacttggaatgcttaatgtgttcccattgtacctagaataaatccaaacttactttccagggtctgctctccaagctgtacatgacctggcccatagccacctttctaaactcgtcacatccattctcctcattgctcatggtgctgtggacagtctggttcctttctgttcttctccactaccaagctcattcacactgccccttttccaaggcccttccctctttacttacctggcttcttgcaagccaggtcttagctctaaagttacttgctcaaagagaccttttatgactccccagtctaagaatacacctctccatttgttcttctgtgccgtctttctttaatggcacttaatcacttaaactaatttaaattaaataattggttatttaaatcatctttttcatttattctctactttatttgtttgtcttccctgcctgaagggaggagctaactgcattagaggtgttgaaattcaccgttagatgatccctgggctagaattttaaaggatgtggggatttatcaggtagggaatataaaggcaaggaagatgtaggtgtatgtactcattcgtatttaacttgtccagtttattaagtcatttgaattttgtcagaagctagatcacttctagtagtttttaacaaagtaattctcaaaaacccaaactattgatttggtttgcctcccaaatctactgaaggcttaagaagtagattttagtttaggccaatgtttttagtttaagttttccctttattttaagctgaagcagtacactcgtccaggaagtcatgttgtgattttccacttacagttgatagaaaccagagacaggccgggcgcggtggctcacgcctgtaatcccagcactttgggaggccgaggcaggtggatcatgaggtcaggagattgagaccatcctggctaacacggtgaaaccccatctctactaaaaatacaaaaaaaaaattagccgggcgtggtggcagacgcctgtagtcccagctactcgggaggctgaggcaggaaaatcgcttgaacccaggaggcagaggttgcagtgagctgagatcgcgccactgcactccagcctgggcgacagagtgagactccgtctcaaaaaaaaaaaagaaaaaaaagaaaccagagacattggtaggccaggcacggtggctcacgcctgtaatcccagcactttgggaggccggggcagacggatcatgaggtcaggagatcaagaccgtcctggctaacacggtgaaatcctgtctctactaaaaataccaaaaaaaaaaaaaaaaaaaaaaaattagctgggcgtggtggtgggcacctgtagtcccagctacttgggaggctgaggcaggagaatggtgtgaacccaggaggcggagcttgcagtgagccaagttcgagccattgcactccagcctgggtgacaaagccgagagtccgtctcaaaaaaaataaataaaataaaataaaaaaagaaaccagaaacactggttctcatccttggctacacatcagaattatctgcagagctttaaaaaagtacaggtactagggtcccattgcagagcttctaaatcataacccctacccaagttttgtgaagctctgaagtagggagactcttagttactcagtataaaatactctcactatgggcatgattgtttttcatttctagaacatgagaaacattcatgtttaactataagtacaaaacatattaccaagccaaatagccatgatttgttttattaaccctaatgactcagtcccattagcatcaaatcagaattgatggtaacgtattttgttagcagccatatgtgtttgtgtgtttatataacataaaactcacttttctttgaggatcattaaaattttttttttacaatacagagttccataataatatacaactcacttttctttgagggtcattaaaatgtttttgttttttttttttcccattacagagttctttcactgatttttttttcatctgaaaatagaagcagttttctttctttctttccaatatgtatagctttccttttctttctcttgccttgttgcgctggtgataaattagtggcatgatgtcaagcaagaccaggtattttcgtcttattccagatcttagggggaaaaatcattcagtctttcacagttaagcataatgattgctatagaatctttgtacatgctctttatcaggttggggaagttttcactgaattcttttaagagaaattcagatttggatttctaacttagacttttagatgtataattttgttattctaccttatagcactttcattgtctaagtacatttatttcacgtacattacatatttaagattgtgatgttcaagaagatataaatgatgttgttttatttgtactgcttctaacaaagtcatgtgcaatttctaacaaagttatgtgtttttaaggttggtagaaaaaagttttaattaggttttaattcttataaggctggaactgttaggattcaaacatagaattaatagataaatactatagattacataaaaatagtaaataatcatgtttgataattaaatttaaattaaaatataattcttttgatttatctagccaaacgtctcaagtccagtaccagttttgcaaatattcaggaaaattcaaactgagacctacaaaatggagaattgacatatcacgtgaatgaatggtggaagacacaacttggtttcagaaagaagataaactgtgatttgacaagtcaagctcttaagaaatacaaggacttcagatccatttttaaataagaattttcgatttttctttccttttccacttctttctaacagatttggatatttttaatttccaggcatagcaatgttatctattttaatgtgtatttgtcacaataacagaacatgcaagaacaatcattattttattttataggcatttgattactattctagacttctggtatcttcttactaacataaatatctcaagtagaaaagtttttgaaaactaacatttaaaaattaatcagttacagtaaagactttgaaaaagaaatgtacttgttaggaagtagcttaattaccccccattgcagtattattgttatatatatagttaatatgttgtacatcacaataatatataattcagtctctagtttccctagagtcatttttgaaaccactgattgcaaacctccctgacaatttttaaaagtagtaagccacattacatttatctttgtaaaaagatttatggtaactggtttcttacttgacttttataaatagtattttacatcttatttttgcctttatttcataagtaatttaaaaatcactggattgctttattatattcagggcaatatggattatttttataccaaggatttgcatcgtgaattacattaagttatttggcaatttataatttattactactttaaatcaaatgtagcattatcacactgtatttaaattgtcattttttaaaggaatattttcttcttaagatatatagaggattttggagaagagagacaggaggggtaaaaccagcttaaggttcagcgagcagaaagggacctgagaggatgctcactgtaagactgttggacagtggtgtgtattgaggggatgaatcggaacgatagtctcatgcagaaaatagtgagattaagatcatccttattgtttctaaattatttcaatcagatgaaagtgatacgattgaaatgaaatcacatagttcgtgctcagaaattctattttggtatgtttgtattagcctttagaaaaaacactccgtttcagaattgttcacagttttatttcttaggtttttagagttcaggatttcatttattaatttcttcttgcttttttggtggaaataggctttgttgtaaacattaagaatataaaatctcctctatatagaaacaagaattttgttaaaaagagaatttgaatcccttcctatactataaaatgctctatagggagacaaagtgtttcttttttcttttatgtttactgtttatgtggagtgaaatataaggctcttggatgtataacatactcaaaagctgttacactttctctgatctgctgtgatccactgaaaatgtgctggggtttgttctgctgtcactgtttatgctgctggaacttagcactgtcttgatttgaagcatatgattgagagccatttgaagcaatcttcattaatgcagataaaacaagtttacatgtgcagagttagaaaatgacatgttcaattctgtaagtggtgactttttgagcacctttcagtattatgtatttgtaaaaaccattgtttttggatataaagctaataagcactttaaaaaggaaaaggcagcctttactattttttctggttgagtcattgctctttagacctagcatcagcaatagatttcaaagataagtattaagcgctaccctaaagtgtgtaagtttttcattttgtcatattgaaaaatgatttgcatagtactgaatgttgacacacagcttatatgtatttacaagaatatctttaagtgtttttttgacacattaaaataaaggaaataaggaaattgtaagctttatttggatttttaaatacatttttaaaatttcagatgtaatttaacatcacatttgtttttcaggtattgagtttagatgcctacttttatgagtaccatcagctggacacagtgtctcatacctgtatttgcagcactttgggaggctgaagcagatcgctggagcttatgagttcgagaccagcctggacaacatagtgaaacactgtctctgcaaaaaatacaaaaattagctgggtatggtggtaagtgcctgtagtcctagctacttgggaggctgagatgggaggatgtcttgagcccgggaggtggaggttgcaatgagccaagattgtaccactgcattccaacctgggcgacagagccagaccttgtctcaaaaaaaaaaaaaaaaaaagaaaaaagaaagtactgtctgtcttaaattttgctgcaaataaaaatgtactttggattatttattgttgaacttgagagatagaaataacatcagatatattttttcttttttttttataattaattttttttttttttttttttgtagagacagtgtctcactatgttgcccaagctggtcttgaactcctgagttcaagagatcctcctgccttagcctcccaaagtgctgggattacaagcataagcaccacacctggctgaacatcagatattttaaagtgtagcccagagtctagttggtaaatgttacttatattgggactagtattttctaatgtttctgggatatgctccctataaaatgaaatgttttcctggaacaatgctaattaggattgcattcctggccaaagacatgacatcaaataagtaatagacatcaccagcaatgaattttgaaaagcaaaaaatactattaacctatataaccatttaaaatttaaaaaattatgttccaagtacctctattttctgagctagaagaaaccttagaggccatctgatgatagattcccagagctggatggatccctagggactacctaatctgactttctgtccactgcatggattcttctaaaaagtatgtcacttatttccctaccttattaagactaaataagtggaacatcatagagctctttatttataacagtcattctttgatagtcaactcttaaatggagacttgagatgcttaaatattgtactactgtgcttatcttgtaaagatttcataaaatgatagtattggttattttaaaaaggctttggcttatgctgaattatacatgtagcaccaaaatgttacaactctactaaatttccttgttctaaactattatattagctataataaatattagtcatacatgtaacatgtttaatgacaaataactttctttatctccttggaattaaagagggcttttaaaagataa

SEQ ID NO: 20 - DNA, 95490 bp, Homo sapiens
ctcctgctccgtctaggagtcaaaatggcggcgaggggaacctggagcagtcccggagcctgagccactgacaggagaggagagggcggcggcggcggcggtgggaggaggatggccgggggtgctggcgccggtgcggacggcggtgctggtggcggcggcggcggaggcgacggcagcggtcccagcggcagcagcagcggcgggaggagcctccggggtgagtgtcccttggtgtctctgaggctgtggagccgaggctgtgtccggtgtggcgcggggcgtccgggagaggaaggggctgttcttaggcgtgggggcgccggggctggggccaagccgccgcgggaggcgctggggcgccgggcggggaggggccagtcgtccgtctggggctgaggcgcggcggcgccggactggccggtctctgtgcgctccgaggggcgggctggagcgcgccgccgtccctggggcaggggcgcgaggtgtggcgctcggggcggggagagcggcccgagggagtcgcgacggcagcccggccggctttgggctccgggcgccgaggggcgggacccgtcgctcccaggacgctgagaaaccgctcccgagacgggggcgcgtgtttacccgggtgcggggttgcgaccgccaggggtgggcgtgagagtggccggcggggtctgggaagggagcaggcctgaggactgctactcccaggggaagttagattgtccgggtaagttactattgcgggataaacctggaattgagctttgacaggttgggagggagacaataccgagtgtttgataaagaagaggaggctgtgcttgttggactacttgaatggcaaaaagtgtgcatatttcagtaccttatttgcacagtgtttgctagctttaccccgagggtgagaactttctcaccgtttttcaagaaactctgaggagtgttgtttctcctgtgaactacaattgcacgtcttcacataccagcacagataataagtactctggagtaggcctaatttacagaagcagtcttggttatctacaccagagcactgttaactctgcgaaaacatcttactgtaatgagaaagtagacatttttacagaattacttagctttttcaactaacaacctttttggggggggggagacggagtctcgctctgtcacccaggctggagaacagtggtgcgatctcgactcactgcaacctccgcctctcaggttcaagcgattctcctgtctcagcctcccaagtagctgggattacaggcgcccgctgccacgcccggctagtttttgtatttttaatagagacgtggtttcaccatgttggccagactggtctcgagctcctgacctctggtgatccgcccgcctcgtccttccgaactactgggattgcaggcgtgagccaccgcgcccggtctggtcaactaacaatcttttgtccctaatagcatctgtttcctttagattgctgaaatgaattgctttcttcctgaaatgtggaagaaagacttgaaattgctttgcaagaatcatacgttgttaatagcaactgttattagacttgtcatggaattttggagtcagaaaaacttttagagatctaaaggtgtgaatattgttttagagccgggaaaccagacccagagaggcgagtgacttgttgtggatcctacagctggcgatggattagaccaaaactaagatgtaggcctctacaccccattaccccatttagagagctcattgttactacactgctgagctgcttacttttcattgattgcattcttcaccattcactacctacccctatccatagggttttggtgtaataaagttgaaagcgaaaatgagagcctctgtctcattctgacagctacttcaagtaactgatgaagattttttttttttcctaacctgaacttaataaaaacggagtgatatttcgtttggagttttcttaggctcatgactacattttcacccagttttagcatggctcattcttgcatgaattcagtaaaactcataggtcaatattctgtcccacaaaacctgactactgtattgttttgtgtcccaacaccagcatttaaacaaggtttttctatcagactctgattttaggatttaaagcacctgtgttgatttctaggttacactacctagtttccaggtatcatcttgagtcacagcatttttatagtgtgtctcaggtaaaccttcggaagtgcagtaatgccaaagttattctgatttcagattctagtcacggaagctcacacatccaaaattacataggtgactgttgaaggtctgctttttgttttgcattagatgaatgatgtggaagaaaggaaagaaacataatattaggttggtgcaaaagtaactgcagtttttgccattaacatatagacttttccctcaagttcttattggaaagatcaggtgtaccaacatgagtctcgaagacaatctagtgagttctactaatgcaaagaatgctgttggtatacagggtagagagagatgagtgagaccccaagagtccaaagaacttgggaaacttcggatttgagctggcctatgaaagtttagatttaccgagagattgtagcagttactttgtgaggaaaaagcaagagtgtaaagtgaagattagcttagggggagggaaatagaaggagactaggatgagctgacaactgaatttcctgaggagaatgttttcgttaggaaactttagtcagttggaaagctatttgtctgtagaagagtttgagtgctgaattgaggagatttctacttttatcctgttgtgcaaggtatagagagcctttgaaagtttggaggccagggattaatgtggtaaaccaggaaggtaaacctgttaatgatctacaggttaagttagagtgaggagagaatgtaatgaaccaaggaagacagtagctgctgtagtaacccaaataggagatcttagacccggataaagtcagtaggaaggatttggatagcagatatctgtgggcttaattgtggtaaaatccacatacaatttaccatcttaaccatttttaagtgtatagttctgtggcataagtacatttacattgttgtgtagccatgccatcaccaccatccatctgtagaattctttcatttggagttttcttaggctcatgactacatatttctaaaccgaaactgtccattttcccttacccccagcccctggcacccacagttctactgtctcttttattttgactactgtaagtaccacgtataagtgaaattatacagtatttgtccttctatatctggcttatttcacttagtataatgtcatcaaggtccatccatattgtagcatgtgtcacaatttgctttctttttaaggctgaataatattccattgtatgttatttttatattttgttaagttcccctcaatgggcacttaagttgcatccacattttgactgttgtgaataaagctgctgtgaacatggatgttaaaatatctgagtctctgctttcatttattttatgaattttatatccagaaaattttacaaccccaccagcagtgcacaagggttccagtttctctacatcttcaccaatacttgttatttgctgtttgggtttttttttcctaatattcatcctgatgagtatgaagtgatatttcattgtgtttttggtttgcattttttaaaaatgattggtgatgttaagcatcttttcatgtgcttattgatcttttgtatttttttagaaaaatattcacattatttccctgttttctaattaggatttttttttgttgttgagtgtggaagttacttatgtatgctgaatatcaatcccttatcagacatgatttgcaaatgttttctcccattctgtaggctgccttttcaccctgttgatagcgtcctttgatgtacacacagtttttaattttgatgaaatccagcttacctagattttcttttgttgcttatgcttttggtgtcatagccaagaaatcattattaaatccagtgtcaggaagcttttcccctatgttttctttcttttttaaagatagataggttctgggtctgtcaccaaggctggagtacactagtgtgattatggctcacagtagccttgaactctggtctcaaacagccctcacatctcagcctcccgaacagctgggactacaggtgcgtacatccacgcctggctaagtttttaaaattttctgaggagatggggtctcactatgttgcccaggctggtctcgaacttttggactcaagtggtcctcccgcctcaacccaaggtactgggattacaggtgtgagccactgtgcccagcctttttttttttttttttttttttttaaagaattttatagttctggctcttaatttaggtctttatgtgtggatatctattaccatatacgtggtttttgcattaccatttgttgagaaaactgtccatttcccattaaatggtcttggcacctttgttgaaaattattcgaccacaagtttgagggtttatttctgggctgtgtattctattccattggtccataagtttgtttttatgccaataccactctattttaattactgtagttttatagtaacttttgaaatcaagaagtgtgagactccactttgttcttttcaagattgttttggtagtttgggattccttgagatgccatatgaattttaggatgggtttttctatttctgcaaaaaataggctattagtattttgttaggaattgtattgaatctctaggttgctttgggtaatgttgacatctaaatactgtcttccagtccatgaacatggaatatctttccatttatttgtgtctttatttcagcagtgttttttagttttcagtgtaaaagtcttttgtctccttgtctaagtttattcctaagtattttattctttttgatgtgattgtagataggattcttgtcttaatttctcttttggattgttcattgttaatgtttaagaatgcaactcatttttgtgtgttaattttgtatcctacaactttactgatttattagttctaatagtttttttgtgtgtggaatcttttttgtggagttttctacatataggatcgtgtcatttgcaaacagttaatttacttcttgctttcgaatttggatgccttttatttttttccttgcctaatctcagctaggacttccggtactgtgtcgactagaggtggtaaaagcaggcatccttggcttgttcctgatcttagaggaaacgttttgagtctttccctgttgaatatgatactaacatgagttttttatataagaccttgattatgttcaggtagtttccttatattcctggtttgttgagtgttttaacaggtgtattttaagaaaaatcatttgtgggtgctgaaaagaaagaatttctagcctggtgagtgagagaatcctggagtcattgacagaataatatattatcatgaagttgatgttttaggcatcatctttgtacatttacagacctgttttgattgataaaaataatactatagttatttagtggggaagactgacattactcaaataattatgcagatgtatgtctgaataactatagtacaactggctcacatttgtatttctagtatctagcactgtgcctggcacaggggcattcagtgaagttgctaattgaatcaagaagcagaagagtaaggtttaacccagtaaagtaaaaaacatattattatataattttttaatggaaataatgtttatttttattttaccagtttttaattttcttgagacagagtctcactttgacagcgggctgagcgcagtggtgtagtcatgactcactgctgccttggcctcctgggctccagcaagcctcctgcctcagcctcccgagtagctgggaatacaggcacgtgccaccatgcctggctaatttttgttgtgagagacagggccttgcagtgttgcctaggctttatttaaaaccattttccctgttaacccagtcttggtacaatggtaataaagcaaaatcaaagttcaccactctagaagaattaggcaagtgactttttctaaaacaggtatagtatcattattaaagtgaggtaacagtttttcttttgacttttttttttttttagacagagttttgctctgtcgcccaggctggagcgcaatggcgtgatcctggctcactgcaactgctgcctcccaggttcaagtgattctctcctgcctcagcctcccaagtagctgggactgtaggtacgcgccaccacacctggctgatttttgtatttttagtagagacagggtttcgccccattggccaggctggtctcaaactccttacataaggtgacccacccgcctcagcctcccaaattgctgggattataggcgtgagctaccatgtctggcccagttttctttttgggtgaatgctagtggaagttagttatcagaatccaaagtttcagaaggaggctttttgctctgtcgcctaagctgcagtggtgcaatcacgactcaccagaacctcaactacctgggctcaagcagtctttccacctcagcctcctgagcacctgggactatgggcatgtgccactatgcctggctaacttttgtactttttctggagatggggtttcactgtgctgcccaggctggtctcgaactccaagactccagcagtcctccaaccttggcctcccaaagtgctgggattataggtgtgagccaccatgcccagctgaggcataatttcaacgaaacttttcaagtgtctgctgattccagatttataatgaaatttgaacattcagcacttatttgcagaacaagttcaaaagttaagaaccaccacgctgtggtggttttttgtttttgtttttttaattttaaaattttggacagtttgtaaatttgacatcacaaattgaatctttcagatacccttactatttcaaataatatagtaactttagaaacataatatacttagtattataaattgacattaaatccatgtcattgtgtgacatgtgagcattatgttaagattgaaatagatggggacacttggaatagctaggaaacactttaatccaatacacagaacattctttaagttacaggattcaaaatagttcccttttagagcatcgttggggtttttagatatagttgtgatagaacaccagactgggaatcaaacctccatttagattctgactgatgtttatagttttatgatcttaaagcaagtcacttaacctatctgaagattaattttctcatctgttaaaataggtatggaaatcttgaagcttttctaccttgtatgtatttttttactccattgttcccctctctattgccactcccttattagtctggactacgtattaaacagcctgccagctaagtctctgcaacttgttctcccactgtacctctccatctctggctattctctatattactatgacaattatgttcttaaaaaacaggccagacacgatggctcacacctgtaatcccagcactttgggaggctgaggtgggcggatcacctgaggtcggcagatcacctgaggtcaggagttcaagaccagtctggccaacatggcgaaaccccatctctactaaagatacaaaaatctggtgtggtggcaggtgcctataatcccagctacttgggaggctgaggcgggagaatcgcttgtccccaagaggcggaggttgcagtgagccaagattgcgccactgcacttcagcctgggtgatagagctagactctgtctcaaaaaaaaaaaaaaaaaaaaaaaaattggagcatgctgcttctctacttaaaatacctttgttaacttcccttgtcgataaagtccagactcacaagagtttatagaatgtgttcaaccttaggtctcctgtcactccagccatgctgtttcttgttccctgtgcctctgtcttgtgtgtgtttatcccattgtttggagttcttattctttgcctattctgttagctgcccatctaatgtctacttttctcttctttcctaacagaaatctgcttttgttcatgcatgcagcagacttggagaagctgatttgtcaccacctccagtagtagagttccattagttcaaaccagtcaaatcatggcatttccctgtaaactcttatttgtaccgatcagatttgaagggaagtagacattctgtttctgggggagaagattctttcctctcttgtatgtgaacaagggaacacaaggcccctattgctaccgacagctgtcttgggatcacaagggatgaagcacttcctgaagatggcagatcagagaggtagagggtatctggatccttggtaacatcatttaaccacatattttattgggcctggagccatccccaccacaggacttctcatgacagataattttcttaatgtttcagacagttctttggagttatttgccatcaaaaatctcttttttttttttttgagacagggtctcgctctgtcacccaggctggagtgcagtgatacaatcacagctcactccaaccttgacctcttgggttcagcagtcctcctgcttcaggcttctgagaagtagccaccacacctggctactttaaaaaaattatttgtagaggcagggtctccctgtattgcccaggcgtcttgaactcctggtctcaagtgatcctcccacctcagtctcccaaagtgttgggattacaggtgtgaaccactgcacctggcccaaaatctcttgattgatacagtcctctttatttttcaagatcaagttatgatacctttaccaacagtcatacattcttttggaactttgcacaatagtcatatgttcttttagaactttacacttctattctttattgccctgtattataattgcttgtatgcctgactcctctacatgactgtatggtttgaaccaaagtgtacgggatgtcgcacagtgtctaatagtgtcacacaacaagtaataggtattcagtaagtgagttaagatgaaatagtaacatgaaagagtgctttgaaagcagttttttaaagagtttctgttctgctaattgtaagccattttttaaataaacatgacgtgtggtgttgtctttaaagtaaaaatggaaaaaccagtgagatcagacattgttttttgcttgcccctcattattacctagacattttcatttagataaaaactatgtcagtctcctggctgtagtcctttacggaaggagcaatattacatttagctctgtttcatctgggattcaattgtgaattattctttagagaaaaattctataatatgcttcatgagacctattcttgtcttcagacttgcctaaaatattttttgcttgcttaagaccagacatgagaattttcttgtaagcagaaagctttgtgacaggactggatgagtttgtagtgaatgttagtgatagctatgacagaagtctcatagcctcaattgcagagtcatagttctgtcacatgcttcaacaataatgtctgataagggaggaaggatggggaagaagagttacaatttactaactgtatatatttcatcatttattggctttggtcaaataaattaaacattaacatagtaatttgtagggttaaaaaaattttttttttctattcgcgttcttgctatgttccccaggctggttccaaactcctgggctcaagcgatcctcaagccttctgagtaattgagattgccacacccagctttgcagtgtttgttttttttaagagacaggatactcattctgtgcccaggctggagtgcagtggccctatcatagctcaccgcagcctcaaactcataggctcaagagattgtcctgcctcagccacctgagtagctagggcagcaggcacacgccatcatgctcagctaatttgtaaacatttttttttgtagagatggggtcctgctgtgttgttgcccaggctggtcttgaactcctggcctcaagcaattcatcccatcttggcttcccaaagcactggaattataggcatgagccacatcacccagccttgtagttatttttaaaatgaagacaagaggaatagagtatacctttaaaaatatatgatactgtgtattggatgattctgaaaggatgtatttgcctatgaagaaaaaccttcttgttttgatgtctggttgttagctttttactttactaaagcccagttaacttttctgtgctttagttccacatctgtaaaattactcattttatatttctctatccactttgaaaattaagtaaatgctctttgaatttcaacttttaattatttaagccaagatctctcttctgtattttttatgtgttctttattgtgggcttactaattcttgaatttaaaaaaatcatttaaatcaagcaatagtaatagtatatgtttaagcatatagtgtatgtttttaaataaataagcaggctgggttttagtggctcacccctataatcccaacactttaggaggccaaggcaaaaggatcacttgagtcctggaattgaagaccagtctgggcaacatagcgagatcacacctctacaaaaaaaaaagtttaaaaattagccaggtatggtggtatgtacctgtagttcttagctattcgagaggctgaggtggaaggatcgcttgagcccagaaatttgaggttatggtgagtagcgatcaccccactgcactccaagcctggttgacagaatgagaccctgtctctaaaataaaaataagcaatagcatatttttttaaaaaacaacaaacaactcttttaagtccaaattcctttttggatcctatggctcatatcttgccactgcctgctgcactctatatagaaatacttttatttccttcaggaatccagttttgttctctccgtgggccttctcatagttagttcccactgctgtttggagcattattttggcattcttctcgctccttctattattttcaccaagaaaagaggaaagctcacactttctattgtcagtcttggatatcatcccaaatgtcactttctcaagaatcgtttaagataaacagttgtattatcagccacaaagaagattaaaaaaaaaaattgcccaagatcatacagtttagaaatggcagagtcagatccaaacttgggcagttttgctccagaagtctttatcgccactgatttatgcttcccctacattgtaattgcctgttcaacagtttgccccactatgagcacctttggggtattgtttgcttgtttgtttgtgacggagtcttgctctgtagcccaggctggagtgccatggcgcgatctcagctcactgcaacctccacctcccgggttcaagcgattctcctgcctcagcctcccgagcagctgggattacaggcacgcaccaccacgtccagctaatttttgtatttttagtagagacggggtttcaccatgttggccaggctggtcttgaactcctgacctcaagcgatccacccgcctaggcctctgaaagtgctgggattataggtgtgagccactgccccccttaaaagaagcacctttggaggaaaaattatgcctgtcttgttcattgttatatccccatgtgcttagcacatactaggtgctcagaaaatatttaaatgaatgaaaattcttatttgagggagagagtgttttgattaaattcttctcagtacctttcatgtagtgtgtcagtaaatgcagtaatgttttcatgcctacttattatacaaagtgaaatttttatgatcaagttaatcatggttacaagctcattttttataacctctcttaattcctttttgccctatactgcgtaacggtatcactttgcaactgtaaaaactagtgctttgtaggcctctttctcatattatccctctgtgaactgttaaaatatagatcatttttaattagtttctaaagggtatgtaggaaattgtataaaataaaattatactagtagatggactctgatcatttatactgtttaaccttttaacaaattacagaggtgtaatttctctgtgtgtagaggttttttaaagtatcccatattttaaaccttgactgttacctcaaaaaaaaaagtggtttatctgtgtccagtagtcacatggtggataatgatgtaaggcatgcacattgtgttcatgtgtttgttggagaagttggaatgtcattatacttcagtagacttttcaaatgaaaaatctgaaagctacttctagctgtaattctgctgtaattctcaatcaggtcagtagacagagaaccaaaaaagtcttcctcctctctgaatgttcttgccaaagcctgacttctttgattaatctttcttttctgtattccttacactctattacagggcttctcaaccttggcactcttgacatttggggccaggtaattctttgttgtggaggactgtcctgtgccttgtgaaatgtttagcagcatccttggcttctacctgttagaggcaaatagtatccttcccctttcccctgtccagttgtggcaatttgaaatgtctccagacattgtcaagtgtgggggttagggagggtggaaggggagaacaatcaccccagttgaaaattgcagctttcctacatcattctgtccacttactcatttgttttaatatcttcccctccctctcacacttaccttttcagacttcctgcctctctgctactgcctcatttctctgaacctttttgcagccatacttctaaaaaagaattgtaaaacatctgttctctccaagttttcacttgcagttcagtttcctcttttgaattctattgagaccacatttttctagttttcctctatctctctggccgttccatttttattttctttatcagttctacctagttggacaatggcatcatctttgcccctttctttcttgttctctgttattcaactctcaagtcttcctttcttgcctcatttcctagtgcttaatgttgtctctcatatgtgttgtcctattcatttttattttttttggtaagaacacaatatgagatctaccctttcaacaaatttttaagtatacaatacattattgttgactataggtacagtgttgtacagtagatctctagagcttactcattttgcttaactgaaactgtatgcccgttgattaataagtctgcatttccccccagcccctgacaactcccctttcactcttcgattctatgaatttgattattttagatactcacttatcattctgggtaatgaccaggcctagataaagacctcatataagtggaattatgtagtatttgtctttctgtgactggcttattttacttagcataatgtcttcaaggttcatccatgttgtcaccatatttccttcttctctgaggccaaatagtattccatttatgtatttactacattttctttattcattcatctgtcaatggatatttaggttgtttccacatcttggctgttgtgatatctattaattgttaagctggtctctgtattgaaatctccttgcctatatttctccatagtttaacatcctgcaaggaccagagcagattttgtctgttgttttttggttttggttgttgttattgttagagacagtgtctcattctgttgtccaggctgtagtgcagtggtgcagtcatggctcactgctcactgtaacctcaaatgcctggactcaagtgatccctcatctcagcctccggagtagctgagactgcaggcacacactatcacacttggcgaatttttctgtttttttgtaacagcctgttgcccaggctgatctcaaactcctgggctgaagcaatctgcccacctcggcctcctgaagtgctgggtttacaggcgtgagcccccgcatctagcttgcacctcatttattaagggttcgttatgagccaggcactctttaaggtctttggactatatagttactgaaataagacacagtcccagtactccaagaacttagtctgtttgaggacatggaaattttaattcattgctcttacagagtgagtatggaaattgaagtgtatcccaaactttctggtagcatataggaaagggatgatttctcagtttgatgtaaacctcattcaagtgccacttcttacatgcaggctatcctggtcactacccagtctgatttgtgtttttatactctcctttactcagttctctttcttttccagcccccaaatcatcagcatttcctatgactcaacacttagcttttcattcattcttctagatccttttctttaggaaatggatttaatttcaagggttcagctgaaactttcaaatttgtagtagctccaacaaaacattttattgtgaagtaatacacatacaaagtacattaaataaatctaacttaaaaaaacattattttaaagctgacatcactctggccatgaaatagagcactgtaagtattccaaaagcccccctcatgcctcttcccaatcataaccactttcttcctccttttaaaggttactgctattctgatctttatggtaatttccttgcagatttttaaaaatagctttattcttgattaccagctgaatatttatcccaaaacaatataatgtcattttgggaggacagtagagaaagacattttatcatatcccgttttgtgcctgtattttgaatccgcaagatcacccccaggtttggtgaggaggaagcacagaactcaacatatagtatgactcagctaagagttactacagcaaaaaaaatacaaagcgaaaatgcccatggggcaacgtccagaggaaaccaggcacaagcttcaagagtcttatcccagtgaagccgcgtaggatgcattgacttgttacaatccttgtgaaatgttgtcttccagggaagcttataagagactcactgcccagggtgtttattggggtataatcacataggcaccctctgtctagcttgtaccaaattccaagctcccagaaggaaagcagatattcagcataaaccatattgtttgcacaaacagtttaggcatagtaaatcacccttattaaatagtcagggaattatgggaacactcccaaaatccaatttcccagagacctgccaagggccatctttgcatgcaggcctttctaaagatagcagtcttaggcctgctatgttgtctttttggcatagtaccttttgctgtttctgaattcaaaatttaaataagtaaaaaatcaattatcactttatgttatgttctttttttctccaccgttgttttctttcctaatgtatcaagattagctgggtgtggtagtgtgtgcctctgtagtctcagctacttgggaggctgagtgctgtagtgcacaataattgcacttaggattaaccactgcactccagcctgggcgacataccaaaccctgtttctcttaaaaaaaaaaaaaagtatcaacattagctcagtgcaaaggttgactactatgatatgattgaaagtatattccggccgggcgcagtggctcacgcctataatcccagcactttgggaggctgaggcaggcagatcacttaaggtcaggagttcgagaccagcctggccaacatagtgaagccccatctctactaaaaataaaaaattagttgggtgtggtggcacatggctgtaatcttagccgctcgggaggctgaggcagggtaatcgcttgaacccaagaggcaaaggttgcaatgagctgagatcgtaccactgcactctttcttatgaaggtttctgtgattaagtttggaaaggatgaattaaacaaagttaaacagatttcttaactacaggactcttagccttttcacaggaatgtgcatgacttggtgactgcctacatgtcctgcctcatctcacgttttttttccctgacccactttgcttactctgcccagatttaatctagtactaaggatcaaattacaattgtctatgttacatgggcattttctcagtttgccacagcaatattatgatcactttaccatcttgaatatgaactgtccctccatctctgctcaattactgtgtcagagcaagcaaacgtttttactatttcattcatagattcagcaaaatttgttaagcacctactatatttgccagacacagttctaggcactggagatacaacagtgaataaaagaaaaaccctgaccttatatagtttaccttatagtggggagtggaaaaagggaacaataattaaaaatacatgttatgcccagtatggtggctcacacctgtaatccttaaactctgagaggccaaagtgggaggatcacttgaggccaagagttcaagaccaacctttataacacaccaagacctcaacagaaaaaataaaaataaattagctgggcacagtggtgcatactgtagtcccagttattcgggaggatcacttgagcccaggagtttgaagctacagtgagctatgattgtgccaccacacttcagcctgagtgacagagtgagactgtctctattttttaaaaaaaattaaaaaaaaaaagactgggcatggtggcttgcacctgtaatcctagcactttggggaggccaaggtgggtagatcacctgaagtcatgagttcgagaccagcctggccaacatggtgaaaccctatctctactaaaaatacaaaaaaattagctgggcatggtggcagatgcctgtaatcccagctactcgggaggctgaggcaggagaattgcttgaacccgggaggcagaggttgcagtgagccgagatcacaccattgtactccatcctgggcaacaagagcaaaactccatctcaaaaaaaaaaaaaaaaagatacattttgctcctaggcatatacttaagagaagtggaagtacatgtctacacaacttgtacaaatgtttgtaacagcattattcataataaccaaaaagtggaaacaacccaaatgtccatcaatggatggatggatgaatgaataaatcaaatacaatgtggtatatccatacaatgaaatattatacagcaaataaagaggaataaagtagtactgataaatgctacaatgtggatggaccttgaaaacatcatgctaaagtgaaagaagccagtcacaaaagcccacattattatatgatcccatttatataaaatgtccaaaataatagaggtagaaattagattagtagttgcctaggattggggaattgaggtgagtgactgctaatggaacttcttttagggggtgatgaaaatgttctacatgtcagaaccactgatggctgcacagatgtatctacaagtaatatagtgtcagttaagcacaacgttctcaagaaattcagtaaaaagtcaagcctaacattgtacacctcaatggctaacaaaagcatcctccagttatttggaaaatttatccatctcgcttcctagcaacagcaggtaattgagttagcttaatacttaggacttaataaaatgttaaatgttagtataccaaatgacttgaaacaataataactgtgttataaactcttaatttaatgttaacttcctccttaatagaagaatatttacccacatactctaatttggagattacaacacaaattgaaagcactttctcaaatattgtcctaactgcttaaatatttatatataaattagttttctgatgtaaaaatgtttgcagtaagaaggaggaaacccagaagttacaaaggaaaagacagagttgtctatatgaaaaatttaaacatttgtgacaaaagctatcatagttttaaaaggcccgtatgaatattttccgtttattattttaacattaatatagaaaatgttgcaaatttgtaaaaagaacagccaaatagaaaaatgggcaaagaatataaagcaacatggggactaatgaatatcagtttattaatttttaagagattaaaatagcaatggcataatttttcctccatcagattgcaaagatgaataatgtccagcattttggacattctcatgcagagctgataggagtgtaaattgcaactcttctgacaatatgtcttcaaattagaaacatgtatatcctttaacccaagaatcttcttgaaatttattctaatgacataatttagactgggcagagtgggcaaagatatgtgtaaaagacttgcagtgctatttataatattgaaaaattggatgtgaccctcaatatggatttggttaagtaaattattacatatctatacaacacagttctatgtaggaatttttttaaggtaaagtaaaattttgtgtgtggccatatttttgcaaccttgctatattatgaaatgaaaatagttttgtataaaactgtcacctggccaaattttaaattttgatatacatatgagtgcataatagtttttaattttaggatttagtgtaaatttagttttcataaataagatagtcatatccacatttaatatttttttctaataattcagtatctcttttaatgatttcttcactggtttgggttttcctaccctgtttaagaatgataatctacaagacttccctactgactactctgggtttgttactctttggagattatgttttttaaatcatttaaacagctaagagttaacagatttcagaccttgcttactatgcatttatagcagatattttatttaagaagtatttcataactagaaatactacaagaacactaagaatatagtttcagccaggtgaggtggctcatgctttgtaatcccagtgctttgcaaagctgaggcaggaaggtcacttgaggctaggagttcaagaccagcctgggcaacatagtgagacccgtctgtaccaaaaaaaaaaaaaattttgttgttcattagctgggcacgctggcacacacctatagtcctagctacttgggaggctggggcaggaggattgcttgagcccaggagttggaggctgcaatgagctatgagtgaactactatactctagcctagacaacagagcaggaccctttctcaaattaaaataaatgtgtgtgtatatatgtgtgattgtgtgtgtgtgtgtgtgtgtgtgtgtgtgtgtgtgtagtttcattttaggataagtcaaaaattcagatactttcctcttcactagactcagaattctaagaaccatactcaactcatttctctgtatttccatcattttctagtttgaaaaattattcgattgttgcatatattagtggaatgtgatgtacttttatattcttttaaaaatgcatttttaatggggaaaaaagtatcagcaggggactgacagctgttatgaattataataggttatattagaaaaaaaccacatggcttaataagattctcctaacaaaaccctaacaactaactaatcttcatttgcagtaatgcaatggaattttatagaaaatgtcaatttaaagattttcatttaacatgaatagaaatgttttctgacttgactatttttggtggtgggtggataagggaaaagactatttttaactacaggtccacattctcttacttataatttgaaatcccaaaagttctgaaaactattttaggggttatgggaggacttaatttgatggcaaacactgacatgacctagatttgtctgccagcaaaaccgaacctaaactaacataggttagtctaaatagtatattttactgcagaatattaatttgtttgatgttacaaacaaattattacaaacaaattagggtgctgtgccagatctccctggggatagttatatagtatacagtaaatgtttggtataccatatgtcatgccaaacttctgtcactccagtgggcatggcattaggttcaagaggccgaagaagagacccagagccggcaaaagagatgtggggttttattgggggcttacatacaaaggagagggtacagtggcagtgggctggacgggagaactgccttatatacagtccagtggcagtgggctgggcagaagaaccacaactgcctgccataggcatgcagtttatatagcatttccacttagcacttccacctagcaacctccacctggcactctttattctacccaaaacttggagcctcagtctcctgtagggcttgtgttccaagagacaggttgggggctcagatgtccttatagacaaggagggaatctctgggttggccactcctgaattccctagctcagaacacacattcaggtgcatctgccatacaaagtcattctaaggatatgcttaaattattgctgtcaggtatgtttactataaccatattatttctctttgaaagcaaaagaaaaaagtgaatttttgaatgtatgtggctccaaagatttctatttgaaaaagaattgtagacctgtattcttaacactctttaactggtactttaagctgatgatgagcattaaatatatattttattggtagaactaagactgagagtgtagtatgtaaccactctataggtaaagtttaattatcaagaatgtggggagaatatatgaaatgtaaaataagctcactggttataggtattcactgtaaataaaaatatatcacttaaaatactggggtagagacaggagaaggaagttactaacttaatttcagcattgctcatagtagggaaccaacggataatagccaaaaaaacagggaatgtaaaatgttgtataaagtataagtaaagttacatatggggcaggcagggactagaatagagtagacagggacagcaatttgtattctttggatgtatcttttttttttattttaactttatactcacttaaatgtttaattatataacaaagttaaaaatgcaatgactaaaaatcaaaataaatcttataaagtggatttcccattggttatataatcacacagagtaaaccattccaagtgacttacatatacagtaatttgtagaatattccaagttgggtatatcctaaagataaaaagaattgtaaaaaaaaaaaaaaattaaaaatattttcatggatcatattggtgatgatagtgttaatatttttattctcaggttgtgtgaatattttgtgataaactattatgtaggctgcattgagaatagagggttttcatatgtgagaaaggagaaatgatataagataatgagattgagtaaaaaccctataaacctgaatttgaattggaagcaacagtataaactaatgataatgtacatttatgtatctatgtacatgtttatgtagatatgtgtgtatataatgtcttagatctttgtactgaaaaggcattaagcatccctattactgagattgtggtttctgaataccatttcccactaaagggaattagggcttctttaaggaaatgaccagtgccaagtcaaaggcaagaaaaatacaagatatgcctggaataagttgtaataccagaaaggtaaggtaacctctgctctcggaggcagaggttaggattatgtcataaggtctcaggaaccaatttgaataaggctctactgtccaaagatgggacagtttgaacttcaataagaataactacaaaggattaaaacctgtcacatagatgtaagtctattaattcataactttttaaaactcactgattgtctttaaggatgctaggaagctattactaattgttttgaaaattagtaaataaaagtaaaaaattactcatttattctgtcctttctatacagactgcatcaggacaactgaatagttgatgagttttttttatagaatttttccagctagtgaataaagaaagaatgatagactatcatgtgatcgtttttcaaccccgttaatggattgctttagttggtgatcattgataactgttaatatcaaaaaaagggaattcaatagacttttgaacttaactgttggaagtacatactacctgccacctgtgaagcagtcttggcaaaaaaaaaaaaaaaaaaaagttttttggtttttttgtttgtttgtttttggaaacagagtcactgttgcccaggctagagtgcaatggtactatctcagctcactgcaacctccacctcccaggttcaagcaattcttgtgcctcagcccccgagtacctgggactacaggtgcgtgccaccacacccggccaatttttattattttagtagagatggggtttcaccacgttacccacgctggtctctatcaatttactgtaaatacaagagtcagaagcacattattaaactacatcatggtaatacatttggcaaaatccaaactataggaaacaaccaggtaacctgatttcttcaacaaaaaaaaattgtaaagggggaggaacccatatgcagagattgaagagacatagtcatccagtcacagtgtgtagaccttatttggatcctaattcaaacaaagaaaaaacaatttgagaaatgttaacactgcccaggagtttcatattaaggaattattgtttattttagatatgatagtctgtagttgctttacatccttttagaggtaaatatggaaatatttacaggttgaaataatatgctatctgagatttgcttgagaatattctactgggattgggtagatagtggactgggatatagttgatacttaaacctgtaattgcagcactttgggaagctgaggcaggaggatcacttgagtccaggagtttgaggttgcagtgagctatgtttgtgccacggcaccccagcctctgcaacagagcaagaccccatttctaaagggggaaaaaaaaacacctgccaattggtaaatgttggttgaaacttggcaatgggtagagatccattaactattttctccacttttttattgtatattttttcatttttattacaaaaattacaaaagtatctcctgcaaaggaaggaaaaacaagtaataggaagggatgagattagagaagcttagtcatttaattgtcctctgtgtttgaatgctaggagatttgatatttatggagtattaatcacaatcaagaaacattttactgttcaacaatacacagcactagagagattaagatctgtccctttacctcagttgggtgataaagtagaaactggagacttaagggttgagtaatagaaacagcagcacagtggacacagaagcatgaggtagacgtggcagcttccttcagaaaggttggtatagcactgaagacttttgagacgctttcttgtttagcaggggtgtggaggttggggggataagacacacactagatgagggattgaaggcctggtctttggtcttggctttgccattttactcttttttttttttttttcttggagacagaggagttttgcccttgtcgcctaggccacacaccttggcctcccaaagtgctggaattacaggcgtgagctactgcacctggcccattttactctttatttgactttggataagtcactttaaagtctctactttgatttcctcatttggagaatagagaatatgcctgtgctgtctacatggaagagttattgtgagaataaaatgacttaacacatgaaaaagcccttggtaaactgtattcccattctgatgtaagatactcccactccagtcattaaaaggaacatgaagttggggggaatgtttaaaaaagggagtggagagggaaggtatgtcattgcttttctgttttaatgtttttttgtgaggttttttccattttttaagttgtcacttaaaaatacataacatttaccattttaaccagttttaagtgtatatatagttctgcaacattaagtacattcacattgttgtgcagccatcaccaccatctccagaactttctcattttccacaactgaaactttgtgcttactgaacactaacttcccagcccctgacaaccatcattctactttctgtctctatgaatttgattactctaagtacttcatataagtggaatccatattcgtccttttgtgactggcttatttcacttaacataatgttcttagggttcatctgtgtttcagcatgtgtcagaatttccttcctttttaaggctgaataatctactctatgtatacaccacattttgttttcccattcatctatctgtggacacctgagttgcttctaccttttggctgttgtgaataattttgctatgaacgtgggtgtacacatctgtttgagtccctgttttcactttttttggtatatatccacaaatggaattgctggatcatataattctatgtttaattattgaggaagcagtgtgtttttaaaaattatttactttattgcttatggaaacatttccacaagtcgtatttgagggtatatgtacgctgtgatccatgaggctttttgctgggaaatcttttgtctccaagtactaatccaattttcttttcttttctttttttttttttttttggagaccgagtctggctctgtcgcctaggctggagtgcagtggtgcgatctcagctcactgcaagctccgcctcccaggctcacgccattctcctgcctcagcctcccgaggagctgggactgcaggcgcccaccaccacacccggctaatatatttagtagagacggggtttcactgtgttagccaggatggtctcgatctcctgacctcatgatccgcccacctcggcctcccaaagtgctgggattacaggattgagccaccgtgcccggccgcaattttttaatcacactcttctaagaggcttagactgtgaaggaatatggatcccaagaaatagtttttggactcaaaatcttgaagaatgattacagataagcctttccttactaaatgtttattttttaaaactaatttcattcagcagttttcaacttaatgcctcctaagtgccaggtactgtattatgtggtgaggatttagtgttgaataaatgaaattcaagtgctgaaaagtactactgtaaagaaaataaactgaagaaagaggatagtgaatgatggggtggaatgttattttatataggctaactagggaagtcttctccaagaggtagtatttgagcaaagacttcagtaaaaatgagagtatgaaacatgtgaagatgtttcagaagagtggtacaggcaaagggaagagccctgaggtaggagtaagaaatgcttttcaagtagacaactcagggatcagatgacagcctatcttgaccagtacctagtacctatatgaggaaatcaattgttgtaagatagctctagaaagtaaagtcacgtctgggtgtgctggctcgtgcctgtaatctgagcactttgggaggccagggcaggaggatcatttgagaccaggagttcaagaccagcctggacaacattagtgaggccctgtctctacagaaaaaaaatgtttttaattagctggacatggtggcacacgcctgctctagctacttgggaggctgaggcttggaggattgcttgagcccaggcactgtgagctatgattgtgccactgcacttcagcctgagcaacacagtgagactctgcctcttaaaaataaaaaagaaaagtacaggaaaactaaaaatagaaaattgttagggataatttatttgcatattctgttaatctagaaaatactgtatttgtggtgtgggagatgtcaggaagatattactgctgacatgacattccaataatgattactacatagaagacataaccttttcctctgaaatgttattttcttggcagaggggcatgtacagtgaacccaaaggatatattttatcatctgttcagggaagacagaatgagacaactgataaagagaatctgagttttaagaaatgatctctaaaaatcttagataataaaatactttaataaccaagtatcttactgatatatatgacagtgatacatatattattaggagaacactcagactcagatctcaagagaggttagagatcacccatattttgctgggtgctgtgcagtaatgtgaagttatgccagaaataactttgcgcctcaagaaataagcaccattacttcttaagactctccatttatctttttagaaacattgataagatatttgtaaataatatcctcatttaaaagtaaatgaattatcttgggagaatgctgtattgtaatacaaggaattttacctttagaaattagatattattaatagtattagaaaacttttgtttttagacttctttatgttctgtttgaattgtttcttccttgataacgtctttttttttttttttttaaagagagatgaggttgttttgttgcccaggctagtctggaactcctggcctcaagcaatcctccttagcctcccaaagtgctgggattataggcgtgagccaccgtgcctggcctctttaatatgtctttcccagatttcaaacccattacctttatcaccctcagtggacccataaattgcttctcctatatgcttcttggtttacagcattgtaaccacccagttatgcaaggtagaaacctcagtcatcgtttccttcttcctctccaccattccccttaccagtttggtgagcattcttcactatgtcttctatgataaggacctcatatgtattacttaattttttattatagatgtctactatgatttgctgttccccacattgcatgtgttgggaacttaatccccaaatctgtatgtcagttgaacgtagggcctttggaaagtaattaggattagataaaatcatcagggtggggccaccataatggggctggtggctttataagaggaagagagacctgagctgacacgcatgttcttgccctcttgctatgtggtgccctcagccatgttagggcacagcaagaaggccctcaccagatattggggtggtcttggacctcccaccctccagaactgtaagaaatagatttttttatatattacccagtctatgatattctgttacggcaacagaaaacagactaagacaagcttctaaacaaatggaaaatagagttttaagatgcagactttcattgccttaacagggccaagaatatctatttcattctgacatacttaaactgtaatatcctctcccagtgtttctgctacaagtgggtagcacagaacaagcaatgggattaaggaaaaattaccatagttataagaaagccctctaataatgcttgtgagagtgagagttttgtctggttttctacttcttgtttttcataagagaccttgttgatgtctcttacagagagggtcttttatagctaaacgttctcaaaacttgttcatcatcacaaccactagtgcttcttttacaaggaccactatatacaagactctaagtgtagacttcagaagaaacttaggaggaacacatttttcacttaacatgccaacaaagattctttaaatagcaaatattctgatgggcaggagctcatcagaatggagtgactagccagtattaagccattatatatgacttgtaactttttcactgaaaatttaaagtaatgggtcccccaccctcatatttatttagactcagtctccgtaatgtgaagaaaaatagaattttactatgtaattacctcaactgctaagccattattgtcttcttatttataagaatttgaataattcatagggctagtcacatgcctattcctttaatgatctaacagtttggaatttgaactgtcttcatgaagactgccctggatgaggaaacctttgagtttctgttttgttctgtgttctcttctgtctgtgcagccatagtctcaggcttactctagggttcacccagcatgtttgcttatctctccagctctactagtggaacccatggtaacttatcaataagaagtatacccttgtattttaaacatttgctaagttggtgtcagaaaatctgaatgttttggctttgaatggaatttaggagaaattgcattttttccctttaaattcagttgatttgaatgtattctctgatgtcagttctatttctctctgcaagtcctctttaaactcaaatctaggccgggcacggtggctcacgcctgtaatcccaacactctgggaagacgaggccggcagatcacctgaggtcaggagtttgagaccagcctggccaacatggtgaaacctcatctctactaaaaatacaaaaattagccaggtgtagggatgcacgcctgtaatcccagctactcgggaggctgaggcaggagaatcgctcgaacctggatggcagaggttgcagtgagccaagattgcgccactgcactccagcctgggcgacagcacgagactccgtctcaaaaataaaaataaataaataataaactcaaatctagactcatttttatcaccatctctaaatctagagtgaaccatctttctgtacactctcaagccaacaataaaaacagttgtccctgattagaacaatcatttcctttattcaataaaatattgtgtgccgggctcagtgctagttttccatatcgtaaacacagaggctccaaatggcaggccccatcaccttatgagagttgattgggcaagttctgcagtctgtcttgcagggcctcataataatttttcaccctctgcttataggctctttttcctgacttttggggaagacttttcaggctccttccagagctacttcagttttgggggattctagctgctagaagacatcaaaacttttggggatgtccaggccaaggcagctcctgcactggctgctgtaggcatcactgctcaggccctctgccaaagaccagataagaggaataagcgactcccattgtcctagagtcaggccttcctctggtggggggtggggaggccgtttcagccctctaattcccattttccatctgttgcttcaagaggatcttcttctgaggttgtaggtcaggatgaagcatttggagtgtgagctctgagggtaaaggtggcagagtaggagaggcccatttgtgtcttcacagtgcagccacattcattcttaacgcaccactttccaggaattggttctctgctttaaatggctagaaactgaattttttaaagaatattttaacatcttttaagatgtagttcgtctagtccaggtcagacctggcacaggcccaagtccctcaaaagacatttctcttttgataggctcctgtttctgctttccgagtggcagtccatattatcttttttatttttttttttaacttttttttttctgagatggggtcttgctatgttgttcaggctggtctcgaactcctgagctcaagcgagctgcctgcctcagactcctgaagtgccaggattacaggcatgtgtcaccatgcctgaccagcagtccatattattttaactcttaaaacaaccttgtaaagtaggtgttattatattgcccccattttagaaataaagccaggaccttattaacacttactttcctggactgttggaagaatcctctaataagtctttctgcatcaagatctttttatagatcaagcatcttccagtagtctttctgtaacagaagtataatggtgctgctttgctcttactactctgtgctttgttccagtagttcctctattgtgttccgaacaaagacccaatacctttggcatttgagacttacctctttttttgagataggatcttgctctgtcacccaggctgcagtgcactggcatgctcatagctcactgcaacctcaatctctaggcctcaaacgatcctcttgcctcagcctcctgaatagctgggactacaggcacacaccactttgcctggctaagtggttttttgttttgtttttgagacagtctcactctgtcacccagggcggagtacagtgatgtgatctcggcttactgcaatctcgtcctcctgggttcaagcgattcttctgtctcagcctcctgagtagctgggactacagtcacatgccaccacgccgggctaatttttgtatttttagtagagacagggtttcaccatgttggtcaggctggtctcgaactcctgacctcgtgatccgcccgcctcggcctcccaaagtgctgggattacaggcttgagccatcgctcccggccctttatttcttttaaaactttgttttatttctaagctactctggaaatgtgagatttagctagagatatgaccattcatcccactttgcctggtcagacctgggctacacgtgttctgtcgtcccctctgatatgtaccccttttcactctcaagcttcttggtttgaataatacatcatattaaaatggggcttggcttcagctcacccccactagcattttttcgtacattcccactaatcacaaaacccacaccactgcctcactggcactatacccactaatcccaaggctttagtcatacaaagaaaatagccattcttctgtgctctcatactgtttaaccatgccttgtgcttaaagaactccagaaactggccttaggagatccaaaatcgaaccaaggttgttgagtgtctcacctctggaaggaatgctgaacaactgatttccagccttgtttttgccagccagacagaccaccagttaactcgtactcaagataaccatcacaaccagccttgctaacctgcatactctacccctcacatgctttgcccagcccagcctgcataccttatccctgatgtcaattcctgcgctttgcctaataaatctttactggctcttttcagggaaccaggctctgctgtctgtctcccttgcgctctagcacagtaggacaagccccagaataaaagctttgtctgggaaatctgtctgtccctttgttaattttcattacatggggagtccaaatgcctatggtctgttataacaatgttgttaccttagatttgacaggagtgaagtattagtatagttttacatttctctttcattatggtttttctttaggttttttgtttttgtttttgagaaagtctcactcttttgcccaggctagagggcagtggtgtgatcatagctcactgcagcctcgaactcctggcacaagcaatcttcctgcctcagcctcccaagtagctaggaccataggcacgtaccactacacctggctaattttatgtatatgtgtgtgtgtatatatatatatatgtaaaaatattttttggctgggcacggtggctcacgcctgtaatcccagcatttgggaggccaaggcagacggatcacctgtggtcaggagttcaagaccagcctgaccaacgtggtgaaaccctgtctttactaaaaatagaaaattagcctggcatggtgatgcatgcctgtaatcccagctactcaggaggctgaggcaggagaatcgcttgaacccaggaggtggaggttgcagtgagctgagatcgcactactgcactccagtctgggcaacaagaatgaaattctgtctcaaaaaaaaaaaaaatttggaaagacagagtctcacaatgttgcccaggttggtctctaactcctggcctcaagcagtcctcctgcctcagtctcccaaagcactgggattatagacgtaatataggcatgagccactgagccaggccgttaattgttatttatattcacatttgccccacattcctatcctgttcctaaagtcagactgaaagggaaatatgtttaaaatgcgaaattcaggtgcctctttttttcccctctgtagattaacatttagtatggaaataccttccagctgggcaccgtggtcacacctgtaatcccagcactttgggaagccaagatagatagatcacttgagctcaggagtttgagaccagtttgggcaacatggcaaaaccctatctctacaaaaaaaaaatatatatatatatacacacacacacacacacacacacacacacacacacacacacacacacacacacacacacacacacacaaattagctgggcatgatggcacacgcctgtagtcccaggtactcaagaggctggggtaggaggattggttgagcctgggaggtggaggttgcagtgagccatgcacgtctagctgggcagcatagaaagaccatatctcaaaaaaagggccgggcacccagtggctcatgcctgtaatcccagcactttgggaggctgaggtgggcgaatcacaagatcaggagttcaagaccagcctgaccaacatagtgaaaccctgtccctactaaaaatacaaaaattagccaggcatggtgacacacacctgtaatcctagctactcaggagggtggggcaggaaaatcacttgaacccaggaggcagagattgcagtgagctgagatcacgccactgcactccaggctgggcgacagagcgagagtccatctcaaaaaaaaaaaaaaaaaagaacaaagaaagaacttccttccccatccatatttcctaaactaataaaccgtacaacttcattaaatttttggaactctgtttcgacgttcttatgttacagatacaggaactgaggcccatagagattacatgtgacgtgtcctacatacatagtaaattagtgacacagagataaccgaatcctagataccttaactcccacagttctttctattgcatgaagcaataaaaagtgtttttatggcaaagatcagcattttcctgagtgtgttatgcaagttcattccttcatgccccgtgggggcagcagggcttctttagatcatgctgaatgctccctctttacaatgaacctcagcactttaaaggtgctcaaatgtcctgaagtaaagaaacctatttggctttgtttaatcctacattttctaaactttgggaaagctctttggaaaatgctggcctagggctttctttttggggctggggtaagggggtgggttagggaggagaaagttgacttctcttttttaaaaaatgtctcatgggttgtttagtctttcttgcattcaacatgattccccgcccccaccccacagttaggtctgccgtgatcactggagcttattttagtttaagacagtcagcatcatctgattgggattgatcatatgctattaagagggagtcccccagaatggtgattctagaaaaaggattcatcagccttttgcatattctgggcctctccaagtcctgtagaccttctcctctcctctcccctctccttgctcctctctccgttgcatcatacaaagattggatgtctgtagaaaagagaccaggcttgcctggagagaacacatcgctggagagattaaactgagactagttctcatttccaacatctacaagtgatggtttagattcagaaataaataacataatactgagcaccatctgacataggattttggttacctgagaagtaatgacattaatccctgagttaattgtgaggattttgagaagaaatattgctgtagtactagaactgtagtcagggttacccatcaggctctggaactggggaacacagggtagactcaagggttacatctcatccaggaaatctgcctcccccacctcccttcccttccaaggtctgtgtttattttagtatatagagctccagtaggatatatgaatgtccccaaatcagttcatcctgaagggagttcccattaaccaggagctaccaggaagagattttccctaactcccaaagacacttgtatttctggccacctctctaaggtgaaaccccagctatcccagcagctactactgcttattgtagcagcaaatggccaaacatccttagctcagcctctgacttccctagtgtttgcaacttgttcttgtttctccagtggggccattgatgtcatataactcttgtataattgctttaggatatctaattgtgctcatcgtaaaatagagctttttaaattttgttttcttttttcttggtgttcttcccttaccagagcttttttttaaaaaaagggatttttgacatggtttaagtattaaaccattgtaatacacgttgagtattccttatctgaaatgcttggaaccagaagtgtttcaggtttgggattttttccaattttgtaatatttgtgtctacataatgagatagcttggtggggtacccaagtctaaacacaaaattcatttatgtttgatacacactttatacacatagcctgaaggtaattttatacaatatttttaatatagtgcatgaaacaaagtttatgtacattgaaccatcaaaaagcaaagaagacagctccagaattttccacttgtggcatcctgtcagcactcaaaaagtattggattttggagcatttcagatttgggattttctgattagggatgctcaacgtgtggcatcttgagtctctacaaaccatacaagattctcagatgaaaataattccatatgtgtgtgcatgcatgtacgtgttaaagtaagagtagtaaattcttgtccgcttctgaagacgcttctgatttttcttcatccggaggcaaggctctattcttctttgtttcatgccataagcatactctgctatgttactaaatttactcagtcaatagaaataaaaaagcaaaacaaacaaaaaaaagaaataataatcgaacttgaaagtgcaaagaggcctagccataggagtgacaccatgccgtcttacctttagaaacacttcagcatgattttcaccatctccccttacactcagattccaagctcatcttaaaagtctttttcccccctcattttggtaaaggctttttattttacatgatagttttattctggatttttgtttatatattttaaactcttttgagaaaggattgtttgtgctgttttttgttttaaatgtaaaccctgagtgagattaggatttgacctataaatgaggccacaaacttggcctccaggcccttattttctttgaaagaaccactataaaagcctgataagatcttgaagattctgtggagctcagctttaaaagtaagatttgttagacttaactggtttttaagtttgaagtggaattaatagaggtaattttagttcctgttttcctgttttgcaagactcctggtcttggccaggagttcaagaccagcctggccaacatggtgaaaccccatctctactaaaaatacaaatattagccaggcatgatggcgctcacctgtagtcccagctactcaggaggctgaggcaggagaattgtttgaacccgggagacagaggttaaagtgagccgagattgcgccactgcactccagcctgggcgccagagcgagactccgtctaaataaataattaattttcatataaatatagtctataaaagattgtaggaaaacacaaatgttaacgatatttttaaacatgaattcataaggttatgctgtgtcactaacagagatgaaaataaattccaagcatcttgacacagttctgtttctagcagatttttgtgataatttgtgtacgtgtttttcactatatttgttaaaacacttcattgtgaggctaggttaactgcctactggtttcttaacaattccaataatagattttaaatggcgttttctcttcttaaactcgttaccccatttagtcagatagattttatatatccagatggtgtaaagatttagaagtatttccattaatcttgttctctcttagattttcttttttgcataaatctcttgctagcagctctgagagttaagtttccatgttcagaatttaatctgtaattgttagaattaccttttattgctactggcctgtccatttaaatcatcatatcacataatagaaagcaggattttttttcagggctttatggggtggatagataaaattttttgttttgtgtctcttgcaatgtgtataataacttctttcaaaattaccatagaacaagtagcttatatatatttagctttaattgtccacctttcctcctccctcttttagtaaaatgcctaattatacagattaaagattgatttttagcaactttattttaaggcagaaaaacaactaatcaattatgtgttatttgtatgtgcggtaccagtgttgacctcttaaatgtttgtaaattgcttacaatgttagataataatgaatggtgattgcctctaaggatttaaaacaaaaattaaaacatttattttcagtccaagtacttttccctgtgttttcaaatactcttcctgtaactatatatttaaattggtttgatatgttactttttactgacttagaaagtatataattggtacattttatggctcaaattgcagctaacacagataattcaagcttaaagatttacattttatgaaaatttgacatgtgaatttgacagcgtgttgttatttgtgaatgaaagcagttttcagtagctttttaaaaaaaactgtgatctgagatacacttgaaaaaatgaattaaattatttttatttcatatcaagaaatggatgaaaagaggctgctggatccagggttgaaggttcataaaggcctctgggattatactctgaagaacccgcagacggaatgcctgagtgactgaagaaaatgggtgctaatgcatctaattatcctcattcatgttccccgagggtagggggaaattcacaggcccaacagacttttataggtaactttcagtttttctaacttcattttcttttgtgactataatagaattgtgttttcggtagtctctgtagatgacaaaagaagtgagctgtagttattataataattctgcagcatctaggttttttcccccaacaaacgtaaatcttaagtctggtttgtatggtttttatcttaaaccacttgtagcacaattgagcttttctatgttttaaccataattgccaattaccttaggcaaactagcagtctccattggtgttaaaacagcgaagtacatatttcctgtgtcccatttcatttattttgcccatacaaatgcagacttgtgtaattaagaagaaaaagaaacatttcacaattatatacaagtaatgttcttaatttacaactctgcctatttttcattcctaaaaacccatgattaagatctatgacaaatgtcctttgatagccagggaacgaaagactttttctaaaaaaatttagactaatttgctctgtttgtccctatttcttatttaatataaaaaatgtaggccagtcacaatggctcacacctgtaatcccagcactttaggaggccaaggcaggaagattgcatgaggccaggacaggagttcaagaccagcctgagcaacattagtgagaccctatctctaccaaaaaaagaaaaaaaaatttttttaattagccaggcatggtggcacatgcctatactcccagctacttgggaagctgaggttggggagaatcccttgagcccaggagtttgaggctgcagtgagctatgatcttcccactgcactccagcttgagcaacacagtgagactccatctctaaaaattaaattgaattgaaaactaaaatgagttaattgaactttttgtcttcctttataaaaaacaaatgcaattttgagtggttcggtaatgtctgcttacagaatttttcaacatgaaaaatgttaaacgttgaaaatgaatgttaagaaaaaataaattttcatttgtttaatttttttcttagggacctcatcctattctcagcaaggctatggttgcgaatcaaagttgtatagccttgaccatggccatgagaaaccacaagacaaaaaaaagagaacctctggtcttgccaccctcaaaaagaagtttattaagcgtcggaaatctaataggtctgccgatcatgccaagcagatgcgagaactcctctctgggtgggatgttagagatgtcaatgcattagtggaggaatatgagggaacatcagcattaaaggagctttctctacaagccagtttggctagaccagaagcccggacattgcagaaagatatggctgatctttatgagtacaagtattgtactgatgtagacttaatatttcaagaaacttgttttcctgttcatcgtgccattttggcagcaaggtgtccattttttaaaacactgctttcttcctcaccagagtatggggcagagataataatggacatcaatacagctggtattgatatgcccatgttttctgctttgttacactacctttatacaggagagtttggaatggaggactcaaggtttcaaaatgtcgatatccttgttcagcttagtgaagaatttggaacaccaaattcccttgatgtagatatgcgtggactctttgattacatgtgttattatgatgtcgtccttagtttttcttcagactctgaactggttgaagcttttggtggaaatcagaactgtttagatgaagagctcaaagcccacaaggctgttatttctgcacggtccccattttttcgaaatttattacaaaggaggatacgaactggtgaagaaatcacagaccgaactttgaggactcccacaagaattatattagatgagtccattataccaaaaaaatatgcaacagtgatattacactgtatgtataccgacgtggtggacctctctgttttgcactgtagcccctctgtggggagtctcagtgaagttcaggctctcgtcgcagggaagccaaacatgaccagggcagaagaagccatggaactttaccacatagcactgttcttggaatttaacatgcttgcacaaggtatgaagttctggtttttaattctgatttatagaattatgtattgatcttccaaattgaaaacacaaccagtatattctatgatttcagtgtttgggatgttacagggtcagtttttttgaaccttcagttatgacatctgagacagattgagggtcagtattaatgtggttctttatttactagtaaaaccaagtattcagtactaatgacttcagagcattaaatgagacttgaggttctttcttccctaatgtaagacgataggtatgggaatatataattaccaacctacaccctctccacccaagctttgaaagagcccagtttcccacattttgagtctcatatttatgttcagtaccttgttgatgtttaaatgtttggataagaataaaaattcattacaaaaatgaagatagtcacatttagatacgaatttagttgaatcagaattgggcagggtttctgatttaaattttaaaatattccttatcttatttttagattcaacttgtacatcaagccacagcctacagcgtgtaaaacacagttagcgctagactcatgtgccttcttcatttaatttaaactaaaatttttttaaaattaggacggcacgttttttgtgttataggcaaacaaattcatgaaagttacattaaaagaagtatacatctgttggtaaatgttagaatcttaacatttcagagctggaaagagaccttttgtaggagagcaaagacagtttgctgttttgacagagtgcattcttagctttctgtgaccatatattaaaagaaaataagctatgtgacatgagactacttgagaaatttagctaatgcatattagctaaaagaacattagaagttgccagttagaagaaaatattaatggtttgggtaagagacatgaatttaaataaggaaagctaagtactgaacttgaaaataatatgtattatatggttaagtcagcctatcaatagggctttgagaaattgaaaaatagccccagttaaataacaacattaagccagtctcagtggtgtgtggttgtagttctatctacttgggaggctgaggcaggaagaccgcttgaggtcaggagttcagggctgcagtgagctgtgatcatacctgtgaatagctactgcactgtactctgggcagcatagtgagaactcagctgtattttttaaaaatctcagtaataaaatgggaacttacacagaagaaggcgttgataaacatgagtgggaaaatgttgagatttcttttacataaagaatcttttaaaaccttactttaccataatccttttataatagatgttttattttattacaacaaccaaaatgtcattaaaacagtttattagtttagaataagaattattgtatcaataatagactatttagatgtcaaactgtaggaaaaatatgttatcaaaaatagagtagcagtttaagctactatttttttctgtaaaaccaaatttgtcagaaaatgcttctacagaaaaatttgaagtttgcaacattaccaaaaaaaaaactatattttctcaaaatatttttatttttgatgccttttaataagaaaccaaattatatagactttgtatgagaaagcattctttaatatatgtttttttgtttgtttttaaaaacggagtcttgatcttgtcacccaggctggagtgcaatggcgcaatttcggctcactgcaacctccgcctcctggattcaagtgattctcctgcctcagcctcttgagtagctgggattacaggctcctgccaccatgcccagctaatttctgtatttttagtagagacagggttttaccatgttggccaggctggtctcaaactcctaacctcaggtgatccacctgcctcggcctcccaaggtgctgggattacaggcatgagccaccgcaccttgcaggtttttttaagttttagatgcaaagtaaaattgtcagccagctctaagatctttggtaatacttgattatttatctagagtttatcttgagttaatttctctttttttttttttagtgtttagctaaaagttgtattttattcagtgtatttaaagatataaaataatactttttgcattgtctaatctggttacttaaaacaagcaaaaaaaaatcttgtgtacaaatattcccttaaatgtggatatatatgctcttctttttccctttgttactcaaaatagagtttgagttatttttgttttgttttttgtaacccatgtggggcatatctttcccccatacccatgaaatattcatattaaggtttataaaagactataactttaacataatttttatctcatttccataggaagaagaatattagctcgcttgaggtaggattttataccataaagctcaagagttcaggttctaaaaccagacagactgggtttcagttctctaccgtgtcttagtttgaccttaaccaagtcacatagcctaagcccctcttttctcatttgtaaaataaagatagtaaaccctataagctatgatgattaaaggaaataatatatgttaaatgatctgagtagcacctgttacatagtaaacattcagtaaatgttagctgctaaactataataatcaccacaacatatgtctctcactaccatatagtttttttctaaaaataactttaagtttaaaaaataattttactaggccaggtgtggtggctcacacctgtaatcccagcactttgagaggctgaggcaggaggatcacttgagcccaggagttcaagatcagcttgggcaatatagtgagacctcgtctctaccaaaaaaaaaaaaaaaaaaaaaaaaactaggcctagcacagtggcccacacttgtaatcccagcactttgggaggccgaggtggatggatcacttgaggccaggagtttaagaccagcttgaccaacatggtgaaaccccatctctaccaaaaaatacaaaaattagccaggcatcatggtacacgcttctagtcccaggtaggctgaggcaggagaatcgtttgaacccgggagatggaggttgcagtgagctgagatcgcaccactgcacaccagcctgggcgacagagtgagtctccatctcaaaaaaataaaaatacaaaaaaatttagctgggtgtggtggcacacacctgtaatcccagctacccaggaggctgaggcatgagaattacttgaacccaggagcgggaggtggcagtgagccaagattgcaccactccactccagcccgggtgatagagtgagactttgtcttaaaaaaaaaaaaaaaaaaaaaaaaggccaagtgcagtgggtcacgcctgtaaccccagcactttgggaggccggggcaggcagatcacgaggtcaggagatcgagaccatcctggctaacagggtgaaaccccgtctctactaaaaatacaataaattagctgggcatggtggcaggtgcctgtagtcccagctgctcaggaggctgaggcaggagaatggcgtgaacccaggaggcgaagcttgcagtgagctgagatcgcaccactgcactccaacctgggcgacggagtgagactgcgtctcaaaaaaaaaaaaaaattaaaaggcagtattggcagacagctagagtggtttggcaagtgggtaaaaggattcttggtgccaggtgcggtggctcaaacacctttaatcccagcactttgggaggccaaggcaggcggatcacctgaagtcaggagttcgagaccagcctggccaacatggtgaaacccccgtctctaactacaaaaattagttgggcgtggtggtgcatacctgtaatcccagctactagggaggctgaggcacaataattgcttaaacctaggaggcagaggttgcagtaagtcgagatcacagcactgcactccaagcctgggcaactgagtgagactctgtctccaaaaaaaaaaaaaaaaaaaaagcccagagagttgagattcttggcctacacagagaatgtgttttatatcagtagggaggagcaggcagtaggcaatcacaagtagataacggcctcaacttacaggcctggcatttaggaccagatttaacttcacttgattttcatttaaacataacaaaatgaatatgtttaattttatttccttcaaagccctattatcatagtgaaggaataaaacaaatataagctctcaaggacaaagagacaaagatacctaaggagaaaacaacaatggggaagatgttgaaatttttggaaaatggaaagcagatagagacttgattactggcttaacagaggagcagcctgtaattagatgctgtaaagggggctactgaggagaagtgaggcagttcacctgttagagctctggcgtggctcaggccaggtggaactaagtactctggaaagaagggatatgcatagcatagaactaaaaagacagagttgattttaagtctgaatactgagggatcagaccctttccccaaccctggaattcatctttatgtatggtattagaaaaggatgtggttttgttcttctgcatatagtgagccaagtattccctactaattccctattcctgatttgtgccactcttaaagctgctatgtatgcatggattgtattcatgcatcagtactcagtctccattttgtcccagtggtccatttgtctgttcttgcattactatcacttgcaacaaggtgacatgcccttgtccccgccccctcaattcgcctctctgctactgcccccacaacaaaacacaggagacctgagattttctaaaattttctgaattttctaaagaaattagagagattccaaatctggaaatagcaacagaggagggtagggatgtggcacagggttgaaatctataattatgtgaaaccctatggtgaaatcacctacttccttaacccctgctgtaataccagccaggcaaatacaagaagaaactggagtcctggaaatggtgaacagctcaaaagtatatacacttacagatactgatgttttgggtttccacagtgaaattacactcaggggttataaaatgaaaaagccagcttgccttccatttgttttacagaggagactacagtcatcaggcctgcctgtgcagcagagctttcaaacagctgcttactgcctcaatcttaaatatgaaaacccatccaaggataactggacatttgaggaaagcttccaaattgagacagagatcagagcaaaaagaacaaagtcctggaggaagcagacaatgaagggagcagaagaaaacttcagtagaatcaaaatatccttatataaaagaactttttatggaatcagtgagacataagcaggatgctattaaagtaaaaacaggagcttttagaaataagatagcagaaatgaaagatataatggaagcattgaaaggtacagttgaggaaatctagaaagtaaataatataataaagagatgagtggagacaaataaaactagagtattcatccagggtctaacatctaacaaatagtggctttagaaatatataccagagaaaagtgaagagaagacagtatctaaggagtaatataagaaatatttccaaaactaaaggaatttctatataaaaagtttctttttcagaacactggggaaaaagagacaattttaaaatgttgcagggaggagaaaaattaggttccatgcaaagaaataggaatcagatggtattgagattttcagtagcaacaactgaataccacaatacagtgaagtagtgtcttccaaaagctgatggaaaattattttaaacacaaaatcctatatttagccaaacagtcaatcaagtgtaaggctaaataaaggcatttttcagtcatacctcgaaaaactgcctgtgtagggatatttcccctgcttccccactcaggcagctgctgggaatgtattccaccaaatgacgaagcaaaccaagaacaaagaagtgaaggatctagaaaatgggctccaacacgggaaggaagcaaagggagatcccacgcatcagccacacagtaggtcttgtgggcattcagtctagcccagaccgggagggtgaaagtctccaaggaaagaggtgtctcggaagaaatcaattactttcaatgtttgaacattaaatagcaaatgacaaagcaattttatggctcttgtggtgcatttatgaagaattagcaataagttcttagaaaatgaagcaaatggaaaaagaagaaatgaatatttccaagataaatttaacagtacatatgaaagaataaataattttagtacacagcatggctcagcagtaagcactatttaattataaacactaaatattgatttaataaaaatagtaatatagagaggtaaatactagaagaaagagctaaagaattgagagtagttacctctggggagcagaactgaaagtggaagggatgtaggacggggtgggggggcgggggggtttagggttagcattgtgttactaccagactttttaaatgatgagcatatactactttgattacaaggttaactttttttttttttgagacagagtctcgctctgtcgcccaggctagagtgcaatggcccaatcttggctcattgcaacctctgcctcccaggttcaagcgattctcctgcctcagcctcacaagtagctgggattacaggtgcctgccaccatgcccggctaattttttgtgtttttagtagagacggggatctgctctgttggccaggctggtctcaaactcctgacctcaggtgatccacccgcctcagtgctggtattacaggcatgagccaccatgcctggcccagaattaactttttaaatgtaaagatatgacatcagtgcccataagaaccagagagaccaagagaaggccacaatcctaaagaactggagactttatcatatctttgaagtctgttaactaatgagctcatgcttataatttgaatgtacagagggctgttacttatctccattggtcatcctgtcagccgatgaatgtggtgaggctcagagattattaactagccttttcccaggtttggaagtcacgaagctgtaactcataccagctcttctgactctaggctcaggaatttgggcatggtaggagaagggagaaatactggacccaatttccagggatgagggtgggaggctgtggcctactcttaggaacaaaacagaaaactatagtgattgaaacatcaacttgtaggagcctcagctgtgagcccgatttgtggctgaacaacaaatcattacccccgacttgggttgagggtaatgtgggctcagctaggaggtttaaagctgtagggtcagggatctgagtagctcactcaaactttgcttcagagcacttagccagagaacaggggctttgtactgtttcagccattgtttcctgaataggtagcattcctatgttagtcatttgacttttctggctgcccagcattaggaccttcttcccagccttactgtgtatgtcttcataggaggcagagcccacctcccagtagaaaagccttaaaggtcatatactttcttctgcagccttctctagtcagggttagtggtacagaaaagcagggactatagagaattttttctggaagcagagtggggcagcaacatctagtggaaaaggagagaaggccatggcagtggtgccattgatgacattcactatccagggacagaatgtaggagctttagtggccagggtcccaggcaactcagggtcttcactgggcttccatgttgtggagtccccatcctgcagccttccttagtccatgtttactgagctgggtctccagcttttcccagcaacactgtagattaatagtgtcctttgagataaattccttttctctttaagccaactagacttgttttctgctattgcaccataagaagcctgattggtagcagtacctatatttaaaagactagtatttaaaactccaaaagagatgactagattggaagagtctccaaagaaggagcacatgtttgatcactttgacttttcataatgaccttagcatatatactgggtaaacagctctgaaaatgtgagaacagtaagagtataccattcattggtaattttttgaggaaaagttcattgtttaggagaactataggttaactcatgaactttaaccatccttgtcataaatactgttgacctcagagcaaaataccccagaattagcaccaacatctacatgcatatttactgtagacttcaaactgcagattttgttttttcatcttgatcacaaatgcatttttcaatctttacaatatgaaatttatttataactttagttccaaaatggactctgtaatgcatttgcccatatttttagtcgtaatggatgtgattatattttattgaattaaaaatctaacagaagcaactgaaagcaatgacctcgttttttcccttagcaacttggtcactttccaagagtgtgtggcttgaaacaaatgcaaaatagcaaagacttactgtccccactcactcatccatttcaccctcttcccaacctccactgtctacatattgacactcttccctctgtctcagttctgttgagttgacagtttattttacttctgtctataattgtctcctcttcagcaaatttgaatgtacttcctagagaagaatggggccaagctaaagaccattatcaacagatcagagtagtaaatgcaggtttcaaacatgcaacataagagttaatctcagtttcatatttatatatatgtttatatataaaacataaaaagtttatatatataatattgcatcttttgttttaaaacttaagtcatttttcatagactacaaactcttcacctctgaccctctgctctcacttttcatttgtctggggggtattttgcctttgatcattaaatgtccaaattctaccctaacctttaagaccgaactcacatgcttactttccttgttttgcttagccattccaagttaaaagtattttctacatcctgagaatttctaaaacactttttattgttcttagggttttatatcttctgacttgttttgaaattacctaggtacccgtctcatttcctctgtcacctagtgtattgtatgctcccaaagttgtgtatcaaaatcttggtcatctttgaataacctgagaacctagcacactgctttattcttagtatactgtcagttacatgttttgaattatttttaatacctttgaaagctgagtaaccttttctttaaaaaaaaaaaaagtggggagtgggatagtagaggttgtaataaattttatccctaaggagttgcaaacaaaatgaaagcacttaaccccagaataggaacaaaatatgaagtattatttataaaagtaagtttacatggggtctaaatggtataactctctaccatttaattcacagtttaatgtcagaaaacctgtctcatcaactcactgtttacttgtcagttcattgatttaaaatagaatatcaattgaatttagaaaattctcaaaagccagtttaatgctgttcatcttttaaggccaaaaaaagtttaatccagaggcagtctttcattctgcactaatttataatttagatcaaagaactaattatatatctcaaatttaataataaaaaggtatagtaatgagaattaaatttatggtaaattatataactcagaatgttaaagtaacttggaaattcttaatctaagttaagtatctttttatttcttacttgtcctgtttgatttattaagggaaaagaaaattttaaggagttgccagtatttctttgtctattgaaagtggaatgtttattcacccttatttatatacttaaaagacattgtattggcctggtgcaatggctcatgcctgtaatcccagcactttcagaggccgaagcaggcagattacttaaggccaggagttcgagaccagcctgaccaacatagtgaaaccccatctctactaaaaatacaaaaatcagccgggcatggtggcgcacacctgtaatcccagctactctggtggctgaggcatgaaaattgcttgaaccagggaggcggagattacagtgagctgagatcctgctactgcactccagcctgggtgatagagtgagagactgtctcaaaaccaaaccaaaacaaaacattgtatataaataaatgttatagcttgttatatggcttttaaaatgtaaatatgtatcaggtagtttgtagctataacaagaagtgatatctctaaaatatgcactgttaatttgtagtagaatccattaaatgtctaaatttctttttatttaaaataatgcagaatttggctggggatggtggctcacacttgtaatcccaacactttgggaggccatggcggatggatagcttgagctcagaagttcaagacaagcctggcaacatggcaaaaccacgtctctaaaaagaatagaaagaaattagccgagtgggtggcacacacttgtagtctcagctcctcaggaggctgaggtgggagcatagcttgagcccaggaggcagaggtttcagtgagctgagatcatgccactgcactccaacctgggcgacagagccagaccatgtctcaaaacaaacaacagcaacagcaaaaattatacaaagtttagttagaagctttctcagcaagcaaaaccttttctctgataataaaattcgaaagatggagggagaaggcaaaatagcagactttgtaaacttatgacatcacatttgtcttgaattactgagatatgtgttcttcattgcaccttgcacataccaccatttatatatgactttcaaagtaaaatagaataattaacatcaattgaggccaggtgtgatgcctcccatcaccaaggaatacaaaatgaatggagtctaagatacaggtgatttggtataaggaagataggactggggaggaggcattactgactaaagagggaaaatgacagaaggaaggaagaacctctgcattgtacaaatatcctggcttttcaaactcagagttgagatacagttgaagtttctgtcttaaaaccaagcataggccgggtgcggtggctcgtgcctgtaattccaaccctttgggaggccaaggcaggcagatcacgcagtcaggagttcaagaccagcctgcccaacattgtgaaaccccatctctactaaaaatacaaaaattagccaggtgtggtggcggatgcctgtaatcccagctactcaggagtctgaggcaggagaatcgcttgaacccaggaggcagaagttgtagtgagctgagaaatcgcaccactgcactccagcctgggcaacagagcgaaactgtctcaaaaaaaaaaaaaaagaaaaaagcattgctcttatctcctaaaacatccagaggaagactatcacaagatgtaagaattctgtttacttttagttgtagaagtggaaaagaaactattccaagaattaagatagattgataatgatattacttagctgttactgtgaaaacactgcactaagatctttttatggaatacctcacttaatctttatagtaacctatgtggtaactgctgtcatgcttcctgtaatagaaatgaggtaacaaatcctaagttgctacctctccaaggctatttcaacagatcaaaagatgaacttcaaaacaagaatgtattgagcacctactctacactcagtgatcaagcttcatgtatactttgcacttcagcagactttagataatacgattgataatattcataaataaaccatctcctataataactctctggtaaaactttacctctgaattaattcatttcaaaaacaattcatgctcattgctgggggagaaaagaaatgatacagaaacatatcagaaagtgtatttttgtctactaccaatgcttttcccaaatccttattagtgatatactgtggccagtttgatggttttccttacaaatctttatatgtgcatatctgtgtgtgtatttaacgtgctatcttattctgttataaataacatcacactatataactttttttcatacttaataaaccttgggaaaatgtttatgtcagtatatatagagtttacttttgaataactgatgttttttaagttactgtctaaaaatacaagtaataggttgggtggtcagataacacagataatactaaaagtgtttaagaactataaagtctcactcctctgtgataactactgtcaacaaaaagtaccttttgggctaggtgaggcggctcatgcctgtaatcccagcagtttgggaggctgaggcgggtggatggcttgagtccaggagtttgagacctgcctaggcaacacggtgaaactctgcctctacaaaaaaaaatacaaaaattagggcacagcggctcatgcctgtaatcctagcattttgggaggccaaggcaggcagatcgcttgagtccaggagtttgagatcagcatggataacatggtgaaactccatctctacaaaaaaaaaaaaaaaagagccaggcatagtggtgcacacctgtggtcccagctctttgggaggctgaagtgggaggatcaagagcccaagaagcgcagattgcagtgagccaaggttgtgccactgcactccagcctggctgacagagtaagaccctgtctcaaaaacagaacaaaacaaaaattagctgggcgtggtggtgggtgcctatagtcccagccactcagaaggctgagatgggaggattgcttgagtccaccgaggtcaaggctacagtgagttgtgattcagcctggatgacagagtaagatctgtttcaaaaaaaaaaaaaaaggtgcctttttataaataataccttcaaaggaccgaatcttagttcagagtatatatatgatgggactgctaaaacactcggtgaatataaactgtccagaaattgcctggcttcaaccattttttcatatatttggtctctattgtaaattaacatgggctggccttactaaatatgtctccacaaggggattacttgatatattaaaagactttgagctctgttacgattctttgcactaaaacatttttatgtatctcatacttaggtattggcatgtttatgtttataaaacttctgataaatgttatacatgtcatgaaatttaagggtgaaatatacatacatctgaaagtagtgccaaaaaactgaaaatatatttgcacacttaaatgtctttgtttctagcgatattcatcttcaaccataatagccttttctgaagtggtttgtttggtttttatattaggttttcgttgtcagtgttcctttctaattgacgtttacattgtttacattaaagaacagtgctgaattttgaaaccgattcagtaaattttctctggaaagtacatgggcattaccttgtttttctaaatcttttgacatctgagcttgtatctaattatgagcagtcagaagtttttctaagctaaactgcatgattagttgttatttttgtgcctcatcttaaaccctagattgatagttttttgtttataagtatgaacagtaaaatagtaagaagctaaagttttctgtggtgtgaacaccacttctaaactacattttgatgtcaaatttttagaggcagtagattaaataaaagtagatggatacagtattatagatctgatcatcacattaggtctataaacctgagagaacagctgctgtcctagttttcaagcaaataaaggtaacaatgggacattattggagctaaaaaagatatagcctatcaactcaaataagccccttggtatagaattagcaccatgattcctatactcatttaacaaacacttattgagctcttactgtgtgccagaacctgagattaaagtaatgaaaatgatagtccatcagtctggccaacatggtgaaaccttgtctctactaaaaatacaaaaattagctggacgtggtcatgggcacctgtaatcccagctgctcgggaggctgaggcaggagaatcgcttgaacccgggagtcggaggttgcagtgagctgggatcacgccactgcactccagcctgggcaacagagcgagactctgtctcaacgaaaaaaagaagaaaaggatagtccagtgttaagtaccaataggcagttagagtgtgagtgccctaatagaacactgggtgctgggggagtacctaggaggacgagaagccccagaccccaatatggaaggggagggcaggaggacatatcagaaacttcccagacaatgagacctggagtaggagttaagcaaagattggaggtaaaagcgagcatatcaggcagcaggaactggcctagagataaatgacagctaggcctttttggctggagatgctggggttgcaaagagaggtatggcaagaaatgaggcaacagaggcaaacacggctataagataaagaattcagtatactaaactgagacaattggctttatcctcactatcataaatcttgtggcctgattacatttgtattttctaaaagctctctttggatgtagcatgtgaagaccgtaagaaatgttctagaaatagtgagggtcttaaaagtacatacattctgctgtaagtagatgaaatctgtaaattttatatcaaaattactaattctttttaaaagttttatgctctgtgtattcatttgttcaggagaatttgtggggcacctgttctttttcaggcactgtgtcaagcactttactcacgttgtcctctgtggtaggtttttcctccatttacagccaaatggggtaccaaaaattcacctaagtgctgggattacatgcctgagccactatgcgtggccaagactattaaaagggacagaaacttgaaagataggcttctatatggataaatagtcatgtaccacataatgatgtttcagtcaacagcagaccacatgtacaatggtggtcctataaggttataaaatacgtacttccactctacttttttaatgtttagatgtgtttagatgaacaaataccattgcattaccatgttacagctagaaagtgttaaggccaagatttgaatcctggtccttgtgattccacagctactcttccacaggtagggggaagagggaatatgatctctgaggagaaatcatctgtgaggtgcactgttttgaagggagcacatgatcatatgtaaccaaccagaagatatcagaaggttttctgaaaaactttttttttatatatggagtttcagccttgttgcccagactggagtgcagtggtgcaatctcagctcactgcaacctccgcctcctgggctcaagcgattctcctacctcagcttcccaagtagctggaattagaggcgtctgccaccacgcctggctaattttttgtgtttttaatagaggtgggatttcaccatgttggccaggctggtctcgaactcctgacctcaagtgatccacccacctcggcttcccaaagtgctgggattagaggcgtgagccaccacgcctggctgaaaaacataattacatggctgtaccccaaaagctttggtttttcccttcaatgatattcttaattccattataataatttactattcatcactagtggggtaatggtctaaggatagtaaacaaaatacaggtgtaaatgactagcttttgttttcagataaagaggtgtgaaccgctgaatttttcacctgctgagtaggaggatagtttttatttaacattttgataaacctgtgacaggaaattatacatttgggttgtcactgtttctgttctcattataggtgtttgacttgccctgctctcttcagactacgctccctcccttcccccttgcacatcccgcaaatcctgtgcttgctttggtagtagaatacatcagtacagtgcgtacgcttatcagggaactttgattatagaaatagctgtcattcatttaacatttaccataaggtaagcaatggactaagagctgtatgtatattatttaatcctgaaagtaaccccctagggtagacggtattatccacatttttcagataaggaaacaggcaaagatttcacacatcacacagctaaagagaattggaattgggtttctggtcagtcccactctagtggtatatcctttctgtctcttccagcaagatgcctgcatataagaatgtgctctatttcagagatttcaggcatcctgtaggtcccagagttagctccccctgcattacagtagagggctatatgtggtgtctttgtgcagagaactgacatccccatgaatgctttcccttcattatgctattctcattaccccccatgcttaaatgtaaacattttaaatgccgtattagataacactaatttatgaagtaaacattaaagaaatatcaatctagtcaattgagtaccttaagaattattaacctgagccgggcacagtggctcacacctgtaatcccagcactttgggaggccaaggtgggcggatcacctgaggtcgggatttcaggaccagcctggccaacatggtgaaaccctgtctctactaaaaatacaaaaattttctgggtgtggtggtgcgtgcctgtaatccgagctactcaggaagctgagatcagagaattgcttgaacccgggaggcagaggttgcagtgagctgagatcatgccactgcactccaggctgggtgacagagtgagattccatctcaaaaaaaaaaaaaaaaaaaaaaaaaaattaatctgtgtgtgtgtgtgtcgtggcttgaagagaaatcgttcatgaattgtgtgtatgctttagcttcctctactaagttactaaagttattccctagaagttttcagctgcttttccagctttgtttgcttttgtctctcacacaacttgtcagaagctgtaagaataaagaatataaacattgtgtaccttttcacacacatgcagcatcaatctcagtgattgcctctttcccattagaagggattaatgttctccaggtagatagccttctcatttccagtattcacttggttttgtagtcagtgattaattttttacagagtactaaggaaaagaacttctggcagcttccatagcctggtggtacttttttttaatttaacttttaataggtaatacattcacacggaacagaattcaacatggtattctgtaaagagtcccccacccttccactttgttccccagccactcagttgcccttgacagaggcaaccagtgttacaggttcctgtgtacccttccagatagataatccagagattgtctcagaacataacctaaaatgtattgtaagggagcatgaaaagatacttagattggaaatatagtattagtaatgcctgactggcatttagctcttgcgggaaaatcttgtaagactttttgagacaaggtctcgctctgttgcccaggctggagtgctgcagtggcatgatcacagctcactgcaaccttgacctcccaagctcaatcaattctcccacctcagcctcccaagtagctgggactacaggcatatgccaccatgcctggctaatttttaaatttgtttttagagacagggtctcactgtgttgcccaagctggtcttggactcctgggctcaaaagatctgccccacctaagcctcccaaagtgctgggactacaggcgtgagccaccatgcatggccaagactattaaaacggacagagacttgaaagatacgtttctatgtggataaatggtcatgtaccacataatgatgattcagtaaacagcagaccacatgtacaacagtggtcctataaggttatgtaataacgtactttcacagtacctttataatgtttagatgtgtttcagtgaacagataccattgcattatagttgcctacagtattcaatacagtgacacactgtacagattcatagcctatgagcaaaaaaatggccttatatactgtgtaccctaggtgtgtaataggccttaaaccatctaggtttgtgtacgtacactctgatgttcgcacaatgatgaaattgcctaacaatgcttttctcagatggtatttctgttaagtgaccactgttaagcaactttaagactacactctgttatgcctctttacccaacagggacaaccaaattccaaatattagctacaagggtataagaaacaaaacacagaaaactacaactttaaaaatttttttgccaaactataatgcatccttgcctaaaatacaaattatatattcttcccactgttcagagaagtggtgaagttaggtgtgttctgagaaaagaaagctgaagaagataaaaggaatagggatacaaagagcaaactgaagtgattaggattgtccagtctgtcagaaagtatattactaaggtggccataaatgtagtgcaacaagtagaccctaagatgaaccctaatctccgttttctggtattcacacagtagtgggttatatgtaggttctatcccttgccattctcactccacctgagaatttaggtagccccccactgtgtaccatagccttttgtacacccctttggtagtacttactacatagaggtgagattgcctacttctttttctacccttctagaacattgttagcttcttgaaatcaagagctgtattatttatcattgtatccctcacatgtagtacagagcctgcacaaagctcaataatttttttaaatgaaagtctagaaaggtaacctggaatccagggctgaatgacccattagtttgaccaaaatctagagtggcaattaaaaataacattacttcttttagaccagtgtcaaaactgtagatttttgtatctgctctttcttagcctgggttccctccaaaaagtagagcctcgtataaggacttgcaagcaaaaagtttattttgggaagttctaccagagaataggagtgggtaactgatgagtgaaatggaatgagaacaagccaatacaagcatgtgttctgagctgatcactgctgtggtcaatcaggcataatcctactggaactcactgatgagccacatggaatgtacttcaggattgtcttccagagggaagaaagaggggacatttacctaccaccttccatccctccattggaaaagtgtttccaatagggtgttcactcccttgcatctcatggtttgcatatggacaggtgcctagcagatttccagaggtgctgactccaagggtcacaattttcacagcagacaacaaaagatacaaaggtactgctgaggcagggtgctgtaactgggctgctgtggtgaaaggcagagaggttgtgcagtgggcgcaagagttgctgaatttagtctacttcttgcatcactcagatcagtttgtgtgctccatcatcacggaatcttcaagatggtggccagccacacctctacaaaagactcaatcatggaagagattgaaactagattttcatcattctttgccaatacttcagcaggcctaggcagcctactaggtgtgagccagaccttcatcccagaggtatttgagctcttagtttctttattagtagttgctacaatcactaggtctctgttatccctcagcaaagaagcaccagaagatgctgcagtgaatcccctgggttctgaatgaactgctgttgtatagccacagaccttgcacctcatccaacacaggatccacttgtacgagtgtaccttcaggacctgccagtgcatatagccaggtcttaccattctttaggtgcctacactctttcctcccagaacagggactgtattttcccaatcagactgtgctgggaacatgatcctcattattggtttggaggtagtgagagaaggcaggaactgatcttaaagagaacaagcattatcttttcaggcacctgcagggtctccagatgaaggaggctgctgctctctagcaaggagttgggggagctgcttctcctagcccaaaaaattcaggtaaatcttggggtttaatattctcagctaagccaaccaaatatccccattccaggtttctgtgtccaagtgttcctaccaggacccagattttatcatagaacacctgtcaaggctttctttcatatctcctttgtagttctgatatcttttaaattaagtctggagcctgaattttggcaatctgccccgcagctgcaagaaatagggtcttttcagacactgacctggaagtcttcagactttgaagaatgcctagatttaagggttggctaacctgagcctgtcattctgtttgttcatggcctctaaagttgttaatccagccagtatctaggccttatagtcactaatgtttccattccattcaagtgccaccatgattggtgatctgatactttaccttccacatgtacctcattttaatctgctcctggtgttgtcatgctactatgtgcaggggttatcaccatgtctcctaccagtaggaatgggagggggagaccttttgccatttggtcagtgagtaaggtagatctagaatctcattcaagaaccttgttttctagggccatttctgttatctttgctgggtgtctcctcccattccccacagtgcatgccgaaagcacagcccagatcaaaggctgacatgcaggtcatttagtcagtaagtatcccatgagcaggagtgagggggagcagtacaagagtgtgtcattgagctgatcaccactgcagacacctgggcttaggctcttcatcagaattgtcctcctgagaaatagtagagaggagcattcatccaagcagctctcagagtcacagcatctaaggaccgacagtgcagaacactgaggcgcaggttgacttgtcttctcgcccttatatctgacactcagtttttgctttggatccggaattcctggttgccttttaaaaatagatttgtaggtgtgatgtgatggtagtgctgttttagaaaacttaaacctttcaatagtgtgctctgtatgcattggaatcctgggtggagggagacagtaggaagcttttcagtaattggtatatgagatgctaaggatttgaactaaggtggtattctagtgggaatggaagagaggctaattgaagggtgttctgaaggacaaatctgtaggacacattggttagatattgaggtcaaaggagggcagaaaggcagagtagaaattaaagatttatagggtactgtgtagacacatttctccccaatttccagtgtaatcctcagaacttcagattctttcagctgacatgagaaaataagactcacaggatgtaggtttgtttttgtgtttttgagacagtctcgttctgttgcccaggctggagtgcagtggtgcaatcttggctcactgcaatctctacctcccgggttcaagcgattctcctgcctcaacctcctgaggtcccgagtagatttttagtacagatggggtttcaccatgttggtcaggctggtctcaaactcctgacctggtgatccgcccacctcggcctcccaaagtgctgggattacaggcatgagccactgcgcccgcccacaggatgtagtttttgtttgttttgtctttttaagacagggtctcatctgtcattcaagctggagtacaatggcatctcttggctcactgcaacctctacctcccaggttcaagcggtcttcccacgtcagcctcctgagtgcttgggactacaggcatgcaccattatacccacctaatttttgtattttttgtagagacaaggtttcaccatattgcccaggctggtctcaaaactcctgagcccaaacgatccgcccgtcttggcctcccaaagtgctgggattaccggtgtgagccatcacacctggacaggatgtgttttaatctggtacaggctgagtgagggtcaagaattagtgatgcagctgcctgaatttaaaacctatggtctttcacttcctgccacactcacttccattatttcttaatttcttttctcaggattctgaatcagtcatgtactggttagtaagaaagaattgaagcaacttttctctcgagcctgtttgtacttcaattcttatttctaactctggtgcctctgaagaatcaccatgccaagtctaaggccggccctcctctaaacttacgatcttgttttatgttgcatggcaagctgtaatctccctgttcctttttcctttcccccttgcctgtttcctccttcctctttccaccccgacctcaatatgaatctggaagtcgtttatatatttcctgatggacatgagccagcggaaaagtttcccactggtattggtgaaacaaatagggtggcattgtaggaataacaagtaagggggaaacaaagatcctgacagtgtattcaggagaactgtcaacgttgaggctatttttagttaccagagggacaaacatgaagaggagaaacaaaaattgataataaaaacagaaagtgatcctatttaacatgcagcaatacagtcatttgtgttactgaatttcagattgatttgttagctctttaagtctaaaccttcagccttggtcattcattcctactggttatgtgactcaattttttgagggaaggtatttttgcttacattaaagattagaaagaaaatatcctagtaaaagagaatagaggaaaggattaaataagtaggagatggatctgtaaagtgtggttatcacacaagcaaaagaaattgtaagaagttgactttgtactacctgccagcctcccaagagcatcactgaaagtctgcctgagcggaatgtattggtgccttttatccattaaatgccttggctacaggtggaatttttctgttaccaggaaattgttaataaaagcttttttttttttttttgagacaagagtctcgctctgttgcccaggctggagtacagtggcacaacctcggctcactgcaacctctgcctcctggattcaagtgattatcctgcctcagcctcctgagtagctgggactctacagacacatgccaccacacccagctaattcttgtatttttagtagagactgggtttcgccatgttggctaggcttgtctcgaactcctgacctcgggtaatctacctgcctcagcctcttaaagtgtgggattacagatgcccaccaccacgcttggctgttaataaaagcttttggccaggcgcagtggctcacgcctgtaatcccagcactttgggaggctgaggcgggtggatcacctgaggtcaggagttcaagactagcctggccaacatggcaaaatcccgtctctactaaaaatagaaaagttagccgggtgttgtggcaggcgcctgtaatcccagctactcaggaggctgaggcagtagaattgcttgaacccggatagctgaggttgcagtgagctgagatcacgccactgcactccagtctggcaacaagagtgaaactccatctcaaaaaaataaaaataaaagcttttgagttgatctaaaaagctaactggtttattagtcaaccgttgctgtgtaagaaacaatctgagaacctcagtggtataacacaatgaacatttatttctaataagtttctgggttaggtggggcatttctgcttcagtttgcagcagctggggcctctctcattgccactgtggatcagcaggggtggctgtgttcccagggctgcccattctcctcctgggaccaataagctagtcacagcatacttttcacgtggtaggagggaagaaggcaagcccagttccctaaagaggaaagggactctagacagagcagtactattcaaagcatgtctgcagtgagtgagataggtacagaaattaacaacaagcatttagaaactaaacaattgccacaatattcaagcggtgtttttgctgaattttactaaagtattggtccaggacacgttggaaatttaaaaagaaagaaaaaactgtagcatgactcgcgatagtttgcaaagtgccgagagagaacacatgacattctgctcactagaactgactccctgtactgcccatgagtaagcattctgatctacgcatgtgtcatgggtttgtgttaggatcactttgtcaccaagagtctgaccatctttgagtgtgctgatggtttcgtacctacaggacttgtccattaccaaggatgtggcaccgtgtaaagcctctcagcacccacttgttggcctttccctgccagcatcccttctgccttgctgctatatttacattttcattccaatattgataaccttgacaaagttgtattatcattaattgaaatcctttaccatcagattaaaacattaattttgacattataagataaatctctttttaccaacattccagttttttatctgtcttccttttacatttttgagttaatatcaccatgtttggtgtatttataaggtgctttctgctcgtgagagaagtagttctaaataagttctaatgagcattgattagtaaaagtcctaagttagagctgggtgcagtggcttacacctgtaatcctagcactttgggtggccgaggcgggcggatcacctgagatcaagagttcaagaccagcctggccaacatggtgaaaccccgtctctactaaaatataaaaaattagccgggcatgatggtgggtgcctgtaatcccagctactcaggaggctgagacgggagaatcccttgaacccaggaggtggtggttgtagtgagctgagatcgtgctgctgcactccagcctgggcggctgagcaaaatctgtctcaaaaaaaaaaaaaaaaaaaaaggtctaagttagaggcataaaaggctgggaaggggaacttttgggaggggaaggaaggatatgtttaggtaggacttgtttcttcctagatgtataaccttgggtaacttatttaatctttctgagtcttagttttctcatctataaaatggggatgataataatagtaataataatacacccttctttgagaagaagtgctaaaattaaatattctaaagtaagcagttaacacagagcctgatacatatacataataagttttcaagaatgttagctactattattatttgcttttagttaattatctactaggtgccagacactatagaatcagataagatggggcttttaccgaaaaggaacttagtctggtggaagagtcagacaaatatatataagaaagatatagtagtatgagagttttgtgctgttacagacaaacacagggtaccagagaaacttttagataggaggaacacctgacctaaggctttgaggagcagtatcaaagtaggctcttaaaagaggcagcatctaagctgagacttaaagatgcagaggagttaagaaaaagagttaggggcatttcagaaaaatggaacaacatacacaaaagcctggaggtgcaagcgattggtggacttctggggaattggaagggacacagtatgacgggtgtagagtctgcgcagggatgggctggggagtaggcaggtgccagatcatcaagggagatgtagcttggactttttcttgaaatcatttgtagcatgaagttattgaataattcgttaaagaggccatatataatttacattttaaaagatcattctggcaacagtacagagagcagattagaaagggaaagactggaggtgggaattttttaaaagccatttcaataatgcaggggaaaagtatcaggttctgaaaaggaggtggtaaaaattcaatggagattctgtggaggggttgaattgaaaagaagaatgaacagcatctggtgatagattggatatgggcatccggagaagaacccaataatagtactgagatctctgcctttggtgactgaagaggcccagatttcccagaggaaatgaattgactttggcatttaagatgtctgtggaaaatccatgtgaaagtcaggtgtgactgggagtcagctcaggcttggagctatcagctgggaagtcagggatataatgaggtgaaggccgtggggcaagtgacatcaccaggcagtgaaaagagctggatattcatggtactcggcttaggtactccagactgtttgagcaaatgtagagtgtcaagagtatggtctcatttaaatcccataacaaccctgtgaggtaggaaataatctcagctttgcagatgagaacatttcagactcttaaagagtgaagtgatttgcctaaagtgattttgctactgagtggcagcgctaggatttcaagtccaatctgattttaaagcccattttttttcctactgtatcctgctgctttgtaaacctcagcagtttaaatatttgtgatcatgttatctttcattctttttcttcacctctgccagtatcctggtttagtaggattgtgacacatcattttaaataaccagcttttctctcatttcccctgcttcactcccaaacacatctatgagattgcctttcctatcagattaactcatcccactcaattctattccaatgcccactttaaaacaacaggccaacagaggtcctccactggctactgaatgaggtctgtcctcctcagcttggtattcaaggctcaaaggctcgtcataaaatgacgactgttgaaaactttcccatatttcccacttctcattagcacatcttcacgcctttgggtgtcatctatatgtggatataaatgtggtggtctcattgtgttccttatagggatattcttttagtgcttggaataaagacatcttttatttgctctgttaccatcttatagaaacggttttgtctttgtgatgaaatcagcttggatgtcttctgaccttagttcctttccagtgtcagggttccttatactccatccctaatgtgacgagccagcctctgttctgacactttctagaaggatcctttttttaatgggagaagaggatggaaattctaattgttagaaatttcttatcattgaaccaaaatctccccacttttaacatctgtctgtttcctaggaacaacggataaatcagttatttctcctctgcctcgtgaagaggcatttaaagacagctctcatgtctctcctcaggtttctcttacataacccaaatcatctcttgcttggagcttttttcctgtgataagttgcgaactctctactattcccttgccctcctgagactcttgcagtttggtcagtgctaatctaaactgacccacggggcccagaatgacacagcactccacagaaagcagcaacatgagtcctttgattacggctcaatgctcgtacctgaaaagcctgagattgcttcagatctataacagccatgtcacattttgcattcattcagtgaaaaaaaaaaacccagatattttatatagttccagttaagccaaccatcatctgctgtgcagtcgatttctttaaatgtagaactaattctcctagttatatttcagcttcattttgatcagtctttttaggcaattatgattctgctatgcagtgtggtgttaactgtgtttccaagtttggggtcatctgaagattttgaaacatactttccacatcattatccaagatttttgtttgtttgtttgtttgtttcgagacagagtctcactctgtagcccaggctggagtgcagtggtgcgatctcagctcactgcagcctccacttcccgggttcaagcaattctcctgcctcagcctcctgagtagctgggattacaggcacttgccgccacacccagctgatttttgtatttttagtagagatgggatttcaccatgttggccaagctggtctcgaactcctgacctcaggtgatccacctgcctcagcctcccaaagtgctgggattacaggcgtgcgccgccgcacccggccccaaattcttgataaacatggcaaaaaccaacttcccactccacgcatcaagttaatcagtgctgtttatgaatggttctgttaaccactgtcctgtcatcccatcccctgtctcttcatgttatctgcaaagatctcatttgtacattcaacacatttttacttagcacaggtttagcacatgtgcgagaaggtgctaggaatacattgaagatagccgtccctatcttgtggtgcttacagtttagcagcatcatgaaatattttctaaatgctttgtggaaatgaagttatacggttctctatgatatttctcctcatctggtagcgtatcagaaaggggaatgagggtttactttttgtagactccatattgctactcattatcttctatcacttgaaagtgggattcactccctttatctttacacctttcatggtttcacaaacagctttgaactttagaagtctctggagtttatttacgccctttctgtgtagccatagtttggtagtgtttattttattttattttatttgagacggagtcttgctttgtcgcccaggctggagtgtagtgacacgatttcagacataatttcagctcactgcaacctccgcctctcgagttcaagtgattctcctgccttagcctcccgagtagctgggattacaggacgcccagctaatttttgtatttttagtagagactgggtttcaccatgttggccagactggtcttaactcctgaccttaggtgatctgcccgccttggactcccagagtgctgggattacaagcaagagccactgtgtccggcctggtggtggtgtttaaacacctgtttgtttgtttgtttgttttcacattatcaggattgttttttgttttatagtaagcttaatgaaaaatttctgttcaactttagccattctcactcccataatctttgtcactcagatttttacttatattttatctttatattttgaaatgatctttcctaaggaggagagttgagtctccttaggttttcttttcttccttgagttcttgaaatgccatagttgctttctccaggatcctggtcctcttcacttactttttcaagtttgccagaattaagctcagatgtattttgtctattttctgaaggattaaactgtcaacaatgcaaggtgctatgttttcatacaaagagtggatgtctgcatagctggcagcccacctaccttattctgaggtgtgcattctctcatcagtcaggtgtcatccacttccttcctctagccagtttccaccactgcagcctttttgcctactcttctttcccttttggtccaatgtcttcctctatactgacttactcacattattggtttgcacatagatgtttattatcttgaacttgggaggattctctgcctttttctgtagatccatctctgtaaggcagcagattttctatagatgccatagtctattgtttacccatcccaccaagtcttggtgattttcatgagattttatttatctccttgagttcttttttgctattgtgacttttaaatatcgtgcctagcacactaatgttcaataagtaatatttatgattaatctcaagaagtatttgccttctcttttaggctgtgaggatatcattgctgagagcatctcattagataccttaattgccatcctcaagtggagttctcatccatatggctctaaatgggtgcaccgacaagctttacatttcctctgtgaggaattttcccaggtcatgacttcggatgttttttatgaactcagcaaagaccatctgcttactgctatccagtctgactacctacaggtaatcatttaaacacctctcaaactctgtcattcatatgtgcgccaagaaacccatctatgctctattactcttccatctagggtagggcaggggaagagaaacaggctgtgatcaaaccacccaggactgccctcttcatagttgtacaacaaaagccttctggctcactggctcttcatgtacactgctaccatgactcaacattgaacaagcccaggtcccagccaaatgcaccaaaaagagattggggcagtaggcaaggtcagaagcacatcccaacatgattttcttgacttctattaatgtagcttctctatagtggtttcttacttttggtggagcatcacatacttagattgtaagacagtagcttcagcagcacaaagtaaaaataatattcaatttctgatctgctcacatttttatcaaaactcagtgcatgtattcttccaaagtacggtaatgttttcaactacttatttttaaccagaagtagtttttagcaaattcttgtgttcttgacttaaatgtcaatttaatttggaaatttacattaataatagattttatacattacagaaaatacttacaggcaaagtatatccaagcttaatttttgtgcattggctatatgaattttatgctaaaaactgtacaaccgttttaatgctattaaagacataaacccattgaaccacttcctatttctttgtatttgtactagaaaaataataaaatgctaccattttagtcagaaatgcagtggagagttaaataatacactcagcatctgtgcttttcctttgtatgttgctttgattgcagtacagatggcatacttgggcttgatttatggagaatctttgttcattaaccttgtctcattgtcctgatcaaaactggacgctttatgtttgtgttagaagttgttagttctcttagattattgtctttaggagctttgcattccttcttagaaagtattaaaaaaaaaaaaaacagagagcagcctagatttgctctaagattttaaataaaatacaaagaaatgagggctacattgccatttcacagattgtgcttcactaaccagtagaataccttgtagagattgtagtttcttctgccaaaacaagttgactgacttgtttttcctgtccctccaggagagagtagttactctgcctataccctatacttacactttcatttacttatctctgttttcttccaaaagagaatttaaggcagctatatagaaaccacatagtaagataaaataaatttaaaataggaagtgggttgcttgagcccggaagtacgagaccagccttggcaacaggtgggaccccatttgtacaaaaaatttaaaaaaaaattagccattttgggaggccaaggcaggcggatcacgaggtcaggagatcgagaccatcctgactaacaaggtaaaaccctgtctctactaaaaatacaaaaaaattagccaggcgtggtggcgggcgcctgtagtcccagctacttgggagactgaggcaggagaatggcgtgaacctgggaggaggagcttgcagtgagtcaagatcacaccactgcactccagcctgggcaacagcgcgagactccctctcaaaaaaaaaaaaaaaaattagctgggtgtggtagcacatacctgtagtcccagctgctcaggaggctgaagcggggagaatcacttgagcccaggaggttgaggctgcagagacccatgatggcactgctgcactccagcctgggcaatagagtacgacttcatctcaaaaggaaaaattaaaatgaaaaaataaaataggaagggagcagattacagaaaaagaagatagaaatgaaatttaaaaattagttggagccaagattgaggttactggataaaatatatgtaatgcagtcttgtatatttcctgttgatggaccacagatttaacactaaaacttcaaacagccaatggaaagagtgaaacatggtaagttgcatgctgttatttcccacctacgaaaagtccttaatgaaattaaccacttatctaatttcactaaaataaatataaaccattttttattataggcaagtgaacaagatatccttaaatatctgattaaatggggagagcatcagttgatgaaaagaatagcagatagaggtaagctccgaaaattagcttgcactagttaccttgtgtaaaatttggtggttcttatatagaaatgcatgccgcacatcagtcttgaaaattgacactgttgcctggtgaaaatggaagtttttaccaccagcaaaatcctttagtggacagggtatagtttattaaaataaatatatcagaaagtcttattttgcagctttaaaaggatactttttattattatgttcttaggtgcttaataaaacatgactgattcgtggaagtactagaatgaaaaatttcatataatttcatataatgactaaagtattacaaaagcataatgttgatgaaaatttggaattagtgttgatggttgcacaacaatacaagtatagtaagagccactgaatggtacgctttaaaatgttttaaataaattttgtgttatgtgaattttaacctcagtttaaaaatacgagtacaggctgacctgaggtcaggagtttgagaccagcctggccaacatggcagaatcccgcctctactaaaaatacaaaaattagtgggaagtcgtggcacgcgcctgtactcccagctactcgggagactgaggcatgagaatcacttgaacctgggaggcagaggttgcagtgagctgagattgcactattgcactccacatgggtgaaagagcaagactcaaaaaaaaaaagagtacaaataaaaaagcattcattgtttatttttaaatgttgtagaaagtaggctgggtgcagtggctcacgcctgtaatcccagcactttgggaggccgaggcgggcggatcacctgaggttggaagttcgagaccagcctgaccaacatggagaaaccctgtctctactaaaaataaaaaataagctgggcatggtggcatgtgcctgtaatccctgccacctgggaagctgaggcaggagaatcacttgaacccgggaggcagaggttgtggtgagccgagatggggccattgcattccagcctggggcaacaagagcaaaacttcgtctcaaaaaaaaaaaaaaaatgttgtggaaggtaaaagagaaataaataatacttctgaatgacctcccagtggggtcactgcagaagagaaggaagcatcatatgttggaggctgggctttcaactttggaaatttgtgattctacagcagtcttttgtttgtgtgtagggttagcccacccacctgtcctccttccctcaaacatcgttgtattcctttatgtactgaatctaaatttaaaatttttaattgaaaaattaaataccaatttcctttttctgtcacctttcgatagttttatttagatataatttatgtatcttaaagttcaccggtttgaagtgttcaagtcagtggattttagtacctttatagagttgttttgtcacatttttaaatataaaaaatgttgtgctaaacctgcctttaagcctttttatagtgtttctttaatatgctactatccaagctctagggaacaaaagcagtccttctattttatttctccaattttttttctgtggctggcaaaaacctttagcaattctcagatttgaatgtgtttatttttatttttaaaattttatttcagagagcaacaaagttatgatttttgtttttgatttatttttttatttgagatggagtcttgctgtgtttcccaggctggagtacagtggcgcgatctcagctcgctgcaacctctgcctcccgggttcaagctattctcctgcctcagcttcccgagtagctgggattacaggcacgtgccaccacgcgtggctaatttttgtatttttagtagacacagggtttcgccatgttagccaggctgttctcgaactcctgacctcagatgatccaccatgcccagcaagttatgaattttttaaaatatgaaaaccattacagttgatttagaaagttttttaaatgccagcatacaattagttctcattcgtagcttttatatttgtcaacttacctagtcactgaaatttatttgtaaccccaaaatcaatactggtgatactttcatggtcattcacggagtagcaaaaagcttggtctcccaacaagcacattcccagctgagttctaacaagacagaggcactctgccttcttgtttcagatctccttaccaagtgccacattttttacatttttatgttttcgtgatctcactgttcaagatggcccccaggtgtagtactgaagtgctgtctagtgttcctgagaacaggaaggctgtggtgtgccatacagagataatacatgagttaggtaagcttcattcaggcgtgagttacagtgctgttggttgtgaggttagtgttaataaatcagccacatatattaaataaagtgtctttaaacagaaacacataaaacaaggttctgtcttaatcattggacaaaaatgttgtacccagaggttcacaggaacctaaccctgtgttttccctatgagcaacagttcagtatatgctgattcattgtttgtgttgactttataactacttcagataataagaaccgattgtatataactctgtgtaaatgttatagaccataagcttgttcagtgatgtaaagttggtaatgatgaaatgtcatttatttggggcagataacaggcatctgcctgttaagggttaaaattttccttagaaaaatagttgctaggccaggcacggtggctcacgcctgtaatcccagcactttggaaggccaaggtgagtggatcacctgaggtcaggagtttgagaccagcctggccaacatggtgaaaccccatctctactaaaaatagaaaaattagctgcgtgtggtggcgggtgcctataatcccagctacttgggaggctgaggcaggagaatcgcttgaacccaggaggtggaggttgcagtgagccaagatcatgccactgcactctagcctgggcaacacagcaagactccatcttaaaaaataataataaaaaaataaataaaaggtagtttccacactgggttagtggaaggttcttctgcaaggataagaaggaagctaagtgaaccaggccatagctttgtttcagtcagttttatacaggaggattctgcacttacctgtcacatatttgggggtttcatgtaagattttatatgaaaacaggatgtcactactttaagaaaaaaaaatattttgaaaagcagaatgccttaaataagtatgaagctaaatcatagctaggcaagggggaaaaaaatgactcttttctacacagttaacaattttattctgaatgaatccagaaaaaaacttagcttctcaaaaacaatcaattctctctctctctctctcatacacacacacacacacacacgatttaaggaagataccagttttcctgtagaatatttgaaaaaaatccagcatttcatgaataataagatcttattctgtgttaatttttttaagaaaaaaattacagacccctagattaaagccatgattaaagatttccaaattacataatttttcttcccacctcaatagcataagcatacatgtatttcagattgttgttcactaatgcccaatgaagaaatcattctctgccttggatgatggacatatattacatgtcaaagatcaaagggtctacttttatgcagtaatgttcccatattatggaaatttgggagattttcataaaaatcttaaaaccaaataaagcacattatgctttgctgcttcaaacaccaagtgattaacatgttgttaaattactgttacacatatgtaggctaatgagcatactgataacttacagtgaccagaaatggcatatgctctacaatgaccttatactactaaacactggtcacaaaagtgagaaggctttttaaaaagcccttgataaaactagattttagtagattgtcatcttttctcttttgagttagtctatagaaaggaatcctttattctttattgcagagcagtgataaaataattttattgtactgttgataccatgctttttctttatccaagaacatccctattaaacaaacatgaaagaaaataattgatttataaccctttttaaagcagaggcacataagtctatagagtggtactgttagtgtatgtactagagaacaaaggaaacctgtctcagaacatttggatttggttggaaacttttcattttctgtctcatagagccaaacttactgagtggcactgcccatagtgtgaacaaaagaggtgtaaaaagacgggacctggacatggaagagctcagagagatcctttcttctctcttaccttttgtgcgaattgaacacatcttacctataaacagtgaagtcttaagtgatgcagtaagtgtttttctccatgtattcctttcatgaaaagaaaaatgccaggtgtatgtttttattcattgtaaataatttctgctactaatagagtattgtgaagctgtaattctgtgaggacagagacagatgtctattgtgtacgatgttgtatctcctgtgtcttccacataatacagttaaaatgttcagtgaatgagagttgagtgggtaaataggtcttactcatgcaagagcattatttctagcagagttaattctgtcatttaagtgtagatcaagtagacccttattcaaaaagggaaaggtagaaattacctttgaagagtcttcaagaacagcagtgaatcagagagtagtggagtggagggattggttgaatagaaaaagaatggatggacctgaaaattaatagagctcatcttgttactttcataattttttaaacagtgaattttttaaaaattaatataattggctgggcgcggtggctcactcctgtaatcccagcactttgggacgccaaggcaggtggatcacctgaggtcaggagtttgagaccagcctggccaacatggtagaaccccatctctactaaacatacaaaaattagccaggcgtggtggtgcatgcctataatcccagctactcgggaggctgaggcaggggaattgcttgaactggggaggtggaggttgcagtgagccgagatcgagccattgcactccagcctgggtgacagagcgagactccatctcaaaaaaaaaaaaattaatagaattgcttgaattcatggatgggaaaaataaatattataaatattagttcttcacacattgacttataaacttaatataatgcttataaacatcataatatgttttttctaactgcacaggaacattataaaacattataaaagtcttctggaaaaaaaacaaaacataataataaacgaactatcacaagtcaatgtggtgctagattaactgattagcagaagaagaaatttattgaaagttaaaccatcgtttcactggcacacaaaattaatccttgttagactgaagaattaaatactaaatggaaacatggaagaactagaagaaaacaatattgttttcaagaagtatttatgggctactctgggcatactgcctatggggtagccctgctccacaaggagcagtaataaaaataaataaaaacaaaacttaaaaaaagaaatatttgtggattctgattagaaaaaaaaattcaccctcactaattacacacacaccagagaaagcaaaatgaaacagttaccattttttcacctgttaaggtagtagttatagtaccactacacaacagaatattttgctcccctgaacagttgttataaagactgtatagtggccgggcgtggtggctcacacctataatcccagcactttgggaggccaaggcaggtggatcacctgaggtcaggagttcaagaccagcctggccgacatggcaaaaccctgtctctactaaaaatacaaaaattagccaggcatggtggtgcatgccgttaatcccagctgctcgagaggctgaggcacaagaattgcttgaacccagaggcaagtcaagaatgtgtcactgcactccagccttggtgacagagcaagactctgtatcaaaaaaaaaagaagaaaaaaaaagattatgcaaagtatgtatttttatgtattcttaaattcaactatgtaaaacttcatttggtaaagactctgccaggcgctgtaatcccagcactttcagaggccaagacaggcagatcacttgagttgaggagttcaagaccagcctggccaacatggtgaaacactgtctctaccaaaaaatacaaaaattagccaggcatggtggcatgcacctgtagtcccagctacctgagaaactgagatgggagaattgcttgaacccaggaggcagaggttgcagtgagccaagatctcgccattgccctccagcctgggcaacagagtgagaccctgtctcaaaaaagaagagaaggaaaaagagaagactggaaggaaatatatcaacattactgttgtaatgagtattgacttttttctctattttctaaatactagataatgctgtattttactagttaaaagtaattttaactaatgaagctgttgattatatttaatgagagtaatattggagaaacaacttttggttttgtttaaaacctgggactcaaatcaaattgaaccctgtatgtagtttagaaaagtattttagaactttggttaggaaatatatacctctgctcttaactccgtgcctaacacatcgtaagtccccaacaaaggtttgctaacaatgactcttaactttcatgctctcttagtatgtgctaagcactgtactaggtgctttcatctgcattgccctcatttaatcctcacaccaccttaggaactaaagatacttgatacagattctcctggcatcagtcaggaaacaacagggatacctcattcagttagctgtgcactgccttgcctccagagccatacaggagcccttaaagtgaagcccaggtaaaggagatgtccatggtcacatggctgttaaatgcaggagttgaagtttgagctacatctgccttgccccagagcctgtgttgctaggcactgtgctagccttcctgtatccttgtactgtagatataggcccatgtcaatgttctcgttttgtcttgaggagttgggtggggactgaatttgttcctagatgagtaaagaaaaaaaattggttttcattaagagttctgatctttagtccaacttaactacattttaattaatgtgtctcgtttttaaaaatattcctctatttagagaaaaatgggaaattatggtatctttttattgaaaatcttttaaatattattaaaaatttgaggtatttcaccgggcacggtggctcacgcctgtaatcccagcactttgggaggccgaggtgggcagatcacgaggtcaggagttccagaccagcctgaccaacatggtgaaaccccgtctctactaaaagtacaaaaaattagccaggcgtggtggtgagtgcctgtaatcccagctactcgggaggctgaggcaggagaatcgcttgaatccaggagacggaggttgcagtgagccaagatcacgccactgcactccagccggggcgacagtgagactctgtctcaaaaaaaaaaaaatttgaggtatttctaaatttcatatacatttctaaatttttatttaaatgataaagtttgcatatttttatttatagttataaatatttttatttatcttagtagtattatagtactacacagatttctatctaaaaaaaaaatttttttttagatgaaaagaggcttgattagtactcctccatcagatatgcttcctacaacagaaggtgggaagtcaaatgcctggttacggcaaaaaaatgctggcatctatgttcgtcctcgactcttctctccctatgtggaagaagcaaaggtaatgaaaaccatttgaagatagtagactactttattacaaaccatatgcacaaagtggttcactgtagtattacttaaatatttggaaatagcctatattttcaacaatagggaaaatgaaagtaagttctagtttgactactcaacagaatagttttctaaaacgtttaattttaattaagcatgtttttaaaacttaggttatgttaaaatgcattttatatttttctcattttagttgccttgcaaattgttaactgccttgcaaattgttaccacttactgaaaatggttgtcactattttgtgatcttgagcatgagggaaatgttctgaaagaagattgcccacttttttacttccttcctaaattaaaggaatgccacgacctcttgtaacatatttctgcaatagctgactgttgggaattatgtttagttttagaataaatgcacaaactaagaaaaaatttcaggcctgttaagtaactagttcgcattatgtatattgtaacataaagaactgtcccagaaaatacggtaatgtgaaaatgaaacatctaatttttattagatgttcagccataagaactttccggggtccatcctgggcaacatggtaaaaccccaactctaccaaaaactaaaaggaaaaatttagccagttgtggtggcgtgcaccctgatttctgctactcaggagactgatttaggagaatcacctgagcctgggaggcaaaggctgcacagtgagccgtgattgtgccactgcactccaacctgggcgacagagtaagaaccagtcttcaaaaaaaaaacaaaaaacaaaaaaactttggccttttgaggaactgacagtctttgaaagcaggaaatccttattaagctttctgaagtaaatttaacagacaaaacagtgtgtatactcaatgagtatacaatcaagttgcctcaaaatgtttctcatttttaaaccaggcatggtggcttacacctgtaatctcagcactttgggaggctgaagcaggaagatcacttgagtccaggagttcaagagcagcctgggcaacctagtgagaccctgtctctacaaaaaataaagataaattaaaaaaaaaaaaaactagccaggcgtggtggtgtgctgttgtagtcccagctatgcaggaggcttgaagtaggagggttgcttgagcctgggaggtcaagactgcaatgagccatgatggcaccactgcactccagcccaggcaacatttttcttttttcttcaaaaaagaaaatttggtttatttctaagtctcttgaattgattatcaatcttttttttttttttaagacggagtttcactcttgtcatccaggctggagtgccgcagtgagatctcagcttactacaaccttctcctcccgagttcaagcagttctcgtgcctcagcctcctgagtagctgggatgataggcacccgccaccacatctggctaatttgtgcatgtttagtagagatggggtttcaccttgttggccagactggtcttgaactcatgacctcaggtgatctacccacctcagcctcccaaagtgctgggattacaggcatgagtcaccacgcccggccctgattatcaatcttcaatattttgtattttgagcactttgttggatttgttatttagcacatgtatacattgttttattataatattgtgtgtaatttatttctgattaattttatatccttccttcacatttcaaatacttctaattaaaagcagacttttcaaaagatggttgtgtcttttcaaagatgctcctaaaagagtctttaaaagttaaagatgtaggggaactttctttcaccactaatgttaacatttataaaatagaaataaattaattccctttttatttgatgaaagtaatagtcttccttcaaatgtgatttaacagaggaaggttgactggttttgttaatactgaatgattatttcagtcagtgctagatgagatgatggtggaacaaacggatcttgtgcgcttgcgaatggttagaatgtccaatgtgccagacacgctctacatggtcaataatgccgtgccacagtgttgtcacatgatcagccaccagcagatcagcagcaaccagtcaagccctccttcagttgtagccaacgaaattccaggtaaggcagtatgttgggtgtttatatttaaatgaataatttattgtttttttgaaattgctgatgtttgagcctctctgtatatgctaattctctccacatttcaatactttttatgccttgttctccttaaagaataaacacttttaagccaaaacttttgctttatattttattttgtattactaagtgtatacagtttatcagtttacccttgagtttctcagccttggtcttactgacatttggggctggattattctgttaatggagagctgtcctgtgctttgtagggtggtcagctgcattcctggcctgtactcaataaatgctaggagcacatatgtgcatgcatgcacacctctctgaaaaccttttggaaacatttttatgtttctagacattgccagttgtgccctgtgggacaaagtcacccattttgagaaccactggtttagaggaattcagatttttttttatcactatagggtatttctcaggttacaagaccctttgggagggtcaaatgcactatcataccttaaagtctatggccttcctagtctattatacctttgagtctgtggccttccaaaatgtgatcactgtgggtttcctagagatccaatttcccaagctctgctctgtgaagtttactgtagcacaggtttatgtcttacgactttaggggaattggctatcgatcaggatataactgtcatgtccaaaaacgtctgagcatcagtaaatgttggctttaaccaaagtagtctaaaaaaagcaacaatgatctggtggtcagaaacttgtagctcttgctaattgccattgcaagattcaaaataaaaaccagcacactatagcaatagaaatagcactatttatttctgcttataaatgtctactgtaattaaagatgaataaaagacatagtgacagaacttttaattgaatacatatattttattctggagctaatgactttcttcagttgttaccttatcaaatttggccactgcatatttacttgaaatatacattagttaacagcatgaaaagaaatatttctttagctgatttatgcagattttgaagctttgctaattagcctggctttttaggcttgagttaatgcagttcaaaatcagcataatttaatcttagaactcaatctcagaggtctagacattctcaaataagtatgctcagaaaaataaggcttgtctctctattgtttagctaatgaggtatggtcctgttctggtatcatcctgggttcttctcacttccttgcacaccacattcatgaaaggatggatagcttgttgcagaggattagggggctcatatcttggctctgttactttgtatgactttggacatggtattaatattttctttcctgaacattaatttcctcatccatgaattggggctcatacctcctttcaagaattaggaggatttaatgaagcaccatgagtaatatgcacaggagtttgcctggcacaaagtaagcactcagtaaatgccagttccttttatccctaaaaaataataatcactgctctagtcagtttctttcataaatatttatagactccatcccctctccagccctacagctacagccctacttcaggtttctaacccgtgttcccgcctctcatcttactcaaaattctgtcttttacaccagcttgtcggccggcatactttttctagaaaggggcagatagtaaatactttaggctctgtaggccatacagtctctgttgcttctatctacttaactcccatacaacagccgtagacagtacgtaaatgaatgggtacagttacattccaataaaactttatttacaaaggcagacagcaagcttgatttagcctaccagtcacagcatgcctgcccattttacgttaacatcagaatgcacttgttcacagctctgatcctgtcatcctcctgcaaaagtgactgcctgttgtgcacagggtacaatttaaattctttatccatgatctgccagtagccatctttctgcctcctctcttcacactcttcctgcttacagctctgaaccctaagttctgctggccatgccaaccacttctgccaggctgtctcagcatgttttacacatacccagtccttctgctgagacagctttttttttttttttttttttttttgcctatctggtttcctttcattcttcaagaatctgctctgtgtacaccttgaagcctttcttgtctgtccccagtctggctgggtgccccttccagtccctcagtgtcctttgcatatttctctccaggaacatttatgaccctatattgtatttgtttactgctggtttagttcatatcactaagccagaaacttttgagaagaggaatcgtgtttcattctgtgcaccctaatatccaagtccaatccctggtgcatagtcaggactcaaaaaattatttgaataatagaatgaatatatttaaagacttctgaaatatcctgagattcagacaagaatacatgcaagtaaaattgtatttgaactgtaaactaaataatacaactcgggctgttcagtatgatcaagagccttttgggcatagtgaaattttaaaaccttgaaaaataattagagatatataaatgaatgtgttcccaggaaattaagatactatcttaaaaacttataagattctggtatgaaatacatgcttttttcccttgggctcacggggtcgtcttttgtgtagctcaggaattttgcttgcccactgttgttctccttccagttcctcgtctcctcattatgaaagacatggtcagacgactgcaggaactgcggcacacggagcaggtgcagagggcctatgccctgaactgcggggaaggcgccactgtcagctatgaaattcagattcgagtgctaagagagtttggtcttgcagatgctgctgcagagctgttgcaggtaggaaatgacattaaactgtttaaaatagggagcctcagtcaccagacaggcagtattgtgggcatcctgacgagtccttggcttatttccttttcgtcgtatgtgctttttcactgcctttggtgtctttgataacctgcaagtccctcctggtgagaggcagcgtcatggagtggactgagcagaggcctaggatgagaactgggtttaagtcccggctctgctgcttactagttggttaacttggaatgagttacttaaccaccctgggcatcaacagctcttttacctgtaatataaattgttatgaagatccagagtgctattgtacagcagctatatttctggtatgtagcaagcatacaagtggggactgctaaaaaaattccacagtgtgcatgcccagagatggcatggaagtagaaaagtctgaacttccactgctctctcttccttgtttggtcactaggtttgaggtttggtctacttcctcacttacacacctttcacatgcccactttcgtttctgttttccatcttataagaaatttctttcatgagggttcaaacccaagcatgagaatcaaacagtaagtgctttcttttttaacctaccaggaaaaaagaaaaaactcatttctagtaattattagatacaaaagcaatagcactggttttgcaattaagatagaatttgtaaactagtctgatcacagccactaaatcagagccttaaataaaatttaatttcatctggttaggtgattcattttcttgctacaaactccaaacccctttaatccgtaccctttaaaaggataggatgtggccgggcgcagtggctcacgcctgtaatcccaactctttgggatgccaaggtgggcggatcacttgaggtcaggagttcgagaccagccttgccaacatggtgaaaccctgtctgtactaaaaatgcaaacatcagccaggtgtggtggcgtgggcctgtagtcccagcctcgggaggctgaggcaagagaatcgcttgaacctgggaggccgagtttgctgtgagccaagattgcaccactgcactccagcctgggtgacagagcaagactccgtctcaaaaacaaacaaacaaacaaacaaacaaacaaacaaaaaagaataggctggacacaatggctgtaatcccagcactttgggaggcctaggcaggtgaatcacttgagctcaagagtttaagactagcctgggcaatatggcaaaaccctatctctacaaaaaatataataaattacccaggcatagtggtatgcgccagtagtcccggttcctcgggaggattaggtgggaagatcacttgagcccagaaggtcagggctgcagtgagccatgattgcaccactgcactccagcctgggtgacagaatgagaccctgtctcaaaaaaagaatgaatgaatgaatgaataaacatggcatagggttcttcagcaagtcagcaaaccacttttaggttctttttcttctttttccccctgctgtcctaattttctactgaacatttttaggttcttgttttagattgttgattttcattttttgctacagtttttctccttaaaatatatagtctggttttctactcatttcttttccctttgccattctaaattgtgtctgaatttggtaccttaaattgcatgacatattcttttataatgtttaccaaaatattggtcagacttagtcatgtataatgggtaatgaatagtattttgtagtttttatttcagacagagcaggcatagatgtcttgtcagaaagtttctagaacatcctcagttgtattcctttctccctttggcatttaatgttaatctcttagcaaagacatattagagtttggttttattaccagtttttgcattatcacataatctgagatgagtgacctgcttgaggagcattcgatcaagcagctttctttcatggctgtgtcctaggctgcactctgtgcctttgtactataactaaggtgatttttttcttgggcttctggcctagaaaaatatattatgctttttattcttgctgactgtggttttcttaagtacctcacttaattctctcagcctataaatttccacttatgaaatctgctaataaatgtcctttttttttttttttaatcttttttagaatcctcacaaattctttcctgatgaacgttttggggatgaaagtccactcttgacaatgagacagcctgggagatgtcgcgtaaacagtacacctcctgcagaaaccatgtttacagatctggactcttttgtggccttccatccacccttgccccctccaccacctccctaccaccccccagctaccccaatccataaccaactcaaagcaggctggaagcaaagacctcccagtcagcacccttcacgttcattttcttatccctgtaatcattcgctgttccactccagaacagctcctaaagctggccctcccccagtctacttgccgagtgtgaaagctgcaccgcctgattgtaccagcactgcaggactgggcagacagacggtggctgctgctgccgccaccaccacctcaacagcaacagcagcagcagcagcagcatctgagaagcaagtggtaagtcaacacttcagtaacttgcttcaaattcggtttatggagaattagaagcaattttcttggccccaagagccccactgggactcagcagtgcccagaagtattgctgacaagtggaaggcatagacttgaggggtatggaaaagagggaaaaacgctagtgtacttgaatgagaaaagacaggaggagagagaccaagaggtgtatatggaggagttgagtatcttcttatctttatgttcatttggcaggattaggaaggaatggggttactgagcaacataaaggaatataccagtttcatgttctgttcaagcacaggtctacaatttgtccctaacttctactattctgtaaaatccactgttctaccacatgctttaatcggacaagaagcaagagctacttatagctaagtacagtataccgtcaggaataatgtggaaaaaactccccattcagaagatgagcagaaaatgaggcctcagggcctcaggcatgcctctgcctctgaagctcatcagcagagcccccacttcacttagaatcatagtagccagggctagtaggtagtaaattgatagaggattctttgcttgattttgcactgtattagagattttgtataatatactttaaaaagttttttttttttttttggccaggtgccatgactcacacctgtaatcccaacactttaggaggctgaagtgggaggatcacttgagcccagaaattcagacccagcctaggaaacatagtgagaccctgactctaccaaataaacaaatgaattagctaagtgtggtagcacgtgcctgtagtcccagctactcatggggctaaggtgggacaatcacttgagcctgggaggttgttgaggctgcagtgagctgtgatcaaaccactgccctgcagcctggatgacagagggagactgtctcaaaaaaaaaaaaaaaaaaaaagatttgtaagatttgtaagtcttcatactcagtcacatgctatcagtagcaagttagaagaaaagattcacctgtcagttcagggaagcttcattaaaatatggcttattggaagcttgagtccaattatgatcctttctcaacttttctttttaacataacctcaagattttatttatttattcatttatttctttatttattttagagacagagtctcactctgttgcccaggctggagtgcagtggtgcaatctcggctcactgcaatctccgcctcccgggttcaagcaatcctcctgcctcagcctcctgagtagctgggattacaggcacgcaccaccacgcccggctaatttttgtatttttagtagagatgagttttcaccatgttggtcaggctggcctcgaactcctaccctcatgatccacccgcctcagcctcccaaaatgctgggattacaggcgtgggccactgcgcccggccaacctcaagattttattatctttaccgtgaaacaaaagatgatgcttacaactggatcaattgtccctttctcttcttatcttctctgggttcagcatgcttgcatctcttaatagccagcatcctcttagatctgcagttgagctcagcgcactcaaccttcagcacagtctttgtagttttaccctttttcgggaaaatcagcctagtctgcccaccatagtcactctgcttcctgtcatgctgctttccctgggcatacagagaatccttgcccttcctctactgtgtcactttgtgggattggtgtgtgccacactgtgacagaaagtccgatgggttttaggaaggttcaccatgtttgcaggggcactgttagcacagaaagcctttctcgccttcttagacctctctacctcccctccctgcttcccccaccccagaatggcgaaggttggtcatgtttgataaaccagattcccattctgttgggccaggccctcagttctacaattacaaaagttctactactttatattttaaataaaactccctttaaaggtaatttatttgtctgttcattgcagtcttgactataataatgaaaaatggtaaacaacctagatgtccaatagtagcagaatgattaagtaatggttcattgatgcagtagaacgtcacataataatttaaaatggtgatctcaaagatttagtgacagattatataggtactaaatttcatcagtatatatgcaaaggagaaaagcataaaaagaaagacctcaaaatgctaacagtggtatctctgttcaaaaggttggagtgatttttttgcctttatagctttctgtatttttataattcttacaaattcagccaggagcggtggctcacgcctgtaatcccagcactttaggaggccgaggtgagcggatcacgaggtcaggagatcgagaccatcctggctaacacattgaaaccccgtctccactaaaaatacaaaaaattagctgggcgtggtggcgggcacctgtaatcccagctagtcaggaggctgaggcaggagaatcacttgaacccgggaggcagaggttacagtaagctgagatcgcaccactgcactccagcccgggcgacagagcgagactctgtctcaaaaaaaaaaacaaaaacagaatgtgttaattttataattgggaaacaaaatcagtgaacatcatttctacagaggatgggtcctttttttaaccctcccaccatttttgtctctgtctgcagcgaacacaacctgtgctgaatgatctgatgccagacatcgcggtgggtgtgtccacactgtcactcaaggacaggaggcttccagagcttgctgtagacacagaattaagccagtcagtttctgaagcaggaccagggcctccccagcatctgtcgtgtattccacagagacatacacacacttctcggaaaaaacacacactagagcaaaaaacagacaccagagaaaatccacaggaatatccggatttctatgacttctcaaatgctgcttgcagaccttctactcctgctctcagcagacgcaccccttccccttcgcaaggtggatattttggtcccgatctgtacagccacaataaggcatcaccaagtggcttaaagtcagcctacctacctggtcagacgtctcctaaaaaacaggaagaagctaggagagaatatccactttcccctgacgggcatctacacagacaaaagaatgagccgatacacctggatgtcgttgagcaacctccccagcggtcagactttcctttggcagccccagaaaatgctagtaccggtccagcccatgtcaggggacgaactgcagtagaaactgacttgacttttgggctgactcctaacagaccttcactttctgcatgtagctctgaagctcccgaagagagatccggtagaagactggcagacagtgagtccctgggccatggagctcagagaaatacagatttggaaagggaagattcaataagcagaggaaggaggtcaccaagcaagccggacttcctctacaaaaagtctgccctctgagagcaacctccaagtcgtctgtgcctgagatgtgaaacatcccattttatgatgtaacccaacaacttacagaccagttcatcaatgccagctgataactcggtttcacatgattttgttctagtttttgtgtatatatgtgtttattagacatggcatgctaagaaggttttgttttttttttttaatgttgcatctgtctaatttgtctttgaacaattatgtcgggaggcatttttaagaacaagcaggctggcactttttatttctctttacaaatgatggaatttttttgcacttgtacatttattttctctgtattgattttatatcagtatgttaaactttattgccacatttaaaggactgtattttcatacttttttgcattttacctttcatctaccaatccatgtgcattggattgcacactaagatgtattttcttacgaaatagttctgtgtttattttttaattatagaaattccaaagaacagcacatcagaatgctcctctcttttcagtaattgttttagttcagagatcttcccgctcagcctccataaatctaatgtcattttttttttaataagtcctaggagctgggcttcattcctccagcgggagtccagtcagggtcctgaagtttgctggttcaggaaagaacaggaaagagaaaagccttctgtgcccaggctaaagctgttacatttccacagtgtggatgcagtcagaatccctgcacattctggtcataaggattagagtcaccagatgaggctctaaacagatcgcatcccttggaattagaaagcagtggagaccgggcgcagtgactcacacctgtgatcggcacttcggaaggccgaggcgggcagatcactgaagctcaggagttcaagaccagcctgggcaacatggcgaaactccatttctataaaaaatacaaaaaaaaaaaaatctagccaggcgtggtggtgcgtgcctgtagtcccagctacttggggggctgaggtggcaggatcgcttgagcctgggaggttgagactgcagtgagccaagattgcaccactgtgctcccacctgggcaacagtgagaccctgtctcaaaaaaaaaaaaaaaggcagtggaaatagagaagtaacttaaaggtcacactgacagaatttctggttctgagcgtcaactctccagctgtgatggcggaactgactgcttgctgcctttaattgtcttgctctctatgggaaaaaaacaaaagggcttcagtctcatggatgttatttggtgtttgtaaagatacgttttcttttaaacgattttcaaaatatgtctaaattttggtgttgtgtaatgcataatgctttctcaccaacagaaaaaaggaaaaaaattgttttcagttaaacactacatgtcctacttgaactccactgggacgctggtttggcatttactaaaccactgagcacatggggtctttcaggatcctctcccttggaagggcaatgtgtgagctaaggactgttttttttcttactctccaatgtaaatatatgagtatttgagtttttaaatcacttcaacattatttgagcatttactttgtatttttacaaacacataaacacacagccgtagcacttagaagaaaagaggctttctaagcattccttcctctgcaggatatttgggatcctcttttctatgtatgtatatatataaaaaactatgaatcactcacactcactcgaaaactatgcagggctagggagcgtttatgagctaccgggtaaatgaattacatgcactttgaagtaaataggttttctattgggtgtcaacaacgctgatttctcccaaaactatagtttctcttacggtcttttcctcctttaccctgtggatatacactcaggaataatctgacattttagaaaagccgaacagtagatagtctccaagatgggaaacatgtcgtgtgtctgcacgccccggcaaactgccgccactcgttctgctgcctgactggttagctgctgtgcgggtgcgctcggtgacactggtggtggtgcacgctcccgagctcccagagttaacactaatctgcaggtcggctgtgcatcgcattcgaggctccttttttaaagagaaaagcataggcctctgttctcatttgtaagaagtttgactcataatagaagacggtgtcttttgaagcccagtctctgtctgtcttcagaaacaaaagtgaatgccgtcatgttccttgatgtgtgtttctgccacatatgtatgttgacatgttcatgtactgcgccggtactgcaagtaagactcaacagacctaatttggatggggagaaaaactctcatccctgacccttccccccccgcaaatgttagaccagagctgttgatcccacacattcatttttctgaaaattcatgaactattctctcatatccctgaaatataaaagtaagtggccactattcctaagattatttagtttataaagtttgcttttaatcatacaatagcttacctggctaaaactttgcgtataaagggaaaacttgctttaatctgtgggattgcggaccgatgcgacttgcagaaggtaaacaggcgtgggttttgtgtgcgttaggttaggtgttagtggacttttaatgtatcttgtgaagtatggttactagggtaggttcaagagctacatgcctctggcttttgaacccatctattaaatcttttttaatgctgtactaagataaatgtgaagtctgagtaaggttgctctcagaaaaaaaaaaaaagcatatatatatataaaataaaatttaggccatgggaactggcattttacttggtataggaatttaatgagaaccaaatcacaaaaataccagatctccttttgagatcgtggacaatcaggcctttggacaatcaccgcttccagtgcccgctgtgcgttgaggttagagacctaccgtttacacgctagagccgagaggacgttcaagtttcttaaagatgctgttggtcttttttcttatgttattgttttagttttgtgattttgatgaataattgaagttcagagtcacccgtggctcctaaggaaaaaacagcatcatgaaaggcaaaaagtatttgaaacgtaattgtttcaattttccacgcccgttctcacatgccccctttagctttatttctgggaacatgtcactagacctcagctagcctgacaccgcaataacccgttaggctttgaggcttttcagtgaattcttgacatttaaatcttcttatagaattctttatgaagccttaactaattcttgtttttgcttcctcagaaactttttattgcatctgccatccttcattggatttttgttttggtttgttgttgccattctagcaatgagcttagtccttgtacatctgcattaaggtgccgatgcagaaggcaaattggaaacacgcgccagcggcagtggggctcaaagccgacctccatgcatcattctctagagttgaaaggattgacatttctcagtaactacccggcaaaatatatattttcataatgttgaatttgccttttaggaaaacaatgtttcatgaaacacttgtaagatacttattttgaaattaattataaggcattcatatttttaggactgaattcaaagggaaatgcttctttgactttttttcattgttcggttgactttcagctttctggagtgacaaagcagcagtgatgggtgctattcctggttctgtggtggtttactttgtctactaagtgatttactttcaaacctcattacagataatcttactaaaagacttaacatgcacactgctaaaaggtgttttactgttttccattaacgctgttgtatgaacaatatttggtgacatgttgtctttttgtcctgtagattgtcatatctgttatgtagttatccttttggcaagtcctttgatttttttttcctctagaaaatcctcagactgtcaatcttccatattttgaatattataatgctgtggccatttctatagaaagattacttgcaagtgtgtgtcttgaaaataacctcttgtatttgtgtgtttatgtgagttctgtctaagagatcagataagctctggaagcttcatcatctgtacctacatgtaactgtatctgggttacatgggcaggcggtaccaagtcctgctcttcgatggggtggctgagagataaaggttcctgaactctccttgctgtgtatgcaccacatctgtacttcagagaggtggaaaatcatctacaacactgcgtttcttgtggttgtgctgttactggtataaagtcaagtgccttcaatgctaaaggctcagaaatttttcttaaactgatttcatgtcctatgcaagtgttttctacaacctgcataaccagtactttgtaaaacttgtttacgcttcaattgtacatagtgatttttaaagaaatatatagtatttttatttaggtacctccaaacttgaattcgtctgtgtgaagcattgtaaaacgatacatttctcttttgagtaccattacagttgtacagaggttttcactgcttctatttttctactgttactgataagcatgtaacactgactttatcctacatatagttggcatttcaaataaatggcttgtatagaa

SEQ ID NO: 21 - DNA, 84239 bp, Homo sapiens
cggtggtgggaaagtgaacgaatcccgaatcaaagcggcgcattgaggcaggtggggtgccagtggaagagagaaagcaggcgagtgtttacggcctgacttgggaggccggcggatcagcaattgcagaagcaggcagcggcagagagggaatggtgcaggcaggcgctgagaaggacgcgcagtccatctctctcaggttagtgaaatgaggctctccgcccggggccggcccggggacagtgcgctgctggtcccagcatgaatgcgggccccggctgtgaaccctgcaccaagcgaccccgctggggcgccgctacaacttcgccggctgcttcggacgcccggagctttcccagcaggcagaggcgcgtcctcgaccccaaggacgctcacgtgcagttcagggtcccaccgtcctcgccagcctgcgtcccagggcaggcgggacagcacagaggcagcgccacctcgcttggtacgtgggaaaataaaaatctttgtccttcgcctcggcccgaaccttctggtctcagggactccagtcactcctttctggtcttgtgtgcatcatcactctgaggtccacttgctgagctaccaaagccactagtgggtgaatggggccgcatttttcccagtgcgattgatgtgagaaactctgatgagcagtcactcacagggcggaaaatggcaggagactccaccacctgtttgcttcttcaggtttgattgagaaattgccttagtcgtcaaggagatctaattgtgtatgtaaaacagtagggcgcttcagcctctagataggaagaaaacaacttcacttgtgcagattctgggtcccagggtgcagagctattagtctaagctggcattgtacccgtccctggtatacagtgttgaatgagagaaacttggcctctgccttcataccttaaaatctatctggagagatagacgatagcaaaagttaatataataaaaggtaatggatgttctgatagatgaaagacagattgttttacctaactgaatttatggaatcgaaaatagtcctccagaagatgagatgcttattctgaggactgtagaatgagtaggagttagatgaagaggaagtaagaagtgtttcaggagtgcaatggaggccgggcgcggtggttttgcctgtaatccctgcgctttggaaggccggggcgggtggatcacctgaggtcaggagctcaagaccagccttaccaatatggtgaaaccccgtctctgctaaaaacacaaaaaattagcctagcgtggtggcgggcaactgtaatcccagctactccggaggctgaggcaggtgaggcaggagaatcactggcatccgggaggcggaggttgcagtgagccgagagggcaccattgcactccagcctgggcaacaagagcgaaactccgcctcaaacaaaacaaaacaaaacaaaacaaaaacaggagtgcaattgatatatagagtgaacgcaagagagtgtgagagatgaggctgcagggtggtacagaaaagtcagatcaaattggatatgtagacattgctaaggattttgaactctaagggcattgataagctactcaagggtttttagtaggggagtgacttgattagacttatttatttgttgaaaagtctgtgtggctggtgtgtggaaaataaagaatggattgaaaaggaactcaagtggagcatcaagactcagttaaggagttaatctaggttggaaataattgtagcttaggcctggatgctggcaatagggaaggggatggattcatgaaagaatgggatacttgagaagaaatatttctgtgctggagaagtagattggggagttcatggcataaacattataatggatgctatgggcatagataacataaacatgtagagaaagtaaaggtgacctagggcagaagccttaggaacaccaaagtttaagagtagactgaagagaagcggctgtagaggtgggaggaaagcctggctcgtgttgtgtcagacaaaggagagcatttcaaaaaggatgcattcattaacagtgtaagaggctgggcagagctcgggcagttctctggtgaagagtgtacacttagatgtcttcgaacttagggacagtaccaagtagacttgcactaggccttgaaggatgaggaagatttgctgtataaatcaagaggagaaagaattatacacgcagagggaataagacatgcaaaagttggtaagactggagcataagatgacagaggagtgtctgatgaggctgggtggcagacaggagcttatgaagaaactcaaattccattttaaggaatttcaaccttattctgtggttaatggagaaaccactaaaaagcttttaagcgtgggaataccatttggttaatattttagaaaagtggcttttggactttcctaactgcaacccacagcataaattttatccagtacacagagtaagaaatatatgtaacctggcaaataagccatatttataactgaaataaatgtttcatgaaataatacttaatctttctatgtgtgatgcattcttatattgtctgtgttatttcattgaaaaatgactggtcatttgtagtttgtagaacactggatagtcaaggctgtagacagggagactagttgcaagaaacaaatggcagttgtctagtaagcgatgtgtttaaagagtatgaggaagggatggatttaaaatttaggatgtagatttcagagaacttggtataggggagagggaactgaaggtgaacttcaggtatatgttcaggtgtacttcagcttctgtgactggatagtttgtggtttcattaaccttatttgcatgtaaaggaggaggagttagttgcaaataggggtgagggcagtcagtcctcactggttggatcttaattaagatttctgcagaagaggtaccaaatgaatacttggggctgtatttcgcatgtttaaatgttttctgtatacctggcacaggacaccaattaacagaatgttcaaagactatatttgtatcaaaagcccattgtttgaatttttgggattcctttaggaacttggtatttaaatttttatatataattatcttaggacaagtaggcggggtagcgaaatggatatttattcagtatctttaaattttatattctttatcttcctggacatatttcttgtattgactgaaatcgctaattttgctgggcatgcacctgtagtcccagctacttgggaggctaaggcaagaggatcacttgagcccggaagttcccgtccagcctgagcaacatagcgagaccccacttctgaaaaaagaaaaaaaaaaatctgcaaacctgcatattggcagaactcagcatgttattcacattgtgatgacgcaggtttatccagatgtgttgctatagactttttgtgaaagtggaatgttcctttgacatgcaggtgaattttattgcattttgtgccttttggctgtatctatagctattaattgaatgacttgctgattaaaatatactgggtactgaataatgttgctgatgagagtaaatgtaaatggtgtgaagtcaaagttggagaattattgatctcagtggaaaaaaaaaagactgggtggaaatgtcgagagataacatattgagtgctttgtgaggctgaacacaatattttctctaatttttgctttgtaattgatccacataacccttagaagtaggtgttgttagcttcattttctgggtgaggaaataaaggcttaacgaagtgatattgcaaagagcagtaagcagtcctttctctgaggccctaagaaggactgatcaatgttttattagcagaagatactggttccttacctcttgcttttcctccttcatcccttccccaggcttcaggaagcctgaaactggagagagaacacattctcagggtcagggctacaggagagagctctcttcttctttgccatcactggaacactcctggtttttcatgaaatgatgtgtgcggtctttaggttctttagacttatcacgggagtacatgcttcgtgtgtgttataggaaccaagtcattgcatcttaacattaatccttacatttatggaaaaaagatgttttaacttctaaaccaactcaaaaaatgaatgttttggcatattactggtttgtaatttgaggattttttttttagtttttgagacggagtctcacactgtcgcccaggctggagtgcagtggcgcgatctccgctcactgcaagctccacctcccgggttcacgccattctcctgcctcagcctcccgagtagctgggactacaggcgcccgccaccacgtctggctaattttttgtatctttagtagagacggggtttcaccgtgttagccaatctcctgaccttgtgatctgcctgcctcggcctcccaaagtgttgggattacaggcgtaagccactgtgcccggcccaatttgaggattttctaaactatacttgctgtatttgatataaagaaaataaatagagaatacagaactgtagaaaaaatttcagaatcaaatggtttatcctcttactccctctgactgaagctcattttttctctgaagcctgatctgctgcagaaatgctaaataaaatcgtggaagtaatggtgtttaacaataagaaatcactatgcgtgattacttttttgtgatagaaactatttttgaaacattaatcaaagatttttactagctggattataagtattttgtggaaggtaaagattatatagcaattgaatatttttctggtataaaattctccccatctgaaatgtatttcgattatgccattatttcaatgaaaaataaaccattgattttcgtatatttggcctgcatctgttttgctccatatggtgtttgaggagaggtaggtaaataagaaagatcctgtgacttaggatgctaagattcttacattgcaatttagtgagtatctcaaatcttaaacatttgcgaatgtttaagattttatttctgatactaaaatatgatgtacatttaatccctattcagtatgttaaattttgacagcatacttatttctaatgattatataaaatgtggcttgtatttatttatatttaatctccctctcctgagctatcaattctacttttgctactgtctgctggtgtgttgggaaggaaaccttaggaagccagaagtagtgatatggttttctatctagttacttctttggcatctcaaatttagtataggcagaattgacctaatcgtatttcttccctaaacacaattctcttgtattccatatttctacttaaggctgtcatcacttttcaagtctctcaagctcaaagcttaaagtcacttttaacttcccctattattgtgaagtctgtaatgactctcctcacttttactactctcacaaggactagtttatgttcttggcaagtaactgttcaatctagtggatcatcagaatcacttttggaaaaaaaaaaaaatagattccagctcccctcatgccttcatcctactcacatatagattctgattcagaaggactggggtgtggctggcttcctgatgatccagatagtttgggaaccactgacctggactagtagcttcctccctagtttctggcaatacgctcttccctcttgcccctcaaatttatcctccaggctgtcatgcatgactgtgagcctcctagatgagaggaatcatgtctttcaacacgttttttgtgcttctctttgtgggtcattcaagatcctattgtatggtatgatcctggctgacttttcaaccctattttcttttgctttctttttaagttctttatatttccctgatattggtgcctttgcttataattttctctttatgtgactgcatgtttacttttcaaggcataagtcaagccttaccttttccgaagaaatcttaccgattatgcccatgttctcctgttcactgaagtagtgtcttcctcagaaataaccttaattcctttatcaggacctcttttaataatcatgataattaagaatcaacatttactaagcgtaaaccagataatgccctaaatgcgttacatgaactatttttacttaattaagccttatctcatgagagatagttattttgcatgtttacaaatgagggatctgagatacagagaaatgacccctcacagagtaacataggaagctaatgggagaatcaggatttgaatgcagatgttctgattccatagcctatgctcttatccattaggccataccaactcttttaggcaccagtcattttctaccctgtgtcatatgtattaacatttatgttcctgtcttacccatatacttgagggcaaatacttgagttattaatcttttgtttaacccgtagaacctagcatagttccttgcatgtacaatatgctgtatatgttttctattggaaggaatgtatgaatatacattttttttatagttttcaaacaaaaaactattaccagttggatggacactgaaggaatcaagacagcggaatcagacaggtatagaaacattcctatgtagagaaatgaataataatacatggatgttttatcttgttgctttaatattttctctctttgttcatgcttttctgttctcctttatctatgttaattcaaaatcaacttataagtaattttttagagagtcctgtgtgccagggactgtcctgtatacttgagataccgagatgagagaggaatagtccgtgtcttttttttttttttttttgagatggagtctcactctgttgcccaggctggagtgtagtggcgtgatcttggctaactgcaagctctgcctcctgggttcacgccattctcctgcctcagcctcccaagtagctgggactacaggcgcccaccaccacgcctggctaattttttgtatttttagtagagatggggtttcaccgggttagccaggatggtctcgatctcctgacctcgtgatctgcctgcctcgacctcccaaagtgctgggattacaggtgtgagccactgcgcccggccagtctgtgtctttaagatacttacagtgtagcagtggccacagacacaaaaacacataattactgcctggtgtgatagatgcaatagtaaaggtatgagcaaggcacagtggtggttagtgtgtagaagaaacaaatgttcaactttacctttggtccctaaaggaagactgcacagagaggtgagtgacatttatgacttgaaggaaaggcgggtgtttgccagacacacagctgcagggagggcattagggatcacatacaaagacatggagtcatggaagacatgctgtgtgctcagctgaccacagggagtttaattactgctgtgacactggaggtatgattggataagtgacttgtttgtattataagttgtttttagttccttctgttctcttgtagtttggatagtaaagaaaacaacaatacaataatagaatccatgatgagttctgtacaagaagataacttttaccaacataatgtagaaaaattagaaaatgtttctcagctaagtcttgataagtcactcactgaaaaaagtacacagtatttgaaccagcatcagactgcagcaatgtgtaagtggcaaaatgaagggaaacacacggagcagcttttggaaagtgaacctcaaacagtaaccctggtaccagagcagtttagtaatgctaacattgatcggtcacctcaaaatgatgatcacagtgacacagatagtgaagagaatagagacaatcaacagtttctcacaactgtaaagcttgcaaatgcaaagcagactacggaagatgaacacgccagagaagccaaaagccaccagaagtgcagcaagtcttgccatcctggggaagactgtgcaagttgtcagcaagatgagatagacgtggtgccaaagagtccattgtcagatgttggctctgaggatgttggtactgggtcaaaaaatgacaacaaattgattagacaagaaagttgcctaggaaattctcctccatttgagaaggaaagtgaacccgaatcaccgatggatgtggataattctaaaaatagttgtcaagactcagaagcagatgaggagacaagtccaggttttgatgaacaagaagatggtagttcctcccaaacagcaaataaaccttcaaggttccaagcaagagacgctgacattgaatttaggaaacggtactctactaagggcggtgaagttagattacatttccaatttgaaggaggagagagtcacactggaatgaatgatttaaatgctaaactacctggaaatatttctagcctgaatgtagaatgcagaaattctaagcaacatggaaaaaaggattctaaaatcacagatcatttcatgagactgcccaaagcagaggacagaaggtaattttctgtcaggagtatctctccaatagcataatatgctttatagttttgtaagggagtttaacgaagctatgatttctagtaaagcaaagaaatggttttgtttcttgttaactacttatgctaaatttaaacctaggctccaaagtttaaactctaaaaaggctagaaacagaaaacaagaaataaaataaatattagaaatcagatttttagtttcatgagtttccttttggtatttatgggaattactagaacatgaaaatactaggttgatagtagctactgtttcttcagccagacattcttctagaccattgtatattacacttttttttttttaacactttgtttaatgccgtgacaggcagacagatggtattatactcactaaatgagataactgagatttgggtaagagaattcactggaatcatgtaccttctgagtggtaatgctgggatttaaatccaggtgtgtcctattacaaagcttatattttgccgttaccccatatggaatcttaaatcccatccatgatttctgtgatttgagtttcctgagatagtggaatcagcatgcaatagtgagttcacttcattgaaaattactgtgtagatgatactgtgaccatgactcatttctgttttgagaaggtgatttacatgtgtttggaactttcttccacagactgttgaaaataagctcttgagttttataagctttataggtttttcttttgattgtaaatataaaacataacgaagtgagtgaccaagtatggcatactttaaacaataacgtctgggtaagttttgtgcttgtgtatctaagggaattaaaacagtaaataatttgtgactaaatacatttgtcttgaccttagaaaagaacaatgggaaaccaaacatcaaagaacagaaaggaagatccctaaatacgttccgcctcacctttctccagataagaagtggcttggaactcccattgaggagatgagaagaatgcctcagtgtgggatccggctgcctctcttgagaccatctgccaatcacacagtaactatttgggtaggtagcacctcttatctatgatgagagaagactggaagtccttatttattgtgatatttattaagtgagaaacagaccaaggcttagaaagttcttctgttttctgcatatataaaatactgagaattctacagaatggagcaatataatgataacttacttagtatagaacttaacaaattagcaatcattagcaatcattatcagctgatggtgaagataattttttttttccagtatttttaagaaacctcattggattctttttttttctttttactcagttgatagtattgtgtactgactgcagaatcctgcattcgtccctaaatttcaaaattacgtatggtttagtgtccttaaatcattatccagttgtgccttttttttgtttttgttttttttttttttgctggagaccagagttttcttattactcaaatcagtctcctcgagcattcggggatcagagtttttaaggataatttggtgggttggggaaggccagtgagtcgagagtgctgattggttgggtcagaagaagaaataatgggaagctgaagctgtcctcttgtgctgagtcagttcctgggtggggacaagatcagatgagccagtatatccatctgggtgatgccagctgatccatcaagtgcagggtctgcaaaatatcccaagcactgatcttagcagtttagggtgggtcagaatcttgtagcctccagctgcatgactcctaaaccattatttctaatcttgtggctattttgttagtcctacagtggcactctagtccccaggcaagaagggggtttcttttgggaaagggctgttaccatgtttgttttaacattatattataacattataacaacattgtaacaaaacataacaaaagactaacattataacaaaagactataacgagggctatgggagttacaagccaagaacctggacaaaaaccaatgtgaatatcataacactatactaacagaaactgtacatattaaacatattaaataattaaacctccttccctgcttcccctagttcttagtaacctcttttgtactttttgtgtgttcttgcttttaaaaaacaacttcattgaggtatataaaaattcacccattttaagtgctcgatttggtgatattgagtccattttttgagctatgtgaccatcaccataatccagttttagatttccatcacttgctgggtagttttaaacattcatctcatttattagtcaggttttatatagatttcacacgcagtactaaaaaaaattgacatgatcccttttaacatacaatttagtgtagatgtgattaactattttgaaattcagaattctttagcatatttagaggtgagagtaacattgagcagagttatggggtttgagctgagctctaaaagataagcataaatttctgaggtgcagttagtaagataggagacttccagacagatatataaggtttataagaaaaggctgtgtggttgaaaactatctgttttagaaatggaaaacagtgcctttgctggagtgtggaatttgggtggggaatgaggaagagacttgaaaattggattggcttcatatcacagggggcttcaagtgccaggaaccagacttaagtcatgtctgtgcagacagtatctgtgctgtagcaagattaatcagacagctgcatgtaaggaaaacagaagtgaggatacactgggagacaggagaggtaatgtaagagcccagataagagttaagtaaggtaacagtatgtaccgaattgtgccacatagaggtgcttcaggggttcttttgaagtttgatgcaaatttcatttctaaattatatttttaacagtgaaaaacttgttaaaaaagaactgcacaatcaaatttgaagatgcttaattccacatttgaaccagctgtttttgccaagataacccatttttgtgcagacgatagagccaaggttcccttgctaccatttatctgaagagttagcttaatatcaaaataaagtttgtaaaatgttaccatttgcaactgtatagatggatgaatcaggattttcttaataatgtgtaagagagataaatgtaaactaaatggtagattgatgtaagctttaactctcatccctaactcctactttcaaattttgtatttaaaactgtctcatcatcacttattgatattagagtaagtaaaagttactataaaaactgtatttctttttttttttttttttttgatggagttttttgctcttgctgcccaggctggagtgcaacagcatgatctcggctcatggcaatctccacctcccgggttcaagcaattctcctgcctcagcctcccgagtagctgggattacaggcatgcaccaccacgcctggctaattttgtattttagtagagacggggtttctccatgttggtcaggctgatctcaaactcccgacctcaggtgatctgcccacctcgtccttccaaagtgctgggattacaggcgtgagccaccgcgcccggccaaaaactgtatttctaaaaatagctttggtgtgactttaaatgactttatgtcaaatttcttagggaaaaaagggattctgctattttaaaaagcttgaaaatcactgagataataatcatggggataaaaaagaaaatagaaggttgcattattatgaggtaaaattgatagaatatggtgaattcctaaatatgggtgacaaataaaaaggagttgttgataatgcatgtaaaattaaggttcttagtctggattactgagatgatgttaatggtgaggaactggagaaaagatggacagagggtgttaagtgatattttagctttttctcttcctcctctctcccaccctcccacaaagaaaacccaaaccatcctgtaccgtcattatatctctctaatatctaccatctctaccatcaaataatctctatagttaatgtttctttcttagatacccaggacccttgagtttttaaaatcttctgttttattacaagagcaatgcaagactattgtaaaaaatatgcaactattatatgaaagcatgtaactcagaaaacccatctgtcagtcttattcccagagtttaacagtttgttgtattttcttctagattcttattcctgaaccctgaatatgataataagatataaatgtaattaacagttacttaatagcagtgtttagttacattattaagattccagatattaatagttacagattttgaaatagtaaaatgaaagttgggcatgatagctcacacctgtaatcccagcactttaggacgccaaggcaggaggatcgcttgaggccaggaattcaagactagcctgggcaacataggcagagcccatctgtacaaaaagttaaaaaattagccaggcatggtggcacatgcctgtagtcctagctactcatgaggctaaggcagaaggattacttgagccctgcagtttagcctggatgacagagtaagaccctgtttcttaaaaataaaaccaacatttagctttagaaatgtaaggcaatctgaaattgcacttagtggtcgatttccaacaaacacatgcatacgtgcgtgcatgcaaacacagagccacacacaaagcatattacatgtatgttccccttttgtgaagctcaactggtacctatgctgttttatcagatgatatggaacgtccttataaaatcacctttgggaccttcttatgagggtgaaaatactttcagcataactgctgattctgtcacatctggctttttttttttttttttttttgagatggagtcttgctctgtcacccagactggagtgcagtggtgtgatctcggctcactgcaacctctgcctcccgggttcaagcgatcctcctacctcaccctcccaagtagccgggactacaggtgcataccaccaacctcggctgatgtttgtagttttaatagagacggggtttcgccatgttggctaggctagtcttaaactcctgacctcaggtgatcacccgcctgggcctcccaatgtgctgggattacaggtgggagccactgctcctggccttcttttgttttgtttttttttttttttttaaagagacaggatctcactccgtcacccaggctggattgcagtagcagtggtgtgtgatcttggctcactgcagcctccaactcttaggttcaagcaatcctcccacctcagcctcctgagtagctggggttacaggcatgtgccaccacacgtggctaattttctaaatttgtagctatgttggcccaggctgattttgaactccaggcctcaagtgatcctccagcctcaacctcccaaagtgttgagattgcaggcgtgagcaactgtgcctggccacatttgactccatagacatttcttttctccttggaatatactcatcctttggctccgtgacacaatataatcctaaatttctttcttcctcctcagccaattcttattttccttttaggctgttcttctgtatgtgacaagtaagtgttgttggagttcctcaagcctttttcataggtccttttttcttctgtctctctctggttggtctcacccacccttgtggttttagtgatcacctatatagatgactcacaggtttatttttctttctttctttctttattttgagacagagtcttgctctgtcaccaggctggagtgcagtggcacaatctcagctcactgcaacctctgcctcacaggttcaagcgattcgcctgcctcagcctcctaagtagctgggactactgacgtgcgccacgatgcctaactaatttttgtattttcagtagagatgaggtttcaccatgttggccaggaaggtctcgatctcttaaccttgtgatccaccctcctcaacctcccaaagtgctgggattacaggcatgagccaccaccccctgcccaggtttatttttcttaagttgcagtgttactaaactgaacctgagtacactcacccagtgcagtaaagccaaacaccgacactgacgtctgtagcaagagaagtaagggtgtttgtttgcagggcaccaagcaagtagaataagatagctattgcttaaaacctgacctccccaatggcttacaagcaagattttttaaaggcagagatatattctaggaaagcagaagttattggcaaaatcatacatcaatacgtgggggttatatattggtttggtcccaaaaggcaggatatcttgaagtggggttgcaggattcagagattctttgatttgcgattgtttaaggaagcaaggctttgtctagaaacttgggatcagtggaaaggaatgttaaggtttggcatgtgggtgtcactgtctccgggcccctcaggaagaaatttagaatgaagaacgtcagtcagagttcagtcttcagttcccccttatgtgatgatggtggttggcactttccatttggcgggggtctgagtttctgaaaaataactcagggacctatgtcaagatgttatctttattttctatagggagcaacacatcttgtggctctgacttccatgagtggctattggtttaagctgttattacctccttgcttatctggtggctcatttacttctcaaggctagataggtgcctggaatttcccttgaaggtttcagatatgatgaggtttctcttcaaataacctgatcagtcttttattctttaattcatagtgccccccttccttttttcctttttctcctttcttccattttgcctttgttagatgcccaggcacgtcacagtaccaagcattatcaataccagctcacattcctttccttatttggaaagagaactaactttctagcttattacagacatgccttcccctttcctctccgctttctttcacatgcccaccttatctaaaagaatcaaatgtttagctaactggaattagtttagattgtacgacccaaccccagccaatggggaaagggtacaggggcaggacttgcgtcaggaataaaggctcttgtgcccctttgttcaggtgtgctctcatggcgactggccaaggaggcactcctctgtgcagaagtaaaattgctttgctaagaatcctttgttcgagtgttcaatttccttaggattttgagcgttattcctaacaaagggattcgagattttcttttatttccttgcttgagggccctcctggcaggcccctaagagggctccctgctctgtctcagcagatgtttttatgaagctgcctctttgacagtcttctttccatagttcttccctttttaaggaatgttggtgaatagagtcaaactctgtaaaatatttaaagaaatttattctgaaccaaatatgagtgaccaatggcctgtgacaccgccccaggagatctgagtacatgtgcccaaggtggtcaggctacaggttggttttatatgtgttagagaggtataagacgtcaatcaatacatgtaagatgcatattgatttggtccagcaggcaggacaactcgaaaggggcttccaggtcatagattctctgcttggcaattggttaaaagggttattatctaaagacctggaatcaatagaaaggaatgtctgggttaagaagggtttctaaagaccaaggttttatcatgcagttgatgcttgtaggtaacaggcttcagagctcttaccagatgcttcattacttctctcctggactggatcagggaagacctggaaagggaaggggattctctacagcagcagtccccaactttttggcaccggggaccagttttatggaagaccatttttccatgggttgggggatggtttcagaatgaaactgttccacctcagatcatcaggcatttgttagattctcataaggagtgtgcaacttagatccctcacatgcacagttcataatagggttcttcgtcttatgagaatctgatgttgccactgacctgacagaaggcagagctcagccttgctcacctcctgctatgcggcctggttcctaacaggccatagacccctagtccatgcctgtctggattccggggggttggggacccttgctctacagaatgtagattttacccacaagagacagtttagcagggccatttcaaaatatttcaaataaatacattttggggtaaaatacttccgtttctttcagagcttggtatctgtcatgttggtatcttaattgctataaagagtctgccttgtcagtcttaaagtacctgttttaatgttaatgctggtcagtcacatctaaatttcaaagggaggaaggtataatgaagcatgtccaaccacccgttcccatcatggcctgaactagtgtatggggtttgctttagaatgcccttggctgagggaggggcccattcagttggttggggggcttagaattttatttttgtttcacccttttccttgttaattttttagcctttagagttaagctcagttgccacttcctcaaggaagccttacctaagtttaccagataaactaaatctgagctggtctcataacacagtgttcctcatattcataacatattacaagtgaaattatatatttatgtgattatgctctgcggtgaagtactcatacatactaccacatggattaatcttgaaaacattatgctaagtgaaaaaggccagacacaaaaggccacatattatatgatttcttttatatgaaatatccagaataggcataatgttaaactttaaaccataatctctttctcttaccagtggcaaatctatatgggtctgcagcaatgttaatactcctccttagaagaaaggatttgattgagaggcataaggcagaatgagagaccaaggcaagttttagagcaggagtgaaagttcattaaaaagctttagagcaggaatgaaaggaagtaaagtacacttggaagagggccaagcgggcgacttgagagatcaagtacacagtttgacctttgacttgaggttttatatgttggcatgcttccagggggttgtgtccccttctcccctgattcttcccttgagatgggctgtctgcatgcgcggtgtgattactggagttgtacacatgcttgcttgaggtattcttcccttaccagttgagtgttcttataaggtcatataccagttaaactttgccattttgctccctagtacacatgctggagctgacttgcccaactcctaagatcttaacaggaagctgctgatcaccaatttcagatttttctatctattgggtgactcctttccctggcgccggctgcttccaattattttagagaggcagtttcacaactccctgtgcatcacttgagggttgtctgacattcctggtagtggtaggggccctgtcctgccctgctcatgtctgactggctacctactgtaccacttcctcaaacatttacttaatagttattatagtagcatatgtgtgtatatatatatttgcatgtatacacgtacacatgtacacataccaggttctatcttacatattcagaatacaaagttaatatggttattttcaggaagtttgggatctagtgagggagaggaagacaagtgtgctctagcatgataataatctaacaaaacaagataaatagctgcctactttgaagtttctaaagacttcataaagataatgaaaatctggcagtgctatgaaggtgacaatagagatttaaccagatacagtgggggaggtggcaattggtagtagtggtattaaaaagagaggccacagtagtatgtatacaggcatataaatatgaaaatgaatttgctatgtttaaggaattttaagtgttgtttaagacttgtttggaatgaatggtgttctgataagaaagtatatgaaaatcaggatgacatttagaatcagagtataggcgttatagcattagaagcctgggagttctttagaaagggttttatgggggctagatgtgtctagcaacagctggagttagggagaaggataggaaacagtaaaagctgaggcaaggaaggattcctagggaatatggagctagaatatatactatatctggtgacttggaacctggttgaatggaggtgaggaatgggaagaactgaagggttctttggtgatttcttgcctgggagctggtctctattttatagcatttgctttggttacttaggattattttatagaagatacattttgtttttatgcactgacaattttgtttaccctcaatttcaggtagatcttttgcgagcaggagaagttcctaaaccttttccaacacattataaagatttgtgggataacaagcatgttaaaatgccttgttcagaacaaaatttgtacccagtggaagatgagggaagaacaaaaccgagattcttttagtctctgaaaaatggtttggtacttgcttgtttgacctttgattctgtgatgcaaaagaacttagaatagcttcctcatacgtttttcttttttccaaaagaatggtgagcgaactgcggggagccggtgggagctcattcagactgcacttctcaacaaatttacacgaccccaaaacttgaaggtatgttgtttttaccatgcttgcctctttatgggccctgtgtctcctctttcgaagactttttggtcttaatagactcaggtagcaacattctttagatgcagagtgcttgcttcctggcactaaggaaggctccttagagacattctactaggaaatgagaagaactgagagttgcaaatgccttgccaggagccacacagaataatttggagaaccaggaataatacctctgtttcttgattccccatccgatttccttcagttcaagcttctctttcttttttttgttttaaaattatcatgtttctgaaatatctttaaaagtaaatcaggaaagaattatgacttcagcaatatttgcccaaagggaagctgagtttcccaattctgcccttaatatagctcctagcagtttaataatttactcatcttatattttggcaataatttatttttgatatatttatatttcatttatgactgcaagggtaactagtagattgtttttctaatatctaaaatatgagtgagtgtgtgtgtgtgtgtgtgtgtgtgtgtgtgtatatatatatatatatatatatatatttatattttgggggcactatagccatgaaaacttttcatgtttttataaatataaacagtgacagaattttttgtacctctatgaaaatgagttttattttctttcagagacttaatttgttgtgtatagtttctcagctttcttaatattttctactgatacttgcaagttattgttaaactttctatacctttctgtagctcctgttttttttctttacatggaaaacattgatatgttataccataatgtattttgaaggctttattccttggggacagtgtttctcaatcttctaatgggctctttttttaaaaaaagaaaaaaaaagcaggctgtttatttttcttttttacagtacaaattgatttatttaaaacagttagaaaaaaacaaaacaaaatagagattatcattagaattattaatggtttgttaaaaatcaggtaggattacggggtaagaaatggtattaggtgggaggagcacctgactagttctaaggctgtagatacaatgcagttgattacgtattaattcagccattacatactggggatagtagatgggggatcagtgatttatctacagggaactcctacacagatccatgaagacctccccagtgccatccttttccactccttagaccctaaaaccacctgggtgacaacatttccgtccttctttctccaccccattccctatccatatattcttcccacacctaaggtgctgtgcaagctgagagcagtctgctctctgcagctggaacatatactgttttggctacagggatcctgtgtgactaagaaggttttaggggcagccttattttaatatatcaggttagccatgagtacagtcagtcccttccctaacacaatttagattatcttgaacgcaagtatcaggtgagggatcaaccctgcctccagcaataccagcaatacgctaaccactcaggctcacaactacagaaagcaaactctttaaatggaaacaatctcaagttctgctagagtttgcttagttttagtataatgttaattatgtgtatgcaaacataaaactaaatataaactccgtgtgtgtgtgtgtgtgtgtgtgtgtgtgtgtgtgtgtgtgtgtgtgtatttttttttttttttttttaatttgaagctgggtcttgctccatcacctagggtggagtgcagtggggtgatcacagctcactgcaacctctgcttcccagactcaagcaatcctcatctcagcctcctgagtagcggggactacaggtgtatgccaccatgcccagactaattttgtttattttagttttttgtagagacagggtttctctgtgttccctaggctggtctccaactcctgggctcaagtgatccacctggccttggcctcccaaggtgctggctgggattataggcatgagtcactgctcccagctaactccctatacctgtagtgcttatacagctatatcagtttgattttcttttttaatttcaggtataatgaaccatcatttgatttgtatttattatcacagtgaaaacaatttgtagtcattattcctttttttgcacagaaattttcaaaccgctgatccaaaccccaaaatagtatgctgagaaattctttaaaatactacataaagaagaaattattttgcaattattacttttcctactaatcatgaacagttgaggggtgttggtggatacaaagatgggatccttaaatagaacatcagatcgcagtggcacgatctcagctcactgcaacctacacctccctggctcaagcgattctcgtgcctcagcctcctgagtagctggaaaaaaatctcaagttctgctagagtttacttgattttagtataatgttacaggcatgtgccacaggtgcatgccaccacactgggctaattttttatattttttggctgagacactgggtcttgccatgttacccatgctggtctcaaactcctgagctcaagtgatccacctgccttggcctcccaaagtactgggattacaggcatgtaattaccacatctggatgaaggttcgttagaatttaacatacctgtactgtggtgtatagtaggacagctcaatcttttcactgtttttgtctattaatagtaccagccttcattcgtacagcgtgttgttatttggctgttgttttctaaaaacaaaattataaactcacatagaaacaggctgcccaggaatactacccggagtccatttgatgaacactatcttaggttctttatttttattcttctaaacagaggctgtttttaagaatttttatatttcttcaactgcaaatagaataattatagtgaggccaggtgcggtggctcaagcctgtaaccccagcactttgggaggccgaggcaggcaggtcgccagaggtcaggagtttgagaccatcctggccaacatggtgaaacctcatctctactaaaaatataaaaattagccgggcatggtggcgggtgcctgtaatccccgctactcaggaggctgagacaggagaatcgcttgaacccaggaggcagaggttgcagtgagccgagatcatgccactgcactctagcctgggcaacaaagagcgaaactccatatttgaaaaaaaggaaaagaataactatagtgttttaacttacacagtctgcttacctctctagcaattccttagtgcaccatgattatttcaggaaggggtaattgctttaatctgaatttcctttttgtgtttctcttatggtagattcaatagaacagagtaatccatcgagatatttttctgtctgcttatggtaattgtttcctttgctgaaagaatgctttgagagaggaagagggaaacattaaacccctctaattgaatataatgatttttttgctgttcatataccatttaatgttggatttagagggattagagacattcagaattttaaaaagtaatagtgtcctcaaaagttgatttacacagtagtacttatataaataatgtgtgtgataatttgcacagaaagaattttttgtgcttattgtgaattatgaactataaagaacttactcagtagttgataactcaagagtacagagtagtatccagtttttctaatgacaggcaacctcatggtggactacttttgagacttgaagactgaagtaaaaatgaatacgagctaaagcttaatgctaattataaaacactaaaataattagagaattacagtgaagaattagaatgcaattgctacttaaaatttttttccttaccaactttgaggaataataacatatggataagaaagtttatccttttaaagtgtgtcatttgatgagttttgacatttacacataccatgaagctcccattataatcaagatacagaatgtttgtatcatccccaaagattcctctccccactttgcagtccattccactttctgctctggccccagacaactactaatctgttctttttcactatagtttacattctgcatgaattgaatcatagtgggtgtgtctggcttcattcactcaaaatgaagataattttgagattcatccatgttgttcaatgtattgatagtttgctccagtatatgcattgtttattccttcacctattgatacacatttctgtttaatactttatgaagttttgaaattagataccagtgattggaaaaaaaatccttaaaatcttttaattttttttttctttctttttttttttctgagacaggatcttgctctgtcacccaggctggagtgcagtggtccgatctcggctcactgcaacctcaacctcctttgctcaagcgatcctcccatctcagcaccctcatgtagctgagactacaggcatgcaccaaccatgcctggttaatttttgtatttttttctagggatcttgtcatgttgcccaggctagtctcgaactcctggactcaagcgatgcacctgcctcggcctcccagagtgtgctatgattacaggcgcgagccaccatgcaggccaaaatctcttaattcttttttttttttttttttttttttgagacggagtctcgctctgtcacccaggctggagtgcagtggcacgacctcggctcactgcaacatctgactccctggttcaagtgagtctcctgcctcagcctcccaagtagctgggattacaagcatatgccaccacacccagctaatttttgtatttttattagagacatggtttcaccatgttggccagaatgctctcgatctcctgacattgtgatccgcccgcctcagcctcccaaagtgctgggattacaggcgcgagccactgcgtcagcctaaaatctcttaattcttaatggaaaatgttatgtatgacttgtgagtgaaaaataaagactctttcactctttcttgctatcttattttacggaagatttttcttttcttttatcttctcttctcttctcttttcttttcttaaagaacttggatgtcccctgattccaagtgaataagacacattttgttggctcatcttttaacctagatacttagtatggcatgaagtactattcaggaagctttgacagagtattaattttttaaaaacttattcaatgataacgaaatttggaagatttatagtaataatctaacagtggttttcagacctgtgtgcctcagtaaaaaaattttgagtgtgtattaccaatataaatagtcatttataaattctacatatctattactttattaatgtaatatgtacagtataaaataaaaccaaagtagatatttaaaaggatgagataaaagataattataaataaatagttgtttctgcacatctagtggattgtcttatgcatacctgactctggaaaccagatgtatagtattgcctattcaaacagttaaaagctacaccagtagatggcataatattttgacttttcattctacataaatgtgtaatttatgtgaactgctggaggaagataataatttatatatagtataaaaatactttatagtaaaggaaaaaagacagtttttaaatacttttttcctaatctcctcgtccccatgaaatttttattttttattttttacaaaaaaatttatgcctcaaccctattaactgacccatgaaattttcatactacaaatctgctgtgtatgtctgtgtatatataatctgatgctttcaaggaccaccaacaattgtgataactaagtttattttttacccctcaagatacagtttttgtctatttggagtatatcaccttatttagaatgcatgctttagggtgtaattgtgttttttcacctattacttgaccgttctaatctcattttttaaagtgagtaataaattagtaatcattctgtttgtctgtagctactgatgtccatatcagtagcagggggaggtagtcggaagcttgtctaacattatgaaatatactggaggtaattcataagagacaggctcttcataggtcattcacttggccataccatgacgttttgtttctgcattttccacaggatgctattctgaaatacactgtggcatattctaagaaatgggactttacagctttgatcgatttctgggataaggtaaaagtatccctatttctttatgaaaatattattgacaactcaataagaaggtttgagaagaatacccataattctgccacactaagataattatcttttagttttataaatttgctgttattttatatgtatgttttaggtaaatacaattaggagttaatattgaattttgttttcatctcttagaacacacattttctgttatattttcataccattatcagcattatcaaggaatgtataatagtccatgactagattttgagaatataatggttcttatattctcaaacatacaggttgcatccagttttaccttcagttacatagtggcaacatcattatatatgtatatatattttcccatatttgatattgtttctttaggtgatttccagaaattagatgactaagtcaaagggcacaaaacatttgtttaaaaatcttttaaaaacttttgccataaaatcatttttccacagattaattgtagcaatttactatgctgccagtagtggataagaatatcactttcatagtaccatcagcagagagagtcttttcatttgtctattggccatttctatatcttctttggaaaaatacctattcaaattttttgtctttattattgaattttaggcattctttgtatattttagatgcaggttccttaccagatatatgatttgcaaatattttctcccattttgtgtttttttttttttctttttcttgatgttacactttgaagctcaagaatttttaattttgacaaagtcagtttattattttttttcttttcttctgttttcgggatcatatttaagaagctaatctaagttcatgaagatttatgtttcttctaagaattttatagctttagctcttacactatgaccattacccattttgtgttaatttttgtatatgatgtaaattagaagtccaattttattattttccatgtgaatatccatttcgagttaattttcatatgtggtataaggtaggagttcaacttcattattttgcatgtggataacaagttgtcccagcaccatttgttgaaaagactcttctatcccgtgttgaattgtcttggcaccttttcaaaaccagttgacgtaaggattgtttctggcctctcagttctacgacactgatctgtatgtctgtccttgtgccagtaccacacagtcttggttccatagctttgtggtaagttttaaaatcaggaagtgtgtgtcctgtaactttggtctttttcaaatttgttttggctgtttttggattctttgcatttcactctgaattttaggattaatttgttaatttctgcaaaaaacctaggtgctaagggcaattcttacatcacgttaatagaatccaaactaattctgcatttcgaggtagtgccagtaatttcagaattatcttattgagcttttgacccatatggcttttacaaggcaggcataaataatggaagacttatccttgtgtctggaaattggatatctcagatatccttgaatctaaatgtctttcactgtaacagcaatgtaatatctgatatgatgaaaagtagatcaaaccgatataatcattatccttgtcacttaagttatcaggacataacatttgtattgtaagtttctgggcttaaattggatatgatggttaattggggtaagaagtaatgtataatttaataccttgagatggcagtaaaacatgccgttggttacaatacctctgtcaccttgctatgaagtagtcatttttttctctcttcttaatcagaatactcagacaggaccttgtttcccctttatctggtgaccttgcccagaagcatgcctgaaacgggtaacatatagcaagttttggtgtgtttagtgtagatcataaatatgagatgattactcaggtgctgatgatggttttacagttctttagggagaagagtccttgcgttttcgaccttctaatatttatttatttatttatttatgaaatggagtctcactctgtcacccaggctggagtgcagcggcacaatctcagctcactgcaatttctgcctcgcgggttcaagcgattctcttgcctcagccttccaagtagctgggattacaggtgcccgccacgttgcccggctaatttttgtatttttagtagagatggggttttgccatgttggccaggctggtcccaaattcctgaccttaagtgatccacccaactcggcctcccaaagtgctgggattacaggtgtgagccaccgcccccaaccagaccttctgatttgtatttactttgtaaacatatggagggttggagaagtccccacaactacactaagtatttatttcttgttgtattctttttaagtctttgcccatatatatgatgtcttatagctagatataaatgtatgtttaaaatttatgcagtattataaaatcttctgtgttatataactttataatgtttagccttaatggttgcaataatattccatcaaattgataaattgtctgctcatccattcctgtgtttgttggagatttgaggaaatttgtgtaaagcttatctagagatttgaaggtggttctccctgtgattgtttgctattctgtcattatgagtgtacttaacaaaataccttggatgtttaatacacttgtttatttttctatccatcaaatctccagatattattctagaactttagcaagtcatgacccacagggacaacattgcccacacttgcagtggttagtgagaattaagtgtcagacatacctatataggtgggattggtggaagaaaagatttttagcgcaagggaaacaattgtttggtttggttttaagttgaaaataaattatatttggtttgcattttcagtgtcttatgttctgtactaggaatgcttgtttataaagggttcttttatttttttatttaaagccaggctatagtgcagtggtgctgtcacagctcactgcagcctcaacctccggggctgtatacattctcccactttagcctcccgtttagctgggactacaggcatgtgctaccacacctggctagttttttgtatttttttgtagagacagggtttcaccattgttacccaggctggtcttgaactcttgggctcaagcaatcttcattcctcagcctcccaaagttctgggattataggcatgagccactgtgcctggcctataaagcgttctttattttcgagatggattctagctctgtcaccagactggaatgcagtggtgtaatctcggctcactgcaacttccacctcctgggttcaagccattcgcctgcctcagcttcccgagtagctgggactacagacgtgcgccaccacacccagctaatttttgtatttttattagagacggggtttcaccatgttggccatgttggtctcgatctcttgacctcgtgatccgtccgcctcggcctcccaaagtgctgggattacaggcatgagccaccgcgctcgaccttaaactaacggttcttaaacattgtttattagcagggtttggcaatattttcaatttttattttctaattttttgttgttttgagacagtatctcactctattggccaggctggagtgcagtggaatgatctcggctcattgtaacctccacctcccaggttcaagcaattcttgtgcctcagcctcctgagtagctgggactacaggcatgcaccaccacacctggctaatttttggatttttgatagagacagggtttcactatattggccaggctggtctcgaactcctgacctcaagtgatctgcacacctcggcctccaaaagtgttgggattacaggtgtgagcggctgctcccagccagaatttggaaattctttacttaaatgtcacattgaactctgagtggcttgttttattaaggaaaagaattaaatttgacatcgtattaagattaatattttgcagttacgtttattttgaagctgttgatatttatctccttaaaacctttctttgattaattctgtaagtaaaggattttgtaacccaaactaccttacaacaagaggagttcatgtcaacagtcattgtgaatccatggtaccataattatgtacattctggtctctagcacaggaggtaaggtgcccagaagcccaccctggtgtgtgagcacctctactggaatggaagtaaggagtattacctaagcttttattagtttttcagaaaccagcaaagatcacagagaccaatctgttaatttgttatttataattatatatttaggtgctactgagtcgaaatggctgttatttagtgttttctgcaacttcagggctaatattggtcttcctcactgccagctgctggaagtgctacaaacacacaatctgtgttttatggccctcctgtgtggtgtttcacaaaattaaattcaaacacttctgtaatttatattctaaatgaatcaatgtacttactcctggcatttttcactggaaagttgaacaaaatgttctatatgttataaaagtcctctatcaatgcatcttggaggaatttttaaatacttctctttttttttttttttttttttgagacagagtctttctctgtcactcaggctggagtggagtggcacgatctcggcccactgcaacctctgcctcccaggttcaagtgattctcccgcctcagcctcctgagtagctggaattataggcacccaccaccacgccaggctaatttttgtatttttagtagagacagggtttcaccatcttggtcaggctagtctcgaactcctgacctcaggtgatccacccaccttggcctcccaaagtgctgggattacaggtatgagccaccgtgcccagccaaatactcctcttttacaacacctgtggcactgtttcatttcacttatagtgtgttaacttgtgaaatttacattaaagctgtagtaactgaagggcatgggggatgtatttttaagggggtttcttctgtttctgcaatgttggcttctatttctggacttggatatttgttttatatttattcattagactatacatatatatttttatgtactttttgaatattcacagtaagcataaaatgttattataaagagctttaaatctgcaattgatttatgtagcaaacttcttaagaaaatggattaattgttgaaaggaagcctaaggattttagtgactatttcatcttcctttccatgttgagttttatgtctggaattgaaaagatagaaatgtataagcctttcgtttcatccttccattggtttttccatgaaggctgtcataaataacaaaatgaagtggttttggttttgcttttgttttttgcatctgtggctggtaaaggtagagagtgagagataggagtacaggaaggagaggacatttaaaagtaaaaaatgaaaaacctagactttagaatgattatgttgctgtgatgaggctagtaatatgtttctctttgtaaaccacaatttaaatatagatgtatagcataaagtctttacttcaaatcatacatacaaaatagattattgcaacttagaaattgtgcatcttttgtcttcgctgtagttattaaaatatcgactacgcattctcctatcagctcttgtcctatgacttgtcagagaaagactgtttaaagcctctatcactgtaaataagagtgtgtaattctattagtattgaacttgcatttttatttatgtgctacttaatttaaaaggtaaatgggacatcatattgagttttgaatgatgcaaattaagttgatcatgttattacatctgtctttttcttcagaactgtttctgtcatttaaattttttttttacttttttttccaagagcacaaatccacttttatttatttacttttcattaatttaaatgcttgaggggtacagcatcacacagattctgtgtccagtggccttagcaggaagattgcttcagaatttggcgtgaaccatgccactatttccctgggaccgagttacctttccctagattactctgattttgtttggtttgccaccaggagtcactttgttgttctttgttttgtatatataagcacatcttatgcccgaatagaattctgtttcattttgggcataagcaccttctattttaaaaagagctgtgtgctgtctttggttctggagaccccacttatactcagcaaaaatggccttggaccacagccttccagacatacttccttttagtattcctgttcccagcaggcctccacaggctccaagttggcagaaagagaaaggccatttaaaattttaaaaacaggtacaacataattcattgtctccaaaattgaggcatgtattattatagctgtgtttagctaaaataacagtttttgaacttgtgattatggaaaactttaaaaatgataatgtattgacagagcatcagtagaaactcagaaaaaagaacataaacttgtattaaaatagattacaaaaagttatttcacatacacaaagtaatggctggaagaaattaagttttgatttatgcctttattatataataaaaagttaaaatatatgttgaaattattaggcaaaaatcacagcacaaatcagctatgattcaataacgtaaaacacaatagttgtatgtttatgcatcacttgagcatcaatgcattcaagcatatgtggtatactgtggacatcctggctttctgaggtgtggcatgctattatgagtagcttatctcatggtaattttaactgtatcaaatatactcagtatttttgtgtattaaaaattttagaacaaaaatattgttagaggatttttctttcttctctcttcattcctcctatccccacccctttatccccagactgtctataaacatttcatgtagggttagtgctttttagaatagtttgggaaaagctgacctaaggcggtaaattgttataactacctttttaaatcacaacagatttcgttattcagtaactgaaggaatgtggcctccttccatgatagccttttggtggtcattttttgttttgttttggtttggttttttgataacactgaagtaagtttctgaatgtatataaacacattattacttagcttgatttaacattcttcgtagataatctgttttctgggattttcttcaaagcttaaaaaatatcaagtgtctttgttatatttgtcacaaagagcctgtaccaaactcctaatcaaatgaaagcagccttgaatgtttcataagactaaagctaatgtctttatctctctagctttcgaacctctgatttggagttcagtggaaatttaacctttttggacctcttcccttggtgactcacagtctctggaatcataaggtctgcattactttacagctcaatttaattcatgagaactataggagccaaaagggagctaatcagaatcactaaaatattgaaacagatcaattgtgacttttagatttgtatggaatatgtggaatttctctccctggtttggttaatgagtgcttttgaatggggacatatgttgagggtctcatatttatgatttatgatttctaaatagtgcatatcccaaaggacagattactccaattggaactaggcactttgcttttataaacttgatgagttaccatggaatatcagtcttagttgagccctctatgcactagatcactgatgaagttggagttgttattttgtgtttgcaaaacactatctggattgtatttatttatgtggtggacaaagaggttagaagttatagatactcaaaagtgaaaattcattcagtagactttctcttatattctaataatgaaattaagctagtacttagtttgtcctataactctaacccttcatttgtgtcaaatagcagtagaagttattctttttaaatgttgctgtggtgttgatttcattatccaaaaatctactgttagaggagtgaaaataattctgtgttttaatcttgcccatgatttatatctctatcagctagctctgaagtgttttgggttttgttttgttttgtttgtattttattaacacagttaaacatgatgccttgatttataattcctgttaatttgcatttattcttcttatgttcctactcataaaaataaattctgtagtccttttgagtatgctttgaacacttatctacatgtaacattgcatatttaaccctggaaggactattgtagtatttttatctgaaggtaaaaataatgagtaaataaaaacagaacgttagatctgtttttcaaatttatatattgtttcagtgtgtagcctatctaaacaagcggtaaacttgctcatcaaagactaaataggtccattggtccttttatatgagggggtgctgttagtgctgtggtttaccaaagactaagccaatggtgtttctccttattttactattagtactagtagagaaaaatactcatcctcgatttattgtgatgataatgacaggtaatgatttactacaagagtctgtcagattctaagcaggctaaataatttttctttatagtgtgttaacaaagtttttagtacgctgagtgacatagtgccttgtcaccacaaatgctctttgattacatgaaaagtgttacaaaaagacattttctgcagcaagggccatttccagcataatgaaatatggaatattttcaaatgaactccaaagtgatatgtattgaggtcttgctcttggtctaatctgcctcagtcctgagaagcctagctctaagataaacaaagggcatcttccactgggagtgcaatgttggaactgctcactgccttaagtaaccatatgcatagcctctttcctgatagttggctcctgtctccctttgtaatcctttccttcttccatgcctgctgcttaagttgcagactattccagcctcacttctcttggacacttctatctgttgcaggcataggcctgtctcatcccagactcacctcttctacaagatcctccctgtacatatctcctttgtgtttgctggatcatcttatttggttatctttggcgatggaggtggtagtgcttattactgagagttttctatgtaccaactatagtgtcagcagtatgctttatctgatttaattctaacaaccacctcatgagttagatgctattaatatttctgttttacaaatgaagaatggaaaaccaaggtttagggagtttaagtaactgacatctcatttttatctatggactgtggcacatgctgtcagagtcggtctttgacatagcacctaggaaagaagctgaatcagattaaacatactacccaaacattaggtcaattgaaaatggctagggaaaagggaagattcatcataaaaactaattgagtaaaactagggaggcccaataagttcaaatatttgaattcaaggtagaaagaagaagaaaaccctctagcaaaagtcggccttaatggcccatagccttagatctggcatcatttagaaccacatggctgggcatgtggctcacgcctgtaatcccaatactttgggaggctgaggcggacagatcacttgaggtcaggagtttgagaccagcctgaccaacatggtgaaaccctgtttctactgggaaaaaaaaaaaaaaaaaagcagcagcatcacagcctcagggaaagtacctaccagcttccaacagtcttcgttcctttgaatcctttgccatctggttatattccctcttcccattcttgttatctgcccatctttgacacctcttttcctctctcctgttacttggcatcgccttgggcaacttcggttcagttgatattcatgttgatgaaccatttactagtcaaacccagtctgtgtgtgagaccttctactttattaacccatgtgaccacaaatgaccagagcttggacctgattatcccctgggccagctccttctctaaagccatgagctcagaattcttctcccaccacagcctcctagttttctactcccttattcctactgtgctttctgttttttgagtctccactgcgttcatcccttttcttctggtccactgtgtcccaggttgtattacgcaaatattaacacttcgtaagtaaagggttaatagttaagttgggggaatgtactgggtattatatccttcttctgggaatagctctgaggagtcttaaagtaaagaaacatgcttagctttatttaattaaacctcttttttttcaaacttatttataaacagcttccatgtaacagcttttgacttcctttgtagcaagtattccatggagcatactttgcagagcacagttgtaatggggaaggaagggaaggaggaagaaataaagggcgagaggagagagggaaggagggagagagggaataacaaatcttactgataggccttgctaagagttcatgttattcaatcttaactaggcctttgtttcctgttgccatcttttatatatttccttattactctaggattccaaaccttttcattgttttgtaacatttactgacattccactatcagtctgctcctacttaatacctctcggagagatttgaggacatctaaaaggtaaattctttaagtttctttattttaagggtttcaacatacctcatgcttctctttcttgttatctcaaaggaaaagctcgtcttattccattcctcaagggcagcatgtccaaaacaattatactttaggatacatatgtcactgtttcttttctggccttgtccctctttccctgctgcctggttagtgcttccttgacttttagtgttcagcatgactatcacttctgcaattgactttatttatttatttatttatttttgagatgttctcttggtctgttgtgcaggttggagtacagtggcatgatcttggctcactgcaacctccgcctcctgggttcaagcgattctcctgcctcagcctcctgagtagctgggattataggcacgcaccaccttgccgggctaatttttatatttttagtagagatggggtttcaccatgttggccaggctggtctcaaatccctgacctcaggtgatccgcccacgttgggcctcccaaagtgctgggattacaggcatgagctatcgtgcctgacctagactttctttttttagagcagttttagattcatagcaaaatacactgatttctcatatatcccccactcccaggcatgcacaccctcccccattatcaacatcccccaccggagtggttcatttgctacaattgatgaacctaccttgacacatcattaccactcaaagttctgtaattgatgttttacagtcatcttctataagcttccttgtatgaggctgtgatttgttctttgttatgttcctagcacttaacatagtgagaactttcaataccacttaatgcaggttatatgcaaatcttttttcttttgctctttctctctgccatcttctaattgactattggatttattcacctggatatgccacaagtacctaaaactatccttgtcaccactcttccacattctgtcagtgaatgattccaccatttatctattcattcactcaagccagaacttgttaatcatcttagctgccctattctgcctcagccacctttttctgctcatctaccatttcctcatcttacagtatgatgtcataattttacttcctaaatacttcttgagtttcggctctatttctgttacacttgtctcctccataccatcgtcatgactcagctagtatattgtaacaatcacctagccgacccctgtgtgcagttgatcccttcaaatccatccttcatgctgcttacacacagtgaactatctgaagcatagatcttaaaaccttccatggcatttcatctcttttcaactctattggtgatatttatggcattccatgaccttgcctctgcccacctctctggcatcatttcatgccacttttcctgcttgaaacctgatggtctaatgactctaaattacttgtggttctctgtcatggtgtttgcctgcttcttaatccagccttcaagactcagctcagtttttatctcctctgagtatccttttttgtcctctcagccgctactaaaaactcctctgtgtgctcacagtagtacctgtgcacaactccatgtgcttgttacattaggcatcatatagccacgaaatgtctgaatattcatgaggcccaatttttccagggcatcttactattttctagcccatggctaatgcacagttaatgtttcttgaactgagttcaggatattcagggagagtagtccagcacacaaaaatgtgggccttgaaccacaatcacttaccgagagatttaggaattattttgtgtaaggtgatagttgaccatttgcgactggtgattggtagagagaaaaggtaaggccagtatgcataacctttactatggtcttttttgtttcttttttttccagagacagggctttgctctgtcctccaggctggagtgcagtgccataatcatggctcatcgcaacctcaaattcctaggcttaagcaagatcctcctacctcagcttccagggtagctgggactataggtctataccaccacacctacctaagtaaaattttttttggccgggcatggtggctctcatgcctgtaatcccagcacttcgggaggctgaggcaagcagatcacgaggtcaagagatcgagaccatcctgacgaacatggtgaaaccctgtctctactaaaaataaaaaattagctgggcgtggtggcgcgtaagttgcagcttctctggaggctgaggcaggagaatcacttgaacccgggaggcagaggttgcagtgagccgagatcgcgccattgcactccagtctggcgacagagtgagactccgtctcaaaaaaaaaaaaaattttttttttgtagagaccgagtctcactatgttgcccaagctggtcttaaactcttgcccttaagcaatcctcccgctttggcctcccagagtgctgagattacaggcatgaaccactgtgcccaggctttatagttgttgtgtagcatttttaccctaaaaagtagtaagtttctagaggacagacaccttgtattgtttgtcttggtgtttatttttcacagtgctcaatctaatgtcctggacaaagtgggtgttcaatatgtgtttggactaagtagcaatatgtgactagaattcagtaaaagggagaggctgttctatttcttgtatttctgagctccgtaagttcacgcttcaggggcccatttacctctttaattccctgcatgcaaaaggaggatgaatgccttagatgatagattgaacctgacctcttaatgttttatgtgatatagctatgtgccacatcagtcctcatatgccttcatttttatatgggctataaaaccaaaattacttcaagaggaatatttgaccattttcatccttcttttaaaatgaattggagttaccaaaagtagcctgatgcagttgaataaaattaagtgtattttaaaatctctaaacaaaaagctacagatttaatcatctgtagttgtatctacatatgtctgaaaacccctgaatcttctttcggttgccctggtgactgtttcattggagtagcgtatcaagaaagactacatctgtggagtccaaacactagctactatccacataggctatttaaataaaaattaattacaatgaaagaaaatttaaaattcagttcttcagtcacagtagccacatttcaaatgccacatgtggctgccggctgccatcctggacagcacagatatagaacattttcatcactgcagaaagttagactgaatagaaatgtactaggtcatccctaaggatccttctgcatctgatatccttctactgggaaacctgctcacagggacttctgagatttctcaacattgtttgactgcattttgaatttttttagattggatattacttcaaataattgagttgttgagtagaacttgtccatttttaataaagatcttttcattgtaatagcatttgttttaactacaaatgtatttgcatttttattctttctccaaagagtgcgcttccagagagtgtcctcaagccttttaggaaaattagttttgtttcatccttaataagagtgaagttcagactataatattattattccatactggataatttaattaaattaagaattaagcactataatatgtatgtatgcacgttacttgatttgcatggcacattttataatagcgctgtgagtgtgctaagctgtcattgaactaccataaaaattacttaagtctgggtgtggtggttcgtgcttgtaattctagcactttgggaggctgaggtgggatgattgcttgagcccaggagttcaagaccagcccgggcaagatggtgagaccccatcactacaaaaatttttttaaaaattagctgggtgtggtagcatgcatctgtagtcccagctacttgggaggccgaggcaggaggatcccttgagcccaagagttcgaggtggcagtgagctatgatcacaccagtgcactccagcctgggtgacaaagtgagacccccatctcttaaaaatatatattactgagaaataagtatttttcagggtacttcttagagttgaaaaaacctgctaattatttaaaagtataaactataataaaagattgaagttattgctcacctgtatttcttggacaaattacatccattttacttctagggctagaaaacttatatcaccattagctgtttctctgaaattttgtcatgttgagtttgattgcctgtctataaagatggataataatgtgactgtggtattgaaagtatccattggcttggacataatagcaatgtggtttggtggtgtttacaaaagtgattgatggatatggccatgtagtcgtacagtaatagaagtgagaaataggaaagacatgtcagagcgtcttgtgccagtgtgggtttatttcctaaggaataatcatttaccataatagtactgagaagtaaattctttggcggcataggataataaggatgtattattatgttttgtcttttctaaagtaagaattctgctgtttattattagcatgaaaatcgatatgattgtgcaataaatactgtttaaagaagaacttccttcatgttttataaacctacacaattctattcttcatgtttaatgaagtttgtgtaggaaaatagtgtgactgtttttgattagaggcatattttgtttcaagaattggatgaagatcttcttcctaaactgattgtgttcccagactagttgttaattatttggaattaggagtcatgatggggaaatttccaccacatccagaaagtctgtgaattttaaacctctgatggcttgttttctgaagtgaaaaactaatgcagatttctgtcactagaaacacagcagtgcttaggagagattggaagtagggttgtggtgagaattggcaggaggactctttctcccttcattcctcctccttcgtcctgcactagctgataagagctgggccataggagtggagactaaaaatgaaaggaggtttcattgcttagcacttcttttcctcttttcccccttctgctggcaatccttgatggggaggaaacaaagtgtctgtatagcagcccgattatttcatattaagcaactgtcaaattaatataaggacaactgcaggttatttccagtgtgaattacagagtactttaaaaactcgttatatttcatttatctatcgttagggcaaatcatttcaaatgcttataatgagctgtgatttttatcagtatttcccagatttgagtcataaacactttgaaaattcatagggagactcttaatagctgtttaaagaggaaaaccaaatcaaaccaaaagaaagtagaggggcaaggtgatcctcagcacagccatttgtatgtgtcaccacagctgacccctggactcagcctttcacaccaccttgccctctgctaccacactgattttgtacctctccatgcacagtcttatttaggtccatgaactaaataagttagctgctaattggtgaaatatgccttcttaaatatgaccatgttagcctggctatttcctgaaaaccagttggagtttattaaaaatagagaccatttttattgaagccataattgtcatgggcgatacacatgagagatcaccctgtggctggcctgtcagactttcatgagccttcagaaattaaggggaatgagtgagtttgttttcttgtaagctgtcacattcttctcttcaaagtgtcagcctgagttgtgcacagataaatgttagaaactttcaccttctccagttgatttttttacccttacataatttagtagtatgattgtttttcctctaacatttaatgtttttgtacttttaatttttgaaatgtgagcttgtgctttagagttgggaaaacttagaggtagttccagtatagaaagcttagcctatagacagtttaatcaacttacacaaaactataatatttttgctaagtaatagagattctgaaaggcaatggagaggaggaggatgagctttgtaaaatcagctaatccagatagaaagtgtcagttaatttaacatatttttattgacagttttacatatgaacaccactgttgtaggaatggtgaatcaatcataaatcttgtcttaaaggagcttctagtaagggctagaaggcacgttcataaataacaacagaaagcagaaagtcttaagtgtcttgtgaaaaaaagttcaaataaattacaagagggagaattactttttagctggagagtaaatttggatagacttgaagcaaactattgtttgagcaagatcaaaaggttggataagttttggagttaagaaggaaagatattccaggatcgtatctgtagcagcacaaacagatgctatagaaaaatgaatttctgagtttctagtatgtaggctgcacagaaggtagagtttgtgagtgtgtgtatgttatatatatgtgctgaatgagactagataagaatctagggtaagggagcttgactgttagttcaagggatttgttctgtattgaaaaggcagcagaaagccattgaaagctttgaagtggagcagaagcacatcatagtctacttgggcagaaactgaaggtgggctatcagcagggcagcagttagattattgtagtaatcttgatgagactggatgagggctgagggtagtttagtagtgattaagatgaggtaataaatatgtgagatcctgctggatcaatcaatataggacttggcagttaattgatatgggggtgatcaaagaagaaggaggctccagaaagtttgtgaattactggcccattagacattaatactttttatatggagctttagaattcataaaaccctattatatctgaaagctttcgtaactctgtaagttaaagttatagtagaattatccttactatggatgaggaaataaagaatttagggatttttctgtggttaatatgagagtaaatgccgatctaggcctataactagtcttccagtttcttggccagtatttcttttatatccttccttgtgaacctgggaagaaaaactctggcatctagtcccaatgtctttttgttttttttttttgttttttttgagacagagtcttgctctgtcacccaggccggaggtgcagtggcatgatctcagctcactgcaacctccacctcccgaactcaagcgattctcatgccttagccacccaaatagctgggactacaggtgtgggccacaatgctcagctaatttttgtatttttagtagagatggccaggctggtcttgaactcttgacctcaagtgatccacctgctttggcctcccaaaatactggggttataggtgtgagccactgcccccaaccaccactgggtttttgaatgtggacaaattgcttatttcttggagctttagtctctctagatgcccttatcctttctatcttgcaaggatactttgaagataaaatgcaatgtttttggttttatcaactctttattcagcaaataatgagcactaaatactatgcttagtactggggggccacaagatgtttaaatttgtgtgtttcacagatcagaggacaggaaatgcagataaataattgtaataaccgcagtaagtgttctaatacaagtatgtacatttggctctagagtcatagagtaaggggcagtcaggcaatcagcgaaggcttcccagggagatgggaactgagtcctgaagcataattcgtggtttaatggtagtaaaatgttaaacaaggcagagggtaaaataatgcatcatcatcatcataatactagctgttatttgttgaaaagcttataattctgaccacatctctgcaagatattttcattttataagtaagaaaataggttcaaaaggttgtgatttgatcatagtatttaatgaagtcagtatggtacattagggaggtgcaaatggttaagtatcactggacagtagcaaacaagcaacagaaaggataaagataaaactgaaaaaggggctcaagtatgctatattctagatattaaaaaataaaaataataaaactagtggtttcatgacagacaggggagactattttaacatatatgagacaaaggattaatacctagtaaaatatgcctaattaaacattggttactatgtggaccaagatgttttcactgatcagttctccgaaacatttaaggaagatataatactaagttcacagaaactcaaataagagaggaggagggagcactttccaactcatttataaagccatatatatatacctctcatactagtatgtgacaaagattttataaaatattagcaaatgaaatctagaaatatgtaaaaaggataatacatgattactaagcagagttcatctcagaaatgcaggattggatttatattttaaaagctgtatgattattgtgataaatgcagaataagcacctgacaaaatttagtaaccattcagagtgaaaaactgttagcaggccgggagtgatggctcatgcctgtaatcctaacactctgggaggccaaggcgggtggatcacctgaggttaggagttcaaggccagcctggccaacatagtagaactccatctctactaaaattacaaaaattagctgggcatggtagcatgcacctgtagtctcagctactcgggaggctgaggcaggagaattgcttgaatccaggaagcagaggttgcagtgagccaagatcgcaccactgcactccagcctaggtgacaaagcaagactgtctccagaaaaaaaaaacaaaaacaaaacaacaacaacaaaactattaacaactatgtcctcaatctgataaagcgtatctgtgaaaaacctactactaaaatcatgcttcatggtgaaatatgaaatactcttcccaaagattgggggaaaagcaagaacagccatgctcttcattcttattaacattgtactagaaatcctagccaatgcagtaaggcaagaaaaagaaataaaatgtttgaaaatcagaaaggaagaagtaaaactgtttctatttgtagttgacagtgtttgtttatgcagaaaaacccaagaaacctaaaaaataactattagaactaatttatttagcaagacataaggtcagtatacaaaaatcattatatttttatatacttaccataaatgaaattttaaaaatttcattaaaaatagtgttaaaaaaccataaaatacttagaaataaatttaacaaaaaatgtgtaagaccagtatcttgaagactgtaaaacattgctgggagaaattgaagaaaacctgaataaaagaatatctaccatgctcatggaccggatgactcagtgtggttaagatatcagttctcagccgggcgcggtggctcacacttgtaatcgagcactttgggaggctgaggtgggtggatcacttgaggacaggagttcaagaccagcctggctaacatggtgaaaccccatctctactaaaagtacaaaaaaattagccaggtgtggtggtgggtgcctataatcccagctagtcaggaggctgaggcaggagaattgctcgaacccaggaggcggaggttgcagcgagccgagatcatgccgttgcaatccagcctgggcaacaagagtgaaactccatctcaaaaaaataaaaagatatcagttctccctatatgcagttccaatcataataccaagcaggcattttgtagaaaatgcaaagctgattactaaaatttatatggaaacacaaaggacccttatttacaaagaaattgtaaataagaagggcagagtttgcagacttacgtgaattgctttggatacttacaataagactacagtaaacaagacagtatgtgtggtgagttgaataatgtccccccaaattaatgttcacctggactctcaggatgtggctttatctggaaatacagtctttgcagatgtaactagttaagatgaggccacactggattatggtgtatcctaaatcaatgactggtgtccttatgagagaaggaaaggacacagagacaaagacactgagggaaaacgcttatatgatgatggagttagagattggactgatgtatctgcatgccaaggaaccccaaggattgctagaagccaccagaagctaggaagaggccaggaagagccttagagccttcatagggagcgtgatactaccaacaactggttccagatttctagactccagaactgtgagataatacatttttgttgttttaagccgcctggtttgtggttctttgtcacagcagctcaaggaaatgaatacaatatgatactgacataacaatcaaattgatcagtggaaccaagtggtaaacccagaaacagacccatgtttatacagtcatttggttttcaacaaaagtgccaaagcaatacaacaagggaaaagaagtgtcttttcaacaaatggtgttggcgaaactggatttccatgtgggcttaaaaaaaaaaattgccccttcccacatactatacatagaaaataattctaaattctaactgaaaaagcaaaaactataaagcttctagaggaaaacatctttgtagcttaggagtcgacaaagatttcctaggacctacagcttttatagctaatgggaaaccttagctataaaagaaaaaaacttataaatacttgtgacgaaaacacattaggaaaataggcaagctaaagacagggatgccaggcgcattggctcatgcctgttatcccagcactttgggaggccaaggcagagggatcgctggagtacaggagttcaaggccagcctgggcaacatagggagaccttgtctctacaaaaaaaaaaaaaaaaaaaaaaattaattagctgggcatggtggcacatgcctgtggtcccagctccttgggaggctgaggtggaaggatcacttggaggccaggtgtggtggctcacacctgtaatctcagcagcttgggaggctgaggtagatgcattgcttgagcccaggagttcaataccagtctggacaacatggcaatggtctctattaaaaatccaaaaattaggccaggcatggtggctcacacctgtaatcccagcactctgggaggccaaggcgggtggatcacgaggtcaggagatcaagaccatcctggctaacactgtgaaaccccgtctttactaaaaatacaaaaaaaacattagctgggcgtggtggcgggtgcctgtagtcacagctactcgggagcctgaggcaggagaatggcgtgaacctgggaggcggagcttgcagtgagccaagatcgcgccactgcaccccatcctgggcgacacagggagactccatctcaaaaaaaaaggaaaaaaaaaaagtcaaaaattagccaggcatgttggcacacacctatagtcccagctacttgggaggctgagggtgacaggattgatgcctgggaggtcaagactgcagtgagatgtgattgcatcatgacactccagctttggcgacacagtgagaccctgtctcacataaataaatagaaataaataaattttaaaagacggagaaatatttgcaaaatgtttatctgacaagggacatgtatccagaatatataaagaactacaattgaaaaataaaaagacagccaacctcactagaaaatgagcaagagtttgaaaggatttcacaaaggaaggtatacaaattgccaataagcacattaaaaaatgcttgatattatttgtcactggagaaatgccagttataactagaaaagatattagcctgcaggcactagaaagactaaaagatcaaatgtaggtagcgatatggagcagttgcaactctcatactttgttgttgggagtttaaaatgtactacaatgttggaaaaaggtctggctgttttttagaaaactgaacatatacttaccctattacccattaatttcatttctttctatacctacctatgagatatgaaaatatatgcacacaaaaagatttgtagaagaatgtttatagcagttttacttataatagccaaaacctggggacagcccaggtatctatcaacaagagaatgaataaacaaattgtgggtgtattcatacaataaaataatttttgtatttttagtagagatggggtttcatcatcttgcccaggctggtcttgaactcctgacctcaagtgatccacttggcttggcctcctaaagtgctgggatcacaggggtgagccaccatgcctggcgtgaactctagttgctgatatgcaaactgaagtgatggggtggaatgcttgcaacttacctcaaaacgcattaaaaaatgcattgatatgtggtcagaagaatggactgatgacaacatgacaaaagcaaatataaaatgttaatcatagaaaccaaatagtatttgggtattcagtgtatagttattttaacttcaccatatttttgaaatttttaaaaacgttgggaaaaatggttctcaaaggggaatgattacaaaaattattgtacttctctactttggaatactgtgtagcatttgtcattgtataatacggaaagactttttaggctttctcttaaggcaaaaacaagttgtagaaaaatataatattttaaaaattaaggtaacacaaaactgtgtgtttatatgcacacacacctaagttctcagaagaagtttggggaggaaatacgcatctgtttatatctgagaagaggatatcttggcagtgggcttgtgggtaatatttcttttctttttgtttatattaattttcttcagtgaaaatacatgacattttaaaaaacattttgcctttagtgatgtaaaaaatgcctttttgtcatatttggtgagaaaaaatactaaattgagcaacataatttccactgataaatgcacctatgtaaaaggaaaaagaaacttaggtataaatattggttatgttactattaggaacatagttgatccacccacctcagcctcccaaagtgctgggattgcaggtgtgagccaccacgcccggccaggaaatttttttttaaagaagcatttcagacatacacaaaaataaaatggggtaatgaacctccctgtttccatcactcatcttcagtattacaggctcatgcctgtcatcccagcactttgggaggctgaggtaggtggatcacctgaggttaggagtttgagaccagcctggccaacatggcgcaaccccatctctaaaaatacaaaaattacctaggtgtggtgatgcgtgcctgtagtctcagctactcaggaggctgaggcaggagaatcgcttgaatctgggaggtggaggttgcagtgacctgagatcatgccactgcactccagcctgggtgacagagtgagattctatctcaaaaaaaaaaaaaaaaaaaaaaaaaaaaatatatatatatatatatatatatatatatatatatatatatatggaccataggattatgaggatatatcctctttgctatttagcttttggagtggtgtacttcttattgaaaaattgtctaaaatttcacatcctagacgtttcatatagatttcattttttttttattaaagaggattgttagtaacttttcacaatttttttaggatctaactaggtttagaccaatagagaaaacggagcagcttgtgctatttcttatattcattaatttgtgatttttttttattttttatttatttatttatttatttatttttgagacaaagtctcactctgtcgcccaggcggaagtgcagtggcacgatctcggctcactgcaacctctgcctcccaggttcaggcgattctcctgcttcagcctcccgagtaactgggaccacaggcatgtgccaccatgcctggctaattttttgtatttttagtaaagatagggtttcactatgttagacaggatggtcttgatctgctgacctggtgatttgcctgccttggcctcccaaagtgctgggattacaggcatgagccaccacgcccggcctgattacttttttaaagctgtttgccctaaactgtttgaaaaagatctatggaaatattttcttttattgaaataacactggtcttctcattttgcgagctacagatttcacttattaattcaaagttcagtagtcaatatttaatactttccatatgtcaggtatggtacttagtcatgtataaatatgtctttcataaatattagagcacatttaacagatgtatgtagttaatcagatattcaaagaaagaagaaataagtaaatatctcttttctgtttggatgtttgtagatatttaaatatttataacgttttgatgtttggcagatttagttcctttattttagtagcttgtttctatttgtggagagaagaaaaaaaaatagcctgtccacagtcactatgatgtggttgcagttattactgccctcctaggttagggctgatgtattgggggtcacagggagaggatagggctttgtgccatgagattcatgaggtcagtgaccacgtctgttaactgtttactcttctgtcatcttctggcacaattcctgagacataatagttcctcaggtatttgtttatcagccaatcgaatgaatgaacatatctataatctaaggaaaggagataggcaaaatagcagtataattttgaaatttattgtatcaattttgactgaaatatatgtataatatatattacatatatatacagccaatttgtgggactagaataaaaagttgctacacacacacgcgcacacgcacagatcaaaacacttgctgtatgtaattatctatgcagactatccagtagagggcagggttttacttgtgggagaatttaatacaactttctttttttaccatcatgtaaatgcttacctcccttataatcatcattatcatcataataagtaatgtatgtttatttttctttaattgttatagaagatttgaccaatggctcttgcttttcttgaagttaagaaatgatgtacatcttaaataacttttccctacttgcatcccagtttgcattgtacaggttataaggtcatggtgatattttagattatgcattccatctcaaacagtagttgagtcgcttatgttcttaaatgacatttttaggttccctttttgtgtttccaaagcagcattagacataggtctggagtgttgacagttgtgaagaagtacagtgcaataatgcttcatcagataaataagcaatattgtaaagcttgtcagcagagcactgcagcagccactcatgtcagttttaaaagacaaagatggatacccaaaggagacgtgtcagcttgttaagacacttaaggtttcatgtctttaggtttaacatggttgaataggcacttctgtctgtccttcccactaattacagtgaaaaacaggggaccttgtatgtaaaacaaacataagactctgaaaggtagaagaccactgaccagcagggactatgggaccctaggagagtacatggcaccaaagtggtatcagtaaagacctagtggggagctggaactctcaccccaacccagcactatcgaggtacctctctcactttccactttgggtactaaaggctgactggggaacatgaatttttaccctcaattgctggtaatgaagtagctatcccattcccctgctggcacagtatcacagaaggcctgctctggctgaagatttaaataagatctaaagatttataataccccaaatatccaaatttcaacaaaatgtccctcatgaccagaaaagaatcaggaaaatctcaactgaaatgaaaaatgaacatcaatagacaccaggagaatacagatgtgaattgtctgacaattattttaaagtagccatcacaagaaggctgagcaattataaacatacttgaaacaaatgaaaaaaacagaaagtcccagcaaagaaaaagaaactatccagagaaaccaaatggaaattttagaactgaaaaatataataactgaatttttaaaatggaatagacaggtttaatggagaatggggatgatagaggaaagaatcagtgaacttggaagaaattaagagaaattactcagtctgaacagcagtgagaaaatagatgaaaaaacaaaacccagagtttagatataacatttgtgtctttgtgtggtcagaaagggaggggaaagagggtgggactgaaaaaatattcaaagaaataatggctgagaacttccaaaatttgacaaaagtcataaatctacagattcaagaagctgaccaaaacttaagtaggataaacccaaagaaattcataccaagacatactataattacatttcttaaaaccaaaggcaaagaaaaaatcttgaaagcagcaagagagaaatgacacaatgcctatacagaaaaacagtttgaatgacaacggatctctcagcagcaaacatggagaccagaaagaagtgacacaaaattttgaggactaaggaaagaattgtcaacccagaattccatatccaattaagatattcttcagaaaggaagaggaaaccacagtgttctcaggtgaaggaaaacagaacttgacatcagtggacctaacataaagtaatgtctaaagaaatttcctgaaacagaaaagaaattataaaaaaaaggaatcatggaacatcaggaaagaagaaagaacaacaaagagtaaaaatatagtaaatataatagactttttaaaaacttttttgagtgttgtaaattatgtttgacttttttcactgttttcaaatattgtaaaatagtatagttatcaatgtatgtagaggaaatattgaagattataaatggagaagggtaaaggaatttaaaggaaggtaaagtctacactttactggaactggtgaaatgttgacaccagtaaatgttggtaagttatatgtaatgcagtccttcagcagctactttaaaaaaaatctattcaaagagatgcagtcagaaacattttagataaacaaaaatggaattttaaactatgttcaagtaacccataaggaggaagggaaaagaaaacagataaaagaaataaaatgaaataacagatttaagtttcaacatatcaaagactacattaaacataaatgacctaaattcatctgttaaaagacagatgtgcagagtgaattttaaaaatgacacactgtgctgtttataggaagtgatttcagacaacaatatagataggttgagactaaagatagctttatttataatagtacaaaactgaaaacaaccaaagtgcctctcagtaggtgaaattgctaaacaaaccatggaatattatataatattatattcataccatggaattctacttagtaatgaggaggagtgaactattgatacttgcaataacttgaatgccttttaagggcattaagccatgtaaaaaatgtcaatttcaaaagacttgtatgtttccatgtaggtaacatggcaaaatttttcagctgaaaaacaaattagtgggtgttaggtgttaggaatagcgagaggaaggaagctgagtgtgactataaatgggtagcatgagatctttattgcagtggaatggttctgcatcttgattttggtggcgattacagaaatgtatgtgtgataaaatggcatagaatgatacacattgtacaggtattcctggtttttagtatgttatagtaatgtgaaatgtaaccattgagagaaactgggtgagaggtatactgtacctctgtagtatttttgtaacatcctgtaaatctataattatttcagaatacatagttttaaaaagcaaaaaggcctgtatagtcctagctgctcgggaggctgaggcaggaagagattttttgagcccaggagttcaaggttacagtgagctatggtcatgccacagcactccagcctgggcaacagagcaagaccctgtttctattaaaaaaaaaaaaagataaattataaacaggaagagtttgaatattttaaacaaatgcattaatatattttatatattttcaggtatagagaagccagtatctttagtgcatacctctaaaatagtagaatgtcatctatgaatatatgattttttaaaaatttagttttttaatttttaacagagttaaagaggcagattataaagaggcagtcatttgactactctaaagtctttttaaaacaagtcccactttagaagattaggatttagctcttattctcactttctccactaccataaatgcaaacctcatttctacctctgcattttctcactatagttttcatattcatttcaattacatcagtagtcttttttcagttggatagtataaacactattcatatatgggctgtgattgcttttcctctcttaaacaactctttttctccagaattaataattgtcttttgtttaattttctgtatgcttatgactaattgaatttccaactctctgaattacaaatatccttctgttcattctgaatgtgtttactcattatcttaattttaaaagagaagtaaacataggttgggttttagagttttggtgtaaagaaaattcttagtgttagaattttctggcaaaatcagggcaaatattctttgttactttttctatttacacacataccctgtccggctgcagataaacaaatggttttacctttatttcagcttagttcctgatttttgtcaagagtctgtttcttcatcgattccaaacattggtcacatagggaagtaggaagagctgtggcatagagaccagaacacttaggttcttgttctgatttggttttaattgacctcaatgtaggatgatcaggtaacctccttggcctcagttttctctgtaatagtgacaagctcagactagattataactgaggcctcttctagttaaaatgtgatttcaagtagataaagtatttacttcagtcctgactgtatatgtagtatctctaaattaagagtgttgtcatttccagtacttttaaagaaataccctgatgtttagaaagacattagattaaaaggtgttatagagaggggaaattttataaaagacaaaaatggaccatgcatggcatctttgttgtgcttcaaatttttatatgggaattgtggttttcactttccaagggtgtctggaaaagagaaattctaagaccatcagaaacctcattgtttattacccaacagattagatttgacccatagagtatgctctgaagtaattaatgtggcttttatggagatttcttcaattgtagaccattgaaactagatgggtccttgggggcttctaagaaagtccctggtgtctagcagtttctagttgatataaccaagggcagaatgtactgttttccatttgcaagtgtttttactttattgtgaatgttgtgtgagggatatttgatatttgggatacttacatttttttcagagggcattaaggtgaattgccttaatgccaaatatacatttggaaatgaatttgtaagtttatttgtatacacctgttgatgcatttgtacatgtgtttggtgatgctgatagggtgccactttatggggttccatgaaaagcagatatgtaatttaatttcataacaaacatattcattggttattatatttactggttattgttattcacataacttattttattggttttcaggtacttgaagaaacagaagctcaacatttatatcagtccatcttgcctgatatggtgaaaattgcactctgtctgccaaatatttgcacccaggttagtggatgtagcttcctcagtagcttccctgagactgacaattgaatttcccttaaacttgaatggccagggtcacagagagagagagagagacagagagacagagagagagagagagagagaggaagagaagagaagagaagaaatgggaaacagtttttgccaaagagtatagtaattttgctgtattaaggaaaaggttagagggtagagagtactacaaaaggacattaaaaatgcagcattccattcctcagcttctgtttacactgttgaagcttgtttactttgacttttttctctctttgtttaaataacctctaacttaaaaaagtattcattatttcaaaacatactagtggatttggaatagcgtattttcaaaatggcttaatacgacccactccttcctcaccctcccccaaattctacaacaaatgagttaatgatactttcttaactttttttgagacagagtcttgctctgtcacccaggctggagtgcagtggcataatcttggctcactgcatcctccacctcctggattcaagcaattctcctgcctcagccacccaagtagctgggattataggcatgtaccaccatacccggctaagtttctttttttggagtgcaatggcacaaatcccagctccctgcaacctctgcctcctgggttcaagcaattcttgtgcctcaacttcccaagtagctgggattacaggcgtgcgccaccacacctggctactttttgtacttttagtagagacgaggattcagcatgtttgccaggctcgtctcaaactcctgacctcagatgatgccttggcctcccaaagtgctgggattacaggtgtgagccactgtgccagccttaacttttaaaaataaagaatcctgtattttattttgtttggagtacattaattatatattgctacataacaaattatgtcaaaattaatggcttaaaacaataaacatgtattatctcacagcttctgttgactttgggagcagattagctgactgagtggttgtggatcaggatttctctcgtggttgcggtgaggatgtcagccagggtttcagtcatctgaaggcttgcctggggctgaaggacacacctctaagttggcttacttacagagctgttggcagaacgccctgacatgggtctctctataggctgattgattgtccttatgacataatagctaacttccccagagcaagcaatccaagggagagagcaaggaagctgcagtgtcttctatgacctatttttctcaaggtacctagcatcacttctgctgtttttctgttcattggaagctagccagtacccagggggaggggtattagaccacctgttttttttttttttttttttttttgagactgaatttcatccttgtcccccaggctggaatgcagtggcatgatcttggctcactgcaacctctgcctcctgggttcaagtgattttcctgcctcagcctcctgagtagccgagactacaggcatgtgccactacactcggctaatttttttgtatttttagcagagacggagtttcaccattttggccaggctggtctcgaactcctgacctcatgtgatccgcccgcctttgcctcccatggtgctgaaattacaggcatgagccaccgtgcccaagactccacctcttaaagagaggagcatcaaagaatttgtgaacgtattttcaaacctccacagggtttgttttgttcataattttattcctgtgtttctcacaaccgtgcttgaatttgcctttgtcttttatttctagggccaacgcctcttgctgcatggctgctagccagggttctgctagcattttactccacaggggccctatggacatttgggtggaacaatttctgaatgtgtataatggtcccatgcattgcaatatgtcattaggacaccccaaaaaccacaaatagggtcactggggcaaccagaaaacaacccatacatgtccaaatgccttcctggactatgccaccttcagttgagacccatgaaatgttttccagtgtgatgttttcaattttatgtaactttaatttcacctcagtaatgcattgtgcctgaaataagttttactattgggcaggggaaatatattttaaaacatatcttcttgtttctgttggaagttatttgcttgatcatattccatgtttgttctttttcctttctctccttacttagtaaattctctccctacctcctaggtatgcctgtctgttacttcccctgtgaagccttccctgcctcccaggcaaggttcatccctcttgaagcactcaaatcattgttttgtaattcttgtcattatatatctcttgccactggattatagtctccttaaagggagatcctctttgtgtccctggtttgcatggtgcttaattatatgctttttgaattcaatatgtagttcataatcaataataggtagtaggtagcctttgggtgtgggccatttaatcctcttcccctcgtgcatatgagagtttccatattttatttaatgagaaatttttgttcaaaggtatctgactttgtaagctataacaagtcccttggaaccaaaatcagacccctgagtcctcagctttttgtcctggcttctctcagtgactttcttctccattagcatatcaacgggtaggcatggaaattctgtgctttgccccctattgaaaagtcaatctctgctgtgaaagttaagatttttatttgagatcaaaatacgtcttgtggcaagttaaattgtatatgttggtgtttaataatttatcacattgaagtactctaggccaaatctaaagggtaaattttagatttatcaaaataaaattaaaggaaacaaatttggtcaggaactttttgaaatatcttggttcacagtaaccagcctcttattttgttgagccgattgcttgacagtaagatttacatctcctgatttctccaaataatgagtttttaggcatttctcctcaccaagagaggagaaatcattaactctatttaaaattatactatttgtttatttgggagacaagaaatgtttgtgtttgaagtccattaagcctgaaatatttaccattaatttttaaaatcatttttctgaataacttggtaaatggtagttaaaaactcatttcttcctaaaaccaagcagcactttgcttgaagccattgatgcactgtcaccttttctaaactcgttgcttggttgtgaacaaatgcacaggatggaaaatggagatcaatatgagctctctatttttctcagaaatggtgattgctaagacctgaaggggagagaattttgtaaacatagtgaaaatacattctttaccttttgcttatttgtttacctttgaatttttccaagagaaatagttgaattacaagtttaatctgttcttttttctggcaaactcttattctagcagtggtgtgtacttctgtacttagaaaagcattcattattcagcaccgcagttttggtttgtcttgcctgccctttcctcaggttcattctgggtgtccactcctgaggtatgatcaggacagtttgctctaggcatgccattttgagatgagtgcagttacccgaaactcttagttctgggtcttactgaaggggagaatgaaatgcatctctaaatattctgtgggagcattttgaaacttaacagcagaaggataaactggtagttggtctttgattttatcagcatgtctttaaaaacatagtttaacatttaaaatatgttaacaaaaagagtcaaactctgtaaaatatttgaagagatttattttgagccaaatgggagtaaccagtggcctgtaacacagccccaggagatctgagaacatgtgcccaagatggtcaggcttggctttatacattttagggagacataagacatcaatcaatacatgtaaggggggcttacaggtcttaggtagattcaaagattttctgattggcaattggttggaagagtcaaagacctggaatcaatagaaaggaatatctgggttaagataagggtttgtggagaccaaggttttatcatgtggatgaaaccttgtaacaggcttcagagcttttatcagatctaaaaaggtaccacaccctttcttaattctcacctggaaaggaatagagattctttacagaacgtacattttcccaacagacagctttgcagggctatttcaaaatatgtcaaagaaatatattttggggtaaaatacttcaattctttcaaggtatgctatctgtcatgtgatgctatactcgagtcaggctggagttgagtcttattattataaaaagatttgtttcatcagttttaaggtctctgttttcttgttaatgctggtcacttgtgctgaattctaaagtgaggagcatataatgaggcgtgtcagacccacacttcctatcatggtgtggactagtgtttcaggttaactttggaatccccttggtcgagaggaggggttcattcagttggttggggggcttggaactttatttttggtttacaaacagaataaaacccactgaacacaatactcaggtcgtgtggattatactgaaataaaaggtaagtgaatttggtggcataactagaagacattttagacataaaagatttgaaggaaaaatgtcttacatcttccatgacttggaatgtttggttatgtaagaaatgtcttatctttttacaacttatacatgtccgtatggtggtttttacatgttctattaatagctttaatgaagttagatttgattcttataaagaaattgtgagtatgaagtgtaatttggaataagagggagggttaagacttatttgttgaattatcttagatcattttattgaggactaagaaagattattctagccaataatttttaatataaataagaacaaaatttagcttaaacaatgttatatatttttgtttcatcttttgttctaatttttcattacatgggcaatgtgtttttatttacttgctgaagcaatcttgtttttcactaataagtaatgttttatattctcttcactatcattattattgattagaaatctgcagtttgtcaaataagtgcattttctgaatcatccctgataaacagcccttgacttttacaatattgctgatttaaggattcaagaatggcctgaaattatttctgccttaatttagcaaatgcaatttggtgcctctgcttttgaaattgctaaactaattattgctcttctcgtctgtatttttttgtttcttttatcagccaataccactcctgaaacagaagatgaatcattccatcacaatgtcgcaggaacagattgccagtcttttagctaatgctttcttctgcacatttccacgatgaaatgctcagatgaaatcggagtattctagttacccagacattaacttcaatcggtatgttttcagaaaacacctctttaacaatgaaaaagacaaaggtggaaggaactaataatatttcttgaatgaattccataggccaagcattttatatgcagttgtcttatttaatttttacagtacttaagtgacattttcaccattttgcaggcaaggtgattaaagttcattgaggttaaaagaacttgattaggatccaggagctagtaagtcacagaactgagattttatttcaggcctgtcttactccagggcccatgttctttctgtcctctcagatgattccccagttctctggactccacatgcctcttcagtttgattattcacgagaacttttgttgtgcttatattccttaatgctgaaatactgtgaaaggtagaggaaaagtcctcctttctacaaaggtcttataaaatgagagtctaaagtcatgagctgtcttatgagacttgaaaagtgtaattgttttgatgaaaagtgaaaggtgattttgaccctttatagacatggttaatttatcagtgtaatatttttaaaagaaaaacaaaagaatgttcaaactgctcgactaaattaatacagtgtgaaggtattgataaagttttagattccagccattttcccaggtgactactttctctatcttctacacaaacaaaaatattttaaagaatcttcttggcaaattaatgtttgttcttccctcctactcactactcccatatccccacctctgtttctttcttcacttgagaattatctttataggacccatgaatagaatatgtgagttttcttccctgatttcagtgtgagacttgagaaaattgctataatctgtgcccctttcccagcaggctgtgtgtaatgcccttcactgcctctggtcacccagagcctgcctctgagggtagggcagtatgcagagtaggagataaagtcatagagcggatacacaaacaaaacccacttttgtttgccatactgcttttgtctctgaagtagaatgatcagtagcatcacttttttttttttttttttttttttaattttaagacggagcttcactctgttgcccaggctggagtgcagtggcgcaatcttggccaactgaaacctccacctcccgggttcaagcgattctcctttctcagcctcctgagtagctgggcttacaggtgcatgccaccacacctggctaatttttgtatttttagtagagacggggtttcaccatgttggccaggctggtgtcgaactcctgaccccaggtgatctgcctgcttctatctcccaaagtgctgggattacaggtgtgagccactgcacccagtctgattctaccagtttttctagtatcctttttctgttccaggatcctacccagcatcccagttacatttaattacctagtctcctccaacatgttccttgttttttcttttctttcgtgatcttgacagttttgaagagtactcatcacagttattttggagaatattctcagtctgggtttggctgatgttttttcaggattggaatgaggtcatgcatttttgggagaataccacagaaatgatcctgtgtccttctcagtgcaccatatcagtgggatcatgatacttcttattactggtgatcagttggcaaaggtagtgtctgctgactttttccactataaagttaccatatttccttttgtgattaataaatattttccaaaagataaaacactatgcaaatgttgttttgcctcacatttatccctactaattttggcatccattggtgcatcttgtctgcaatgattattaccatagtgtttgcctgttgtgaattttctgcttccctcttctacatttgctaattgaaattccattgtaaggaagagctatcccttttcccccgtttttaaaatatcagaatggactcatggatatttattttgttgtgtcagtttaaattaaacagtattatttattttactgctttaattattctagctttggccattagggctcctttaggttgactcctatgttcttttgataagccctatcctttttttgagcattaactttcattctggaatcatacattgttccagattcatcttacattttccatgcctcaatcctggaatgaaccattttctcaaggattcctggtctcttttattgtacaacggtatttagagaccaacatctaggtgataggtgtgctcattgctgctagagtgtcattgtttctaatgcaacttactttatgtgggcagcattccttataactccacatggcagcagagaaatgaattcacaattctctccaatatcagagtgtcagccccgaagaccatattttttagccttttaaaattggagaatgttttactctcttaagatgagaagaattctagaattcagctggttagttcctaatgtaaatttttaattaaacttaaaaactagacatttcggtgcatttattgtgtgtttagcagatgaaagtatagcagatgacttgaatataagctgctcttagactgtcataattcttgggttatatttttatgaccttcaaacattaaaatattgatgataatttgttattatatatggttaccctctactatcaacactaagaaaggggcagcaaagaatgaaaaataatgttatctaagaaaatttctttaaaatcctagtgttagcaaacaggatagtttttttttaatatataatatgctccttggttacataaatattagttgcaaggggcatatttttaatctatttttcaagtttgtacagtaggtaagtttgtttttagatactggtatttagtcaatgtttagttcaaatgtacaatgagcaactgcaatattccccacagtgtattaagtgccataaggttacagagaaaggagaagccagtttctgagttcttactgttatgtagtattgtctcattttcaaacctcacgtcacagatgcccttctcttttccacgtggcttttattcctcctccagtactcagttcacgtatcagtttttctggtgtctcagattctgctaggataggtttgctactccaggttcctatgctagcctgtgtgtacctctggagaggtgcacagcaccatgacgttttattaaagaaagatataatttaataaaggaaactttcctcaaggaaataacttttcttgctgttgttgttttgagactgggtctcattatgttgcccaggctggtctcaaattcctgggctcaagagatcctcccacctcagtctctaaagtaactaggactacaggtacatgtcaccatgcccagcgcaacttttgaattaagtacaaaagggtgaataagagttttgccaaggagaaggagaggtggttgcattctaggcaggggaaaagtatgtgtaaagtcactgttgcaagaaggacctgacatgtccagagactgagagaagacagtgtggttgcagcacagagagtgagaaggagcatggagatggtagaggctacagaagtagctggaggctggaccatgctgtgcctcactaggccatctgaaaacaacaggaagtcattggaggattagatatgtgggtagagggagactagcacatgtgttcagatttacattttcaaaagtttattttggctgtaatgtgggaatcaagcagagaggggccagagtacatgagtttacccaattggagaggctactgcaatgcaccgggaaagaggatggtagctgggatagtgtaggggaggggacagaggtgtggagacatttgaaggggtagccagagtgatggtgatggacaggattggtagatgggcagagagaggcatccaaggtactccttaggtttgtacagccagatgtgtgcctttactgtcccctacttttcctactgtactacctagactacttcataattgcttatttaatcatttcagtgggacagggatcttaactgtctttgttattttcacaaagtctcatgcattgtaggccttcaataaatgcttcttgaatgaatgaaaagaaattttacagatgaaatatttgagaattaagtgacttgttttgagtaatggagctggttagtggcagagtgctaagactataatttagaccctttgttctcagtctcttgtcttttacttttcatattatgtcttagtcttaggaattacgagatgttttatttttaagccacatataatcaaacatagcttttacttctgatttcgttagtaattggggtagaattgagagaaaacacagagcattggaatctgcaattgcagttatataaaaaacctgtttcacaggcgtgagccactgcgcccagcccatatattacttttacgtgcagaagaaaaaatagttcagggaagaacaagtcagttgtcagaaatcaagctgaacacaaagttaataagagtggacaatttttgtaatttgattttgagggtggaatttcacagattttttgaggcttttccaaaaaagctagtgtggatagcttctttccaattactcctccatagacacattgtcattgtgtctacttcaccctattttacttattcagcatatagcattttatttcttatggaagaaatagaatccacagagttctgtagggagcaaagacccatcgctgctggatggctgacaggcagaggtcaagatgtcttgggaaggcttggctttggtgacttccaatttcctgtaaccaattaccagaatttacattcatatatatatcttttttgtttttgtttttgttttttttgggacagagtctcgctctgtcgcccaggctggagtgcagtggcgccatctcggctcactgcaagctccacctcccgggttcacaccattctcctgcctcagcctccctagtagctgggactacaggcacccaccaccacgcccggctaattttttgtgtttttattagagacaggatttcactgtgttagccaggatggcctcagtctcctgaactcgtgatccaccagccttggcctcccaaagtgctgggattacaggcatcagccaccgcacccggccaattttattatatattttaattttaaaagacctttgtttttcagccaaccttctgagtggggaagcctggggcttcttggcgatggcaggtttatctttttcattgtacatggtcatttatcctgaagactgagctggttagcgctgaaagtcagcatgttgggcttgatgggaatcaaggctgggccatttttttaaatgaagggaatattaattagaacaatgcaactgctttatgtaaatgaatgttgatttttttggcctgggcattatgtaatgccttattttagcgcaagtaccttagcttactcagcattatctgaaattcatttacttgtcacattaaccatatgaattagaatattgattaggaattgttgttacactcatttttaaaatgaggtggaagtttagagaggggaggttacttcaccaagttaacacagtaactagtagacttgagattcaaacgcaggatgtagtctcctttgagaagctgtgtcccttaaccattctgctacacagtctccctttgaatgaactgaattaataattcttacctcatgactagtcaaaaattagaactatttttagaaataattattgatctattaaatgaattaaagccatttttaagtccagagtgaccgtgacggatttaagcttgcagcaaatagcattctcaccaaataagagtttaagtagttccgttgaagatttgaaatcaggcatattcttgtcttcctaggtgatggatgttcttttggatagcagaacatgaaaaatgaattaaggcaggtaacctagtgttagtctccacaatgttgtagagaatcctaagcagccaggatgtctgcacttgcctttcactgtgagatggtgtgtgttttaatgagcctaagctagcaaataataggaacaacaactgtacatcaccattgatactgtcttttgatggcttgctttgattctgtctatggaattttctaggtagggaagcctctctactgataaggttcagggagaataaatgaattgttagcacaactggaacttgatcactgtcttctactcaaactcagtgttcttttattatatctcaaagcctgtcatgagcaaaatgctctgagtgctccggaaatgccaaacaactgaaagtccccccacttttatgtggcttctgaaagatccagtacgtaatctgatgagccatttgttaagctgattatgtagcattttattgtgttatttccttttatgcatagtttctacttatgattatagtttctagcagtggggagttgtgtgtgtgagagtgtatttaatctcaaaagagaggtatggctagctagttgaataagaaaaatggtaagagtatgtggtgggaggctgaagtcaataaattgaatatgtcttcccttttttatttattgctgtgttctttaagccctgcttagttatggtaaatacccctgacctttttccctgcttgcctttcaggtcctaaacattcatataaaggcttccaatgtgattagcatcgatgcttctgagtttgcatggaaactagatggtcagagataaattgtgggtctcagcagtggtcagcccaggaggtttttacatctgcctcttccctgtattgaaaatgctgctggggccatatggcagagtgcctcacagaagagccaggaatgactttctggctgggttccggactatcacttgctcgtattttaaaatggaggttgtagtgctttgggtttgatttactgtatactaatgggattattacttaacttgaaatggcatagtgggtcatggtgggggtggggatggatatacctagaataaaattccagtaatgttatcagtattccattcagggaaagattttattcaactctgtttctccttataagtatgcaaagaaaaacaccagctaataagtgtctgacctttgactgatgtctgtctttgaaaataccaacagttttgtttagaacaaagtaagatttcctgactggctttttgtgtttgatttctttaataatctgtaattatctttcaattaaatgcccaaatgtcctccctacatgtagaggagttattgtggcctggtttgtgtgcacactgctgacttaaaatatgccttcaaatatacatacccaggacttgaaaaatctaaattaaaaaagaaaggtgttgggaagtttacaaaaaaagtgggggcgggggaatgatgcttaatgattatgagaaggcctcactttctctgagcctgtttgtgtatgtctttctctctgtgtgtctgtctctcatgctctctttctctaaccccatttctatcagcctttctcttctctctatcttccctgccccatctttcttctcccccttcacccgtttcttgggctccagcctcagtccttttgttttcctcctcattcccaaaagctgtccctcagattgtatatcactcctgggatgactttcattcatgctgtttgcctgtctatttatgttatttttacttgcttccatatcaggataattcattttatttgagtggctgtgcatacaactttaaaatttcacaacagccaagtctgagaattgtcacaaggattttaaacctgcttcatctcctctgactttatctccacttcttacccccgacacccaccacgacacttcccccacttccccctgctctatcaggaagatgggaaagtgtatttggttacacagtgatttgaagttaggattggagcagtgaataaacagagtacattgagattctgcttgatttgtacctttaagatttgtacctacaaaataaacagtggtgttcatttgtagtgggtgataataacagccataaaatcttccaggaaagtctgtctcgccaggataataaatctgcagtctcacgaggctcctaaagttaataatttgtcatcatggttgtgaagtatgtgaccttttatgtgattttatacagatgaccgcatatggaagctagggacacttttcctatgttttagagaattatttcttaagagcaacagccattttctcctcactatgcaatagttctattgaagaagaacttttatcctttaattgaattgtatagtacatcaattcatctctaggaaaaggtggtggctacttttgtattcatattgctttcctctagtgcatagtgagcctagaaagagattttgcagtggagccttaggtattcatttagtaaatcatatttattgatataggatgtttaattaaactgccatgtggcttcttcattttgacttaaataaactctattctagaagaagccatgctgaaacctgcaccctcaaagagcctttctttcagctggcaactggattataagagtatgtgtattaaatattttagaaagataggttctttaaataaaaattatcacacaggctgtcttaaactatttttaaaaagagatctgattttagatttggttaaaatactagcatacattagtattctttttaggaaataaatattcatataaattgtttttccagaaattgaccctgaatacagatttcagatcattgaaaacggaaccatttgaaatgtgcatttcctttccttttcctaatttatttcagtcgctcaataggattttctcatggaattaacttttccctctcagcgtagttacataagcttgctgttgtaatcatgaaaaataattacccatttcagcacttattaacatggactttacttgaagggtctctggttttaaagtcagagcacatgactagaggcagatgaagagtacctcatcattcatagccactgagtctctataatttttaaatgcctttggaaagctagatcttatgctcaaaagcatgcttttgtgttagaaatctttcagtgagctacttactcaggtcataatgcttttaaagccctgcttttctttcctcagaataaactgaattgtatgttaccaataacaatgccacatcatttcaaagaaaacggaattaagtaatccaagtccgggttgctgaaaactagatgacacagggtaggcactgttgtggttaccatgcaaaggatctctattagtcagcttgggctgccataataaaataccatagaactgggtggcttagacaacagaaatttattttctcatggttctggaggctagaagctgcagatcagggtgctgctgctttggttcctgatgagggctttcttcctggcttataggttggctggcatcttgtcctcacatggcagagggagagtactgtagtctcaccttgctttttaaaatgacaccagttctatcagattagagtcccacccctatgacctcatttaactgttactacctgctcacaggccctatctccaaatttagctatattagggattaaggattcaacatataaattttgagaggtcacaaacattcagtccataaaagaatctagttgtttaacaaggattgttgagccctgatatcttgttatacctgcctgtgtccctacccccattcccctccactctcatttcctcacaaacactcagataaggattttttttgataccgtttttgttacttatcaaactacgtagtaacattatgaattataaatgttattagccattgagaaagtagctgtgcactgactgactgaccccagttgactgggagggctggatggtgccttctctgtggtggaagataggttggagaaatgtggttggtagtaaatgatgtctgatttgagcagctttgaagaagtctggttctagttggtttcagttctttccagatgccatttgaatctaaaccaattttccagttcttatcattacagaattgtcttctggaagaattatttctttgtattacttggtagcaatatggatgtagttttgtgaatcattaaggcattttaacttatcttccattctcttttattttttatctcttttagattgtttgagggacgttcatcaaggaaaccggagaaacttaaaacgctcttctgctactttagaagagtcacagagaaaagtaaattcctttcattcttactgtaatttttcttgctgatgggaacagttcaagtcaagtgacatgtgaggaacattttgtgtttaacgtaaaccttcctgtcccaaccacattgaaacactagtaatgatgcgacaatataacctagattttatgcttatgttgtgtataagcataaacgtgtgctaaatgtagggggggcggggtttacatactctgaaatcggacccatattctctgaaatctgtaatatacatcaaaagattttcatgaataaaaaccagagaaagtatattgaccaggaaataaattttggatgctctttatttaaagaagtattcactagtttatttgcataagtcaactaacgcattgcttttctacccattcctctcttttgtgcccccctaagccctttgtggagttcttataaaactgttttgtactgagttttatatctccatcttcctctattgaaccttaacattcttgcttccccaaaaactgatagcagctaacacagtaatagtaaatgtccaacaaatactggtaatgaccagctgataatagattggtattgccactcttatctcagaagctgaatgaccatggtcaagtttcttgacacctctaagcttcagttttatcacctatgaaataatataataacggccattaccttacagggtagttatagatattaaacaagaagatacatgcttaataaatgtaagctattatcaatgggtagcctttcctacaagtggatgtaaaccagaacacctcaaaagttcctttgtgctaagtaggtaaggtcaacctggtcaagtgaaatggctttttttcagttctgggtcataggattgtcttaaaatatgtctttgaatcattttaaggtcatttttctcatatccttcttttactcttgcattacaatgtgcttggcatcttcccccttgaatgtattgctattggacattgttaaatttttagaatgaaatcaattatcaggattttgatatttaagggaaaattacatgcttctctgatatggaattacctcatagcttattgaatttcagttttgtgccctgtactgaatgaaatattaaaatgcagaatcatttggacctatgagacacaaaatcaaattagaatttgtaatgacttgttaaaaagatgactacgtaaggcgaggcacggtggctcacgcctgtaatcccagcactttgggaggccaaggtgggtggatcacgaggtcaggagttccagaccagcgtggccaagatggtgaaaccccatttctactaaaaaatacaaaaattagccaggcgcggtggcgggagagtgtaatcccagctactcgggaggttgaggcacaagaatcacttgaacccaggaggtggaggttgcagtgagctgagattgtgccactgcactctagcctgggcgacagagcaagactctgtctaaaaaaataaataaatgactgctttttttggccattctaggtctaattagaattattactattgtttttttttgttttgtttttacagtactttgagttgccgttttaagtagaattattataactaagtagtacagagtttacttttttgtcctgggagtcaaatcatgtatgtcttctctaaaaactaacttggctttctaaattttaggatttcagatactttgaggaaaaagcttaaagtttgttttttcagctggaaatgtatatgccattataagtattgggaatttgaagaaataaattataactagacattttattttctgactttttcactgtacatgttaattaagttctttgtagaaatacagtacaacattgctcttggtcttcagtgtgtaaagctaatggtttgaagaggaaatactaaagagaataaaagaggttgcagtataatgagtggttgtgtagaagttctggagcctactcaatagacttcagaagcttatttaaggtaccatatttcatcgaatctgagatgtcatagatgactttttaaaaatgctcttatattatatacctctaagaaggaaaaaacactcaggacagggagtttagtaggagacatgacccacaaggctggtacacctaaggataaatgagaaattaacttgaccttccaggaaagggaccataaagaaacgtgcaagtctcaaccttgacactaaatagagaaaggaaaaaaacatttctctgagaatttgaaccacaagccctaagctttgagtgtgcagccttaccaccagtgtggtccacaaaggcctgccacaaaggattaattcagatggtatcaggctgatagtgttcccagacgacagcagaagcagatgcacatcttctctgggaaaattcacctctagtctacacctatggtaagatacctccattataaaagatgtattccagtttcagaaatgtaacatgtgaaaaaacatgccttttagaattgataaactagaattccatcaggaccaacttttcagtgttgttaaacatgtgtattttatatctgatgaagatcttgagactgaagtattttaaaaagccttctgaattaaattactttctatatagttttagataaagtgtcttatagatcaggtttttgaaaatttatgacctgtatatagtatatattgtgattttatgatgggaagtatttgattaatcaaagtatcctattctgagatgaaagttgccttgttacgaaaaaacgctaacagacgtgctctcaaggcatttttgttaatctaagaaaccatgttcttctgccttttcttgctttgccagcagtgtttatgaatttcttttagcatctcttagtatatattaaggacatttgatgttcttctctgctaagttaccgaatgacaagagagatgttttctattatattcatggaattgcttcactagtgtttgagttgtttgaccacttacttgtgagttttaaatatgttatccatttatcttaaagttaggtatctaaaagacgtaagacccatcttaacaaaaaaatttgttttctactgcaactgctccatatggtttttgagtggttcctgcttttgactgagaacaaggaaatgtggaattgtgcacaggaatgaaatgatggccaggctttcactgggttatacactgtcatcactaatagttcctgacatctctctctttccttaagagcttttttgtattcaagaaaacagaaacggcatggcctttttagtttgttctttgatttgaatcagacaaattacttctggccagctgatttatttgtttcttttgctactagcttgaaaaaataaataaataaatctgactagaaaaggatctcatcctctaaaattattgactacattaatagtacttcatttagatcctcccaaatttattgctccttgaaaaatatgtcatctttgttctgtaaactcttagaaccagtaatttctcctctggctacgactgctactaacaagtagagtgattgcccactatttaagcctgagacttagctgtactaactccagaggatgtgcaaatgatttcctttttaaatctgtgacatttcactttaccatatagtacataaatgtgtatttattctccagtctttgaatgtagggttaagtcctttctttgtaaaggagtctacaaatttgaattcaattttgtctttattgcattagctgtaccagttatacatcctttttttcaatgctcttttttttttaaaaaaaagtgtattcagcttcaaaaactttaccaaaaataccagcactcaaatcctactgttgtgctgttatttgtatagtttcgtttagtgaagtcttattattttatagaaggagtttctactgtaaggatattattttcaatcaatattctgttattttccaatgctaggctttgtatttcctggttagttttatagccaatgttagacctattcttttaccgagtgtgtgtgtgtatgtgtgtgtgtgtgtgtgtgtgtgtgtgtgtgtataatcttttcaaaattgaaacttattttgggtatgtttttcttttattgcttctgtagaacctactgggttggtgacatttacaagacagagtcttgaagattttccagaatgggaaaggtaacaacaataataaaaataatcctagaccccctagaaatagaaggactcttgcaccatgagaggattctattttatagcacctagaaagatggttttccaacctctatttatcctagtgccagggaatttcttctcataaatgattcattgatagctctcatgtttgaaaaggttatgccttttaaatcaaagtctataaccctttgatttctaccattttgtcttggttttgtcttctgaaacaaagtcctgtttaaaattgagaagtgttgtatgtgaagacactaataaaaggaacaccaatatttaaatgtttctccttaccctttttttttggttagtgtttgaactttatggcttttctttctggaggacaagattgagaaaagtctttttattatttacattttagtaaacagtaaccatctagagttcgtcgagtggcaagaattttgaagtttggctgcccttgtgtactactggtagattttgtggaagttgctatttactgtttgtttcttatttatcagaaaatattgaggagatagcagccaatatgagctaattcagatttgtaaagtccttagtgtcctgaaatagttaacatatttcttaatctaaagcaagtctcccaatatacttaaagaagggtcctgaaatagttaacatatttcttaatctaaagcaagtcccccaggacacttaaagaagtgtagattaactttttaaatatgtttgaggacatgatgaagcatactaaatacatatttaaccaatgcctcccattttcactttctaataattttatgatagtttgtaattgttttgtttggaattagtgatgaatggaaatcacttaaaaaaacgttaacttgagaagtcatatctgcttaggtggctttcctgcagtgttttcatccatcaaagatgtttatttgtgaagtgaaagataaagaaatttacttcagaagactgagtgcgtggtttagatgattattaatagagggaagtagataaaaggttaagcgacctgaagagagaaaaaaaaatgagccagaaaaagatgagaacatgtacagcattttggcatcatggcatgttagatctgaaaggaaccccagccgcctgctaaaactcttgatcagctctgtaatacctgcaacagacagaagactggatagcttcagtgatggcagatccgctgtttcgtatcagtttgttccattggtggctgcttgtgttatcatctcatgctttcattcactaaaaatgttttctacattcattctccaccattcctggttcttccttctggagctacataaataaatctgaatttctagttttctttaacatttgaccctccttcatgtatcttaatggcttcttaacctacttccctctctaacagtgcatacaagttcatactaaactgattcgtttcttctatttcacatgtaatatggattctaaaccctttatctctgctcttaacatactcccattcattgggccctcttaaaatatagtacctggaattaaaagtaccattctgctgtgtcatctctatggtgcagaggattgtttttcttcactcttctattaatctctaataggaatgcatatgttttgttcctgttactttggtgtagattttatagatcaatctgagggcttatttttaagtcatccaggatctctactttgcatctgatattcatttggcactaatgtgaaagaacacccatttgtataccaccatgtgggagagaagggacaggtcaaaatgcagagactggcaaggctgctgtgtcaatgagacacagtaactttgcctctaagtgagacgaagattgtccccttaattttgataggcagaatttgacttatttttatttcattgatctcttttttgttttagttgctttataagtgagttggagaatataattaaaaccagtctcccagactccacagaaccagaaacatgcattcacttaaagagggagaatgaagaaaagataaggattgttggtgttcccaagcgtaaggggctaaatgggtccaggaacttagaggctttcctgaattccatgtttctggcatgttatagttaaccctttgattatcagcaaatactttagccaggcttaatcacagagagccagaatcacctacgtctctgactcctggggcgggggtgtagaggatgacctactgggaagttagaaaatgcttcaaaacaaaaccaagaaaaagtttctagcaatttcgtgattttattaagagctatactataaagtttctagcttcagtcatggagaatagttgacaacagatggaattcccattctgaagtcctgactgacagcccagagatttttagattatgcttctttatctttttagtagtatgcttacaggggtcttcctctgaataaaatggctaggaaagtaggaccaaaaaaaggaagttaaaaaaatatatcaaacttaccgtactgttttctacaagagactgggaaagtaatttttctaaaagtgtagcatactgattcagagcttgagtgagtctacctagtttcacatctctgctgctttatttcactagtcttggttagcttacttagatgttctgtgctttgtttccccgtctataaaaggagatagtaatagggttgttgagaggattcaatgagttaatacaaataaggctcttagacagaacctgtgcagaattaccttctgagttaaagctatcagcctgttgggctggagttttgccagaaatgtatttaaactcattgaaaccaggaaggaatcaaacaattctcagtacttttccagctaacctcctagactattttctaaaaatataatcatctcctccctcccaaaaaagattatgggcactcttatgtgagttagaactttggatctcctctgtttcattcatttatattttttattcagtaagtgatcaggggaaaaatatctaataaggcaaataatgttaacaaatacttttaatacaatggaatttgttgttaatataacataagtcaagtaaatacctcagtggccatggttgaaagggaaagaaaataattatgccttctaaattacaggtactaagtttatctgttaaccttattaatagaaaaataccattgttcagaatttctgtggcaggtattttcatcaagacacacacacacacacacacacacacacacacacacacacacacggttatgaaacagtgaaaatagaaaatggaagccagaagagaatcatatatgatttattgccaaatttttctacatttttcctcagattgccaactctagccataacaaaatttcatagatcttaattttttttaatattttgtaatgtttttcaactgttttaaagaagaaaaactttcatattatttagaggaaaatcaggtttcaaactatgttatccaattttaatttaaatatgtatatttacatgtttgaataaaggaggatcaataccaagaatgttaacagtaggcatctgtttctgactttcgagatttggggtggtttcggtttttgaatagttacctatattttcacttttgtccgcagtgaacaacttgtcattaaaataataaataagggaatgtctttttatattgtagatgtgaaaaacccttgacacgattgcatgtcacttacgaaggtaccatagaagaaaatggccgaggcatgctacaggtaggtgaatcttagtagtgtctgtgtatggttaggactttttcttgtcaagcttctgacagcaaaagaaatttgaaaaactgtttatttgtctcctaaactgatttaatgcaaagaagcatgatagcagaatgaagaaaaacaccaaacagatcactttgacagccttggtaatgttgtgatttgccagtgtatactctctgtttcttatatgtgcttctctaaaaagcctttgacagaaaatcccaagatctggacagcatcagcctcttggttcagacattgatagtaggttgacagtggaggaagttcccagggtatagtcttgacagactgtcaccaggcatttttattctttttccttaaaggctcttcttgctctgccccagttgatgaccagatggagatgtttttctgccaccaacagctttgtttaggttgagggggcagacgtctaaaactgattgataagaaaggcctctctctcatatgtaacagtttcacgcacgtgagctagctgtttgctatgtcttttccctgttaaaagcaggtaattctggtccacttctcaatctttgttaataatctgttaccgcctttacctttaaaaagtatttttggagaagggggttaacaaaagccccgtgtttaaaatatagtaatatctaacctaatcttttgatttataatgcttctttaaaattcactaatgttagtgttttgtgttcttatcccatttataagagcattgtaaactgagttttctttgaaagaagcttgtataccatctcatttatactgataatagtttatttttcttcttagattcttatttggtgcttatattggttcagaatctaaagaaagcagttgcctgaaaatggactgatttgtttgaataacttaatgctcactataaaatttacgtctagttattatttaaatgaaactgagattcttttttaaatggccttttatttggacatatttgtaattaaaatcttcaaagagacaaactatgttttattctaaatcaccttctcccagtggttatttgagcttataaacaaaaacaaaacatatttaaatttgcatttactcctataccttttttctgtttaaaaaataatcttaaaatatgcttaaatattggttcaaattagtatcactttttcccccacattcccctcttgatgaagttctttccatctttaaagtcttggataaactgagagattcttaatacacatgaactaaacaaagttactgctagttagcaccacaggaatgctgacctttcattacaatacaattcaacaaggaattatttaacaacagttaaggttgagatcctccccacttccttggaatatattatagatggaaatgtgagacctcggtagattagagaataccgtaagggcttctttctattaattgttctccctacccatgccatgtctccgcaggagatcggggaatattgtattgcaatgctacagagctccttgtgtagcatataaattacatgatgctgaatggccacaacaacaaaacctctctgaggagctttatcattcctgtcttttcatcaagttataattcagaagctgagtaatctgaatgagtagctttaaagtgacttggaaaataactggctaaaaataaggatgcattcacattcttgttttcatgtactggaacaggtctctcaactgttgtagagggtctttattgttaagaacttttttaagtagtaaaactttggttttctaaaagactctggcatttagaggcatactgagtttagtgtctttatttctgtgtacacctttcaagttaaaaatgtgggccttttattcaaagagtaaacaataacatacacattgaatgtatttcatcatcattatcaagtagtacataagttggatagagcttatctttttatttttgttatgtaccttattccagtaaaaattaagttaggccaatcttaaacctcatctgtttctcatttgtagtcacaatatcattatacttttaggcactcagccagtctcttagttctcaagtacagtccattttatttctttaccgagtttcttctctttcctttactttaccactttcctgtttgaggccctagtagtgcctgtataaactatttagtactcacctaaccagcatttttacttttagttttacagttttccatttattctttaaactctagcctgaattatcttcctaaaacataggtccaggtgttacttgaatctttcccagaaccttcagagggaaattgagtaaaaattccctagacctcagaccacctcatcaccaactgtaagcctccacctactctacactgcaggcaagcacaatgaatctgtttaccattcccctcatacagtgatttacatttgtttttttttttgccctgtgtccttgtgcagctatgccctcagcctgcatgtcagctgccacatccccttgtaaagctttcctatcttcctcccatgctccaattttagttaattgtattattagaaagtatcaaatacatagtaacaagctcttcaataatcatcttctcattctgcttatgctcattctgactgccatctaaattgcaaatgccgtgaggccaggaaccatacatatcttattcatctttgtatccagtgattcccagcacaatactcagtaaatagttgttgaattggacagtttaagccatgaatcacccagtgcccatagacctcatatgtagtaggtagctaattctaatcaacagactggtttcaccaaaattattttcctatttaagctaaagagttactctggttttttagcattggttttagtactccagaacacaaatccaaatatatgattctctctggtagctcaattgaagaactcctcagtggtatgttttagtattttctaagttctcctgtggtaaaagaagactgcttcgccttctattaatttctgtcttttgacatatatttttacatatcaaacgattcatactattgttttactattttgtaaaataggcttcagattgtcatttagtatcagttgctttagagaacactgaagttttaagaaatcgtatattttaaaatagtttgaaagaatataagcctcatggtatttagtaaatcctattttacttgtgtgtatgactatgtatatacacaagttgtgtgtgtgtgtgtgtgtgtgtgtgtgatctaactcctcagatagtctcactaaggaaaagatggttgctatttcttacatactgcttcatgaggctggcatagtgctggacacactggacaaacggaaataatgccagcaagttgagtttgctttctctggaggattgtgtaattcttctttattagtaggcatttggggatcccatcatactactccacataaagcttaagagtttccaacctaattggaaatattactttaattgaatctttgttgctatactgggttttctttcttccttttttccttagttatatttttaaaaagtagtttgtaatgttcatgtagtttggggtttggggttgaatttagaaggacaaaaattcgatctctttattcttacaataaagttggaaaaggttacccaaaaagttgattactaaacttttcagttctttagggcaagtgtttggttaccatattacataagaaaagtttaattatattaaagtcacgtgaaatacataaagggaagttgagtagtgaatgggggagaatgactttgaaaccttcccagataaagacctcccttgatttgtggcccatgagacacaaataggtttataaacaagagtctgtatgattcataatattttgcctaaaagctccattttccagattgcttctctggttctgggatccagaaaaatgtgcagagatgttaactgcagtgaggtggaaagagcttaagcaaccaaaatctgcccttcctgggaagattacttatttggggattgattttcatgggagaggaaaagatgagagcttagagactatgtgcttcttgatcatatgtgtaggtatttttgaccattatttaatgtcacatttccccaacaggtggattttgcaaatcattttgttggaggtggtgtaaccagtgcaggacttgtgcaagaagaaatccgctttttaatcaatcctgagttgattatttcacggctcttcactgaggtgctggatcacaatgaatgtctaattatcacagg

SEQ ID NO: 22 - DNA, 13622 bp, Homo sapiens
ggccagggtgccgcagacgcggggacgctggctcgctccctccctccctccctccgacgctgtgagtagagaagctaggccccgagccgggcgggactagggtggtggttgtgttctgccctcgcccgtcgccaacgctgggctgactgaaaacctggccctttgggtcgcgcgtcttcgaccttcaccgccatgcggacatggggccgtgggagaaactctgggcgggattacggtgaaaattcttgtttgggcgggccctgcggcttctttcttccggctcgccctcggccccgcccccgccccgcccccgctccagctccagccgggtcctcgctcggccccgcacgcggcccgcggtagacggagggcctgggcacccaccgtctccatcccggccccagcccagtcgagcgtccactagaagggcgctccctgtccggccctaatcctcgctcctcacggaggctctttgtcacagcgaagactgacagcccgcagtcttctggacttcttttatggggctcctggcggtgctattcattcagtcattgattcgtcttgtaaatatggagcgcctgctctgtactcgacccggcactgggtaccggaagaaccagacagctcggtttttgccaccatttataagtctgtgtccttttcttgagtactgaaccgagatacagttttaaatgtgctgtgcggtctctgagcagcgactcacctgtgcaggtcacttcacctgattccctttatgtaaaaatgagggcgatgggctgtgtaatctctaaaggaccttctaactctttaaaattgtcactgtgccggtgttgctaacactcattctgtatgcttgatggcagtttttaatttttagggttaggacagctgaacataacaaatagaattatacagatttattaccagaaggacttcgtgtgcctctaagaatcttggttccagtctttggtcaggtagctccaggaaatcacttcacctctttgcctcagaccctcctcagtgaactaggaatgatagcagtgtctccctagtcttagggccgttgagcggattacacgagataaggtcagcaggtgtttagcacagtgaagcatttgctacgtgatgacatttattatggttaaagggttttaccaccagaacagtggtacatagtttgctttatttgttaaaacaatgtagaatattgcctgcttgttccatcacagatgaaaaaaagagatggttattcaactttgtgaggtaattgtggatttccatgcaattgtaagaatagagattctgtgtaccctttacccagtcttcccagtggtagcatcttgcaaaactagtaccatatcacaaccaggtaattgacattcacacaatccattgatctcattcagattcctcattttgtattagtgttctctgtgtatatttagttctatatggttatcaggtgtgtagattcttgtatccaccaccacagtcaaggtacagcccaggtccatcaccacaagggtccctccagttgcccttttataaccacaacttacctttgcagccccacccaatctattctctgtttctaaaattttgttatatcaagaatgttacataaatgtaattattgtaattatacagtatgtaacttttattgactctttttcattcagcataatcccttgagatatatccaaactgttacatgtatcagtagttccttcctttttattactgagtggtattccataatgtagatgtactacagtattgatatggtttggctgtgtccccacccaaatctcatcttgaattgtaactcaccattcccatgtgttgtgggaggaaccaggtgggaggtgattgaattatggaggcaggtccttcctgtgctgttctccagatagtgaatgagcctcacaagatgtgatggttttaaaaacgggaggtttccctgcacaagttctttctttgcatgctgccatccatgtaagatgtgacttgctcctccttgccttccaccatgattgtgaggcctccccagccatgtggaactgtaagtccattaaacctctttttcttctcggtctcgggtatgtctttatcagcagtgtgaaaatggactaatacaagtacattcaactgttcactcattgaaggacatttgagttgtttctagtttttagctattgtgaatcaagcagctgtgaacatgagtgtacagccttttgtgtgaacctgtttttgtttctctaggataagtgcccaagagtacaattgctgggtcatatggtaagtgcatgtttattttttatttttatttttgagacagggttatgctctgttgcccaggctggagtgcagtggtgcaatctcaactcactgcggcctctgcctcctggtctcaagcaattctcctgcctcagcctcctgagtagctgggactataggcacatgccaccacgcccggcaaactctcatatttttagtagagatgcggtttcgccatgttgaccgggctggtcttgaactcctgacctcaagtgatctgcctgcctcagcctcccaaagtgctgggattacaggtgtgagccactgcacccagcctattgtatcattcttttttatttatttgcttatttatttttttgagacagagtctcgctctgtcacccaggctggagtgcagtggcatgatctcagctcactgcaagctctgcctcccgggttcacaccattctcctgcttcagcctcctgagtagctgggactataggcacctgccactatgcccggctaattttttatatttttagtagagacagggtttcaccgtgttagccaggatggtctcaatctcctggcctcgtgatccacccgcctcggcctcccaaagtgttgggattacaggcatgagccactgcgcccagcctattatgtcattcttatgcctttgcatcctcatagcttagctcccacttttgagtaagaacatacgatgtttggttttccattcctgagttacttcacttagaataataaactccaggccaggtgcagtggctcacgcctgtaatcccagcactttgggaggccaaggcaggtggatcacgaggtcaggagattgagaccatcttggtcaacatggtgaaaccccatctctactaaaatacaaaaaattagctgggcgtggtggcatatgcctgtaatcccagctacttgggaggctgaggcaggggaatcacttgaacctgggaggcggaggttgcagtgagctgagactgcgccactgcactccagcctggcgacagagcaagattctgtttcacaaaaaaaaaaaaaaaaaaaaaaaaaaagagtaataaattccaatcctattcaggttgctgcgaatgccattaattcattcccttttatggctaactagtattccatcatatatatataccacagcttctttatccactcattgattgatgggcatttgggttggttccacattttttgcaattgcaaattgtgctgctataaacatgcgtgtgcaagtatcttttttgtataatgacttcctttcctctgggtagctacccagtagtggaattgctcgatcaaatggtagttctaattttagttatttaaggaatctccacactgttttccatagtggttgtactagtttacattcccaccagcagtgtagaagtgttccctttacaccatatccacgccaacatctatttttttttaattttttgattatggccattcttgcggggagtaaggtggtatcacattgtggttttgatttgcattttcctgatgattagtgatgttgagcattttttcatatatttcttggccattcatatatcttcttttgagaattgtcttcatgtccttagcccactttttgatgggattgtttttttctgctaatttgtttgagttcattgtagattctagatgttagtcttctgtcagatgtatagattgtgaagattttctcccactatgtgggttgtctgtttactctgctgactgttccttttgccacgcaaaagctctttagtcccaactatttatctttgtttttattgcatttgcttttgggttcttggtcatgaaacccttgcctaagccaatgtctagaagggtttttctgatgttatcttctagaatttttatagtttcaggtcttagatgtaagtccctgatccatcttgagttgatttttgtataaggtgagagatgaggatccagtttcattctcctacatgtggcttgccagttatcctagtaccatgtgttgaataggatgtcctttccccactttatatgtttgtttgttttgttgaagatcagttggctataagtatttgggtttctttctaggttctctgttttgttccattggtgtatgtgcctatttttataccagtaccatgctgttttggtgactatggccttatggtatagtttgaaatcaggtaatgttgtgcctccagatttatctttttgcttagtcttgctttggctatgtgggctcttttttggttctatatgaattttaggattgttttttctagttctctgaagaatgatggtatttttatgggaattgtattgatgggaagactaatatccagaatctgcaatgaacttgaagcaatttgtagattgcttttggcagtatgatcattttcacaatgttgactctatccatccatgagcatgggatgtgtttccatttgtttatgtcatctgttatttctttcagcagtgttttgtagttttccttttagaggtcattcacctccttggttaggcatattcctaagttttttttgtgtgtgtggctattataaaaggggttgagttcttggtttgattctcagcttggtcactgttggtgtatactaaaggtactaattatgtcattaattttgtattctgaaactttgctgaattcatttattggttctaggagctttttggaggagtctttagggttttctaggcatacaatcatatcattagcaaatagcaagtttgacttcctctttaccgatttggatgccttttatttctttctcttgtctgattgctctagctagaacttccagtactatgttgaatagaagtgatgagagtggggctgggtgccgtggcttatgcctgtaatcccagcactttgggaggccaaggcgggtggatcacctgaggtcaggagttcaagaccagcctggccaacatggtgaaaccccatctctactaaaaatacaaaaaattagccggacgtggtggtgggcgcctgtaatcccagctacttggaaggctgaggcaggacaatcgcttgaacccaggaggcagaggttgcagtgagctgaggtcatgccattgcactccagtctgggcaacaagagtgaaacactatctccaaaaaaaaaaaaggggggtggtggtggtgagagtcggcatccttatcttgttccaattcttggagggaatgctttaaactttccccgttcatattatgttggctgtgggtttgtcatagatggcatttattactttgaggtatgtcccttgtatgccaattttgcggaggattttaatcacaaagggatgctggattttgtcaaatgctttttctgcatctattgagatgatcatgtgatttttgtttttaattgtgtttatgtggcatataacatttattgacttgtgtatgttaagccatttgtgcatccctgtatgaaactcaatcatggtggattatctatggcagcagtaatttagtagtggttattttctaatttgcgtttaactgggttcttttaatttattagagctagattcactaacttcccactagaggtctcctctttccctatagaaagcgttcccaaaggcaactgtttggactcaagtaggaataatttgcaaaatcattagcaaagttgcagttgaaatgtaaaaacctaccaatttttgttacctctattgccaaatataaatttaatttttatgtttaaaacattttaaatctaatatcttgtgtttttagagattacagcctaagtaaatttggcctttcgtttaagctaaattataagatgggccaaaatgaatcaagcaaaaatattcagttttcaaagaccactctaattcacctgcttaataacagtttaactggttttacctttctccatggaaacatgtcaaccgttgaagactattaataaacaaatatttattaaacttttgcattatgctgagaaaaatggaaatgaataagatgccatccttgttcttttactttgcatactcttttttcgttctaactggaattttttttttcatattctgcttctgcttctagactaactgaaaactcttaatcattaagacccatttcaaaagacacctctagtgtgaaggccttcttctcactcccttctctagattctcatggtatttgttcacacctctattatccaaccacgttgggtgttatttatctctttatatgttatctctctttattaaattatatgttctatgaggtcaggaaccttgtctttctgtgtgtctctttctcctttgttcttgtttttgtttgttttgtcttaccattgttgcctttgcactaagtatagcagacattcaataaacattttttgagcgaatgaatgaatggacatggcatttgagtaaggtcttgaggttgggtgggatttccacagattgatggtgatgggggagggaggctaagagaaaacagcctgagtagaagctgggaaagcccatatttgtaaataagattgacaactaatagagttattcaaggtgggcacaggcagagagcgctttaacaaaaagttggaaagggttgagaacatgataagaggtagtggagcagaggcttgcagtaatgaagacggctgtagtgaaaaagggatgaaagggtagttggttctgtcttcagttcacatctctcactgttccacggcctcagcatcctcaatcacttcctcagctttaaggtgtttccctctcaggcatctttctagtcctcttctttctcttgaattccagaaccatgtaatgattgaggaaaggaccctgggctggtagagaactgggttcaggtttcaacactgccaccaattagtcatgaaacattgagcaagtccctttaaacacatgcatttattaataccccaccttgtttcagaaaggatttaggatgtcaggaagttacttaatatcagggcttcagtttcctcacctctaaatgagagatttcatccaggtgatctaaattccttacagctctaatgttttgtgacctctgattccaatgatttgttggtcatctgcacttagaaatcctgctaacacttagtatgtagattatgaaaaactaaaagaaaaaaatctgaacctataaccctgttctcctaatgtgatttcttttaatggcatcaccatcctactaccagtgacccagggccaaaacttggtgtcattttcaactcctctagcccttgcccctacatctcacttaactgagtcatatggaactaactatgtaatgtcattcccatccttccccaactaggccctttcgtatggcctcatgtgattgaagcccttgctgactggctgtcccattctgttgacccttaatcttgatgctgctgagtcaatttcttgaagcacaaccgtaacaatgccaatgctttgttctattttatttatttatttatttttgagatggagtctcactctgttgtccacgctggagtgcagtctggtacaatctcagcttactgcaatctctgcctcccgggttcaagcgattctcctgcctcagcctcccgagtagctgggactacaggcgcatgccaccatgcctggctaattttttatttttttattttttggtatttttagtagagacagagtttcaccgtgttagccaggatcgtctcgatatcctgacctcgtgatctgcctgcctcggcctcccaaagggccagtgctttgttcagaaacctcggtgactccctgctacatacagaatacagtccaaattccctggctgagcatgcaaaacacttcacgacctgactgtgcaagttgcctgcctcttctcatgactcacatgtgctagtgaaactgaaaataacatgccttaaatgttcctgcttcagctaataatctggcataatttttcctggcacctttgtttgttgaaatcctttctgtccttattttaactcttttgaggcatttatcaagttctgtcacttattttaactacttgataacgtgtcttagcccactccatcctgcattaaattgtcagatgctcaaagcaaacaccatgtttcatttatctttgtctccccatctcctcctccctgccacatccagtcccctgcacacacctagcatactactagggaaacttgaattgaggtcaatcaaatcgaaacctactccaggaatcactttctcaaattatggttatacattttgacagctggaaattaagcaaatcatctcattttacaaatgagaaaaccagaggtcagagaggtgaagttacttgcccagtctttcccagctgcccttaaaacagtttttttgtttacactgctctggtaacaccacttgcagccttgtcataggtagatctattttcatgtctcctcttctttcctggatgcaagcatcttaaccttgacacgttgctctttcggtgattttagtctgtcattttgatgctggaaatatagatggggaatagaggagccagcttcagcaaattcatagctacagcgcctgaatggacactagatggcagtacgacaggcagactccaattgaggtttcaacagtggaacttaacgttctagccggaaggagccttagacaccatccagtccaacccctcatttttttgcagcaaacaaataaaaaaccccaagaacaagaaacaggagtgacttgctcagtaattgttgagtggcaagtgagtcatcagctttatcagtacaagagcattgactctgaagtaagttgctatatgtatgggactcggatgatgatctaatgtaagtactgttttgtgtgtctagatcaaatgatgccgtttggaaaaatttcccagcagttgtgtggcgtaaagaaactcccatggtcatgtgactccagatacttctggggctggttgaatgcagtgtttaataagtaagttactctaaataaagtgaagaaatgtggagatggttacagctaaataagttcccaatagcttgtttggctatttctcatatttacagtttgtgcagtgtgatcctaattttgtttacaaacaaacaaaacccacacaaacatggaaaaaacaccagaaaaacagattacaaaatattaattgtggctgtttgggttgcaggatttcgatgatttttcttacttgtccttttgatatatttcaagttttctaaaacattttataatcagaaaaacttattaaatataattttaaagtattttatttttatggctttttaaaggaatgtagttaaccttttgaattctatcaaagtaacttgggttttcaaaaaattagtgggtggcacacttagaaatgtcattttgaaacttgaaactaaccttctaattacttaatacagcattatgatcactagctagagaaaaaagcatatgtagaaattaataaatatcacttaatgagattaatttgaccacagattcagaattattttctctttaatcttttgttattaatacaaattctaaccaagtatagtcattcgtagaatagttactaagtatctctggtgtcaagcactgtactatatgtgaatcaatgaaacgttgtgtctgataaattcatataaaaataatacgccttgacagcgttcacgtggaaacaaaaacaaaactaaaaaagtcagcagatagactgcaggtttttttgtttttgtttttgttttttttgcatggatctcactaatttatcttcctcgtcagtcacttgaaatgaaaatttgttgcgttctgtattatttatgtcagttaatatagttaacaagctagtgattattgtaaaagcaaactgctttttttctcttgccaacagggtggattatgatcgcatcagggatgttggccctgacagggcggcatccgagtggttgctgcgctgtggggccatggtgcgctaccatggccaggagaggtggcagaaggactacaaccaccttccaacaggccctctggacaaatacaagattcaggcgatcgacgccaccgactcttgtatcatgagcattggatttgatcacatgggtaactaccctatcgttttgctaatagaaaatgcagatgatttgcagtgaccattttgttgcagttgactcacgattatagtcataggtatgtcctttttgcccatttcattatagtcaagtttgtttcttcctgtgtttgatatttattttcaaattaaattgaggttacagacaccttcctctccttcctcctctcactaagcttgtttctgtatgtctctagtctttggtttattgacttaaaatccagggccttgtttgtcaaactatctttgtcaaacttctgtcattgagaagccctcaataatgcaggaataattatatccacacagcttctgcttacgtgggcatttttttttctttctttcttttttttttttttgagacagagtcttgctctgtcgcctaggctggagtgcagtggcgcgatctcagctcactgcaagctctgcctcccaggttcacgccattctcctgcctcagcctcctgagtagctgggactataggcgcccgccaccatgcccggctaattttgtttttgtatttttagtagagatggggtttcaccgtgttagccaggatggtctcgatctcctgacctcatgatccgcctgcctcggcctcccaaagtgctgggattacaggtgtgagccactgcacccggcctctttttttttttttttttttttgagacagagtctcactctgtcaccaaggctagagtgcagtggcgtgatcttggctcactgcaacctctacctcctgggttcaagtgattctcctgcctcagcctcccaagtagctgggactacaggtgtgcactaccacgccagggtaatttttctatttttagtagagacaaggttttgccgtgttgaccaggctggtcttgaattcccgacctcaggtgatccacccgcctcagcctcccaaagtgctgggattacaggtgtgagccactgggcctggccctatgtgggcatttctttcctccagtgtgtgggcatctgactgcggaatggtcctgtccatcagcacaagctctatagtgaattccttatatggttaatagggtgagcagtcattccagttttcatggaactaagaggtttcccaggacataggactttcagtcctaaaaccaagtcagtcgtgggcaaaccaggacagtttgtcatcttagtggtaaagcagattcttaatctgtactttttctccccagagggcctagagcatgttgaaaaaataaggctgtgcaagtgtcattatatcgaggatgactgtttgctgagacttagtcaacttgaaaatttacaaaaaaccatattggaaatggaaataatatcctgtgggaatatcacagacaaaggcatcattgctttgcgtcatttaaggtagatgatcaaagccaaagtggaaacttgataatgctgttaaggtgaatagttagaatttaattgactgtgaggggtggtgtctttttttagttctaaaaaagataattttaaaaaatgacctcactttcatctgtaatattttaaaacagctaaaatgatcaaccttaatacattaatgttgtattgaattttttatagagtatattttaaaaaattaaatctacattaagcacctagcatggtgcctgccacagtaagccctcagtaagcatcaacgattatgctttctctcctttttttttaaagcagtttctcctatggttttaatattttcaagacatttggtatatacctattagcattttactgtgtaattattttgcttgaggggagaaaaaccttgaaatattcacctttctgtctctagagcctagaacactgcctgacactgtaataatcatcaaaagcatgcatccactggttaggaaagctgttctacatcctcttgtgccaccaaccagacccacgccatggcctggagcaagtcacctaatcccaaatgcaaaaacagataatactagcaaggaatgtttaattctaaaatttgtaagattctgagtctcatcggcgtgatgaaaaaagaatagaagtttttttgtttgtttgtttttttgagacggagtcttgcttttgttgcccaggttggagtgcagtggcatgatcttggctcactacaacttccgcttcctgggttcaagcgattctcctgcctcagcctcctgagtagctgggattaaaggcgtgcaccaccacgcccggctaatgtttgtattttcagtagagatggggtttcgccatgttggccaagctggtctcgaactcctgaactcatgatccgcccgcctcggcctcccaaagtgctgggattacaggcgtgagccaccgtgcccggcctagaagtttgtttaatcaaatccctgtgttagagatctcaacattcaaattatgtatctaattaatgtagttctgctttaatatataatggatctgccagtaacctcagtatcacaggaagtttaagaaattttaaacattaggaccaaaagtactagattgttcatctcttacattacttgaagcttcaaagcttcatcttttagtagaaactctagtatctaagaattttcccagcttttgcccttttggggttgagattcacatttcatgtttcacatgcaaagaatatctacatcattataaatatatattttatttagaatgattcagctagaaatattgatgtaacccaaagtctgtgttacttcctggcatgaatttcatctctaaggctactgctctaaaagtaattttgaaggcatagggtgatatagattcattttctacataattttctttctttaagtcagtaaattgaatttatttttaatgctcttggccaaattgaagtgacttttttctttatttgcagaaacctcaaatatttgttgttaagtgatcttcctggagtaagagaaaaagaaaatcttgtccaagcctttaagacagcactgccttctctggaactaaaattacaattgaagtaaaataatgtgtcttatttcagtataaaggatcatttgaaactgttgattccaaacatcaactaatattatatagtcatcagtagaattataaggatgccatatcatgacattttagaagtggagagtgcatcatatgtagaaaataaatattcagacgtggctcattaatgttactaagttggaagtgagaatttatgaacattaattcattttaagaaaagtgcagc

SEQ ID NO: 23 - DNA, 19749 bp, Homo sapiens
cgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggtgagcgccggccagccgtccgccgcgcccggtgtcccgccgcggtcctctaactcctcggcgcctcggtgcccggccgcttcgcccccgcccccagctccaccgaagccccggggacgctgcccttgggcccgcccgagcgttcgggaccctttacttcgtgttcgctcttgcccgcagctcgagtcggcgcgcgccccactcgggaatgtggctgtcctgtcgcgaaaaagagctcttgtttccgcttcgtggcaggcttacgcattcgacccagttctctctctcctctctgcctccttcccgggcggatttggctccacttggccttgcattacagtctgcattgcctgtcgtagattgtgcaaattaatgcttgattttggagctggctccggggctttttaaaaaagaactttgggagaggaattcggccctggcatcctgcgatggcttgtttttgctgcttttagaacaccgggaggaggctggaatgcggagtctggaagcctcgcccagcgttatcccgctttgacagcattgtttactttgctggacgaggccccacgggtgaggggagtccccaggccgggaggagagcgtgataaaataaagctcaagtaatagccaagggaaagtaggtgggggtggtagggtgctgacagccttaaggtagggtgtctttcggcagcgacgcctttggaaatggattgaaggacctttgtcaaggacaccccagttgggtggggtggttgcttgatcctgtggaaggggctagagagaggcaatccagagagagggtggttccctggcattgcttttcaaagcatgaccaggaactgtttacaaataagtaatactggggtagaggtgaagcttggtcacgggaagagagctcaaaggttgtctgtgccctaactgggctgtcctccagagggaggagcctggaaagcgattttgaggagccttattgaagggaacggggcctcctttttaacttcagaactttgtcttcttttggtgctggggtggcctcttgctagagggtggggacttcgcagctcctgcggtctagaggattgctagccttgttcctgtgggcagggctcaggagctgtactacaaccaatccgatgcagttaggcctggaccatccttaaatcagttgcacaatagcaaggcctgtggagtaaggagaccttcttgccaacaccaagggataaaatctaggagggagctttacagagaaattcagccaggccgctctgggggctgggcgggctgccttgaaaggctttttaaatgacccaggcagaagttcagtaatatatatggagagctgggtttaaggaaatgttaactttgcagaatagtggagttcttaggtggcttaactcatggaagaaatctccccccgatatgatcagttcaagaccaactcgtgtttgagcatggtacagggtctcactctgtcgcccaggctggagtacagtggcacgacctcggctcactgcactctctacttcctgggctcaagcgatcctcccacctcagcctcctgagtagctggaccacaggcacgtgccaccacgcctggctaatttttttgtattttggtagagtctgggtttctccatgttgcccaggctcgtcctgggctcaagttattcgccccgtcagcctcccaaagtgctgggattacaggcgtgagccactgcacccggccaagatcttgctttttaatcctgaaaaattttggcagaccagaatctgctccatataagagttgtcttgaacttgaactgatagcttttaagaaatagatgctgttttccgaggtgatggaaagggatttataacttcttccagaattctttgtggtattgctcagtaaatgcctgtgcttccagaagttcagaacacgtcatagtgacaactgcactcagctataatgtatttggaaagggaactaaactttcagctatatattaatcccctgagggaagagccacctagacacgtttttggcttatgtcaaatagtcaagctaccatacttttaaaaataagggcatagtctttaagcgttgcttcaaagatagaagcctgtctcatagcctggattagttcttaaagtgcttgcaaagagtctgccagaaatactaattcattacccctcctcctaacaacactcaatcactgttttctcaaatatcacttaacttcccccgacattgtttctacacacagtttcttgttttggatttaaatacttgtgatcttggctcttctttactgttgagcttgtatttattgggagagcccatcataatctttggatttatttgtttatttatttatttatttttggagacggagtttcgctctgtagcctaggctggagtgcagtggcgcgatctcggctcactgcaagctctgcctcctgggttcacgccattctcctgcctcagcctcccgagtagctggggctacaggcgtccaccaccacgcccagctaattttttgtatttttagtagagatagggtttcaccatgttagccaggatggtctttttttttttgttgttgttgatcattcttgggtgtttctcgcagagggggatttggcagggtcacaggacaatagtggagggaaggtcagcagataaacaagtgaacaaaggtctctggttttcctaggcagaggaccctgtggccttccgcagtgtttgtgtccatgggtacttgagattagggagtggtgatgactcttaacgagcacgctgccttcaagcatctgtttaacaaagcacatcttgcaccacccttaatccattcaaccctgagtggacacagcacatgtttcagagagcacagggttgggggtaaggtcacagatcaacaggatcccaaggcagaagaatttttcttagtacagaacaaaatgaaaagtctcccatgtccacctctttctacacagacacggcaaccatccgatttctcaatcttttccccacctttcccccctttctattccacaaaaccgccgttgtcatcatggcccgttctcaatgagctgttgagtacacctcccagatggggtggtggccgggcagaggggctcctcacttcccagtaggagcggccgggcagaggcgccgctcacctcccgggcggggggctgaccccccccccacctccctcccagacggggcggctggccgggcagaggggctcctcacttcccagtaggggcggccgggcagaggcacccctcacctcccagatggggcggctggccgggcggggggctgaccccccacctccctcccggatggggcggctggccgggcagaggggctcctcacttcccagtaggagcggccgggcagaggcgcccctcacctcctggacggggcggctggccgggcggggggctgacccccccacctccctcccggacggggcggctggccgggcggggggctgacccccccacctccttcctggacggggcggctggccgggcagagggctcctcacttcccagtaggggcggccgggcagagcgcccctcacctcccggacggggcggctggccaggcggggggctgaccccccccacctccctcccggacggggcggctggccgggcggggggctgacccccccacctccttcctggacggggcggctggccgggcacagggtctcctcacttcccagtaggggcggccgggcagaggcgcccctcacctcccggacggggcggcttagccaggatggtcttaatcttctgacctcgtgatctgcccgcctcggcctcccaaagtgctgggagtacaggcgtcagccactgcgcctggctgtaatcagtggatttttaacatgagggcttatttaatatctttataaggacatggtgccgttgcagttggatttaatcactattacagcaatgaatactgtttaggtgttctttacttactgatttaacttccccctctgacggtttgtgtatctctaatgctacattcatcttcctctcatcatgtaattttatttccctcaaccagggtgcaatagtttgttatctggccacctccagactcctggattaatatggttaggtatcgttagtaaattttgtgtgcccaggggagtggttcgcacaaaaggggacaacagacaaaagtaggaaatacagtccttggtctgaacaggtttaaattcttgatttgggggtaggggcagacagataagatttttagttctgaaagagtagagtcaagtgctaacatatatttcagacttgaaaacatttagaaaaatgagtgataggcttgtattggaaatctctatttagtggtaagggaggggattaacatttcctgcctcaaacttctagaaatcttctggagggtcacatacatgtcagagcattccagcataacaacagttgatggaccgaatgccctaaatgatcagactgagcagggacattcacagcatagcaaacttagagtttctcccccttgaagagttctttattcattggggatcacaggagatacagcttacccttgagctttctcaaaattgtctttctgtggtttgggaagtgagaagtgggtgaaaacacacttgctgtaacctcttggatttctcatattgctggaagagtaccctttctccttatgaaggaagaggaaactttttgttgggcaaattccaggccaaaaaaaaagctcttggattttatttttttttctatctgcctgtggaggagtggggatgatatttggttcttccattgagaagctacctctgccctcaaaggaaggtaaagttactatagttggctccacttttaataacactagtgacctagaagaaacctaatgctttcattttattattgagagaaattgggacccagagaagttaagtaacttgttagtattaaacagctaattattgtccgtgagtccctcaaatttagtatcctgatcactattccagttttttcctctactgttttgagatgcttatcttactaggaaaggaagtttgcaaacatttaaagagacttttctacctctggaatgctagctaatatgattctttccgctaccttatttcctttctaggtgctgaactgcccccttttagaagagttgttttgctctgcggaatgagcagaaacagagacacctcttttaccctttctctttgcctttcttttccttcacagagttctcatcagccatggaaaagtatgctgttaccataacaagggcagcagaggggaactaactgtgatggtctgaaattttgtctgggttgtagctcttctgcctcttggatagttgatatgattggttcattgggacagaatttcataaaggtcattggatgggtttggaaaaaaggagaaagcaggaagaagggaaaataatccactgggagtgaaagtgaactataccaaaataaagagtattgggggtgaagggagctgcttttttttttctttctttctttgagacagagtttcactcttgttgcccaggctggagtgcaatggcgccatcttggctcaccgcaacctccgcctcctgggttcaagtgattctcctgcctcagcctcctgagtagctgggattacgggcgcccaccaccacgcgtggctgatttttgtatttttagtagagatggggttttaccatgttggccaggctggtctcgaactcctgacctcaagtgatccgcccacctcggcctcccagagtgctgggattgaaccaccatgcccagccctgtttcttttgttaagataaaaattgtctttgttggtttattagcacttcagagatttgatggttgtgcacagtgaatgtggtttggccaccacctgtctccctgaagaatacagagttaggcagcttttagtttcctctgggttatttgccatagagcttttcaggagtctgtctcttcatccagagtctccatgaagaacagatgtttaaaactgaagttcattcatgaatgttctataactcagtcaataaaacatagaccttgttctaccttcctaagttgaaagaataaaaagcagagaaaacactttctttgttaagtcctttctgttttttcctttcttattttcccttatgggggtgggagagagaaagacaggcttagacttcttttctgagtgcattagaagcacttgctgcttgttcatcttgtatctgtttctcatcttttggtgggcccttatgtgagacatagctggagaattgtcaagaattcctagtagaaattgaagttacatgccaaatgctttgtttctttttttaattcaatgtctaggcttgaaggataccttcctcctcgtggtccctgctgccctagcagtgttggtttgtatgtatgtatttataagatattttgtaagcatcttttttcttagttccttataatggttttttaatacactatctcttgatgttttaaacatacataacaaaaatttccattttagtcatttttaattgtacagctcagtgggattaaatatattcaccttgttttgcaaccatcaccaccatccatcttcagaacgtttttcatcttcctaaactgaaacctcataccaattaaacaataacttcccattaagcagtaccaccgcagcctccggcagctaatcatcctactttgtgtcttcatgaatttgactactctaggaatctcagttaaatggaaccacgtagtaattgtcctttcgtaaatgaacattcatcagtgttcatgctttttttcttgccattttgctttttttttttattattattacatttttttaatacctatgaaagcaacaaagttgtaaaagtcatatagtcttactggccacacaacaaaaagcaacattccgatgccccgttccttcatctccatttccactctcagagaaaccattttaaactcatttagctaatgtgcactgcagccttgacctcctgggctcagcctcctgggatcataggagtgccaccaagcacggctaatttttaaaatttttgtaaagatgatttctcaccatgtttcccaagctggtcttaaactcctgggctcagatgaccctcttgcctcagcctcccaaagtgctgtgattataggtgtgagcccctatgcccagcctatttcttagtttgggatattaattcattttctgctatggaagatgaggatttagttgttatatacacccttctcccaatgtatatacttctgtctcctatcctcttaatttaacttttttttaccctttttggtcaaactaatatgtatgtaatctttactaaattttggtaaatattgaatgcagatgtggctgacattgttggtttcctgctcaatagctattccctcttcttgcttgctgccagattccctcattttttaaatggcaaggtgctaaaccccaggatatagactgtgacagctcttaagtcagtcatagtttccccagtgtttggtctggtgggcatctgaaccagttctggacaaatgagatgtaaaggaagtctgctgatggcttctgagattttcccctccaacggagaaagtcccaggaggaaagccctgtttgacttcatgttctcctttcctgcttggaactctattttatgagggtgtgggtccatctcagcctttttggagggcttgtgggcaagttacttaatgtttcgttctccaggctgtctatttgcgtgagtaaatggttaattctaattctggaagcagacttagttaaacagaattttatgatggcggccggggggtgggggtgggggctccctgtaaaaatatagttaacaactaccctgtaagttaaccatgttatagtggactttctctgtgtggtttaatttcagcttacataatttcttaactatatagcttaatgcatggattatttatcatttaaactaaggtacttggtattgaaagaggccgttacgcttgaatgaccttgtttctatactagccatcttggcaagcataactttgggctttattcattgaccttcttgttgttttctgcagtttgagaatcactggtttttagattcaaaggtagatagggtttttcccccctctctgtcaaagggactcagttttactctcatatttccctagtaatgttaaatctagaaagtcctggatgaaagtattagatttatcctaatatctggtcactaagggatgaaaaatttataaatagctaatgttaacctagatctaaagcttcctattctgaaatccaaacatgaagactaagaaaaatatgtacattttgaaacaaagcagaaaaatgaaacttcaacaatgtaaaagagggtaaaatgccagtagacagccactttcagcagtttctgtttacagtgcttttgctggctaccattgttgctgtaaataatatatgtatactgtgatttctttaacattagacaatactgttaactccccattatgaaagatgaggaatctaagatacttttattactttctgtctcttgtttctcatcctctctccatttactaatttctgtaaattgtattatcatttttggctcctctagtagttatctttaaagctctaaataatatgtgtctcaacctgtcaactttagctctccactgtataaaagtacaccattcacctgtcctcctgcctttactttgctggtatgtaacctcattatgtttataatatcagggtttgtgggcaggcttggtggcgtacacctataatcccaacactttgtgaggccaaggcaggagaatcgcttgagcccaggagtttgagaccagtcagggcaacgtaatgagaccccatctctacaaaatataaaattagttggactgtagtcccagctacttgggaggctaaggtgggaggatcacctgagcccaggaggtcaaggttgcagtaagccgtgatcatgccactgcactcaagcctgggtgatagagcaagaccctgactctcaaaaaaaaaaaaaaaaaaaaaagaaatcagagtttgtaacatttacgtactgttccttaactgttaattcttctatgcttttactatagtttgattataaacgttgaaaatcaaacagcatatacaatattgtgattttttttcataactttccaatataagactaaggagcatgattattttcatagagaaggaatggaaaattgttttttaatttttgtaacactccatcaattgatcacaatcatgccccattttaatactgtgttatatgagctatggatttcttgtgtagtctgttttccttcttcagtagcttaaggttaacttgtttctagttacttatggctgcattggttgacattaaattgagctgacatagcgttggagggagtctgggtgaaatgtgaattgctaggaagtccttgcttcagaaaatgtacatctgtgcatgcatatgtataagaaaccttaaatattttagattttttaatagattgtcttggaattgatgtaagtttatagtaaacataatattcaataaaggaaataaagggttttttcctgccattttatccatggttgaatcttaattttttttctttgaataattttggttttttaaaaggtcagtttcttttgaattacaccctaaaatcattagtgattaacaagctgattctgtatttttgctttatacccactacaattaaattttttttagcttgcagagattactaaaattcaaaaacttataaatactatactttcatagtcatatttttcctggctatatttgagaacattacagcattaagacgctagttcttcagtgtgtcttgttgtctgaattatttactgtgttggcattcaaaatcaaacatatcttaggaatgcattaaaaaaactattagaaataataggtgagtttgccaaggttgcaagataaaagagccatatagaaaaacctgtttttggcccagcacagtggctcatgcctgtaatcctagcactttgggaggccaaggcttgcagatcacttgaggtcaggagttcgagaccagcctggccaacatggtgaaaccccatctctactaaaaatacaaaaattagctgggcatggtagcgcatacctgtaatcccagctatttgggaggctgaggcagaagaatcacttgaacccagagggtggaggttgcagtgagctgagatcacaccctgcactcccgcctgggcagcagagggaaaatccatctcaaaagcaaaaacaaagaaaactggtcacgcttgttatcccatcattttggaaggctgaggtgggcagatggcttgagcccaggagttcaagaccagcctgggcaacatggtgaaaccccgtctctacaaaaaatacaaaaattatttttttctgggtgacatgtgcctgtagtcccaactgctagggaggctgaggcaggaggaccgcttgagcccaggaggtgtaggttgcagtgagccaagattgcacttctgccctctagcttggacgacagagcaagaccctctctcgaaaaaaaaaaaaaagaaaagaaaaagaaagcaatcccatttacaatagcatgaaaacaatttgataggaataactttagtcacaaagcataaaacttttactctggaaactacaaaacattgttgaaagaaattaaagaagacccaaataagtggaaagacatttggtggccatggatcagaagacttaatattgttaagatggtagtactccacaaattgaccttcacattcagcacagtccctatcataatctcagctggcttctttgacaagctgacaaaattcatatggaactttaagggacctaaaatatccagaacaatcttgaaaaagaaaaactaagttggaggacttacactttgtggtttcaaaacttattacaagtcaagacagtggggtactagcatatggatatacatatagatcaatggaataaaattgagagtccagaaataaacccagcaataatggcccattgatcttcaacaagggtgccaagacaattctgtggaaaaagaacagttttcaacagatagtgctgatacaactggatatgcacacagaaaaactgaaggtggaccagatggctcaaagacctaaatgtcagagcaaaagctattaatgtacaacctttagaagaagacagaggcaaatctttatgaccttggattaggcagtggcctgagatatgactccaaaagcacaaacaaaagaaaaaaaaaaaaacatacattggacatcatgaaaattaagaacttttgtgcttcgaagatcatgaagaaaatgaaaagataacccacagaataggagactatatttgcagtcacataagagatttatatccagaataaagaactatcataatttagtaataaagacaaatcattgaaaaatgggtaaaggttctgaatagacagtttcttcaaaagaagatatgtggtggaatggcctgttaagtacatgaaaacagcatgttcaacataattagccatcagggaaatgcaaattaagatcaaaccacagtgagaaaccacttcatatctgctaatgttggctacaatatataaaaattagaactcttacacactgctgatgggaatgtaaaatagtacaaccactttgaaaaacaggcagttctggccgggcgcggtggctcacgcctgtaatcctaacactttgggaggccgagctgggcagatcacgaggtcaagagatcgagaccatcctagccgacatggtgaaaccctgtctctactagaaatacaaaaattagccgggcatggtagcatgcacctgtagtcccaggtacttgggaggctgaggcaggagaatcgcttgaacccaggaggcggaggttgcagtgagccaagatcatgcagctgtactccagcctggtgacatagcgagactctgtctcaaaaaaaaaaaaaaaaaaccaggcaatttttcaaagggttaaaggtagagttaccatatgacccagtagttctaccttaattttttaattttttttttttttttttgagacagggtctcactctgtcatctaagctgagtgcagtggtgcaatcatggctcactgtaacctccatctcctgggcttaagtgatcctcccacctcagcctccccagcagctgggactataggcatgcaacaccacgcctggctaatttttgtatttttttttaagagacgggattttgccatgttgcccaggctggtcttgaacttgtgaggtcaagtaatacacgttggcctcccaaagtgctgggattacaggtgtgagccatgcctggctaattccacttttttagtttggtatatacccaagagaatggaaatgtgttcacatgaaaacttgtacgtgaatgttattcataatagacaaaaagtggaaacaacccatttatcagttgatggacttgtttttatcgacttaccagtccatcaactgataaattgataaggtgcgatatatacatacaatgaaatatttggtaatgaaaaagaaatgaggtactgataaatgctacaacataaatgaactttgaagacattatgaaagtgaaagaagcagtcacaaaagactgtattgtatgattccatttatatgaaatggccagagtaggtaaaactatatagagacagaaagtagattagtggttgcctagggtcagagggtgtggggagatcaggtggcatctaaggggttgggggaggttatgggggtaatgaaagggttctaaaattgattatggtgatgattgtacagtcctgcgaatcaactaaaactattgaattatacactgtaagtggatcaattgtaaatgaatgctatttcaataaacttgtaaaataccgtatcttatcagctctttaaggtcatagaggttcttcagagtttctcttatacctcacacatttaggcagaatctccactacctatatcctagttggtttaattgcaattctttaatgtatgcgttgttgctgatacataatttagaaagcttgcttctgtgctgtgcttttttcaccacctcatctccacaatttccaagcttgatgtactacagaagtaagaataatcttgttccagtttgcaagttgactcatctgacagtgaaacctcacccttctgaaatctcatcatgaacaaaagtggggtaactcaaacagataggcaaagtccattgttaaagctccttccctttgttcattggaaggccatcagaccccctttcagcctatttgcccttattttacatagcatgctaataagcaagttgctgatttccaaacccaccagactagaaacaccaagttagaaagggtgttaagggtgtgctatacagattgaattgtgtctccccaaaattcttatgttgaaaccttaattcccaacatgatagtattaggaggtggtgcctttgggagttaattaggctgagttgaggtcataaaggtgggaccctcatgatgggatttgtgcccttataagatggaacaccacagagttgaggcccccttacccccatgtaagggacacaaagagaaggcagctacctacaagccaggaagagagccctcaccagaaaccatccatgctggcatcttagtgttggacttctagcctccagaactatgagacaatttctgttgtttaagttgtgcagtctgtggtattttgttatggcagcctaagctgactgagtcatagtagtagcctggaaaaaaggtagctcttagtctaaggggacaagggcactgtgggggaggggtgcaccagcacaactttgaccatccgaactctgtatagtgatgttcagctgtacagagcaccaacttgatagggcttagagacttcttaggtcacaacatagtataataaacaattttcataatactgtgattcatcaagagggttgaatcattttctgttgaaggccataaagggatttaaatctgtattagaagtattttcattcaagataattgaaattgtttaccctttgaaagttgaactaagttttgtgctacccagaatgcctcgttcctcataatttctagatgcctttttgagtgctactctagtttttgtttttcaaagcaaagaggttgaaggtaagtttctactttccttgtcctaaaattatatttgatttacattttgaggcaggatcttgctctgttgcccaggctggagtgcagtggtgcagtcatagctcactgtagcctcgaactcctggactcaagctattctcctggctcaacccccgagtagtagggacttcagaccaacagcacctcacttggctctttttaaaataatttttttagagacagggtctcactatgtggcccagactagactcagactcctgggctcaagcagtcctcctgccttggactcccaaactgttggaattacaggcatgagccaccatgcccaggctctcttgtctttttgataatagccatcctaagagatgtgaagtgatatctcattgtcgttttgatttgcatttccttgatgattagtgatgtcgagcaccttttaatgtacctgttgaccatttgtaagcagcacgtttccataactgtttatcagttaaagtgtactcttcaaaactattgtttttaaaacattcaggtagcacttaactggtaagcagattgttttgtagaatagagaggggctgccagtttcagctttgactatagctgtgagaagaatgttagtctcagtccttctttggaaagcctttaaaaggggctgtttattttttctcatacttgtttattctttcatttaaaactttttttttcttaaagatgttaatgttagggcctaggtcacatataaataagacatagccctgacataagaaactcagagtctataaagagagacagatggataaacaggagtcctgtaatacatgatgtgtgtaagatggagaggaagaaccttttaaaaaagtgaggggtgggggtggcttcataaaggaagtgatggttggagctgagtcttgaaggatcaacaggagtgtccctggcagaagagaaagggcattccagatggcagaagagcctgtttacaggcagagaggttagagattatgctttcaacttgaattgtaaaatccttaaaagttaggattacatgggatttaaattaaattcctgggtggtattatatgttgataaccccttaaattgtttcaaactctttttaaccctgttttccaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggtaagagaatggcgatgttggagacctagagcgtggctcttggaatttgaatgtctgtttgctgtaggttgagaagctattgattcttcagttttgttttttgttttttgttttttttgagacacagtctcattctgtcactgaggctggagtgcagtggcacaatctcagcacactgcaacctccgcctcctgggttcaagcgtttctcctgcctcagcctcccgagtagcggggattacaggcgcctgccaccacgcctggcaaatttttgtattttttagtagagacggggtttcgccatgttgcttaggctgttcttgaactcctgacctcaggtgatccacctgcctcagcctcccaaagtgctaggattacaggtgtgagccactgtgcctggccaattcttcagttaataactaatgttcagttatatgtctctaaggtttccctcctcccccaaaggtttcttgaaatactctgaaaaccctgaattctaaatcataaatctgatgtagttggtgggagaaaagaatccagaatcaggatgataaaccccaaaaatgactctttgaaccatgccttaaggacttcctggcctaggcttcattggactaaggataacacacacagaaaacaaaacaatttcatagcccccatttccatcaccctcaggcaaatagaccttgtttcttttgttttgttttgttttttgagacggagtcttgctctgttgcccaggctggagtgcagtggcacgatctcggctcactgcaagctctggttcccgggttcacgccattctcctgcctcagcctcccaagtagctggggctacaggcgcctgccaccacgcccggctaattttttgtattttttagtagagacggggtttcaccatgttagccaggatggtctcgatctcctgacctcgtgatccgcccgcctcagcctcccaaagtgctgagattacaggtgtgagccactgcgcctggccgaccttgtttcttatatgagtttcttttatatggtgtgaggaaaagcggtatggtttatttcctctattttccagaactgcgtttaaggtttacctaaattacccctcctccaacacattctttttttctttatcactgtagaagcagaatggtgcggtaggagtggccagctcctgaaatattcctcagggactgcacttggtgacccctagatgggggccagcattccgctttgtcatatttcagatgagttttttaatggacaaagtgttagtttggagcagggccaaagtccaaagcctccagaagaatgtgctcccctgagagatggcaaagagctccccaagagctgctgtttagtcatcctgaagacaaagggacaatggggatgttttcacttgtgtccttttccccaaaacttctccccatgggtgatgggactgccattcttatttttcagattaagaccagccaaagcaaagcagagtaattgttttaaggcagcagagagtgggacaatttgaattactttttgtctctcatttagagggaatgacagttaaaactgttatgcttctttgtgtacgtgctaaactcttcattttattggtcctaactaggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcatttta

SEQ ID NO: 24 - DNA, 16150 bp, Homo sapiens
agggcgtgtggcgtcacttccggcttccttcagtccgctggtcccgagcacgagctgtgaggggattcacttgtgtgcggaactcctcggaaccatggtgagcctgactcccctgcctcttgccctacccctgctccgccgtgctcttgccaccccactgcttcctctgtcctgctagggtcgtaggctccgtttctgtctccccggccctccgcacatggtgcgagccatgcgcggggcgtgcggcctgcgccaggccagccggtggagctcaccacgagggggaggggtggaccgcaaagccagcgtctccttgtgcctaggtctttgcatagtcccggcagcccaggtccgcgcctcacccggagcgaagaaatttctagtgtgggacccgctccgccctccttctaggggcggagcctggagcgacggggtctgagccatcagagggtggaggggccgcagccttccgagggtggaagatggaggccgcgttccctcgcccgcccggcaggcgtcaccttgatggcctgcaacccctccctgcctcattcttagttcaagatcgtctttagtctcgctgtacgtaactgtcaatctcgctggtgtataatttatactcccgggggccttgtaaatccgaaaagccatgtcgctctcctacaagtccctctctcccacttaaatgctttctccgatgatggaagcttcatttgattgaaaacattgttgtaaatgagttttctcttagatgtccacttgtaagactagtggaaggcacctcagtgtatgtgttagagtattggtacttaaacggaatgcctcttggttttccttttcaggcgtccctttcccttgcacctgttaacatctttaaggcaggagctgatgaagagagagcagagacagctcgtctggtaagccttgttctaagcattgttttaaagataaaactggaggccaggcgcggtggcttactcctgtaatcccagtactttgggaggccgaggtaggcggatgaactgaggtcaggagttcgagaccagcctggccaacatggtaaaaccccgtttctactagaaatacaaaaattagccgggcgtggtgatgggcacctgtaatcccagctactcgggaggctgaggcaggaggatcgcttgaacccaggaggcggaggttgcagtgagctgagatcgcgccattgcactccagcctgggcgacagagcgacactctgcctcaaaaaaaaaaaaaagtaaataaagataaaactgtacttgaagactgtaaagttgattctgataatctccttggtttttactccagacttcttttattggtgccatcgccattggagacttggtaaagagcaccttgggacccaaaggcatggtaagaaaaatagaaaagttttatattttaatattgttttagagcgcttggtggaaatataataacaagcgtattaaaatgctttttaatctttaaaacgtttaattataaaagacaagtatgttctccttagtaaaaatcagagtccccagaatcaccatccccaatcccatgcccctccccaatgacaagtactgttatcatttgcacgtacatcttctaatattctgtttatgtagaagtatgtgtacttcattatgtattttatactcatgtaacatactgttttataaaacagatactatttatcaatacttttttgtagcttgctcttttaaattcctttcagtgtaagtagataacactgcccctttaactgtcaaatattatcctgtaccttaattattttataatttaattatggctgtattgatagtttctttccattgtttttgcagttacggtgttgaaacaaaaactagtgtctacctgtgcttctagtgtttctaggggtagatacatggtttggttacgtggtgtatgtattgaaaacatttgatgaatggataccacaaaatagctatccagagtgtttatacactagcactgtgtgagaatactgattgatccatgcattcttcaagatgtgcttatgtcttaacttgaaccaattatgttccctttaggacaaaattcttctaagcagtggacgagatgcctctcttatggtaaccaatgatggtgccactattctaaaaaacattggtgttgacaatccagcagctaaagttttagttggtaagtctgaatatactttttcaccaacctaataatactgtttgttaacatttttgaaataactttataaataggctgtgttgaccaatcgtactgtcaattgatgtccactagttgttaattatcgttgttaaaatacaagcttcaggagtgcccgtatgttggtggtaaaactgttgcatttcagacctcagagttccaaataatttgttgaatgaggaaccctggtaagtttagattggtagtgaatatttttggagaatttagtaagcaaagaagcaattttgagttaataactaatttctttttctagatatgtcaagggttcaagatgatgaagttggtgatggcactacctctgttaccgttttagcagcagaattattaagggtaagagcaactaagcaactcttttttcctactgtgtttttgagtatcagaggtaatctagtccttacttcctctgtctttactattgaggagtgcttaataattttctatttataacttttgttttataactttattaataggaagcagaatctttaattgcaaaaaagattcatccacagaccatcatagcgggttggagagaagccacgaaggctgcaagagaggcgctgttgagttctgcagttgatcatgggtttgtatagcaaagtactactgttctaaacatttagtgttctttcataacatgcttaatgcaagaaatctataggacactgaaaagcatacacaaagatcatcttgctgcctcaccccactccaacagtcaaacctacatcagcctccagagatagccactaaagttaagtttgggtttttagtctttttgtatatatcatcaaaatatacaaataaagcaaatagtataatactgtatagagaatttgttagcctctttttaacctagttaaatattaagcacatttttggatgtcaattttctgtgcagtattttaatagagttacacatttgaatatttggctagaatgactgtattaacctatctgtagggggagatttgtgtatttgatgatttttagcattataaaataactttgtgacgttgcgacatagcccaaaggtttctagaagtgtaattgttgggtccaaaggtaagtgtgtgtgttttaaggcacccccaaacctgggctgcacagcaggtgagcagcaggtggaaaaattgtcttcccatgaaaccagtccctggtgccaaaaaggtccgggaccactgttttaaggcacttctatttatttgcccattcacaactgtataataatacttgtttttcacgtccttttatttatttatttattttgagacggagtctcgctcttagagttgcccagaatggagtgcagtggcacgacttcggctgactgcaacctctgcctcccgggttcaagcgattctcttgcctcagcctcccaagtagcagggactacaggcatgtgccatcatagccagctaattttgtatttttagtgtagatggggtttcaccatgttgctcaggctggtcttgaactgacctcaagtgatccatcctcctcagtctcccaaagtgctaggattacaggcgtgagccactgtgcccggccatttctcacattcttgccaacattagacttttgcatgcttgtgtggcccccacccctcttttttttttggcattttgccagtttggtggggaaaataacatctttaatttgtgtttcttgattactgctgaggtttaattcttttcatatagcttacagacttgatcagttagggtaaaattatctattgacatgaatatctagataaattttgaaaagtaaagtagggttaatatgtatatttggttggttttatttagttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaaggtatgtatgaatgtcagatacaagaagctttgattagatgctgagggctgaatactgagtgaattctgttttgagaccagtgaccctttacaaagccagtgaacttgaatttaaggacatatcatatgtgcaaccatttttgtcattttattgacagtgtactcctcttcccgcgctattccagcattgttgatgatctctagagtttacttaactaccatgaagttatttgcagtctctgataaagaggaaatgttttcttttactagaaatcatctattctcaaatggtacttttaccaggattatatgtattctccaggaagggtctgggtcagtcaaatcattgtgttagctggttgttgaggatgtacagttgaccattgaacaacatgggtttgaattatgtaggttcacaatgcaggttttttcaataaatatagtcagccctttgtgtccgtggtttgcacatgtgcaaccgaacgtggatggaaaatgcagtatttgcaggatttgaaacccatgtatatagtgggccagcttttcaaatctgctggttccagtcagcctggaacttaagtatgtggggattttggtgtatgtgggcgtcttggaaccagtccccttcgtatactgggggatgactagttttttttagaaaagaattaaaaaaaatttctttaacaaataattatgtatgtttatagggcaagaggatctagttcttaaagagtgataaatgagacataataagtactgctttcttagtagtacatttttgtttagagtgaagttttccagatcatcttcacattatatttacttcacaaaatggcctgtcaaaaagtataggcattcttatatagagaaggaaaaaaaaagaattagatggtgctttacaacttctgtttttaccagtggtttggagtcctggttttgttctgtgtcataggtcttgatttattttaagagagagtcataattctgaaaatactcttgattaagtttatatacaagagctgtgtagcatttctttttttttttttttgagacggagtctggctgtgtcacccaggctggagtgcagcagtatgatctcgcctcactgcaaccactgcctcctgagttaaggcgattctcctgcctcagcctcctgagtaggtgggattacaggcgtgtgccaccatgcctggctaacttttttgtatttttagtagagacggggtatcgccatgttgaccaggctggtctcgaactcctgacctaaggggatccacctgcctcagcctcccaaagtactgggattacaggcgtgagccaccatgcctggccgctgcgtagcatttctgataggggctggtggtagggaaggagcattaaaacaagaatattagtagcacaagcagcaccattcttgaatgtctgctctgtactaggaattgtaataggaactttagtcatttagtcatcatgacctggtgagtgaggattaggttcacttgaatagagtagaaaacccaagataatggtggcttcataatggaaaagtttctaatgtaaccaaaaaaaggcctagaaaggtaggtggtactgggtttgtatgatggttccaaagcagcaggactaggctggtaactagcacctctgctactggttacattcctgttttacaaattagcatttctggttggataatttgtcgaaggttatatagccagcagcaggggcatgatcagggtcagatttatctgactccacggtgtccatggtttttccatttttaccaccagcctcaatacctgaatcttcaatttttctcttgtggtggtgattttaagctaataaaaatataggacttaacctattgtctttatattgcaacccatacagatgtgggtgtagcgtatatctgaaacaaaagtttcaaaatactgtttaattttattgtctgtactgtgctcttatattttctgtttcatattttttaagtaacccattaaattgattttgtaataactcttctagtgggatgctttataccagaagtgtccaaggaagagaatacagtcatgggttcctagtttctgtttctggttgggtcggtaaagccccttcctcctccctcttttctgcttatcactagagacagaaactaaaatccatggctttcaggcgctaaaagcctaaaagcaaaacaacaacagaataaggcaggttggacaagcttgcttttatgccttctaagagcttggtaaattggacttaaatagcttctttgaaacagtgatatgataaagcagacagctttttataagatttactaaggctgctttgaagtattaaatatgatactgttcttatatttattgtaggcttcctgttggataaaaaaattggagtaaatcaaccaaaacgaattgaaaatgctaaaattcttattgcaaatactggtatggatacagacaaaataaaggtatgtaactctactttttaaaaattaaaattactgcccaggcagagtggctcatgcctgtaatcctagcaatttgggaggccaaggtggtggatcatctgagatcagaagtttgagaccagcctgaccaacatggagaaaccctgtctctactaaaaaaaaaaaaatacaaaattagctgggcatggtggcgcatgcctgtaatcccagctattcgggaggctgaggcaggagaatcacttgaacccaggaggcggaggttgcactgagccgagattgtgctactgcactcgagcctgggcaacaagagtgaaactccgtctcaaaagtctcaaaaaaaaaaaaattgctggattctataaactcaggaatcaattgcactaaaaagcttggaataggtatgaatctattgtgtatatacacatatatatacgttggtaaaaatgttgaaatatgctatgggactctttaaaaagagtaatgaggcctggcgtggtggttcacgcctgtaatcccagtactttgggaggccaggcgggcggatcacaaggtcaggagttcaaggccagactgaccaatgtgagatggtgaaaccctgtctttactaaaaatacaaaaattagctgggtgtggtggcgcacacctgtaatcccagctgcttggaaggctgaggcaggagaatcacttgaacccagcgggtggaggttgcagtgagccgagattgccccactgcactccagcctgggcaacagagcgagactcaatctcaaaaaaaataatgaaactgatgctctctttatgcttcgtttgtcttagatatttggttcccgggtaagagttgactctacagcaaaggttgcagaaatagaacatgcggaaaaggaaaaaatgaaggagaaagttgaacgtattcttaagcatggaataaattgctttattaacaggtctgtgtttgcttttaagaaaggatttttttccatgaaagtttatggaatacttcatatttacttatattgaattagattttttacctaggaactgtcttagataacttcacttaaattatggatttttgtaatcagtaaattgtgatttatgcacacttacagtgaccagaattacgggattgatttatacagttactataataaagaacacttcttttcaatactagtaatggatgcattagtactatagttgataaactctaattatataggtaagaaatgcaatcttgttctaatttgcatttcttttacttgtggtaaaaatgtttacatgttttttagtctaatgtagtttatcttgtaacagttgtgagcataatgttttcatgtattttatttacaggcaattaatttataattatcctgaacagctctttggtgctgctggtgtcatggctattgagcatgcagattttgcaggtgtggaacgcctagctcttgtcacaggtatggaaaaaaggtattgttttctaacaaacacaatagtcactcttgaatttgttatttgttactatatgcaactacctttaaggagtttagaatttcagcagttattctgaaatctattctcttggatacctttaatttagatacatagatacattacatttacgataccaagttatataccacatttgccgtaggtatagatttctttcattgtgtcactgttttaaaggtagatttttggccaggtgcagtggcttgtgcctgtaatcccagcactttgggaggccgaggcagccagatcgcttgagctcaggagtttcagaccaactttggcaacattgcgaacccacatccctacaaaaaaaaaaaattggccaggtgtggtggcaagcgcctgtgatcctagccacttggggggaggctgagggaagagaatcgcttgagcctgggaggcagaggttgcagtcagcggagatcgtgccactgcgctccagccttggcgacacagtgagaccctgtctcaaaaaaaaaaaaagatatgtatatttttttctcacaaacctgtaagaccgttgttaaaatctgaacaaactagagctttaaaaagtcttaagtctacttacatttatctagttcgtacatttgtttttattgcttagtaagtagttgaatgctttgtgtcctttgtagtagtacagttacaatagtaacctttattgaacatttactgtgtgctggagagtgggtcaagtactgaaacattgcttttgttaattttaaaaaatttctgaaagtaataaacgttagcatacgtgaaacaatcaacattgtataatgaaaattagtatacctcaataccctttaatagaagtatgagtgatataattccagttgtgtcaaatagaaattgtgtttataaatcagacatgtctgtctacatcacaatgacatgagttcaggctggttgcggtggctcatgcttgtaatcccagtgctttgagaggccaaggcaggaagattgcttgaagccaggagttcaagaccagcctgggcaatatagtaagactgtctctacaaaaaattagctgggcgtggtggcacatgcctgtagtcctagctacttgggaggttgaggcaggagatctcttcagcccaggagtccaaggctacagtgagctgtgatcacgtcactgcagtccatcctaagtgacagagcaagaccctgtctttaaaaaaaaaaaaaaaaatgcagcttgtttgctttttattgtggtaatggtttaaaaattattgtttattaaatttttacagatttagggatataagtatagttttgttaatggttttcatagtacactctaagccctggaaaataagtttaacacttttctagattttaggtccttgaaaatgaatgaataggttggaaagttggtttgggaatgagaattaaggagacctgggttatgagttgtgaagtcagtagggctgtcacactgtttggaactgccatgaatattagaagaaattatagtgtactaacctttggagagtggacttggtctcatcccagaatgatctcttaagacgttttttttaatcatttgagaagcatagtcgtcttctaaccaagagacattttcctttaattacttgaagtgggtttacttgctttaaagttacttaggagccattgcgtacttgatgctttaaggtgacaaataaacacaatttaagatgctcatgtttatgtaattcattctttagttccacaaaataaagatgtaagaggccgggtgtggtggctcacgcctttaatcccagcactttaggaaggcctaagtgggcagatcacaaggtctggagtttgagaccagcctggtcaatatggtgaaaccctgtctctactaaaaataaaaaaattagccaggcgtggtggtgggtgcctgtagtcgcagctactcgggaggctgaggcaggagaatcacttgaacccgggaggtggaggttgcagtgagctgagattggcgccactgcactccagcctgggtgacagagcgagactccgtctcaaaaaaaaaaaaaaaaaaagatgtaagaagtaaatggtaataatatattgatgggataaacatatcgtaaggtcttgacatgaaattgctctatacccagaagaatgtttattaagtacaccaactgtatgtctatgaaggtgaccacatggtggctcccatccttaaaagctcagtggttgtcaaaggtgtatgatgacattggttcttgcaagtgtcattaaataaatgtcttgcactgggcatggtggcatgtgccagcagtttgatctattcaagaggctgaggcagaaagattgcttgtgcccaggaggttgtgctatgatggtgcctggtgaatagtcattgcgctccagtctaggcaaggtagcaagacactctctctttaaaaagaaagaaaagtctcatgtagaaggatgaagtgaaaagtttcataagccaagttagtcttatttttggatatgacgtcccaaatatctgttgtgtctcacatctagaacacaaagcagtctcagaattttgccagccaaaagtaaaaagaactttatacaaattatgagtataaattagtagtttcaaagaccagagtctttatgaatttattataaaataaataatagagcattgacagatttatcagtaaggcataggaaaagaagggttgattgataatatatgcaattcacattatgaaaggagtagtcagctagagaaaaggattttgaaatggaaacctgacttttgcttagttaggaaatagggaacgaagtggctgacctgttcagtttacagcatggaagatggagggaaaataggaatagaaatgagacataaggactaaattaatttgttcttattaaatttggtctgggaaattcttagtatgcatttcttgtttttttaggccttaggacatttcatttgtgataattagagatatcaggtgcttattaagcagttcatgaagtgtatagtggttgacttataggacaaatattttcatgtcttgtgctgggaattgtatcatgaggtcttagtcttataggttggattcagaagagaatctgaatttaaactcaaaagtaactgctttaagactcagtttaaccttgggaaggtagtattgtatagtgtgtgcttataggtctgaagccagactgcttgagtttgaaccccagctttttatattcatcctagttaggtctttggataggaaggtaaacctcttggcctcatttttatcatgtgtaaaatgggataataatggagcctatccaagaggattattttaaagattaaataattagtcgatatgaagtatttaaaaagagtgccaggaatataatcagcaatcaatttttaaaatgtgaaacacattacctatcattatctatccattactgcttattagaaaacaggaattttaagcctgctgtgcatttaactaatacatgtttatgtttataggtggtgaaattgcctctacctttgatcacccagaactggtgaagcttggaagttgcaaacttatcgaggaagtcatgattggagaagacaaactcattcacttttctggggttgcccttggtgagtgattatgtagatcctggttagggtgtctaaattcttgctaggctctgttgaagtaaaggttattgtagttactagaatagcatatcttacaagtcttaactcttcagaagcatgatacatactttgtttcagtctcttgagtcaacctcatatttaccgtgtctttgtgaacagtgcatgttcaacagttttttttccttgataacttagaaccattatgagccttgattgttggagaatgtataatacaggaagacaggtcagctttcagaacccagtaatataaccaacaccggcataaataatagaaggcaaactttttatccctaagtggtcactgtgtcttttaattttaggtgaggcttgtaccattgttttgcgtggtgccactcaacaaattttagatgaagcagaaagatcattgcatgatgctctttgtgttcttgcgcaaactgtaaaggactctagaacagtttatggaggaggtaagcatttagaaaatgttgaatatatttttaatttcttaaagtacaatataagtcataagtggttttaatggttcttacagaaatcttatattgcttttgcactaaattttaaaatgcttggcatatcttaaagtcagtaattcagtatcttggagacaactaagcattgcaatattttattggaattttaatctttaggctgttctgagatgttgatggctcatgctgtgacacagcttgccaatagaacaccaggcaaagaagctgttgcaatggagtcttatgctaaagcactgagaatggtaagttaatcaaaatgagagatccgaacttaagttttgtggttattgatagttttaaaatgagtagaaaatgaactggttaatactgcttttaaatttgattctggagtttctcctcttcgtgagcagtaactgaagcagattttacattgttcctaaatgtataattttaaaaagctatcctagttaggagtaaatcagtggttcttacagtagagtgagtagttacttgttttcttcattttcatagttgccaaccatcatagctgacaatgcaggctatgacagtgcagacctggtggcacagctcagggctgctcacagtgaaggcaataccactgctggattgggtaagcaatcaaggggaactttgtggccgttgttaaaagtaactcttttcactaagctttttttttcttttggaacataaagagttacaataaccgtataaaagactcttttggactttgtcctcataatcattacatgtgctgggaaaatgtgtgtgactttatatgctcagcatttcccaaactttgttattccataagacatgtaaaactggttagaagatttgtaactatttggtatataacgactataggatttaaatataaacaatacttacattctgaaaaataacataaactattatgttgtttatacaatcagtattaacttctaatttcatagtaaacttactgcaagataatcttgagtacagatcacagatctctagtccatagataaaagtggccaatgaggcagatttaattcatattgaaaaactttctgacaagctgtgctggacattatagagtagtcttaagaaggtagataatcctgtcattgaacaagagggagcaccagttaatctgtgagaaaatgaagcaggattctcacaagaagagaagttgggtaggtaacttatgaattttcttccatttgttttttattatttgatatgttgtcttctattaatatgggtgatcagtagttgacattattgttgttattactattattataactgacacaatggtcttgctctgttccccaggctggagtgcagtggcaccatgataattcactgcagccttgaacccctggctcaagcagttctccttcctcagccttccaagtagttagggctaaaggcatgtgccacaatgcctgactaaattatttttattttcttagagatgggggggcagtctcactatgttgttcaggctggcctcaagcaatcctcctgcctcagcctcccaaagtgctaggattataggtgtgagccactgatcctggccccttttattttatttatttattttttgagatagagtttcactgttgttactcaggctggagtgcagaggcatgatctcagctcactgccacctctgcctcctgggttcaagtgattatcctgcctcagcctcctgagtagctgggattacaggtgcccaccaccatgcccggctaattttttatatttttagtagacggggtttcaccatgtttgccaggctggtctccaactcctgaccttaggtgatctacctgcctcagcctcccaaagtgctgggagtacagatgtgagccgctgcacccggccccttttaatttttttaaaggctttctttgagctcatttgtaggcttatctacctactgagtaaagtagttgggtgtcctaattttattaataggattaatttttattataaatcattagagatgttttgatactttagttaaaactgctttttagtaaatttgtttttctttgcagatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggtaccctaacacttttctcagaaaaaattactaacagcaaaacaaaatagggagctgtatttattttataattagagttaatgaaaagcagagacagttttgcctggataaaagtatgtaagttatttaaaatatcacaactcttaacacttaagccagaaaaacttaaggggaaagagggatgggcagctgaggtagctcttaggattgaaaaggcacagaaagagccatgcttggaaaggtcaagtactgaggacagtagatgctgtgatgctttctattgtctttaaacagaatgatagcaaaaggaaactgagttctgtaactaaagtgttctagggcaaggtcatatagccacacctactcccagaaatcttcacaagaagtcagtgccctcacccacagttgaaataacgcttaaaaaatgtataataccttgtttggtctgatactgttttagagatcaggtatcttttattagcaaattctgagtaatttgcaataaagaaactgaattttaactcagccttccagacctaccagaccatgggcttctttttcatattccttattaatctccagaagactttttttttcagatcagtgccctgtgacagctgcttcataactcttgacaatggttagcatcctagtccccccataagctaccaagggtgaaaagtttatctctctatatgatccctgtataatgctgtactctttgatctgttcttaagcttcttcagcttctcgtaactgttgtgtttgcctctaaaagcagtgtttctcaagctttagatccttgaacaagcattaagtacaaatttactagtacccttatcccatctttccaaaagattgttctatgcccccttattgtatggtcatcaaagaataaaagatgagaatagaaggtgcttcttgttggtgggggtgtctgcagagtcccaaggcagaacagtcctgatgtggtgcagggcatcacacagaggagggggctgagtggctagctcaggtctgtcttcctcctcacctaaagccagcagtcccatcctatataacccattagtccatgacataacttggtcacctcttaaaagcccaacttccaatactgccacattggggattcagtttcaatgtgagtgttataggggacacacatgcaaaccattgcagagttataacagttttaatacaggattctagttgtgtttgtatttagtataatactttggataaaatcatgctcttcatttttcactattgacttttttcttactctcataggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaagttcatttctcatactgtgcattaaaataaaaatttgaacaattacttggtt

SEQ ID NO: 25 - DNA, 42834 bp, Homo sapiens
actcagcctggagaccgaagcgcttcactgagcgctcgccgccgcccagcctctcctctcgcgcctcctagctcttcgcagagcaaccaggagccaggagtggtctagagcccgagggtgggaagggggagtctgtctggcttttctcctatcttgcttctttttcctcttcccttcccactcttgttcaagcgagtgtgtgagctatggagcgaagagcctggagtctgcagtgcactgctttcgtcctcttttgcgcttggtgtgcactgaacagtgcaaaagcgaaaaggcaatttgtcaatgaatgggcagcggagatccccgggggcccggaagcagcctcggccatcgccgaggagctgggctatgaccttttgggtcaggtaagagtttccactttcaagaaactttctggggccccaggggactggcgggactggagcgcggtcttccaagtgggagccccaggttgcactctccagagcccagagtagcaaagagcaaggagctgctccagccctcgcccctgtcgcgcttggagagagagaaagcttgcattatttactgtttaggctgggcgcagccaagcagaaggaagccgctgcagctgggtagggcttatgcttactgttggccgctctagaattgaaatccgttcccgcgcggtttggaagaaaaatccctccacgcttgttcagggaacttgagatacactcaagctcttaccaaccaagcgcccccgggagaagcagtgcgctccatcccccgggactgaggcggtctgcgtcaggagccggctgttgccttcttttcaatatggcagcatcagatccaagtcctgatgcaaggggctaagcaggcttggggctgtccgccctggcagcctgtaagggcacgcccagggcattggaagagtgccagctgctgggactcgcgaccaggaggttgggaggccgcggagtagcctgggaagctggggggagaaatggtgggtgaaagacacgggaccatctatccccgcgactctctagggagctccggcttttcactgggaacttataaagtccaagcttcataactttgcccggccagtcccactgcagggtcgagatgccgaactgactatggggaagggatctatttctttcttgttcttcagccaagtacgtaatcgttttcccgggaatttcagcttattgttgcctgtccaagtgaaggcttggtcgataggtagctggttggaggtgggtgggcgtcaagacattaagtgggagactgcttatagctgagcgattccgaggggaccctagggagtgtgacttctagtctagagctttcctttccttggctcggaatcaagccctcgccccctgcttgggaagttggtctgcattgaagcgtgggaggaggcagttgtaaaacattttggcgcgttttttctggaggtggtggttgagacgccgctggagtcacggatgagtaatcggcgggggcgttggcgattctgtagaccgaaccctctggggaattcgcctgctcttgctagaggcttcattctcaactttataaaccaaattgtctttgaaatgcccgaaaggaaaatcaatgcagattggcttcctggtgtcccagcagcagatgagtcttttgcttttggccagcccttgccctcgtgccaggctccgtgttaggggctgaggaataagaggagggaaagaaacgctctcaagtaatcaagaatctagaggagactagcttagagataaatgattgcaactgattgtaatttgtgtaatcatagaagttgtacttgaagtctcaatattcattggttgaaggaatgaaagtagtagggaattcgggaggggtgaatgaaaactgcccaaaggagaaaacatttgctccgggaacagaagtcaaaggttgccaggagcacataatgagatcggagaagacagtctaggcatagaaaacagcttgtgggaaaacagtgagacataatacagtttagtagtaagtctgggaattgcacgcaattattaggaatttttgagacccaaagagggtatgagtagcagaggaaattgtgctggtgggtactgtggacatcatacaaatcatgtatgacctatgggggtggacactggggatttaattgtgtattccttgagcagctactgaaaggctaaatagcactggtaaccgtgtaggaggagactggggaagacagcaaaaactaaatctctcttctttttcccacctgttagctctaggcatgcatctaaacctagaccattcaatgtgaaaactgcttttcaaaataaataaacataaatcttaatagtaaaaaacaatacatcatcattcttgggaggatctttgagtaagggatagcatagtcacaaaagcattaacaaatagtgggggaaaaccatctatatttatatatgatttacaatactatctttcctctaaccatttttagttaagatggcattactaacaaaagttttaaaacaaacttaacaaaattattttattagaataataattctttgtagaaggctgatagcacgttcctggttctgcttatttctctttttgtttaatattactaaaattacactaatttagcattactatattgggtaccttattgcctcaggataaagcttggattaaggtagtgacaagaagaaaaaccagttgacagcagagaaaacagagctaagcactggtgatctttttctgcggctgctgatttctctccccagttccatccacagcttataggaagattcactgagattcaggcttggagcagggcctaagcttctctattttaaaattctctgggcgatgagaatcaccaatttaaagaacacgtttcttctgtaatatactgttgtcaactgtttgtttcttaattttaaaaatgcagggttacctagaggatttggtagcctcaaatttagtactgagtaaagggagactagctcaaaagaataatgaatatagtcctaaatgaaccaaagatgtcaatagatacccggagaagtacaaaccctctaaagtgggacaactgccctaaatgtagcatgttcttttctgaaagccttgaattagtggaaaatcaaacgatcactaatagtggctaatagcaatttatcactatgaattcaatggctacattttataacaacgataatttattttagtggaaagtggcactgaccatagatagtatcccaggtgtttgcctgcttaccacaaataattgttctttgaacagatatatttgattaaatgagcattttaatatgatattgtcacacatgaaaaacatgtatttcctccaatgtgtgtaaaatagaagcatcactagcctcctactgtgagctaatgaatatactgtgaactcaagcaataatattctgagggtcatcttaagacctctatcagtgccttcttcatgaagaatgtggatggagctggaggccattattgttggcaaactaacacaggaacagaaaaccgaataccgcatgttctcactcacaagtgagagctaaatgatgagaacacgtaaatacatagaggggaacaacatatactggggccttttggagggtggagggtgggagaagagaagggatcagaaaaaaataactaatgggtattgggcttaatacctgggtgatgaaataatctgtacaaaaataccccgtgacacaagtttacctatgtaacaaacctgtacttgtactgctgaacttaaaagtttaaaaaaagaaaaaaaatattaatttcagataccaggaatgggcttaataaaagttgcctatctctaagttagctgagttttaaactagtccatatatacttgtttgggaacgtggatatttattttatttctttccttttatagattggttcacttgaaaatcactacttattcaaacataaaaaccaccccagaaggtctcgaaggagtgcctttcatatcactaagagattatctgatgatgatcgtgtaagtgttgtacatttgtcttcaaaccaatactctagcttatctgctttctttatgatttctaataaaaacagaagcattttgcaaatgtggttttttttttattgtgaccaagattgtttatctgtattatttctaatttctttccataaaattataatggcacataataataacaagattgggttgaattggttgagccaaagttaattttacacatatatacgcagtttaattatataattacatatatatctaaagttaattttatatgtacactcacaaattcagtctaagagcatgaaagtgaatatttaaaatgagagggcagcactaataaaaatgtttgacaatacagtcaatcaacaaccttttattaggtacctattatgtaccaaacactttaataccaatgtgggctcaaagaaatacatgggccttactttcaataacatttcagtataactgaaaaaaaagtctattatttctatttggttttgctgtataaggagctagtgtttatgagagaactgtaaatccatgtcttcatgaggcaaatgtttccataagtaatctattgttggatccaaaccatctgatctcttttcatcctagtttgtatcttggttcaatgattaggttacagcagaaataaatataggtaaataaggtagaggcagtttgaatagatagctaatgtacctattgattttgaagtctattttcaaggtcaacaaacatattagaaaatgtttactatgttgggagtattgtaattttcatacagtgttgccttttctcaaagaaatgccatactggaagaaatttatcctgattcgcctgatatctgtgtacataatttttgttacctaggacaacctggagaattagaatgagagatcctcttggtgagaggattaaaaacatcctttcaacttcccagggggaaaatatatatatatgtatgtgacagaaaggtgatagaactgttgaaagtagacgaaattcatgaggactgtaagataatttgcccttttattcattctgaaactgatagaatttttaaaagaagaagaaaaagacaaattatgagggtagggaatgggaatggcctgggtcaccagtgttcgaatgtaaaagaaacaacaacatcctgacaatgctgtattaggaccacggacagtgaccgtatagctcatctacacccactgctagctcttttttgtcaagttattgcttgatgtgggagaccaaatcagaggccctggaccttattacagaagtttcttgtccactgaggtcttcccttactcacttcaagggagagggctcatcgtgtgtgggctctgaaaagcagaataacttctagcactctggctaggcttagtccccgggctaagcagaagagagatttccttctttgcctaaatgcatgcccaaactgcatgcccattaatgcacatagaactcaaactgacctgccttctcactttcataggagaaaattggacagaatagagcatacctaactgttattcttactcaaagtatctcatgacaatgaagatggcccattctactctttatacatccccttgatagctgatttggtgggggaggggtggaatctcaagacattatgaaaaaatgctaagaattccttctccagcacaggtataactttgtaaaaaattagcccaagaataattttattttaggaaacattctggaaccatagaaacttgcattggaaggttgaattagatgatcttcaatgctctttccagatcaaaagtattatttataattaagtacatgatacctataatgcataatagaaagacactaccaattttcctctataccattcagcctgctcttctagagattaatacatgattctgagttaatgacattaatcataacactgttttctacaattggatgtttatctgatcagacggcagagtgcctcctcttatatcccatttccaaaaaattgctcttggttttcattttattgctcttttttgatggaggataatattctttcaaatcagccctgtgaaatgcagcaacagtctatctttacaagtctgttaataaaatctccaagtgtaagtgaccctctacctcaaagattagtacttattccctagcagtcagcttccagagatcaactcagatgataggcagcattccaagcattgaggtattttaagccaaaacaattaagcttgaaaatacaagcactttaaaaataaatcatagtgactaatttctagctttcaggttcttcccattatttttaataggtttgcagtatatttttaattgaaaattgagggcagtcttagtggatggttttatccttcagttgcaaattatttttcggtttttatttttggagctgattcatgagtactctcacattaacaatattccaccacacactgaattgtcatcatgcatacagcagaaaagatgtgtttggggtaggaaatagtcatattgccaagaaaaataagagtatagaattatctcataatgaatataactacaaggcagcccctcactctctcagggcttcaagtataatagtattatgctgtaaatatggggcaggtaattttcgtattgtcagatctctttgcataatacatgagactgaattaatggtaagtgtgcgtggtcagtagtgctcattcatcacccaggatctgtgtctcatattaaatacttttaagcagaggtcgaagcacaggggagggagtttcaaatttgcatggatacagcaccattcttactttataaaatatttgcaatttctacctgttgtatgtaaagacagagaaattaatctataaaagcattataacagcagtctcttggcttgttgactcaatccataaaagcagacaaattttcagccatggagccctgaaacctcaatataaaaatgagtattatggtccatttgctgatgaaagcagactgaacttttgcttccactgtaaccacaatgtaaataatttagggaattatcatttcactgactgcttctcctccccctaaaggtgcactttactgtaatagaggaaatattcatctccccagtgggcaatcccttcttctcactgaggtgccagtttaatctgtagtcaaatgaaaatattgcagagctgcctgaactctgatgggaagggtactggagatagttagaggaagtatacagaggtagatatttgacttttgattttcttgctataaaaatccttgtaggtgatatgggctgaacaacagtatgaaaaagaaagaagtaaacgttcagctctaagggactcagcactaaatctcttcaatgatcccatgtggaatcagcaatggtacttggtaagtacctacagaaggactatgtgggtgggacctgggacctggcttctttatgttgttacatttgcaacatggatttttttttttttttatgatggagaatttcatagggagctatattgtctggagattagggctgatgggatcttcttgatctgcctcttctgttttgctgagtaaggatgttggaaacagatatctttagctgctgtgaaaaaaataggttgtattttttgtcttcttaagtttatttgggataaatgcagaaaaataatatcttgcaggttagggtttccaaaaacagtacttgtggcaaaaatctcatttggttaaagttattcttcagaaccctttaaagcactcacagagtatagtgaacataatttggcatatacaaccctgaatgacaattcttatatgacacagatgagaatctctgaaagaggttaaaagaaggaacacaagaaaagtctattgcaaatgtctagacttgcaaaccattctacctttaagatagttaccaaatccttgagcgaagaaattgttaagtgttgctgtctacctgcagggtgtcctctcttctgtttaatgttacgtctgtatggtagtagtataggctaatagaaggatttgttgttgagaattttataaaagattatttctcttgaaaaacacaagctaagactttgatactcttgttgcataagggttagaaaaggggatcagtttctcttgaccctacgttttctttctttctttctttctttctttctttctttctttctttctttctttctttctttctttcttttctttctttctctttctttctttctttctatctttctttttttttttgacagagttttgctcttgttgcccaggctggagtgcaatggcatgatctcagctcactgcaatctctgtctcctggcttcaagcgattctcctgcctcagcctctggagtagcttggattacagatgcccgccaccatgcccagctaatttttgtatttttaatagagatggggttttgtcacattggtcagtctggtctcgaactcctgacctcaggtgatccacccgccttggcctcccaaagtgctgggattacaggcatgagccaccgcaccgggcctcttgccactatcttaagtatttgctcattgcagcagaagagacttatcagttaacacttgtgcatttcctgtgtgacaaacactattctaaaatgtttgatatgaattaattcattttgttctcatgattgtctgtgttgtagaaatagtaattatgcccatttaacagatggaaaaacagagatattggaaagtagaataatttgccaaaatccatggctgctagtggtgggactataattcacgactccagagtccatactcttaacaactacagtctaaaattgttcctgcaactgacatagaggccttcttctctgactttggccaacaatctgtgtacagttccagcctcctgtgattcagcttcataccagcctggcaaatacttgtcaccccaccccccaacctctttatggggaggagggcacaaaagcaagagggcagctccttcactgacacttttgattgtggttatttatagatttcttattgaccctttcaccgggtacctggcattcttttactgtctctgtctcacatgcttagaaatgtgcttatatctgtgttcccttgctaccctgtacttatctcctgtacagtcccacactctgactatcagaaaatgtattttaaaaggaaaaccctgaatctcctctcacagacacttaccccctaaatcactcatacttaaaaataggcaatcacattgcaattcctgaggcaatcacagtctcctgagcattccaggttctgctttttcctttagaataaaaattctaaaacattcatgaatgactatgcaccaggcaatataatgagagctcaatgtggcaatggagaatcaggatttggggggagatgaaaacatcgactatcaaatagagcttccatagatgaaagggttgagcatgttattataaatgaaagaaatttagggataaaattcttcaaagccatgtagttcaaagagaaggagcacaggtgattcatcttttcaagtgatgtccatttgggacaatcgggagaagagcagcactctgggggttcatttggccttactctcaactttgttttctcatttcactgaattggcttcttctaaagagtagagtgacccaaggaaaaagaaagatgggtctccaggttggaactgaagtgcccattttgtagcaagcaaatgataattttatcaatgcttcgttgtttttctttaccagcaagataccaggatgacggcagccctgcccaagctggaccttcatgtgatacctgtttggcaaaaaggcattacgggcaaaggagttgttatcaccgtactggatgatggtttggagtggaatcacacggacatttatgccaactatgtaagtgtgtgccttctcatgactgtgacttagggagctgtctgtgcagacacacagttagggctttccttcttttcaaggggatgctgctctggtgtcagtccctgggattatgggccaaggttatgtcccttctcccacttcccactagcttatatgaatttattttgtaccagtgggcattgaaataattcagtgggatcaaaaattgtacaaaagtatatgtgttgggagaagaaggggcagtgcctacaccaattaagttaccaaaatctgatgactttgagttgctcagtgtttggggcattaaagtaatcaaatcaagccccttgcctgagatcattgtcacagtttccctcctcacctcttttatgagtctatatccctgacattgtaaaattatatgaatgtgattccttccatgcaaatccaaagtgaataccacacaatgcacctatgccaagctgagaaaggaaaagttttctagaaatgggaaaataaataaataaaaacaatttgcttcattgtttattaagtttataatataatatgaacaccatcatatatcttaggtctttagatcaggaggctggtgtttcatctttcagattatcccttgtttttctctcatcctttccacctatcaaacattccccagctataacaccaagctaaagagccaaggaaaagagaaggaaaaatagtagcacagagtagaaattaggaatgattgaaatatacggaaagcattgaaaagtaacagtaagggtatgcgggaggcgtttaagtgtagctattgggttggaaaagggagtggagcctggaagcttgtcttgaatttcaagcaccctctctcaaattaaattacatgtttatttagtgtgcctgggaggctgaaggagagcaccatggacctgagtcccaccctcagccacttctttgcacctatattcataagagagatgagtgtcaaagtgtcactaactagctttatggccttagggaagtcatttaacttctctgggcctcaattttctcatctgaaaactgagatgactgaactaagtaaactaattccttccaactccaatatcccatgagtgcctgtgaaccataggcttggtaacattcactgagaattgaatgctggctcacctggctgtgttcatcatctctgcctggtttgtgagtaaaataaatattcagtgactcggccagaaactctaaaatgcaggcttttgagctatcagccaggatgggaaggcatagggtaagaggcttgggaagtgatgcttttttttttttttttttttttttttaatgctgccacagtgttatattttgttgtctctttaggatccagaggctagctatgattttaatgataatgaccatgatccatttccccgatatgatcccacaaacgagaacaagtgagtaaatatgcatttgtgtgaaataaagtactttacaatgcttttatcttgtttgagaaaattataccatatatttcatccacattccagtgctcaggaaatgttaatgcacaacatccataccacaatattttgttgcttttaaaacagaaaccaaagtttctatttttatattccctttggtttatagaaccatattttcattaaacttcttacattatgaaattctcctctcaaatgttactgaactgttgtagctttagaaagaatgtttgagacataaagagtacacactttgagcccatccctcccctcaattcctctatgaatcttttactcttagcaacatgctttatgttagtcatgaaaagaaatatatgtaaagaaatggatatgaacaatgcccacaacttctgacggtggctacagtcaccttcaccagttctctcagaagagcatggccaaactccagacagagaaatgcctctgaggtctggcccctgaatccaacacagtctccagggcattgagccagccggaagtctcctccagagttcctgctgctataaggccataggaaagagagaggagacagcacccgactcccagattaactctctgtcccttgaagccacattatggtgagagaggccaagagccacagaggccaagagcaagatcttctaaagggagaggtgaaagaaagacccagaggcaagagactttcaacttctctcctagccccaaagaaacttcacgctctaggcatgtggaccctcaaagtgtccatgcccatgggagagaccatctttgctcataccgatgttctcacagacatcaaggagacactcaaactttccttttcattttctctacacagaagagacttgcaccaaaatgatcaaagccaaggtcaaaattagggcttgttgctacaagtgaggatggaaaaagccaagcatctaacagctcttggtatatgtcacatgaagcgcttctttattctctctggatggcactgtctcttggactgttacccaacttgggtcagacaagtctgtctctgtctctctctctctctctctctctttctctctctctctccctctcttccttcctccctccctccctccctcccttccttattctccctcagaactcccaagtggctggtgcagtaatactgatctaaagttatttctttctttggatagtcttccctccagaaagccaacaaaccccaggatgggaggctggggtacatggacttggcctcaacttctgggtgtttatttcttccttggggaaaatgggaggcttgtggatagttcagggatatgacttctttccgtaccatttatttctttgagggtgactaaaggggttaaccgcaaatatcccttagaggtgaaaacattccagtaaaaacacaataggaaccactggcaagggtacctttggagcaaagtgggagtgtttcgagagcttacagcagaccctcagacaaactttttgctatatgtctgaagcaggataatgcaggaccagtaaggacatctactcttttggggcacagccttgcaatgtagttatggctttgccaattcccagagtaaagggtgaccttggagaaatcacttacctctctctgcctctattccattttcttcccctaaactgggtgacaacgtaccttctccctatgtttcttaaatgaacttcctgaggaaatggctaataagcacttggaataataagccttcttagagtggagtagaaacaactttcattccacccccttggttaagactacgggaaatctgttcccagacacttgaggagacttagatggaggcactggctccttcctaggcagtatacggtccttccaggcagatcctgggtctggccccaggatccagtgtgggtgataacttgtacgatggctgcatagtgggcgaattcttgatgaaatgacattctctggagtttttccagtcaggagatggaacactcagaccttcctcaaaacaaaggggatctcacagcacagcatttataatagttgttttatatatatgaatataataattaaaataaaatataatttccctgactcagggagttacctgcaaaggccctagggaagcagcccatataatgctatttgttttgtgcctgaaagccctgagcttccagatcatagcctgctgtgaatcttccacacagcattgagagagcatgtcatagcccaacagttaagagcagacttgggagccaaatttaggtcaaattttagatctgccacttagtagttgggtgatcttgaggaaattatttaacttctttgtgcttaagttttatcatcttttgaaaaagaatctctacttccttgagttagaggtattaagtgagtgtatatatatatagagagagagagggagagagagagagagagagaggtattaagtgagtttatatatatatatataataagtattatataacatatataatacttcattgagttaggggttaaagtgaggttttatatatatatatatatctcacttaatatatatatacatataaactcatttaatacctctaacttaatgaggtagattatttatctatatctatatctgtatatctggcatttaaacaaattgatttgtttaaaaattattccacaagatatttaaatactacccttattctggttaaaatattcttgtcacacttgttatttaagccatatatgtatatgtgtgcatatgtatatatatggcttaaataacatgtgtgacaaggatatttggcttggacatacacatatatatggcttggacactggtacacaaaaaagttaagtaagtgtttgctgtggtgatgatgatgatgataatgatcacagcttctcatttagtaactgaggtagaccttctttcagtgagaaatcaacatgacaagaataatatcatccgatgggagcagcagagacaagtcaattttctgagccaattcagaatctgctatttggaaatgacataatgagcaactctctctcaggatcctcttgactatcaaccaaaaaggtggcatccttatcatttatcagaaggtataataaaaagtagatttgccttctagcatgttgtcagacataaagcccttaggtttagaaaatgaatggctccattttgtcttggcctttacagcaattggagaggtattataccccaattccaaggttattatctcttcaaactatcagtattgctgttgttctttattaccacgtaaatgagattaatagaagctacatttgaatgctactctgaaagtcaaaagaggaatcactaaataataaaatcttaacagtgcaggtaatgcttaccattaagctggcataaatctgtattcattatttcaacaccaattacagattgtttttctagttaaataacaaatgtgacaaggatattttaaccagaataagggtagtatttaaactatctcatggaataatttttaaacaaatcattttgtttaaatgccagttactaccattgttctaagataatagaaagttctttactgcagcacctcacttagaaaagaaaaagagctgcggcctataaagaatgacataggaacacttttctttctctcaacgtttggaggtggaacctgaggataagaggaggaaaacatgtcaatgcatatttgtaccatgatcctcctgcagctctcactagagaatagtcgtccatatacaaggagagataaataataggtgctgtcacactgcatcattttttaggacaaaggcacaaacctggggatgtctgtcagcagattgattctgttggctcaggctgaagacctgcactggattcttttgctgacctgagccttgtctcccatcctgtatacatggaaatatataagaaggcagtggtgacttctggaagtacatttctcagagatgacaactgaattactccttctactaaggcaaagagcgttcatccatccacaaagcataagttgccttctgtatgttcagatgtgtgcacttttctcagagaatggtgtggtcaggacagcttcagttgcaaatgaaagaatcctaactcaaagattaagtaacaaagggattttaaaaatattcacccaagtgatgttctagtttctgatgtttcaagatccaagagctcaaacaatatgttctcaggacaccaagcactctgtttccatctctagtgctgctcgcctctgcttggcttcactttcaagagaatcctgcctggcagagcaagacccatatgactcacatggaacttaaagctcataattctcaagaaagagtggggtttcttccctataatctacatcagtccttgaaagttgtctgagaggaggggccccatgattgaaaaaaatcacaaaaagtcaggagggctgcttccccaaacaggaaaatgctagcatacataaaagaagcaggtgtttgctgcatcaggaaagatcttgaattaaagataattatattgtcctgacttagaattcctagccaggattaacatgaaggagcaggaatcttattttgtggaaggagaccaggaaatcatctttgctacttcaggaaaaagagaagttgaacaattcttcttgatggccagtcaatttaggaattttatattccatgctatgctgaattaatagatggccagtatagtagaattgaaatgtaactggccaacattattgctccgagctaacccttcctctctttcactctatgttggtatatctggtaggctcctccaagccaccaacagccttcacactcttacaggttgtttccacaatagaataaaatcacgaaataaatgaattcacattaatgtgcttttggcttgttggccctcctgagtcaggatggtggtgggaaaagacaattatcatcctcagaatttcagaatagatgctttagtggtggaatttggtgtttggaagacgcatttttcttccaaatactctgaaatcataaattaccctctttgcttgactgcaaaaccaatcatgttcaggcttctggccccagttgggatttcaggagcatcttggctttccaattagctggtaatgtcttgcaaatatctcaagctcctcttggtaccagataatcttcagacattttagtgtggcatatatttagaggagaggaggagggcttaataggggacttgttctaggatatcctactaaggctgatcaaggataatctaatccaaggcagtcactagggagaaaagtgaggagccactttgctaccaaaaagtacaaagcagaagccatttctctgaaattgtttctgaatgtcagagttcttataatagtatcaatagttaacactcactgtgttcttactatctgccatccactgctctaagtgttttacatataatttgtcatgtgaccaagcctttgcagacaagtaacttacccaaggtcacacccttagtgaatggcagaagccagaatttgaaatcacatactttgtctctaatacttgtgcccttcatctgaacataagttttatgttatactaatttaaaacaaacaaacaaaaacagtaacaaggccgacaaaaagttaatatacctatgccccattaattcattcatatgcaaaacaaatgtttgttcttctgtatgttttataattcttatttttcaatcctcagacacgggaccagatgtgcaggagaaattgccatgcaagcaaataatcacaaatgcggggttggagttgcatacaattccaaagttggaggtaaaacagaggattgtccctatagcttggcattttaatgtgaagcttacatcacccattgtaaatgggggaggggagcttttctttttaacaactggaggaacaaattagttccatgccaaagttgctacaggacttgaatatgatttgccagcgagtcaatagatatggattcctagaaaatggatagttgaatatagcctatacatctttgcaggaaaaaaaaatgtggaaatgttgaatagcatttgaaccaaatctaattttctctatgttctgatttagaatggtttgttattgagtgcttgctaaggaaacagaaggaggaggtaaatttaggcaaagacttttcctgcctctcaattctgtagaagttcttcactttatagagaagaacagcttcaaaatttaaaaaaagtacatacttattatattaaatagccaaattttatcttttatagcaaggatgtaggatttaattgttttcatcagtgtccttatggggaaacacatggtaagttgcattagggcaactgtggacattttaataaagaaacgatttacaagaattagagaaaaccaacaaggggctaagaagtggtaggcagatgttatcacctttagcctcaaggagcaaagggaagaagtcagcagaaaatagagagggaaagctgtggtcacaggagagagccactggataggccttgagtacaacaacagagccacttctaggcaaaggggattcaggggtataggcacctcattctcctcttgattcccaccctcttgctggtgtcttcagttggctgaacccaatgggaagacagagcccattgatgcagtccatgttctaatggagaagagtggaaagtgtatctgcaggggccaagagaaaagaaaaaactgtctctcctctttatgctatcccaacctcaggctttcatgttatgttataagcttcaagtttagtttggttttcaaaaaccataatcacaaaaagaatcaattgtagaacatttcaattacaataaaaccccattaaactctacatgagtataccttgcatttggttatgcatttctttttagaaaccaaataaatatacatcgtgacatgtaatgcatctttcatgaatatagggcactcttagaattttaagtgtcattcctgattcctttgatactaacatcttcaaagtgttctgttaatttttaaaaaaaatgaagggagaagcacaaattatgtaattagctagtaaaagaattcactcttttagtcataatgaacgaaacagctatagtttgtgaaagaatcatctgatcccttcattttgtagagaaagaatcagaagcaagctgctcaaggtaatgaaagcaagtttgtggcagtgtagaactgaaacacaagattccaagcctactgatgttttccattactccatcctttgatggtctggccccaaatgcattttttaccaataatcttcatttattaggcacctattgtatgtcagttactctacaaatattataggcagtgtatcctggtggttaacagatttaggggctagatttgtagggttcaaattctggctccccagtttcaagctatgtggccttgagcaagtcactatcccttcctggcctcaatctctccatttataaagtgaggagaattacggcacccacctcaaatggtggttgtaaggtttagatgagtttatacatgtaaagcctgtggattggtggctgcatatagactatcatgaatgcacatgagctgttattatcatccctattttacagttgaagaaactgaggcacagagggttaactggcttgcccaagattccacagctggtaagagcagaactgggattttttttttttttttttagacagagtctcactctgtcgcccaggctggagtgcagtggcgcgatctcggctcactgcaagctccgcctcccgggttcatgccattctcctgcctcagcctcctgagtagctaggactacaggaacccgccactacgcccggctaattttttttttttttttttttttttttgtatttttagtggagacagggtttcatcatgttagccaggatggtctcgatctcttgacctcgtgatccgcccgcctcggcctcccaaagtgctgggattacaggcgtgagccaccgcacctggccgattttttttctaaatgcattttttttttttttttttgagacagagtcttgctctgttgcccaggctggagtgcagtggttgcaatcttagctcactgcaacctctgcctcccaggttcaagcatttcttgtgcctcagcctcctgagtagctgggattataggtgcgtgccagcatgcctgactaatttttgtatttttagtaaagatggggtttctccatgttggccaggctggtcttgaactcctggcctcaagtgatccacccacctcggcctcccaaagtgttggtattaaaggcatgagccactgcgcctggctctaaatgcatttttgaacaatttcttttttacaaatacaactttcactgatcatatcaatttcatatcattttacctttgctccatagtaaataagtgtgaaaatctaaggctgtgcactttattgtattatgagcctgaagccagaaataaccaggtagctgcctgtaatctgtccagattgtttttgccttcctggctcttgaattcataagtctgatgacgggtgacagcctgttggaaagcacaaagagctaccgcacctacattgtcctgatgaaaaatgattccccttgggggtgaaatccatggcaatgatttcatccttgagattatttagaagaataggaagcatgttccttgaaaatgtttcttagcaaacacatgaaaggatggcctctgggttatttttaatcagggcttagaaacaaaagtgctttccctatttgttagtttcctgttgtgactagatcttttgaagctacatgtttcctgtccagagtccttgtgtggcgtagactgggccacagccatttgtgggacagccatgaggaggtgcatcaccagagggctgcttggagggtctttctgaaagctggtctgtcatttagttggggtgggagggagggcaaacattttgtaattgacaacaatcacggccacttcctctcatccaaggatgctgctccacttcagactcaatgcccagagcttttgctgggaagagagccttgagtgggaccaaaaaaaaaaaaaaaaaaaaaaacatcacagctgcctacacagtgcatggtattgcatagtattatctctaaagtgcgacaaaaaagcttatgggggcagcaacatgttccttccttctgtggtgtcagtagctgggttacagaaattggggacatctatctagtagttacctggtttttgactcttaaaatcctttaaaaatacaaatagtaagagtattgggcttttgtccatgtacatactgacatcaacctttgtgtgtctttgtttattttgtttctcaggcataagaatgctggatggcattgtgacggatgctattgaggccagttcaattggattcaatcctggacacgtggatatttacagtgcaagctggggccctaatgatgatgggaaaactgtggaggggcctggccggctagcccagaaggcttttgaatatggtgtcaaacaggtaagatgctttacacagacccacatgaaatgaaacctgaccatctggatatgaggagaaggaaagaacacttaggttacatggaataacattgttgtggatttcttaacaaagtcctttacaattttaaatgcacttagagggccaaatcattcttcagagggatgggagttaaggcttaagaaagttttccctatttgtggccaggcgcgatggccaagggaggcagatcaattgaggccaggagtggccaatatggagaaaccccacctctactaaaaacacaaaaattagccaggtgtaactaggttgcactgttctgcaacctagtttagacagtgaaactgtggtctcaacttagatgcctatagtcccagctactcgggaggctgaggcacaagaattgcttgaacccagaaggcggaggtagcagtgagctgagattgcagcattgcactccagcctgggtgacagagtgagaccctgcctcaaaactaaatataaataaataaaatgaattttccctatttgggtctgaggttgaatggaaatttattacttttagcatatttattttaaaagtgcttctggacatttctttctccttactcattttcctgctgcttttgggtttttacactagtaaaaaactactcagtcttcttccaagcgcggaaatgcttttcaaatatagaaacgtgttgccttctgctctgcacgtgcctgttgaatacctgtgccttggttggattgctctgtcacttgggtttactgtattcttgcacagattctaaagccttgtgctccataagatgaaacaaaagtagaaactctggagagcacaaattgaaaaatcatagaaagggcggctttgacgagttccattcaattgaagagtcccttttaatgcagctgcaaggcagatctgaataattcctaattttgtcattctatcagtcagccagaagattgaagcagaaagaaagagaggaagttcaaagatttaagtgcagtgacataaactaagagaagggtggaaaaatatgagcaagtgcaaaacgctagattatgaatctgcataagaaagaaaagcgtgtgctcagccctaccccaggagggcccagagactggcagggccagagtccagtggcttataatacacagccttgtgagatttccaatatcgaagccaaaagatctggaattgaaaatagatcccaaatagctgtctctgagaatttcacacatgtagtcgttggggattttattgggatataacaatgaccccaatagatgataacagataatatgcattctggcttttcctttaggggagacaggggaaggggtccatcttcgtctgggcttcgggaaacggggggcgtcagggagataattgtgactgtgatggctacacagacagcatctacaccatctccatcagcagtgcctcccagcaaggcctatccccctggtacgctgagaagtgctcctccacactggccacctcttacagcagcggagattacaccgaccagagaatcgtatgttgcttttgtctaattctctctgcttagttaggagagcgtggcatgcatgtgaaatgattcccctaactgacctttggtacgactgattcgcttaagcttgatgtctcagttgggagaactcacacttactcacttgaaaggctggcatccatcagaaagttttctctccagggataatgacacttctgccaagatgatcttcccctctgtcatttttaaacccagccttgagaagccaccaaacctgtcattacacacagcggagactccaaatgtcttttctgcttgtctgatgcctccctggaaacagccttaaaggagatctcagggttgtaggggctttatcacccttgtacttgctgatcctttaacagcagggatatagtctgacctgccctgtcgcagatgataaaaatacagagtctacaccagctatgtctcctaagaatggatgacctgcaggaaaatagcagtttcagtgtcccctgaggtgaactgctcagcatctgggtaagcagctcggggaggtcgtatgctcagagagctcctccagcccacgcttgcctgcgcctttgcttccatgagtcagacggccaagggcaattactggatttcccttcaagggcatgacgatggaggggcatttaggggctttgagaacaaagggagacacctttaatttaaaaaatgtaaggcccccaatttaactcctgacacagaaaggaccaactagctaaagtatatagatcctatctcagtgaaatagcaggtcatgatctaattagagggtgggtgaaccctataataatgaccttggaatgcgtgcaagattcctattaatggcatctcaacaaaattgtcaacacgaacatcttcttcatacaggatcacttctgcaagctagtttagacagtaaagctgtggtctcaacttagaagtgtgggcctgcttctcacgcgcatctcttcagctactcaagtaatagacagtggcattctaccgaggggttttatggcaggcacattttaaagggtttgaaaggggcatatcagacatctgccccacttgtcttcagagcccctggctgttgtcatttccctgggtgtccagagctgcctttagaaaatggcctgttgggcatttcagaatcaccatttcacagactgttccttatcttgggtaacctgcactgaagcagaagaaagattttctatctttgtaaaactccctccttaagaaagccagccttaggagagacagctggtggattctatttgagacagtctcagtaacataacctttttcttacgcaaaccttttcctcagcatagtcatctctgggggcttgcttgcgtcaacaggtaaaaagggcaaccttgcttccgcagccctctgaggagcagagccatcataacttgagaaattcagcaactccaagcaggaagccaatggaggtgataatagaacaaattatttttttacacctccctcccacacatcgaaatctcgagctagaacttcggtgctggagcctgggtgggtgtcttgttagtaatcccttggcccaaccagcagcgccgtggtccttaaggcagacaggaagtcttttcagtttcttcccttcatctcagcaatctcttcattaccctaaagttagccagggtaattccttacttgcaagaaaattatgtaaaactactttcacagagaacatctcgggtaagtctcgcatatgagtcagaaaatataaatcgcattttacagatggggagccaaatgacttgcccgaggacaaatctattaagtagcagttagagaatttgaacccagaactaagtccagcacactttccattttaaagacccatcgttttcctcaaagtgtaaatgtggacaccaactcacaggtatcaaatctagttcaacagtgagtgcaaactacatattaagcattttttgtgcaagtagttcaaatggctaaggccaggatgtcttcatatccttgggctgaagaggcagccaaatgtcaatctgaaggcaaaagggaattttgtatgagacagaatttctaaatatgccagaccaaacacaatggacccgatgattaatgggccagcatgattcacagtgattttgaaactttgttttttatagacagcatttcgtttgggaatctcagaaaagaaaatattcgtagtgggagtacttcatccccagaaaaggcatcttgctgccagaattatagagaagttgcatatagagggtgaactaaaatatcagcagatggcaaacatccgcctgtggtttagaggagaaagtaggcaatcgaatcagctgagtttcctggtcatagcagatgcagcctttggtacagttaacccccaagacaggcccacactcctcacgtgttctccctgcctttctctccttcctgacgtcatccagacgagcgctgacctgcacaatgactgcacggagacgcacacaggcacctcggcctctgcacctctggctgctggcatcttcgctctggccctggaagcaaagtaaggcccagaaagcttctaatcacctttacaaaggctgattctccttatttttaataacacttttttttctgaatacatggttacaggagaaattttggaatactgcaaataaagataagctctttcctgccacttcgaggtcactaaccatagttaacatctcaatgtagatttaatacacacacatcttacaaaattgggatcttaatatagacgttattttgtaatctgtttttaaaacccattctacaatatattaaacatactttctcctgtctaaatcaatatgctttgacctttaaaactcatgctatccctcaaatcttcttcccactcagctacaacgccttttgtttattctcttccagcaggattttgtttaaatagtttccagtgggcagtattaggaacaagtttaaaaaactcctttctttgaatatgtaagcctagtcctggagctgatataaccacatcaggggacatgagatttaaaggcaggagttttatattttcacagtgttccattgtataaacacaaatttccttaaagtcatctaatcatgcttaaacaccattgtcagtaaatattagttgtcatctctgacaatttcctcaggataaacactcagaattggaatttctgggtcaaagggcaagcatgttttaatgatttttatatatattgacaagatgctgccttgaatgactataccattttatattccctccaggaatatatgtgtgaaagtgccagtttccaaaacccttgtcaaaactacttttattatcttttaaaatatttgctatgttgataggtgaaaatggtatctcattttaatatgcttgtatttaattactaatgaagctcaatatttcatacccttcagctctttgtcttctggggttgcttctttatggccttagttttgttttatggccttggttcacaaaagctagatgctttataagtttgacatttaccttttaatttgtttctatgtaatttttaatgaaatgtagttaatatgtatgtagttatgtttgtcagtctgtttctttaaggcttcttcctttgcttttatgctcagaaaaaatcttcacaaccccaaattagataaacattaattatatgtcttttattatggtttctttaccatatttaaattctaaatccctctggaatttattttagtgtatgatgttaaaaaaagatttaactttttttttctcataattacccaatagtccaatacttaacacagaggaaaaaaattgaactgtctcacactgcacatcacagctttttatgtgtcctcattcctgctttctgatgtgtggtgacagtgaatcttgaaatgtcaagtcaggtgctatggttgcatattagaagaagtgattaaacttgtaaattactattatccttcctaataaggagattatcctagaataaattacatattctctagagagagaacaaagcagtgtccttatgtcatattcagtagactcagttcgtaataacagaaaggaaaaatatcttggcctttgccatgactggaaaagccctgaggttcctgagcctttgtccaggagagtccagtttatctctaggatccctggggcttcctatggagatggggtatattcctgggtatctcggctgtgagatggctacagtggctaagcaaggaagtctagcaaggctcttaccaagagtccacctacttggaggggctggcaagatgtttggtaagggaagaagtaaattcaggtgctcaattagaaatagatattgggccctccagaaaagctatgttcagaatctaagttcacttataataggaagtagatggacaaaagacaaaaatctatgaacacaagctgagactggcatcagcagatccaaattaaccgagaaataattgtccaagcagtgaaaattgcaaggaacacctggcttcaagttctagctctaccactagctatgtggccttcggcaagttaatttacttgtggggttcagtctttccatctataaaatgaaggggtcaaacgagacctttttttacaaacttcttctcttcctaagattctcagagttgagattgaaaatgtcagcctgcataggtaatccaacatgaattgttggggtcagtgatgaggggtctggactggaagaaaatagggtcctatggattataggatcctgtgcaacagacttattatatttaagatttcaaaacacagactactaccccagggagctgttaaaagaaagcaatcttaaaattttatgtctagagcctttcttctctatccaacacctgtcagatgcatgtaaatataactagccgtgcctagcccatccttgtatagtgaccaatatagtagaaatatccatctgctgaacagaagtaatgccaattttatgtaagagctgaaattgtaaaagtgcaatccttggtttctaaaacctcaaggcttctttttctgtatagtggaaaatgatcctatacagaaaataatcctttccttttctttttcttttggagacagtgtctcactccgtcacccaggctggagtgcagtggcaagatctcggctcactgcaacctcaacccctccggttcaagaaattcttatgcctcagcctcctgagtagctgggattacaggcatgtgccaccatgcctggctaatttgatccttcttttttctatgtaggagaaaatgatctaggaatgatctagcctcattaatctcagtctctgatggacagtctctaaagcaggtgtttcatttctgtgaaacactcagatgggttccaaggggtccatgaatctctttgcaactaaatgcagaattgcttataaatgtatgtatggcatatttctggggaatggcttataggtttcaccagattctcagtgttcgtgatttaagagatattaagagtctatgatctcccaggtgcttatcataagaatttaattcccttcattttgactcaattcatcagtaagataagtatgactgatctatcttaacatttatatccttactgccaaggtacatagaggttattaagatttctgttctcaattgaacatttttctgaactctattcaattgtctataccaaagctgaatgccagaatttctagacatgtgaccaagctttatcccaaggcactcaagaatgagaaaatcatttaatcatgtgccatcccacaggaacaactatggagactgaagagcccttgcctaaacttatcaagaataatggcacccaatattgattaggttcttactgtagaccagacacagctggcctctttatatacaatattaattataacgcttacaacattcttatgacatagaaattattaatttcacctataaatgggaaaaaataaggcttagagaggttgagatatataaccaagatcccacaaagaaattcaaactcaagtctctctgactgcaaagtctgtgctatcagcaaccacaccttgcagcctcccacagccctgtgagggagaggcaatgttgaatggcagcctatcatctcctcaaataaaggagggttcggaagattgaggctgataaatgaacatgcatttatgagtttcttataagttttctgtcacaagcagactactcaatatgctgtgttaaatgttatatagccagagtattggggaatgggaggagaaaaggaaaggagaaggaatggtttctggctgaatatgcacaaagaaatactttccttccccaaagcgatgtttctcaagtaccagcatatatagtcatcacctggggagtttatttaacatgcaggttcccaggtcattttgccagcaactattcagaccttgtatctgcctaggagtttctggtattcaacctaggaattccttttttaacaaatctcccaggcactttttaatgctagtaataccttaaccaagttttgagaaacaaatgctataaagagttacttttaccactgtgttttcctacaacctcatccacctgtgtttgtgtagaaacccattagggtagttagtaggtgtatcttggagataaatatactaagagaagaaggaattccttgcataaatgtttgtggcactattattattatgtagtgagtatacctaagaaagctgtagaaaatagcctcagccttctgaggagagatcaaaagaatcagaataatttttaataggtgaggaaaattctgaagtgaaccattgaatcccttcacacctttggaaatattaaacaaacagataagccaaacttctggtcttattaaaacctggagaaagagaaatggactttcaatgctgcatgaaacctttggaaaaaaatcacaacaaaaaagtcttgacttagtgggttgtgaaatgttagaaagtccaagttagaaaaattttaagatctaggctaatttaggtatgattagaggctgaaccagatagctcctaagacttttcactctggaattttgtctccaaattacattacctacatctcttctaattagaagcaatgcttaattcggtgtttaattccatacccttattttctgtaaacatatctttgattagccactcaatgcagtgtttaaaaatttaattatcgtggatgtcattgagcacaaattaacaaaggaaggctgtcaggaatgagttgcactgttgttagcagctccttttcatttatgaaatacaagcacacgaatgaacaataactctgttagaaaaatacaccggggcctgtcatggggtggggtgagtggagagggatagcattaggagatatacctaatgtaaatgacgagttaacgggtgcagcacaccaacatggcacatgtgtacatatgtaacaaaactgcacgttgtgcacatgtaccctagaacttaaagtataataataataaaaaaagaaaaataggtttttctaattgcatgacaatgaagctccttaatattttgcagagactagataaaggaaatttttaaaacaaaataacctgcaactgcatataaaataaatgctctactacagaaacataggacacacatgctatatgtgataatcatgattatcagcaccttgccttaagcctcctcagtacgcttcctccttcctgcctccacacatgcacctgcacatactgatgatccaaacggaaaactggtgtgttgcccattgactgccttgataagaggcttttacctaaaactccttttaaaagactggaaggaagcaagcatttcaataaaatgtcctattctatttacaagtgtaccaggtgatcatgaggcaagcattctgggactcactgaggatccctaaactggtgtccttccaaggcctctctgtcagtcactctccagggtaaagtggtatgtttgtcgggagctcagctcaggtgagctgagctgtcaggtgtggagtagcctattaattcaacaagccaaaaatgaaagcattgagcctttagtcacttactgctatgacataagcaagagtctgaaaccggagaaaacacttactcgccctgttcctggcatactggttgagtggctcagcacagacttgagggtcatctcactgctgagggagccccgaacaaaaggctctggcaattttatggactctgaggtgtgaggcggggagggaccaagagagtacgggagtggagaagcaccaggcactgagtctgagtgaggaaagtgtctagatgtttcccctcctctctccacgaggaggcctgaccaagggacctaggaaggaaagctctcaccagctaggaatgtcaatatggaaagaacatgaggggccagggggcctgcggccttcatggaaactcctctcagaggctgcgagccacaaactgcacactgtgtctgcatggggagggcagcttccccgtgtgtcgtgccaggtaagacctttgaaatcgcctatggtcaggcctgaaaaatcacacacggtttttaactaggagccggactcttcagtgtttaggaatgtccactgcctctttcttgtcacaggggattactgagccagtacatgatgggctctggggagaaggcagcaaagtgagccagactcccctgatgattgttctccaaccgagtgctgagacaggaaccttgaggagtaaaaactgggcatctacttattacataatgcttgattggcttcagggaacaatacaggtctcaaagtcgaggaaaagtttgagaatctgactgatgactaggagcaatatgttttaaaattatatttggggctagttagcacttaggcatgttcagtctctgaaccaaccatatctgctgagcatatataccctgtgcccagcattcttctgggtgctacacatcagagaacaagatggataaagatctcaccacttctcatggttaaattagaaccagggagagagacatcaacaaaacacaatacaaatgagtttcccgcatgttagaagcctataagtgcaatggaaggagaatatgcacatatagcagaataaaagagctcgggaccatgtgggagagtggaaattttaaataggctgatcaaggaaggcctcatcatagtataatagatccaacaatcccttatatctctgatttatctttatagtgttgctaaattaatcttactaagacttatgattttactatttccttactcaaaaattctcactgattcccactgcccaaaagataaagtataagctccctttctggcatgccaggttctcatcgctctggcccaatactcctcactgcctctcccctgccccagcaaaccaggctgtcatctggccacacctgtactgtcccactttggtgcttttgctccagtggccttcttctctatctccacttcttaacactctaccccctgtcaaagtccagctcaaatatttctcccccacaaagttttcctagatctttctattccatggaaattctttctactctaaactcccacaatgcgttaagctatgaatatagcactcaccagatagaattataaaagccttaattctttttactggattgtaaacttcttttttttttttttttttttttttttgagacggagtcccgctctttagcccaggccggattgcagtggcacaatcttggctcactgcaagctccgcctcccaggttcacgccattctcctgcctcagcctcccgagtagctgggactacaggcgcccgccaccgcgcccggctaattttttgtatttttagtagagacggggtttcaccgtgttagccaagatggtctcgatctcctgaccttgtgatccgcccgcctcggcctcccaaagtgctgggattacaggcgtgagccaccgcgcccagcctggattgtaaacttctaaaagacaagaaccacatccttgaatatccccatggtattagcatagtgccttgcaagagtgagctcaaatagctaagagtttcttgacgcttttgatagataaagaaaaaggcaatacatgtttacagcaggtagccagtctgtgtctttaacatctcactcttcctaagaaggaagtcaaggcctcgtctgtgggttcataatgctgaaagtgctaaggcttttaatggacagcatgagactggagggcataaagaaagtgttaccatttaaaatgtttgctcagttaaatggaagcaattagaaattaaggacaaagttttatacttctatattgctgaggactgaattttactcatagtaaaagcttatatgctctggagagaagtcataacttatatgttacagggagaagttttcagctctgtattctgaattctgaatgaaaagatatatgaacagtaatagacactagaataacataactacaatagcaaaaggcacttcataatccctgaatggagatgcttattgttagcacttgcttttgcaaggaaacttcatttttctctgaaagacactttgggtcacttcccctccagcccaaatctcacctggcgagatatgcagcacctggttgtctggacctctgagtatgacccgctggccaataaccctggatggaaaaagaatggagcaggcttgatggtgaatagtcgatttggatttggcttgctaaatgccaaagctctggtggatttagctgaccccaggacctggaggagcgtgcctgagaagaaagagtgtgttgtaaaggacaatgactttgagcccaggtaagtatctcctggaattttaaacacatgtgtgcccatggcataatttcattactatgtttgccattctgcctgatttttttgtatctacccttctgaagtagatggaggtggaattttctagtgttctctgtgggtatccatggggactaactaagagaccaaagctctagaaaccatgttaaccatttgcatgttcctcttgtagtccacctaccacatagcacccagtctaagatgcaccattgttttattgtcaattaaactgtgatcaaccacccatcagttttaagattcattctaaattcaatgtttaactatttttttaaaatgcatcttagggttgatgaaatgcagtacttgccaaccagttttacccaaaatctgcttgcaaaatagccttgcttcatgccacagtgctgtgtgattcatggcttttcttccatgagggattctttatcatacacttacttagactccctctagcacaccacatcttgtcacagaagaaatttctactaggagtgttttgtaatttctatcaaagcaatcaaaataatactgaagacctgctcacacaaaatatccaaggatgggaggcttggggcatgccttcagaaggccttctagataaaatcatttttttcttaagaggggctttttgatgggtctacaataaatctgcctgaatttgactccacagcaaatagcattgtatttaagtattagtgccccttaccattttcttatgcattaaaattcatgtatacataattctgaattaggttctacacatcacagggagtgacaaaaagcttagttgagcatctagtcaagattgatgcatgcagatatgcataaaatgcaaggaagtttggatatactttattcaatgctgattctttaatgtatttagagccctgaaagctaatggagaagttatcattgaaattccaacaagagcttgtgaaggacaagaaaatgctatcaagtccctggagcatgtacaatttgaagcaacaattgaatattcccgaagaggagaccttcatgtcacacttacttctgctgctggtaaattaaaaaagttctaagccatttatatttttaagtgtaagttgaatgattcaaataactgattgcttttgtttattcatagaacaaagtctcctaatagatattttcaggtcttaaaaaacatgcttattttttcctttttcttggtgttagatctccctctgccctgcccatttccactgatcctttgataagcagagaatgaggcccattcaaataatgctaattaatacacttttctgaagtcatgcattttcaaactgtttacttttccattttactgacctatcacttttctcttagatagcaaattagtgaaagttactctgataattaaccaaactcacagatatatccgaaacatacaaggagtccattgaaaactgggaattcagatcgattagaggagattgagaagattaacaaatttatcatagtaacatgaataaggccattttatatgatgtatgaacatttgctttttcctgcgagggcactaattcagataagatagtggatgggaaagagctcgtgaaccataagccataatctaaccaggaggagcagtcccaatactcctttatgttttagcaggactcaactgactaaatttggtttctgtgggtgatatgtgaggaaagatgagctatctctatgatcttcctcctgaatattaattcttagaggtttggaataggctctgttaattttgaagttatgctttctagatgtattggaattaacctgaaatattggtggaatgcttttttaattgatagacctgcagttatttaacccttccacatagaactattatcaattgatctagaaagggctgggacttaaaaatttacaggtaacctgtcttttaatataagagattgttaaattaatatatctttaagaaattaatacattaattaaataattatgattattaatgattgcataataaattaaataataatttttatgtttaaatcattatggagtcaggcacctactaaattttcaagatttcctctcacacttcagaaatgatagtttcattaaaatatttttagatttttgactctctaattcaatttgtaaatgtagttcgccgagttttccttatttaaataaaccttagtcaacattttcattcattcattcattattttttccacaatatttattgaggcaaataatattattcattattatatatgccaggcaatgtgctaagcactatagataaaaacatcatattttttccttgtgagtgtctctatcctggtcttatactaaaagagaaaattaggagaactcatctttttcagcttttattttcagttatcagatgctagagtgtatcctactatcagagctattaggacattcattaacttgtatttgtttcataggaactagcactgtgctcttggctgaaagagaacgggatacatctcctaatggctttaagaattgggacttcatgtctgttcacacatggggagagaaccctataggtacttggactttgagaattacagacatggtaagtgtgaatgagaggatgaaaaaacacaagcttacttttaaacattttgaagcacttttaaggttgatttcatcattaattagggccctaaagaattgtaccccttcttagtagaagtaagggaaaagtagagtgtttcaagccctgaccacttggttacgtagataatattcaaaaagaaagattaggcttcagccatactataagagggggaaaaacacttatataaacaatgtgacagactgtgggacaaatccaggtgttcccatgtctgcatgcagccagccatctaacctattcagccaacaaaatcaatcatattcacaaagatacttaaatgctcagaccaactttggtgtgacattctgccagagtcacatcttaaaggcatgcttatgattattctgcaatagctatttagatgtagcttaatgtttggagagatatcttatttaatatgacttttttaaacagttttagtcatgaaacaaaccgaaagcatttctcatttctttttcattctgtttactaacattctttgacatccttctgtaattttaacacacagtcacaaaaatgcaagtacagagcaaaagttagaaaaaagccaaatatagcttaattatttatttttgcatcatttctccaacattctctgtaggtgagaatataaatgaataatgttttggctctgagttcttctgtgacaaaagtgtaataaatatcagcagtgtagaattatacgcctaaataacttttttttttttttttgagacggagtcttgctctgtcacccaggctggagttgcagtggcacagtctcggctcactgcaacctctgcctcctgggttcaagcgcttctcctgcctcagcctcccgactagctggaattacaggtacccaccaccaagcctggctaatttttgtatttttagtagaaatggggtttcaccatgttggtcaggctggtctcgagctccttacctcaggtgatttacccacctcggcctcccaaagtggtgggattacaggtgtaagccaccacacccggcctagataactttttgaaaataaatcatttaaagttcttggagatgtcaattaaattaatacaaattctatagtcgtttgttacatttttttctctgaggatagctttctcctaaagactgctaaaattgtgatttagaaatggaagttgtaaaatgtccttctctcatagagcaaaaaaagaatgttcttagcatctgggcctgttcttgaatttggcctctattcttcaactcaatttcaccatcaggaaactaagaaaatctatttaccaaggtgggatttatttcatgtcaagtctgcaaaatctgaccttacacttctaaatttttaaagatattttagattttaacacattatttataattgttgagccttgaaaattatgactattcccccaaatatgcaactttttgtaactgaatttatagacctcttatttatttattttttgtcattgaactttatagacctcttttatttagttttttattatactttaagttctggagtacatgtacagagtgtgcaggtttgttacataggtatacacatgccatggtggtttgctgcacccatcaacccatcatctacattagatatttctcctaatgctatccctccccttgccccctactccctgacaggcccattgtgtgatgttcccctccctgtgcccatatgttcccactgttcaactcccacttatgagtgagaacattcagtgtttggttttctgttcctgtgttggtttgctgagaatgatggtttccagctttatccatgtccctgcagaggacatgaactcactcttttttatggctgcatagtattccacagtgcatatgtgccacacaatttttaagggcttattaatgctagaggttgtttataatactccatagaggctgacttttttcccagtggaatgtttctataagttgataattgggaaatatatttatagaaggtacagtcagctttccaagaacacatccaatatggaaaagaagacttacatagagatttctgatttttaaattaaatgtttgattatgaagcaatcagtttctaaactgttgaacctacaaattgtcaatttttatagcaagagtggatccaatggtttctttcacatgaaatgcacagaatcttaaaatgagattttaacaatgaaatcctttttagctattttgaatgagtttgttttatattatctaaaacacatactaaatgtaggtatgcttatttgttagtctggaagaattcaaaatgaaggaagaattgtgaactggaagctgattttgcacgggacctcttctcagccagagcatatgaagcagcctcgtgtgtacacgtcctacaacactgttcagaatgacagaagaggggtggagaagatggtggatccaggggaggtctgtgtggctctgttcttggcatgctctcttttgaactggggtagacaatgtagtcagtgaagctgtacccaacttccaagcaggaaataagtcaaacatggatggggaggataagaagtgatagtggtaaactattcttttccataggataaaactgtatttttttcattcaatattttatccagaacttagaaatcacaattaatgaattcaaaagtattaaatttcctaacatgaattttctccacttatgacagataacaaatggaaaaaaaagttatctttatgcccaatcacatatatctaacatttgtactgtactttgtttttaagcattttccacattgtctcattaacctataatccctataacctaggaaggatagacattcgtgtatccattttgcagaaagaaaaacaaggctcaaatggccaaatcatgtaggcttctttttattaattcattaactgacacttcttggcaacaccaaggggagcgatagatcacactttttctcaaaaaatttcagaggatagctaaaataagtcgttcacattcctgggtttcagcctgctatggctcctggcttccttctatcagatggtgagaaaagcccacattttctttatctctgtatcccagcatctagcacagtgcctcaggtgtaataggtaggttttcagaattttcagaacgccctgctctgaataggtccagctctgagctgggtgttttggaagatacagaggcaaagtacatattcaagaaacttacacatgaactgtgaaggcctcagcttgaattctagttccatttatattcttcaaagcagcttccctccaggacctgagtcctgagtacttttcttcacagtctgggaagcaggttaaccttgtcagtgttggaatattgaaacacttccacagcagttggccaaggttggcttctctgagctctccagctccctcctccccagcctagcacctcagtctctcccctgaccacttcttacagctcagtggctaaaagggtagttctgaaagccagtgcctccaggaaggcacacccatgctaccgcaaccagtgggtgccttctatatgacttgttagatattttgatatcctctgcttcccaaaatggattccatgacagcaggctgacaagtaaagaaaaccaccatgtactgagtacttacctatacagtctcatctagtcttcaaaaccaccacaaatggaggtactcttattccacctgacaggtgaagttgagggagattaaaaaggttgttaaaggtaccccagagggtaggcaaatgagggttgaagcccaagtccatgtggctcccagtcttgaactctctcccctcccctcattgcctctcaagcggcaggcagcgttcctgtggtagggttgcaactagcttgcctggccataaataatgaaccttcttccctttgtggatggcattctatgttttaggagcagcccacacaagagaaccctaaggagaacaccctggtgtccaaaagccccagcagcagcagcgtagggggccggagggatgagttggaggagggagccccttcccaggccatgctgcgactcctgcaaagtgctttcagtaaaaactcaccgccaaagcaatcaccaaagaagtccccaagtgcaaagctcaacatcccttatgaaaacttctacgaagccctggaaaagctgaacaaaccttcccagcttaaagactctgaagacagtctgtataatgactatgttgatgttttttataacactaaaccttacaagcacagagacgaccggctgcttcaagctctggtggacattctgaatgaggaaaattaaaataagtgtgtggtcccaagttggaaatattcatgcttcttccttaccctgcgattttgcctgtgtctgaagtggttgttttgtcatgaattcttatgcttataatatcctttgtggcaccttttctttttctccctaaactgtacatgtgaaggggatgagctcaagcaggaagttcaacttccagaattgatcataggtatttcaaaacacatctttcctgtctgcacaagtgaagtgttttgttctttctggagtcacagttgacaaaaagctcttacactacattagaacactgcattagagcccatttcaattctcaaaagaaaaggcaaaacctgggatatcaattaatttgaaaacataatctgcaaagaatgagaaggagtcagaaactgtttctgtagcttgttccctgtcttgtccatgtggttcttcaaattttgatgccaagaaagtatttggtaggcctaatgaaggagttcactgtaagactcattccctagatctttctattccaaagtgccactcattcctgtagtcaaaatctggtcatgttggtcaaaagctggattatttagatctagaaacagatcttgaaatctgaatgctctggtttgagcaattttcgaacattctttgcctggtgcactgtgtctgtggtgccagaggcgtccgtggatccagaggtggttatgactcgtgctgcatgcctggtctttcctctgtttctccttctgaaagttttctatacctgtctcctttctcagccacaaaataaatgttgggagaaatgatatataccactttcccagaaaaaaaaaaacttacacttgggacttggcaaattcctagtcacaatttttttcagcagtaacaggaaaccacttatcacatggagacctaatgtaataatagaaaaatactcataatagggagaaaccaagagaagttttgtttttgtttttttccaactgtgttcattagaacagcgtgttctaagtatttgaaactgaatgtttattccttgatactaaaagttcttctccaatcctatcactgatagtgtccaaattctcaccaaattgctcctaagcttcaaatcagaagcagaaactggcaggccatggaccttaattgtccctcaggtagattttgtttggtatgcagaatgtttttaaaatatgagtggttattgaaaatatgatgtttcacataaaacctcattctcggacccatctttgctcatggcaacagttagctggagctgagtagcagctgcctgattagatgactctcagtccccatggcaccctgctccatgttacctagagcaggcacttgattccttgctgggcagtatccaataggcatttgattttgcccactcctacactaagcgaatgtgtacaaagtgtaaatgcattaggaaaaacaaactacccgcatcttctgttaggcaggatctgtacaataataattatgagtttgcttatgtaatctcacctcacctggatgatcactaatactaattcatttattactaaccttctggcttccttctctcaatatgcttacaaagtctccagtcacctacaatgctggctttctcccactgagtttgctgtttgcaatttttccatgaagtttgaacttcataaggtaattcatggcattgaactggttcatgaaaagaacactagagtctgtcatttgctttggcttgaagtatggttggtaacacaaattttcacctgctcttctaccatttgaatttgtgtagagggtgtttgcagagcaatgcccgtaatgcttagagaatgttctcctaaaagacttgcggaatcactctgtccttggaagtttcatatattgtttgatatgaagtgttagatagaatttccaatattggagcatatcaaaaagtattaaaactaaaaaggaccagagaattcttagattggcccggaaaggccaataaagagttagaatgaaaactcattacttttccattcccaatctagtgctagatgtataaatctttcttttgattcttcctaacaaaatattttctgggttaaaaccccagccaactcattgggttgtagccaaaggttcactctcaagaagctttaatatttaaataaaatcatattgaatgtttccaacctggagtataatattcagatataaaacagttttgtcagtctttcttagtgcctgtgtggatttttgtgaaaatgtcaaagagaaaacttatatactatttcccttgaaattttaaactatattttctttacaggtatttataatataccaatgcttttatcaaacagaattttaaagagcataataaattatattaaagaaccaaaagttttcctgagaataagaaagtttcacccaataaaatatttttgaaaggcatgttcctctgtcaatgaaaaaaagtacatgtatgtgttgtgatattaaaagtgacatttgtctaatagcctaatacaacatgtagctgagtttaacatgtgtggtcttggtattcttaagggaacttccacattatacatttgatgtattgaccagaat

SEQ ID NO: 26 - DNA, 55393 bp, Homo sapiens
acggctgcgcagatgccgactttagaggaggcggagtttcggccttcgcctgctggaaaagcagtaggatcggccagtggcgacagcaggagctgagcctaagccctggcggggctttgggctgtaggtgagaactatagggttttggaattctcgaggatcattgccgctgtagcagtgaccgtgagttttggtgggggaggggcggtgggggtgggtcttccagcggtgagtgatcggcatgtttctcggccaataggagaaggagcttccagaatgggttctgagattggtcctttccaatcttcaaggccaatggacctcgggagaggggggcgggtcatctgggccttattttcttcttcctgcggccgagcttcactcgccaaggcggcggggccgggaggggccgaacctgtgcgcggtgaggttcggggacggtggggagcagggtgcgctgcctttggagtgatgctcgcgggagcggctgcgagggaagggtgcgggagtccgagggggttgttagcaacagctagctttattgagtgggtaagtaccgggcctagtgcttagtgcttcgcttgcatcatctgagctaatcacagcgaccctgcagggcagggggttgggatccccattttacaggtggagaaactgagactcaagtcagctcacacagccaaggtcacatagctaataaacggcagagaccggatctgtattcagagttttgacttcggagccggtgttcttgaatctctaggctttgttactgattgggagggaaggtgtcatgaaacgggagctttccccagggaacagatttgggggaagggaatcctagggttgaagaagggatgaacaattgaggtgagggtgaggaaatcagtttttcaacagttaccgattgcctactctgtgccatgcattgttctaggcatacaaagatgaataggggcagaggctgatgaagcccattagggcccctttgaaggcccggggaagggccccaacattgtattcacatgattgtatgtttttataaaatgtgcaaaagtaagatattttggattcatttttctttttaagagggtcttcaaaattaaataaacttcgggtttctccacacttggagctgcccttgcagaggacttagtccaggtggagatgagtatgtaagcagtatagagcagtggaaggtgcacttaagagtgggctgtgggcaaatttcctggtatgtaaaacagggagaacagtatacctgccatgcaaagtttctgccaggttcatgaaaagcgcctgtttagaaacacgccttatttttgataggaagcctaggagatacgggtaactggatttgccttctctcctaccttacacagttgtgctccgtgttctgctcccaggcctgtaactagatttctggtggattggaggcgcttttctcctttctgagctctccaactctcaaagagagtcttggagctgaaccgccatacctttgggccccagatagggggtacggaactgctggaccctcagtgaggagggtgggtaaaggaaaggacatactggtgttccttctagaatggcctattttcattgatatgctttgtcttttttcagttgaggtggtctattgcgttaccgagctgtggggatgcacccacttagctgaagttctcatctaaaaacaaagtatttattttgctttctccaatcagttatgaagttttccgtgtattgccagtttaaattttgtcctttgagttctgggtacagtgcaactgaacttgtctgtagcttgatttcattaagtactgctgaaactgcatcttagtttcaacagaacagtttcactttagggttttaaaattatgttactaatatcaaagggcttttaaatcatgttactaatatcaaagtacttttgaacccttaagttttgttatcttgtagccacgtaacttttattaggtatctggtttagctgtgccctagggaggagccttggcctcccaaagtgctgggattacaaggcgtaagccaccgcacccagccatgggtggctttcaagttgtagtgtattctgtttaatactctgaaaagtgattagcaaggtgttaataagggagtagcttgaaaggataagggtaaaatatgggcattttagctgtactattaggaccaacaactaaataattagtttcctttttttagctgaaacaattttcttttttttttctttcaagaacaatcctattgcagtaacaatgtctctgttgaaataaggtttgaatccatgcagttttgatacatcaggttctttttaaacagaaccttttcgatctgtatttctagtttatttaaataactttttgttgtttatttaaaaaaaattttttttgagacagggtctcactatgttgcccaggctggtctcaaactccttaactcaagcgatctgcccacctcagtctcccaaagtgctgggattacaggcttgagccaccacacccccaccctaaattacttttctttctttctttctttctttttttttttttttttttgagacggagtttcgctcttgttgcccagtctggagtgcgatggcgcaatcttggctcactgcaacctttagcctcccgggttcaagtgattctcctgcctcagcctcccgagtagctaggattgcaggtgcccgccaccatgcccagctaattttttgtatttttagtagagacagggtttcactgtgttggccaggctggtctcaaacttatgacctcaggcgatgcacccgctttggcctcccaaagtgctgggattacaggcgtgagccaccgtgcccggcccctaaataacttttctagaggtagattccaggtgtgaagtcttaactgtgtcttttgaatttctatattatcttttactgttttcagagttgatgtttccagcacttaattttaatttttatattattttatactcttaatgtgtttcttcagattcctgtctgactaaagggacctcaaaaaggagggaaaatggcttctgagtctgaaactctgaatcccagtgctaggataatgaccttttatccaactatggaagagttccgaaacttcagtagatacattgcctacattgaatcccaaggagctcatcgggcagggctagccaaggtaaggagctgggattgttcaaatggttttgttacctagggcagagcagtaagatttttttcctacatttgggccggaactgtgttttactgaaagttgggtggggtgatgactttagtgaatgcggttctatttgcaagttaattcccgttgttaacatcagaagcatctctgcttttaggtaggaagagagctacttggaatcttcagaaagggggaggtaaagagctagtgtctccaggcctggctgctgttgtgcctcagccctcttggtggagctgggtgctgtggtgttattgaactgccagtgagtgcttatgccatctgacttctcttgctctcatttcagtctcatccagcactctagtagcaatttggcttcccatgtggactttcttcaaggggagagaatgcactggccagccaacatgagtattctggtccttgtaatttgaaattggtttctggtttgtacttctttctcctgtgagttggattcgttatttttcctgagtcaaatcagcttttcatatattctgtcacaatcaggttgagtgctggaagctgaaagaactgcatttctggagagatcctcaggaaactgagaggcagggacctcagtctaagccaggaggaaattttttacaccattttatgttgtttgaattccctaccatatgtgcttgttacattttcaatatgaaaagagaaagcaagaacattggctacaaagctgaggaccagtcttggaccctggtgcctccagagacttgagacgaccacatcctctttcttatctgcagatacggctactgctgggttaataacagcaggcgggaatagcagggcctgcagtgcagtttttcatagcacattgctttttttggttgtactttattagatttaaagttaccaaaaaaatgtcggttattacaagttaaatatttcaaacgcagataaagaaaaggctgatcttcatccaccttctccagtgccgtctccttaagtggtattagctccctccacacctttttctctgctcatacaaacatacacacatataaaatagtgttatttgttttgtttttaaaagagaatggcatcatgccatatacattcctgtgttggttcgttcattcttttttctttttttttttcttttttcctttttaacaacatatattcctccctctaggtcaattatggattcaactcattcttcttttttctcatgtcgactgtcttgttaatttattactattggaatgggtaatttgattatgtgagtaaaaacagaatgctattggaaggtagctaatgtagagtcttgctccctttccgtattttcttatatgtcctttcagtgttgccttatgcagatgcttgtgagtgtgtgtgtgtgtgtgtgtgtgtgtgtgtgtgtgtgttgttttctcccttgttacataaagtaaaacaatactctctaattaaaaaaaaaaaagctgtatagtattccataaagcagatctatcttacttaactattcaagattagattttttttgtttttttttgagatggagtttcgctcttgttaccccagctggagtgcaatggcgcaatcttggctcactgcaacctctgcctccgggttcaagcgattctcctgcatcagccccccaaatagccgggattatagttgagtgccaccacaccaggctaatttttgtgtttttagtagagatggggtttcaccatgttggccaagctgatctcaaactctgacctcaggtgatccacctgcctcggcctcccaaagtgctgggattaccggcatgagccactgtgcccggcctcaagattagatttttaagaatgttatgcttctttgtaattaaactgtaatctagtgtgtgaaaaaaggaaattctgtacaagtatagagttgaccaaatcaagtaaagttgtgtttgtgatttttttaaagagagccctgggctaggagattgagagagaatcaagtctttaatctcctttcttggtgtccaaataagatactgaagctgggaacaagtattacttaccttaggttgctgcaattaggcagctggttggtggcaaaagtggatcagggttagcatgcctgtgacttactgtgttttggtgaatgtgggtaaatcaaagtaactgtctagtaaaattgactgttaggttggctggtaactacatgcttcctggactctgactggcttgccaggtttctcatctgtctttttgtttcttgtgttcccttcaggttgttcctccaaaagagtggaagccacgagcatcctatgatgacattgatgatttggtcattcctgcccccattcaacagctggtgacggggcagtctggcctctttactcagtacaacatacagaagaaagccatgactgttcgagagttccgcaagatagccaatagcgataagtgagtggaaaccctttcttacctgacatagcacctaggaccctggtgtctcatcctcctagcatctccaggactgctgctgtcctgatgaacagtgtcttcagcaggatggctctgttctagctgtctccctttctgctttttttatggaagcattccctcctctcaggactgtgtcccagtctaaacctgttcctgttcttataacaacaaatcccattgtttttccatcagaagtagaatcattttctgactctaaagttgcaaggagaaagttggatgtggtgcacaaggagcttttgctgggtattatcaaccacctgctcatcaaaagtgctttagttccacttcctctctctcgggatgctctgtgtttaattgtgctggaatttctcactgcccatccagcctgctagctcatttctgttttgacattaacagtgtgagtaaaccaccaagctggttgctattttctgtcactccttctttctctgtacattcctgtctcttttagagatatctttctttgtgtaggcctgttttcagttcttctctgctgttggttttttttttttttttttttttttttgagatggtgtctcactttattgcccaggctggagtgcagtggagtgatcttggctcactgcaacctctgtctcccaggttcacgtgattctcctgcctcagcctcccaagtagctgggactacaggcacgcgccaccatgcttggctattttttgtattttcagtagagacagggtttcgccacattggccaggctggtcttgaactcctgacctcaagtgatcctcctgccttggcctcccaaagtgctgggattacaggcaagagccaccactcctggcccttctccgctgtttttaatgtttagttctcatttttcctgagattcacagagaataaattttgtgtttccttgttcagctctgactactccatctttttttttttttgaggtggagtctcgctcgttccccaggctggagtgcaatggtgcagtctcggctcactgcaacctccacctcccgggttcaagcaattctcctgtctcagcctcccgagtagctgggattacatacaggcgcctgccaccacgcctggctaatttttgtatttttagtagagacggggtttcaccgtctctactgtcacccaagttggagtgtagtggtgcaatcatggcttactgcagcctcgactgcccaggctcaaaatgatcctccttgctcagcctcccaagtaactggaggtatagataggcatgtgctaccgcgctcagctaatattttttattatttgctgcccagtttggtcttgaactcctgggctcaagcgatcctcctgcctcagcctcccaaagtgctgggattataggcatgagccactgcatccggctgacaccttaactccttttatttatttttttttttgagacagaatctcgctctgtcgccaggctagagtgcagtggcgtgatctcggctcactgcagcctccgcctcctgggttcaagcaattctcctgcctcagtctcctgagcagctgggattacaggcgcccaccaccacacctagctaatttttgtatttttagcagaggcagggtttcaccatgttggccaggatggtctcgatctcttgacctcgtgatccacccgccttggcctcccaaagggctgggattacaggtgtgagccaccgtgcccggccaaccttaactcttaaaacatctaccttgctggccaacctgctgaccgatgagagaatttacataaaggcatgttgaagaaatgtggggctctgcaggtgaaaggctgtatccttcctgccatccttattgtctgatttttgctacacatgaggagcaaactcacctgccttctgtttctcacatggaattcagccaggggcttcagtctcctcagccttttttccctttttgttaaggctttttcttttcttttttttttttttttttgagatggagtgtcgctctgtcacccaggctggagtgcagtggcacaatcttggctcattgcagcctccgcctcccaggttcaagtgattttccttcctcggcctcccgagtagctgggagcccgccaccacgcccggccaatttttttgtatttttagtagagatggggtttcaccatattggccaggctggtctcgctttttcttcttttagcacacttgttttccttttaaattaaccagccctatgtctattcctttcgtcctaatacatagcagattacctttaaagtaaaaacataactttttttttttttttttgagacagagtctcgctgtgttgcccaggctggagtgcagtggcacaatctcactcactgcaatctctgcctcccaggtttaagcgattctcctacctcagcctcccatgtagctgggattacaggtgcccaccaccacgcctggctaatttttttgtatttttagtagagacggggtttcaccatgttggtcaggctggtctcgaactgttggcctcaagtgatcagcctgccttggcctcccaaatgctgggattacaggcatgagccaccgtgcccaacctaaaaacctaaattcatgaaacagattagttgacaataggggagttaattgtatttcagagagaatgttaggtctctaaaatttattattccctaggttgacattaaagtgtaaggcagttacttagtcagatttttttttttttttttttgagatggagtcttactctgtggcgcgggctagagtgcagtggtgctatttaggctcactgcaatctccgcctcctgggttcaagcaattctcctgcctcagcttcccaagtagctgggactataggcgcccgccacaccacccggctaattttttgtatttgttgtagatacagggtttcaccatgttagacaggatggtcttgatctcctgaccttgtgatccgcctgcctgggcctcccaagtgctgggattacaggcgtgagccattgctgctggccagctctgctaatttttaaagtttttgtagaaataggattttgccatgttgctggtctcaaactcttgggctcaagtgatcctcctgcctcagcctcccaaagtgttgggattacaggcatgagccactgtacttggctagtttgaatctaaaagaagtttttttttttttaattaaattttcagtattaagctaaagagtatagatatttttagactgggtgcattggctaacttctataatcccatcactttgggaggccgaggttggaggatcactggaggccaggaatttgagaccaacctgggcaacattgcaggacttcatttctacaaaaaataaaaacaccagatgtggtggtgtacacttgcagtcctggctactcgggaggttagggcaggaggattgcttgagcccaggagttcgaggctacagtaagctatgatcacaccactgtgctccaggctgggcagcagagcaaggatcttgtatagttttttttaaggtatagttttcttttctttttttgagacagagttttactctatggccgaggctggagtgcagtggcgttagttagctcagctcactgcagactcctcctcctgggtttaagtaattctcctgcctcagcccccaccctaaatagctgggattacaggcgtgtgccaccacgcccctctaatttttgtatttttagtagagaccaggtttcaccatgttggccaggctggtcttgaactcctgacctcaggtgatccgcccccgccaggcctcccaaagtgctgggataacaggtgtgagccacacccctggccaaagtgtagatatttttatggctttatgtagataggtagatataaatatgcgtatatgtgagtacgtattttcctaattggaatattggatgtgcaaaaatctatatttttagagctattttatatttttactaaaatatttgttgtttttaggagtgattacttggtgagtgtcagccactgcgtagggcgcttgggcatatagcaggggtacttacaaatgagccctcttggagcagcttccttttggctggttcagggaggtgaatgctgttggaaagccttagctcttcacatgctgctgggttttggttgtctgtggatatgtagggaccttgggtcttggtctgtaagcccattttctccctgggtggccacctgaatctagcaaggtgtagtttaagtagagtctcttcagagagttgaggatgttgtgcttgttaaggaagaccggtttacatctgtgtgtacattaccttcctcaggcttcctcaggcccagtgctcatggaagggacgttgagggactgactacgtattagagccttgaaggccaagattatgccttgttcatttgaaattcttgctgtcactggaataggggattatgtcttgtaatgttcataatgcctaataaacccctgtaagtggtttacatgtttctttttactttcaaaaaggtactgtaccccacgctatagtgagtttgaagagctcgagcggaaatactggaaaaatcttacattcaatcctccaatctatggtgcagatgtgaatggtaccctctatgaaaaggtgaggctcactggaaaccctctgtgcagtgtttttgtaattttgtaatacctttttttcggcccggcacgtagtaggcacctaaaagctgtttggtgaatgggtggatgaacagatgatctacccccagctgatgttgctgtgctggcctaattgtgggccattttgcatgtgactgaattttatttctcctgctttacatgtgaattggatgatgtggtgttcttttcaagggttgttagcatagtcggtgggtggtagctgatgagttcttgaaagggtgggttggctctcagataatgaaatgaggcagtgtggtttctgcagaaaaaagatgactgactaatctaatgaaaggggtatacatttaagaagagaaatacatttagatttttcagaaccctcaaacaagattctgtggcaaaagctattttaaccacttttattggcttgaaatcctgccttaaatatggtgaaaggggagaatatttgggaatatcttcagatgactgaaaaacagtagggcattcagggattatcactcataattgttttcatattttaattttttttttttttgagacggagtttcgcttttgttgcccgggctggagtgcaatggcgcgatctcagcttaccgcaacctccgcctcccgggttcaagtgattctcctgcctcagccacctgagtagctgggattataggcatgcgccaccatgcccggctaattttgtattttttagtagagacggggtttctccatgttgctcaggctggttttaaactcccgacctcaggtgatccacctgcctcagcctcccaaagtgctagaattacaggtgtgagccactgcgcttggcccatattttaatgtttttatcaattattggaagagttaaaaaaatgaattccaggccgggtgtggtggctcacatctgtaatcccagcactttgggaggctgaggtggatggatcaggaggtcaggagattgagaccactctggctgacatggtgaaaccccgtctctactaaaaataaaaaaaaagtagcctgcagtagcgggcgcctgtagtcccagctactctggaggctgaggcaggagaatggtgtgaacccggcgggaggcagagcttgcagtgagccgagattgcaccactgcactccagcctgggtgacagagcaagactctgtctcaaaaaaaaaaaaaaaaaaaaaaaaaaaaaaaagaattccagttttgttgatagcagtttttgggggtcagggaaagtcagtcttgtagggatgaatggcaggaagatgctgtaaggatctgggatggagagctacaaaagtcaggcataataataatacaggacctagttatgggagatgggctcccagctggccattacaactcgggaaaaggatattccacattttttatgaagacactgcctggtggaaatcagggctaaaaagccacaacattgccatagttttttgttcttttgtttttgagacagagtctcgccctgccacccaggctagaggttagtggtatgatcatagattactgtaacctcaaacaccggggtcaagggatcctcctgcttcaccctcccaagtagctgagactgcaggcacatgccacttcacctggctactttttttaatttgtaatttttttgtagagactgggccttgctttgttgcccaggatggtcttgaactcctgggctcaagcaatcctgccttggcctcccaaagtgttgagattacaggcgtgagccaccacacctggcccactgtcatagttcccatgttttgcgatttttttttttgtggtcatagagttttttttctattttgacctaaatttctttagcatcagttcaaacttttcctcttggggtttcaaacaggtgactcttggtcgggcgcggtggctcaggcctgtaatcccagcactttgggaggccaaggcgggtggatcacaaggtcaggagttgaagaccagcctggccaagatggtgaaaccccggctctactaaaaatagaaaaattagttgggcatggtggtgggtgcctgtaatcccaggtgcgcgggaggctgaagcagggaattgcttgagcccgggaggcggaggttgcagtgagccaagatcatgccactgcactccagcctgagcaacagagcgagactccgtctcaaaaacaaacgaaaaaacaaacaggtgactgtcatctctttattcatctttcctacactagtattcacaaagtaatatttgccctttgaaggtaaatggtgtcagttccagtggtagccgtgaaagtcaatgaggaatgctatggtcttcacgtccatagtgttttgacattattcccaatgtttgtcagagatgacagcttacttgtgacctactctgatttgtaggttcagagcctcggtttctatgcaaatgtaacttgccctggactgtcattgcctttgcagcatgttgatgagtggaatattggccggctgagaacaatcctggacttggtggaaaaggagagtgggatcaccattgagggtgtgaacaccccatacctgtactttggcatgtggaagacatcctttgcttggcacactgaagacatggacctctacagcatcaactacctgcactttggagaaccaaagtcctggtacagtctgcctgcagtcggcaccgggcttctatgctagagcacgggctcatgttcattgtgcgtgggaagcacctcaggattgtgttaaagggcagaccctggttcaggcttggggtgacattccatgttttaaacacactttcaagtgctaagatgcttgctgttggagctctggtgctcggaccaccttttgagtagggaggctttagagagcagggtgctggcagttacccaaagacacgggggctcttccaggctatcccactgctttctaattttttttctgaacaggcctgaggcatttcttagcagcagacttccaagactagagtcactctctcagatgacagaaagctttcttttcgtcatggaaaaaatactaatacttggggagcagcagtgtgtgcttaacacataagggattgcgaggctattcagcatgcttcctgttctccagagtgttattcttgttggtgagacaaacattggttctctctcctctctctgtgctgacccatctttgagtctcagcatttttttttttctattttgagacagggtctcactctgtcacccaggctggagtgcagtggcaccattatggctcactgcagccttgacctcctgggctcaagtgatccttctacttcagcctcccaggtagctgggtttacaggcgtgcaccactatgcccagctaatttttttccttctttttttttagggtagagatggggtctcactatgttgcacaggctggtctcaaactcctgggctcaagcagtcctcctacttcagccttgcaaagtgctaggattacaggcatgagccactgtacccggcccatctcagcattttagtgaaggtgctgcagataacagcagtgaataagatggatgagatacctaccctcacacagataggagactggtcaggaggtagaaagtgtgagagaatgctcatacggtgtggggacagctctgaaggggaagaagtgggtgctaaggtccacataagaaggatagatgggattaaagaaggcttctttcaaagaggtgacaagtgagacctaaaacatgagaaggacataaccgggtggagtggtggtgggcttagcagctgggagattgagggaagtgtatccaggcagttggaaccacagacgcagagctcctggattaagacagcacatgagggccaggcgtggtggctcacacctgtaatcccagcactttgggaagccgaggtgggtggatcacctgaagtcaggagttggagaccagcctggccaacatggtgaaacccgtctctactaaaaacacaaaattagccaggcgtggtgtgtttagggagctagggggagtctgctgtagtttgggtgctgtgtaaaacgatgagaagtgagtgatgaggccggaggggacatcatggggcacattatggggagtcatgaaaaccatatccactttcaggtcttttttcagcatcttcagccatgttctttctcaggggttttcctttcttctttcaagtgctctccagtttctaatcttgggggaaagaaccttttgagcctatgattatctcctaactactgtcctgtttttccttcctcagaaggctagacttgtaggatgtgtaaatgtagcttttgtgtcttcaccattgtttactccaaaattcactgctcctggatttttgaattctcttataaaagaaggttttccagttattatatacattcttaggtcctctgaagtgggacctccagagccttctgtatagggttgcctgatggatcccagagtcctttaggtgacatttttgtcaactcttcttctctgttttgttttataatgaagctgtttgcagtgggaggatttgttgttactgtggaataatcttcagaagagattaaaaaggttaaaacagagttactgtgagtttcagaatataaagtttaacaattttgcaaaagtttaatagtcctaggtgttcttttttacttttcattttttaggaagagcagtttctatggtgtttagacaccctactgggtagagaggtaattgattgttgggtaatcagtatatgtagctgttggggagataaagggaaagtgggttcatcagcagatacggggctaggtctcttaagtgtcagatccatctttcactttgttttccatcttcctcttgcctgcccccagttaggcctttcaagcatttaaaaatactgagcatttttaaatactgaggttatatagtgacatccttctttttttttcttttaaaaaatgttattatatgaacaacattataaaggagagtaatattatgtaccgtaaatcctggctcatggtgaacacttaataaacatcttattaagtgaatgaatatagaagaaataaattcactcaccttctttatgggctccttactcctgtgcccaaacagtctaatatttcattttttcagattcctttctactgcttgggaagttaaaaaaaaaatctgctatttcaaggtgttttgagagtgggaataagtcccttagcttctgtacctgccctccacccagcctctgatgctctcatgtgattgcaggtactctgttccacctgagcatggaaagcggttggaacgcctcgccaaaggtactgtgtctcttctgtttgctggattggaccctcctatgagctgtgctccttgctctgcactaaaatgtgcgttccccatggtcagatacttgcaggtcctgttgcaggcctgcagacgggggtgagccacactggttaccttaagagggcagtgacggagccttttcttcctttgtcctgactgtctgtgcctcagttttaatgagcaggggtgtttctttgaccagcgataatgaaccagacccagtatgactggtgtttccactaaagacccaaatgttaaagaaaaaattgaactttatgctttgtttcttttaagtggacttagatttgtatgtctggagaacataggaaagcctgggtagatgatactacagctgcattactgaaaaaagatcagggatacaagtgactggagaaaaggtcctaaatagtttcaaagctctataagaacagaggcagcttgggtgaccttggtttcccaaacaggatttcattacccacgtaatgccctacatgggagtgagcctagaggctcattgcagaatcttagaattggtgcggagctataaggatcctcagaggtcacattggtgatgcatcctctttatcattccgatgagaagcacaggtgtgaagtgactccaggattgcggagctagtgtggagcactgtgttaacctgtaccctttcaattaaataggctttttcccaggaagtgctcaaagctgtgaggcatttctccgccacaagatgaccctgatttccccgttaatgctgaagaaatatggaattccctttgacaaggtgagctgatgttacatgccaaagttctcaggcaccaccctttctggcctttgttttacagttttattctagttcatcactataccaagagggggccaaagcttaaataaactatgtaacaacactttgatctaagagcattaaaggtggggccactgtagcttcctggtgccagaggagagtcagatcccctagaacagtgttcatttggaggaatggttaattatagtcatgtcatctgatatgtctgggctttgcattttatagaagacagcaaggaccccaggggttttatgacttaccctttgttactcagctaagttgtggtggagctcagaattccagttctgtggacttctgccatttgaagcagctgcttcaagtctgctcttgttcaggtgactcaagaggctggagagtttatgatcactttcccttatggttaccatgccggctttaaccatggttttaactgtgcggagtctaccaattttgctacccgtcggtggattgagtacggcaagcaagctgtgctggtaagtctgcttgatttctttctataacaccatgacaaaaatgagcaaattctggttagatacgttggctggtgattagagtatttctttgagctgctggaattcagaaacaagcagctagcaatgtgtcagagtactaacattttgtgttcataaggaatttttaaaaatgtgttcagaattgggaagtataaaatgaggttcttaagtccattaggcattaaaaccacatccacacacgttaatactcttgtttatccattccgagatttctctgttgaaatttttaggggtttcctttactctagggaagcagcagggtcgggcctttgactgatagtagtagacttgcttgtgtgttcctggcttggacagggaacaagggcaggtggctcaccgtcctgggggcctaagtgcagagcctaaccaccctctgtgaccccgagttagtgcccaggtagatttgccccagtagcatgtgctctctgcctttttttccctgcttcccttcatgtttgaaggtcctgcaaggataacatgccctcagcctgtgaaccaaaacaatctggttataaaccatcttgcacttgtttccatgtggagggaggagctaggacgtgggggtgagttggaagcagcaaggtatgctcacctggtgctcttctggttcctgctgacagtgctcctgtagaaaggacatggtgaagatctccatggatgtgtttgtgagaaagttccagccagaaaggtacaaactttggaaagctgggaaggacaacacagttattgaccatactctgcccacgccagaagcagctgagtttcttaaggagagtgaactgcctccaagagctggcaacgaggaggagtgcccagaggaggacatggaaggggtggaggatggagaggaaggagacctgaagacaaggtaacccagcagcccttttgtcctggctgcgtgagggagggatgtctgggtaggtcctgtaatctgtggagaggctgtttcttgttttttttgttttgttttgtttttgtttttgtttttgtttttgatggagtctcgctctgtcgcccaggctggagtgcagtggtgcgatctcggctcactgcaagccccgcctcccgggttcaggccattcttctgcctcagcctcccgagtagctgggactacaggcacctacagccacgcctggctaattttttgtatttttagtagagacagggtttcactgtgttagccaggacggtctcgatctcctgacctcgtgatccgcccacctcggcctcccaaagtgctgggattacaggtgtgagccaccgcgcccggccgaggctgtttctaagatgccgtttgtgccttggctaagggagtgttcttggtaaaggctccagaaacctgagagccagagcattcaggcactttctgaatgagagacctgtagtgggcgtgtagtctgctggagcaaggcgtcagttatatgagggtcgggggcatttatgtgcgaaggtcgggctccctctgagccagaaaagtcatgttttctcatcatatcagagagtcttttaaaaagaagtgtagtgaggatgagactcaagggcattggtaatgtcgtgatttaagtctgcagtgctattggtggctgagccaggggatctgtgctctgaggagaatttatcctgggccatatgggaaagaaaggaggaaccgttccttggtacctgctatatgccaggcactttgccagctactctgcataccttttcttaatcctcacaacaaatctgttaggtgggtggtaatacctgtattttccagatgattgaacaaggtcagagaggtgaagtcccttgtctcaagtcacaaataagaggtgtccctgagttttgagccaggcctgacaggctctggccattcactttgggttgtgtgtggatgtgtatgaatgtgtttgagtaagtggatgtatatgtgggctcttaaaagatttgccctctcccttgcagcctggccaagcaccgaatagggacaaagaggcaccgagtttgtcttgaaataccacaggaggtgagtcagagtgagctcttccccaaggaggatctgagttctgagcagtatgagatgacggagtgcccggcagccctcgcccctgtgaggcccacccatagctctgtgcggcaagttgaggatggtcttaccttcccaggttagttgactatggtgtattttccacaaccctaactcatatatgtgtcccgtgttagatgccatattgagtgctgggtcagaaataaaaaaggcagagtgacaggtccgtgagcagatagcatacttggagtgtgagaagtgctttgggtagggatgtacagggaggactggacacgtagggaaaagctcctccctctgcctggtcaggggtcagggaaacactggaggttttggtgaaggtgactcttacaaggtaagtaggaccttcccaggcggacagagagagaggagggatgtagaaagggagtcccagatgggaggagcagggcacaggcatggagatgggaatttttttttttttttttgaaatggagtcttgctctgtcatgcaggctggagtgcaggggcgcaatcttggctcactgcaacttctgcctcctgggttcaagcgattctcctgcctcagccttccaactagctaggactacaggtgcctgccaccatgcctggctaatttttttttgtatttttagtagcgatggggtttcaccgtgttggccaggctgatcttgaactcctgacctcaggtgatccgcctgcctcggcctcccaaaatgccaagtgggattacaggcgtgagccactgttcccagcagagatgggaaatattaatagcatggtccacttgggggaactggtggggagtttccctcaattgaatattagggtggaaggcagctgtgtgaccagaaggtgacgctggagaaataggagatgatgtagggctgtctgccattttcatttgctcacttggaagcttaagaagccatttatattttaagagagggagtggtgtgatcagtgctgtttagcagtcacttggaaggtcattgaggctagatttgttagagaaaggcttgtatctgtcttgggtcaggtatgacccaaagatgtggtctgccgacagccaggcagcactgtggactgacaccctgggctgggctggcttctcttcagcagattttctttcccttttttctcttcaaatttatttatttatattgacagataaaatcgtgcatatttgtcttgtacaacataatttttttgtttgttttagaaacggggtcttactgtgttgcccaagcctttgtgaacacagctcactgcagcctcaactttctgggctcaagcaatcctcttgcctcagcctctcaagtaggtgggactacaggcatacaccacgcctggctaatttttttttttttttttttttttttgagacggagtctcactctgtctcccaggctggagtgcaaaggcatgatcttggctcactgcaacctccgcctcccgggttcaagtgattctcctacctcagcctcccaagtagctgggactacagatgcttgctaccacgctggctgatttttgtatttttagtagagacggggtttcactctgttagccaggatggtctcgatctcctgacatcgtgatccgcccacctcagcctcccaaagtgctgggattacagcagtgagccaccatgcctggcccatgcctggctaatttttaaattctgtagagacagagtctgactttgttgcccaggctggtcttgaactcctgggctccagcaatcctcccatcttggcctcccaaagtgctgggattacagttttgaactactgctcctggtccaacatgatttgtgaagtatatataagttgtggaatgggtaaatctagctgtttaaaatacatattcacatagtggtcatttttgcagtgagaacatttaacatccaccctcttaatatttttcaagatctttagattttctagcatgggctaggtagccaggtctctgctgagctcagacttgcattacctgcaggagactttggaggaaatggcagctgccccttactgagtgtctgctgagtgccaggcggtgctcaggagtcttatttatgagccctgtagatctgtagtagcatcttctcattacagaggaagaagctggaggccaggaggctgagcaaatagccctggctcacagtgcccctcagtgacagagccaggattggaagccaggtcccattccccgcccatgttccttgtgctttgccctctgcctttcatcaggttcacatgtgcaggaggaacttggctctgtctaatgtgtatgtgtgtttcagattattctgactccactgaagtcaaatttgaagagcttaaaaatgtcaaactagaagaggaggatgaggaggaagaacaagcagcagctgccttggatctttctgtgaatcctgcgtctgtagggggacgccttgtcttctcaggctccaaaaagaaatcatcttctagcctgggctctggctcttcacgggattctatctcttctgattcagaaactagtgagcctctctcctgccgagcccaagggcaaacgggagttctcactgtgcacagttatgccaaaggggatggcagggtcactgtgggagagccatgcacgaggaagaaaggaagcgccgctagaagtttcagtgagcgggagctggcagaggtatgggctccaggcagtggtgtggggtggggagctgccctggaggacaccctgtcgggaggggatctgtgtgggggagggaggtggatctgtgtgatggaggtgctgcaggagggcaggagagaccctcagtcagtgcctctagccagcagtggttgtgtcaaacaaaagcctggggtggcattcactctcccagcttgttctttgctgggagttgcttttctgttatccctgtggctactgattccaagaattgcatcaatgcagcctgagtcacagcagcagatcctcctcagcccacttggatcacaatgccttttttttttttcttgagatagagtctctgctctgttgcctagctagagtgcagtggcatgatcttggctcactgcaacctctgccttccaggttcaagcagttctcctgcctcagcctctcgagtagctggtattacaggtgtgtgccaccacacccagctaatttttgtatttttagtagagacagggtttcaccatgttggccaggctggtctggaactcctgacctcgtgatctgcccacctcagcctcccaaagtggtgggattacaggcgtgagccactgtggctggccttttgtttttttttctttttttttttgagacggggtctcgctctgttgcccaggctggagtgcagtggcacgatcttggctcactgcaagctccgcctcctgggttcacaccattctcctgcctcagcctcccgagtagctgggactacaggcgcccaccaccacgcccagctaattttttgtatttttagtagagactgggtttcaccgtgttagccaggatggtctcgatttcctgaccttgtgatccgcctgccttggcctcccaaagtactgggattacaggcgtgaaccaccgtggctggccttttcaactggggtaggcaggaactcttcctctgatcctcattgccttagcggcaccagggttagaatggctgctgttggagcccacgtgtttggaggtttgggatcagatgagatgacctttcttaccttgaaattcaagggtttttttcttacacctcttgactgccctgtagactcccagtatgacattgatagagcatccttttggagaccaagatgcattcccaaagctataaacacgaacatgtgtgttcaggcttcctccttaaatacatgttgtcaccaaaagctgattcctgcttttgtgcaaaatggctcttggtgggtctgccactctgagtgatcagtcatgtcagatgccactggacccccactacccaagtgactttccctgactccccagccttggagcttatgtgggtcaagctgcagtctttggtgaggggtgggagatagaagaagccagtgcagaaggtcctctttattccctattcccttacctttagtttttaaaaatgtatcttaaaaatcttcactatggaaaatttctgacgtacgtacaaaataccatcacgagcccccgcgtgtactcatcatatatatgattaacatttggcacatttgctttctgttttctttggctgcagtacttgacactcagtcatattcacatttccctagtgttgccaatagtccctttttatggtaggtttgtctccttgttgttgatactcataacttttctcggtgccttctctgaatctcagggtacggttttggtagacttctttttaccttgtgaatgttcctctttccatcccactgtggttgcaggctaatgagctaataactactgtgtttccttctcattgcctctgattgcagttctctgtgccttcttatggcagcttccataaaggagggctttttcagcctggaaaccagagtctctttaactcccagttgccacctagcaattcttccttcgcagaggccccgggccatttcatccatcctactgttgactactgttcactacagttcatgctgtcctcttgctgagtcttcctgacattcttgtttctagttgcaatcacaatcacaaaaagcagctaagaagtagcaagagctcactgtatattaaatactttgtttatcttttttgagacagggtcttgctctgttgcccagggtagagtgcagtggcacagtcttggctcactgcaacttctgccttctgggttcaacccatcctccccacctcagcctcccaagtagctgggactacaggtgcacaccaccactcttggccaatttttgtatttttcgtagagatggggtttcaacatgttgcccagactggtctcgaaatcctgggttcaagtgatcctcctcccttgatctcccaaagtgccgtgatttcaggtgtgagccactgtgtgccccaccgccccccagctgttaaatactttatatgcattgttcagtctttgtattactgcttaattaatcttattacagagtcaagtttttgtgggaattttttggggtgggaggtgcaggaagccaataaataacacctgtcctttttcctctcaattcggaactatttaattgatgatacaagagtcaggcatatggagctcagaatgtcgctttatttacaagttaaaatgattgaagaaagtgacttttaacctgtgactaaatggccctgctactttttttttttttgtggggggactgagtctcgctctgttgcccaggctggagtgcagtggtgtaatcttggctcactgcaacctccacctcctgggttcaagtgattctcgtgccccagcctcccgagtagctgggattacaggcatgcaccaccactcctggttaatttttgtattttttttagtagagatggggtttcaccatgttggccaggctggtctgtaactcctgagtgcccgcctcagcctcccaaagtgctgagattacaggtgtgagccatcgcgcctggcctactcatttactcttgatgtctccaggcccctctagaggcaaagcatttccatggaagcactcagcttccatgtggtgtggatgtaggccagaatgcactccctctccaaaagacagatcctagtgaagtgaagcacagctttcaagggggtggggagaagaaaagccaggactccttccgtgtggaagtgtgctaggggaaggggtcttctctctgacatgtctctctttttcagtcctctgctcaaaaacccttgagtgtcttcttggttcctttttatttcggtatgtacttttcaggccgagcctgatgataataccctaataaataaccctctctgctccatcgccaaccatccctccacctccaacatgtgctggcttgtttgtttgaactacttaaaagtctctaaaactgtcttggctgccctgccacttccctctactttctaatcatttatggcatgcctactctaggccaggactgtgccttcaaggagctcacagtctaggatagataggtaagagcaaatcattccagtacttaatgatacgtgttgtggtacaagtgggagagttagcagctcagcctggggttgcagtgtagagttctggactgcctgagagaaggaaacagtttaggcctgaggttagaagaatgccaggtggacagaatgaaatcgaagagaatctgggagaggagggtgttctaaatgctcatgataactcatgccagggtcaaagcacttggggatctgcagtggtttagtttgtctcaggcatataggactggagagggcctcaggtggtgctgttgggggatgtcaagagccagaacctggagggtctgccttgttgctctgtgaagcagtttgacctagttgtggtgtagggagcagcagaagggtccccaccatatgcaccatatggatttggaaattgaaaactttcataattcattcttttaaacgcacacacaaagggccgggtgccgtggtgcatgcctgtaatcctagcagtttgggaggctgaggcgggtggatcacctgaggtcaggagtttgagaccagcttgtccaacatggcgaaaccccatctctactaaaaatagaaaaattagctgggtgtggtggcgggcgcctataatcccagctgcttgggaggctgaggcaggaaagcgcttaaaccctggggtggtggggggcggaggttgcagtgagctgagatcacaccactgcactccagtctgggcaaaagagtgaaactttacctcaaaaagataaaaaaaaaaaaaaaaaagcaagaaagaaatgcacacacaaagattcagagggaggccacgcagggtgccatacacctgtggtcccagcactttgggaggctgaggtgcgagaattgcttgagcctgagaggttgaggctgcaatgagccgtgactgtaccattgcactacagcctgggtgacagaatgacacagtatcttagaaagatgcagagcgaataatacagtgaacccacaaataatttttttttgagacggagtcttgctctgtcgcccaggctggagtgcagtggcatgatctcggctcactgcaacctccacctcctggctttaagcaattctttgcctcagcctcctgagtagctgggattacaggcgcctgccaccatgcccggctaatttttgtatttttagtagagacagggtttcaccatcttggccaggctggtcttgaacccctgccctcgtgatccacctgcctcggcctcccaaagtgatgggattgcaggtgtgagccaccattctcggccaaacccacaaatattctaacaggtgtcaggatctttccatatttgctttgtttgtcctgttttcaatttgctgaagtatttatattaaaattatattatcttcattagtatataatgtacatatttttggggtacatgttgatactttaatacattaatttgtaaagattaaatcagtgtaattggtaaatgcatcaccttaaatatttgtcttgtctttatgctagaaacattcaaattattctattttgaaatgtacaatagattattgtaaactatagtcaccctactgatttgtcaaacactaggtcttatttcttctatcagactatatatttgtgcccattaatctgcctctctgctgaagtatttgaaagcacatcccagataccttgtcatttcttccctacttcagtgtgtatctctgaataatatggtcatttttggctgggcgcagtggctcacacctgtaatcccagcactctgggaggccgagggggtggatcatctgaggtcaggagtgcgagaccagcctggccaacatggtgaaaccttgtctttactaaaaatacaaaaattagccaggcgtgttggcgggtgcctgtaatcccagctactcaggaggctgaggcaggagaattgctcgaatctgagaggcggaggttgcgctgagctgggatcttgccattgcactccagcctgggcaacagagtgagactccatctcaaaaaaaaaaaaaaaaaaaggaaaatatggtcactttcttagatgataactatgccattattatacctaagaaaactacaaaaattctttagcataatttactatccagtccataatcaaatttcctcattgtccaatctgttttacagttgattggtttgtatcaggattaaatcaaggcccacacctttgatttgccgatgatgttctgaagtcttccttaatgtaggccagcgcctctcccccttttttcctcaccattgacttaatcaagaagctgtcattgattgtccagtaaagggttttttaagtactgcactgatgttttggaagattgttctggaggcagtataaagattttgagggggaggaagaaggaggcaaaattagaaattgtttaacagaggttctcttgaaggtggaattatggatgatttcacttcctacatttatgcatcatttgaatatttttatgattaacatgtgatttttataactaaatacttctacttcaggaaaggaggaaaaaagatttgaaacagggaaaccaattaggaacctgtttctttagtctgagagagaggtagtgaggacctgtaggtggtggtgatagggatggggagcagaaaatggacttgagagctacttggaaggtaggcacataggactgggtgactggatgggggtgagtcagagggtagcatggggcttgactcgggtttccagctttgagttcttgggataggtggtggtgtcatccatataggataatggttataagaaaactaaagggtttttagtgtgggccaggaaatgagttgagtttgggtacgtctagagggggacttttgtgaggtaggctatggagacacatagacatagccttgaagctggggtgggagggttggtctgtgggtgtgggagtcaccaggagggcactggtgggcatggaagaatgtgtgtagagtgaagaacagtttcacagtgtggggtgacaggagagggcccaggtaggagaatgtgagggagcagccagaggtcaggagaactaggaaagaacagtgtatccagtgccagggcaggagaagagttcaagacagtgggagatatggccaagtgtgccttgtattaaagggcagggtcctgccaagtgggggaagttgaagaggtagtgattggattctggggatctaaggaagtgggagtgcaggtggagggacaggaggggatggctgcagataggttttttttttttttttttgagaaaaggtcttgctgtgttgcccaggctggagtgcagtggtgcgatctcagctcaccacagcctcgacctcccaggcttaactgattctcccacctcagcctctcaagtagttgggactataggcatgtgccatcatgcccagctaagttttttatttttgtagtgatggggtatccttatgttgcctaggctggtctcaaactcctgggctcaagtgatcctcctgtcttggcctcccaaagtgctgggatataggcatgagccaccacacccagcctgtgtttttaaattgtggtaatatatacacggtatgagatttacctgttttaacagtttttttagtaaacagttcagtggcagtaagtacattcactttgttgggccactgtcaccagaatgcagatggttttgaggtgggaggagatggggaatttatctctgagggtcgcctagagtagtcagataactacctctgcttagtgcaacccagcccttttcaaaagccactactcttagaaacacttcattgctttccatctagttccctttcttctttgaagccctagagtactagtttcttaatgcccttgccataggctggtgaagaatataaccttctagaagctgggccctgtgccacattcatcctcatttcttgagttaccagcacggtccagagggcttggcctatgaaaccctctgtaatgaggatggaatgagtaaatggaaggtcaggtttgttttagtaagaagccaccatcagaattaattgactgggaggaataagggacagatagtcaaggtttgggggcagaagctgagcaactttgtccatccctggagaggtcttatagcactggatctatatttgtagacaactgggttccttagagcacccttatgttcccccacccccactttaagcatccccaagctgtaatctgggctgcctgctgttcagtttccatgccaccatctatgtcaagggccttttttaggtcagtctggtaaactgcagtttttggtaaaagcaccctggctggctgacactgccgaaactgtagagttttcattacctactgactgagccacagccatatgtctgctgcagaagttcttgttagttcaagctactttgaaaagtgagttcccaaaacaaggtgggagaacaattggttcttctctgtacagaataaaccctatcaggaacactaaccttgaccctggtgccagatgttggatgagggaggaaagaactcaggagccttgagttccagctttcttcaggcagggccctgggagtctgcctgctatcccgccctgtctgcaaaaagagccctctggggaagggtttattactaccgttttactggtggggctgctactcatccaggctcacacagctgctagttggtcgaaccctgacctttctgttatatactgagggaatttagaaactggagcaatcccagggaaggcagcaccatgagaagggtgcggatgccatggtagcaggaggagtactgtccaggagatgaggaaatgtgaaaagatattcaaatctttgaatggacctgactactttggtcagaggcagcatgacggtagtggaaagggctcagacttcggacttggacaccaggtctccctccctgaggttagagatcacgtcttgtttttctctgcattgccaaaacaagtattcccaccgtatactgggtatataagaggtgctgtgaatatactgatcatggaaaaggtgtcctcttcccttcccaagctgcattctggtgttcttgaccttcacccttccacctcctttggaacttggatcttaggtacctcctaccctgtatttgtttcctattgctgctataacaaggtaccacaaacacagaggctgaaacacttgttctcttatggttcttcagttcagaagtctgaaatgggtttcactgagctaaagtgaaggcatcagcagggctgtgtaccttcctggaggctctcaggggaggacccatttccttgccctttccagcctccctgggctgcccacattccttggctcctggacctctaggtccattgtcaaaggcagcggcatccagccaagtgtctctggcatcacatcactcggacagactcttctgcttccttcttctgttgtaagccccattgggattacattgggcccacctggatgatccagggtacgctccctattttaaacactatctgattagcaatcttaattctcctttaccatgttagaataacatattcacagggattgggatgtgggcatattggggaaccattattctctctaccaaatatcctactatctccctttcacaagctgctgctttgcctataaagccaagctcatgaagcccctatcatagctaaaatacaattctagaggaaatttccttctcaaactatgatctcatttttcccttgatcttctcaaaaatactccacgacgtattcactccttagtttcttattctttgtccaccggaacttatctcaaaaaacagtcctcatagctccccgttgctgagtgagtcccttggccacttccctgctcagctcttctatgttctttgacctgtggatctccccctccctgaagccgtccccttcttctctttctggtattcctcttacctgtctgcttctgagtctccttttctcccttctcttcttcctcctgtccctggaaggcttagtcaattcatcatccaagacaatctcatcttctcccaccattgtaattctgaacctggtgctgcggattcccagatcttgctctgacttcttttctgaacccccagtctgaatttcttattgcctcccctgggtatttccaaatgaaaagacccttgggtacatgttgtgtaccctacacagcttgtttaacctggtttgttattagcccccacttcctccacatgagccctcttaaagcctgtcaccttggtggtccaggctagaaatccccaccgtttctggcttctttattcccatcctttttttccctagtctgccacagcccacaggtttaggcctattgtccaggtgcccccaaagtgatggcgggggcaggtcggggggaaacaagaatattattggggtataggaataaagcaaaatgaactttgtttttatcttaaccttttatagtctgtttttgctttaaaatatgcatatgtgcattaatattagtatatgtaattgattagtaagtaatatataggttgggggtacatgctcctaaattttctatttacatggttaagactgtcgggcaagtatgggttttccagtttgttttagccaaagaacccttttacttacttacttattgattggagacaaagtctcacttctgtcacccaggctggagtgcagtggtgcagtctcagctcactgcagccttgaccttccgggctcaggtaatcctcccatctcagcctcttgagtagctgggactacaggtgcatgccaccacacctgaatttttttgtgtgtggagacggggtgttgccatgttatctgggctcaagggatccgcctacctcagcctcccaaagtgctgggattataggcgtgagccactgtgcctggccagaaccctttctttaagtgaaatcttaattaaaacataaatcaaaagcagagccattctggttggaaagaagatggggcctctagccctttttgttcactgtaatggaggctcctgaggtgctttccggatgtacgttttgaaaaccatgggtttagacagttgatatagttccggtctgattaagtctatggtcatgtaagtcttcatggacatcagtaggaaaaggtccctgatatcctcactccaccatattcctccatactgctgcagcatccttactcacgtaagcacagatcacatcttctttgcttctctacaccttcttcttttcctgggcaggcctttgcacacagtaggtgcccagtgaatatttgttgaatgaatggcaaatggatggcaaaacttgttggcaaaatgtatgtttggaagagcaggttctgtttttcctggacatggcctgttcagaagttgttttctcttggcattccaactgtggtccttaactcctggggctctgtgtagttgcacatggagtctgtaggcccagggtgtgttctctgaagtagcactgcagcatttatggcattggtttttgtcacagttgcaaagtggccctctttcaggcctcatttccttgcttaatggattttgctaaccctgcatctcctgatgtcagtataaccaagttttaaatacgttgattagaaagaaacccttctgtagtgtttctgagtcaatcctgtacatttaaatctaattacatttgctctgacattatgtaaatgcagtcttaaatcaacctttccctttgcaagccaggccagagtttcagatgcactttctgtcctggctgatgttctcccctggagaagcagcagctaactgaggaatgaacagtatctgctagcgcgaagtcttggcagtgtataaggagaaggtggcctattttacttttaataggtcagctgctgctcacccctttgggtgtcccctagacactcctgggtggcccagctgcctggcacattgtaacaggtactgttgacctactgggccaaggaaaggggcacctaggctccttgggggctctctcacttgggccaccttggtagtctcatagcagtgagcttaagggaccgggcaagcctctctcagagctggagcaggcttgtttttggtacactggtttcaggctgctcctaagaaggccaagaactacacttgggttttgccctaaatttacataatcctggttcagactagtttggtacgtggtattgtcatttggctttttctaagataggtattttctgtttggtattatatgtctttttgtttctctgtgcccctctctttcctttggttttcattgtaagggtgacttgtgctgtgtctcaagtggagacaagaccaatttaatttcttgtggtttgcccaggttgcagatgaatacatgttttccctagaagagaataagaagtccaagggacgccgtcagcctttaagcaagctcccccgccatcacccacttgtgctgcaggagtgtgtcagtgatgatggtaagtgttgttttttcttcaccaggaggaaagcagctcaccacattagacttgacaggacaggacatcagaaggccaagctgagggataagggtgggcctgtggcttagctgctcttccagatattccataaagagaggaccggatttccttatatctaattgactaaccagattccattataagtttgagtatcttgcagtgtaccttaataggggataattgcaggcaggttttttcctttcttttcctgggaggtacaaggctgatttttcaggacagaaaatcctgtcagtgatgcaaagccctgtggtgtatatgtggctgcaaagataactaagatatgtccgtgccctcaagacactcacagggtggtggggaaactggacaggtaaacagatctcaagaaagaagaggtggccgggtgtggtggctcatgcctgtaatcccagcactttggaaagccaaggtgggcggatcatgaggtcaggagatcgagaccatcctggctaacacgtgaaaccccatctctactaaaactacaaaaaagtagccgggtgtcatggcacgcgcctgtagtcccagctactcaggaggctgaagcaggagaattgctcgaacccaggaggcagaggttgcagtgagccgagatggtgccactgcactccagcctgggcgacagagcgagatgccatctcaaaaaaaaacagaagaggtgttactctggggcagaaggacagcatgctatggagaagaggagcaggaggctgtagtcagaggaactacagtcagctcagtgtggctggagctggagggcaaggccagggagtgataggtggagtaggaggagggggaccagatcctggatagcgttatcatggaggccagagtgaggactttgtcttactggcattcaggagccagtgacatgttttaagcagaggaatgacagagtcatttagattcctttagaaaagatcgctcctagtgctggcatcttgaggatggctttgagaggaccacataggcttccgtaatggtctgcctgcaatatgaaggtctgaagtaggatggtggtggtagggaatatatttggaagataaaatcaactggatttggtgactggctgtgaagctatgaggatggtagttgaggaggatgagttgagtgcctccccggtttgtagctttggttggggaaacctgagttcagtgtctatggaggatgtagacttaggagttggcactgaggtgacattggatacaattgttggaataatgaggccgatcttggggaggggaccaaggggggtgagcagacgctggggctaggtggacagaggagggaggggagcctgtgaaggaggcagagaagcagggtaagcagccatgtgtaaggaaaaccaggaaatgtggcactgaagctcagggtgtgttgacatcagtggagcatggtctccttggctgcctgaagcccagagatccaggatgatcatcactgccgagcctcagctccagcttggttggtgactgggccctgtcaccttcagggagagcagagtcaatcgtacatgttactcttgactaacatcaggccctgtcctacctggtcctctccttcctgatctgatgtcagtgccccatctctgctgtttttttttttcagtagaaagatcatggtatagccgggcgtggtggctcacacctgtaatctcagcactttgggaggccgaggcgggtggatcacaaggtcaggagatcgagaccatcctggctaacatggtgaaacaccatctctactaaaaatacaaaaaattagctgggcatggtggtgagcgcctgtagtcccagctactcgggaggctgaggcaggagaatggcatgaacccaggaggcagaatttgcagtgagctgagaccatgccactgcactccagcctgggcgacagcgagtctctgtctcaacaacaacaacaacaaaaaagatcatgataaacagggtggggaatatcccttctgtcctccagtcagaagtgtggcaggaccctgagtcaggtcctaggaagttctctgtgttcttattccagctcagacaggagcttcaggttctctgggtagcacctgcctatctccctgattggtttaaagcaatatagacttcaggaaactggaaaagttaccaagaggaatacaaaattacccttaaaagatgaccattttgaatatattaacatattatcttcctggcttttctctagtcagatattagagtatgtccatgtatatctttttaaaataatgcagttgagataatacacaacctctccccctacttttttttgtttcttgtttttttttttttttttttttgagaaggagtctcacttactctgttgcccaggctggagtgcagtggtgtgatcttggcttactgcaacctctgcctcctggtctcgaactcctgaccttgtgatccacccacctcggcctcccaaagtgctgggattacaggcgtgagccaccacgcccagcctttttttttttttttgagacggagtcttactcactctgttgcccaggctggagtgcagtggcatgatcttggctcactgcaacctctgcctcctgggttcaagtgattctcctgcctcagcctcccgagtagctaggattacaggtgtgtgctacgacgcccagctaatttttgtatctttagtagagacggggtttcaccatgttggccaggcttgtctcgaactcctgacctcaagtgatctgcccgcttcagcctcccaaagtgctgggattacaggcgtgagccaccgcacccagccccacaatatcctttaatcttcagtccatgcccatctttccctgcatgtcccaagaatgtgttttatagttatttcttttgaactctaatataaatcaaactaaggtcacatactgtatttggaagttatgtttctttactgttgtatgcccctccccctacttttaaaaaaatttcaattcaagcataacaattcagtgatatgcacacattttaactgtacagctcaatgaaattttacatatgtaaactgtataattttgcttcctgcaattttcacttaacgtagtgaacattttccctcatcattcagtattcacaaatggaatgatctggggccacttttggctttgtaaatggaacagatgtcagtgtgttaattttttagttgtgagtgtgagcctgcctgtctgtttctgtttcttccattctatcttggtcactcctgtttggccaggataaagaaaaaaatctgtgcttgggttctgggcaccatggctcctgattacaactgaacgatggggcatataggggttgattttaattgtctgcgttggtgtccttagggtacactgaggcggcgcacaatggcagctgccagatgccttcagattaaacatgactatgagggcagcgtagaatactatctgcactgagctggagttgccagaaatgaagaaacaggcacctaatggaagtacagaccagagctttccttggctgcttggaacaggtttcaggggcctttgggaaagcacctctgtttgggaagaaggagggtcatagctggggactgatgatgccattcaaagcgagatgcatggatcccctgggatgccccgtgtgatggggctggcagagagccagtctcctgtcaggggccgcatacttgggccttgcttggtcacacttgccaaagaaaggcatagcaactctagcttcatacctccctcacatggtagagcatctggagaaacattttggacatctaccaaagactgcgctcatttacttataccttcagaattatggcgtttcctttacttccctgtttctgtttccttgtttctgctgggagcttgtggactatgcccctgtttcactgatttaggaagaactgggaagtgtgcacctttatcacttacatgagttttgtgagcaaactttttttgttttccactcagcagtatgtcccctttcttgtaggaagatgcacccagaggggatttttccttcccaggccttagtgaagtctgatgagttgtatgccctgctgtctagcatacctaggagacaccatctgtcatgaccagggatatataaagggccaggaagtcagtattttaggctttacagtcttcattggtctctgtggttgtcactgttttttttttttaagccccaatgctgaaaatgtaaaaacaaagctgggtgcagtggctcatgcctgtagtccaagctacttgggcagctgtgatgggaggatcacttgagcccaggagtttgaggctgtggtgagctatgatcgcacatgtaaatagccactgtactccagcctgggcaacatagcaagaccccatcataaaaatgtaaaaacaattcttagcttcctcagtgggctggattcagcctgcaggatattgtttgccagcgtcaggcatcacatcttgtggctgggaagaggattcatcttggacatgtagctctgctctaggaggggttggggagccttgtccagaataggtacatactgctgacctttccagaggaagctggtaagtcctggccaaggaccatgatattacaacttttaagctttgccaattccctgttattttccttccttgtttagttgcactaaagggaaaactctaaaaggtaaaggacttaacaggctgacgttttggaggcagcaaataagatggtttttggcaagatggtgcttcattctgctgtccttgggcagaagggctgaatgtggcagctgttaagggagagtagagcaagctgagctcgtggggcaggaggaagaatggaggccatgagtcagtctggccagagaatggggtactggcaggactccctacacatcatcaagatactgaaggagtctattgacagttgcttccaccctttgcctttatcatccttaggaattcaggagtcacccttggtccaaacctaggatcaggagtcctagtggaactcatctgttctccaggcagagccacagatgtgcagggttagtgctgactcacacttctgtttcctcctctagagacatctgaacagctgacccctgaggaagaggctgaggagacagaggcctgggccaagcctctgagccaactgtggcagaaccgacctccaaactttgaggctgagaaggaattcaatgagaccatggcccaacaggcccctcactgcgctgtctgtatgatcttccagacttatcatcaggtaacccagctccatgcactctgtttacccaggaccagcaatcatagggaagctagatttaattgtgagtatatagcttgtcactggttgtcttgggaaaggccacctccacccccagcattctctgccccatctgtgtattggtcagtcttctccaggcagataacccagcaacgtgggtttcaattgagaatgctttggagatgagctgagggtgggcttaggctcccctttgcacatgcagtcatcacagacatcagtttgcagagcaatctgcatttctgttattctagtccgtggttattcctgccaagtggtttatagtcctggccagggtggagaactgtgatttccttaccacagtctgaacctcagctgaaaagccagatcctctaatgttgtttttcctttcccattgccacaatgcgtgttgccagtagcagaaggaacttgggaggggtggaagcaagggcctgatatgtgaggaggggctgggaagcaagattgctgagctcagctgtgtgcctcctgctctggggcatctgtggcttcattggtggatctctttgggtccagctctaggatgccaggaaggcattcacagcagcaggtgccaagggaccagctcagtctcagctgggacctgcacagcatagcaggtaggtaagtggtccttacctgctgtggtggttaaagtggcatggctgccgctgagcctggcagggccccagattcatgcttgctgaaaatggaacctcagaccaacacactttggattaggaactcactaaacctttccattgacaaaaagcaaaaccaaagcctttgcctatgaggggagtgaatggctgggttcttactataagcagatctactaagtaggagtttcacaaatggcataggctctggggttgacatctttctgggcctcatccttggaatggagatgcaggtgccatccagcagatatttgcaatcagtatagtttgccaagggaagtatgtggatttaagttcttcctggagggaccctgagccaggaatcacacaggtggggctccagccatgtgacagtgctgcagttcaggtgacctgctgacaggcacaagaggcaattagtgctggcctactaggagcatctgctctgggtacactcctgaggtggggtcaccgcacagtgtagcacgtaagggagcccacagtagcagcctagctgctaacatctccgtgcattttttttttttttagacggagtctcagtctgttgcccaggctggagtgcagctgggactacaggcacacaccatcacacccagctaatttttggattcttagtacagacggggtttcaccatgttggctaggctggtcttggactcctgacctctggtgatccacccgcctcggcctcccgaagtgctggaattacaggcgtgagccacctcacctggcctctcagtgcattttattaaccactttctttgggaagattgaaatcccagttgcctcttaccttgctcccttttctcagttgtcccctaggggcctttgtatgatgctgctgtgagaaactgaatttgagtcattacaggtaacttcaattagcagctccgggataatggctgtgcacccgggagctgtagccatagtcagatcggtaagagagccagctttctgctgatagagcaggtggaaagctaagagcataggcacgtgctcactgaggtgtacacttgttctttccccttaggttgaatttggaggctttaatcagaactgtggaaatgcttcagatttagccccccagaagcagaggaccaagccattgattccagaaatgtgcttcacttcgactggctgcagcacggacatcaacctttctactccttatcttgaggaggatggcaccagcatactcgtttcctgcaagaagtgcagcgtccgggtccatgccagtgagtgctgctcacctttctctgtgtcctgtcccaggagtatgggcctgctcactggaagttcttgccacctcctggcctcccagccccaaaaagattgttgatgttttattggggagtctgttgctagctgatttttcactgtctccaggggtccatactggcactagtcatctctttgccatcctcttggttgcagatagcagaaagggattagtccctgccacttactaggtgtttgtaccagtgaatctacagtttttgactttttgagactttgagccatactgtatgcctgagccctggggactcagactaaagaaaactaaggggtttctgtgagatttggttgtagctttgggaggtggtatatggaaaggaattgcaaatctaccttttgactctgaccactgggtttaatttgctcatcttggtgtccctgttaggttgctatggggtcccccctgcaaaggcttctgaagactggatgtgttctcggtgttcagccaatgccctagaggaggtgagtgatcccacactgttactgtcttcaccatgagtcttggtgcatattcagggccagacgatttcatgttggactcagtattcccagcagtctgcatagggtctggtacgcggtgatgtcagagagcgagtattgtgagagtaaatcctatgaccgtgagaatggttgctgcccacttacggagtctggatgctgtgtttgctccattgtggaaagaccaactagtggtcttcctgtggaggaacaataactcccttaaaagaatttagccattttgaattggagcctcagaaaggggctcagatgattcattgtgctgttttctcttcactgtaccccctggaacctggctgtacctagcccatataagaagcagtcagagccctgtcatgcctctagtttgagcaaagtatcttttgtgactttgctaagagttgttattagcagcaacaatgaagaggattatgtgaagtcacgtgactacttggcacactttagccctgagtggcctctccttctgacagggcgtcctggtgcaggggctgcctgggtgaagccccacatgctattatgcttctttcttatgtggaggagttgcccaaagcaggtccaggggagagcagattgaatgttaatgacttggtattaaccactttttcctccctctcctttcttggcaggactgctgtttatgctcattacgaggaggggccctgcagagagcaaatgatgacaggtaagtttcctgagcagtgccttggaatgcacaggctcagttccgaagcacacagtgtctttgtgagggtactagctgttcttctgaatgactgatgaggatttgggaagcacatcgtgtggagcaggaatagcatctccaagactcattttaaaaatggaatgctaagggagccaagcagtcccagactttccaactccagctgctcctctgcagcagagatgtcagtgacatcctcctttggagaagctaagaatggactcatgagaatatgaagacgaagatgatgcgcagggactgtgtgggctggagtgaggacattcaccttgtcacagctggggctggtatgcagaggcggccacaggctagcaagcacttctccacatggcaaactccctggctcagacctgctgtttggaatgaggcgagtgtgctcaaggaggacactgaggagagctcagacaggcccacccactatggaaccgaatctgctgaattttctgggcttctcagctgttgggcagctcgttttcatggagtgaatctttgtgcttaggcttgtgtttggttgctctgaggtggaaacgtaagatgaatgaggtttctgacctggaagagctagctgtctagggcatggtgcgtgcaggtcagtgctgagtatcctgcttccaagtagaatcccgtggcaacttgcagcatatgttcagtccagccgcctgccctcaagagtcccagttatgctgtccctgagagatagctactctgcctgctgcttctgctccttcaaaggcacttgctgccattatttgaggtcactgggttcctcacagtcacaggatagtgctgggaacattctttcttatttggagtggaaatggctgtgcttgaatctctcacctttacctctgaatgcctgttctgccctccagggccacacagaacaaatctgttcccactctaaaaagacagccccactagaactgcagagagcttccatggagccccagtgttgtctggtgtaggttttcacgtagcatggttttaagagttgtcaccattttcgttcttctcctcttgatgcatgctggtttcccaaaatgtccaaaacttactttaattcttaaggatgtccgttgaatagacctctcagagtaagtggggcttgggtcagaccttaaagattaaagagtgagtcagctatggaaaaagggagcagaagggagaggtcatttcagcctgggggagaggtttgggcagaggccgagagagagctgtgattactggcagattagggcacagccggggacgttttcaggaagcacttgggtcctatggtaaagaggtctgcatagagctttccagtttattctcactccctgagacctgccacacaccattagcctgcagctctgttcatttttcaacagagtggtgtaagaagcatgatccggtgctaacctagggcagtgggcagtggcctaggtgggcagtgggggtggcactgcttccacatactcagaggagagacggttctggttctcaccttcctgggtcccaggcatgtgctggtggaagtcagtggtcacccaggtgagggaggaagcgctgtcagcaggcccaaaagagaaggccacagagccttgggcccagaggtgactgagggagcctttgccttttggcaggtgggtccacgtttcatgtgctgtggcaattctggaagcaaggtttgtcaacattgcagaaagaagtccggtggatgtgagcaaaatccccctgccccgcttcaaactggtaagggcttgtagactctacataatttcccgacttacaagtttctgggtagaagagaacagggacctcctgtaccccttggttttggttagagtttgtgattctcactctgtggttagattccttagtggaggccaggtgtggtggctcacacctgtaatcccagccctttgtggggccgaggtgggtgaaccacttgaggtcaggagttcaagaccagcctgggcaacatggtgaaaccccgactctactaaaaatataaaattagctgggagtggtggtgcgcacctataatcccagctcctcgggaatctgaggcaggagaatcacttgaacccgggaggcggaggttgcagtgagccgatattgtgtcactgcactccagcctgggtgacagagcaagactccgtctcaaaaaaaaaaaaaaaaaaatttccttggcagataaagttgtaaccagacctggattagagcaggctggtgtgtccttgtattttgggaaggggctggctcttgcttgcttggctttgcatttgggaggggaacaacagaggaagctgcagtgccagttcctgcaatcactggttttcttcccctgtgctacagaaatgtatcttctgtaagaagcggaggaaaagaactgctggctgctgtgtgcagtgttctcacggccgctgcccaactgccttccatgtgagctgcgcccaggctgccggtgtgatgatgcagcctgacgactggccttttgtggtcttcattacctgctttcggcacaagattcctaatttggaggtgagagagggtgtcattctagaatcctcttgacagttttcatggtcattttctctgcatgttttccatttgttgtatcagcaactatttcctcaagcattctgcattatgaagagtgctaatgagttaagagattgagaggtggcccctgtccatctccactccctgccttgtactccataagccagtgacaccaaactgcttgtagttgattcgttttgattatctctttacttgtctgcctctccatcagaataaactccttgagggtccatatcttattaatgtggtcatccttattacttaacctagtgtccgggacatgcagaacctctgaaaatgttgagaacaaatggggagagctcccaagagttaaccatgaattgccagacagtagagatttctgcagttctcttaatggtaaagcttagagaaaaagtgacatgtaatgttagctagaggagctctgaagaggattgggtagacggtggcatttgaagtgggtcttaaacaataagaaggaattgtatgcagagactgttgtgtgcagagcttgagaaacagaatgaacaggtcgcagaagaaggatcatgaaagactggttatgggagtgtgacggtgtgtgggagtgtgatgcttgagaggcggacaacggcagaggatgaaggccctgcactgccactctcaggactctgacctgtcttcactggatgagaacttgttgaatattttgattctgcattatagtttttgataatcactcaggtggttgtttgaagagaggattcagagtaagaatttgaggctggaaaaccagttagtccaggagagagtgaggtctgaaatgggaacacataggcagggctttggggtacatttaactttgagatcctccaacaggtagaactgatagggtttattgaccctcgtgggttgaggagagaaggggagaggaggaggaaagggggagtgaatattgaagatgactcaggttactcccttgagagatgggaaggatgctaatatgatgttagtaactgcaatcaggaactgagatgaagcagtgttgctctgcaagggagagaaggagggatgagaaagaggaaagtaaatgctgaggtcactggagcattctggagagtaactgtgagggtaaagatttggctattagcatttaacagcatagttaaatctagttcccattagaaactgggctctggagattcccagtgggagaagcaggtagcagagcatgaaccagtgaaagcagttgagaaagtgaagcaagccagtgggaggaaggagggtcatatccaacagagaaggcagggctggtgtggtggtcactaagtaccacaaactggagtgtccctgtggagtagtcaggtcagaagccagaccgtagttggggaaggctctgccatgagtgagttacaatctaatagaagaggcgatcatacaagtttgacaacagtgtggtaaatacataatcaaaggaagaacgtgatagatggccagcccagaaggatgaacttttcactctgccatttggggttgcagaaaagtcctggttggctgactgcattctttttcataaagatgttgaacgtgacaggtggtcaggggtatgataggaaggaccttaggaagatgggaacatattgtatgtgagaatgagactccggagtgtctcaagggccctgccctagccatccctggtgccctcaccatgcccttctcattctgaacttgcccttaatgcaagtaaaaacttgaggtagtactgagtcacagctatgatagggaagagttttttcatacacagaatagttattttgtgataatcattaatactccacatgcttaagctggcagctgtagactgctggtgctatgaggaaattggggggactgatgagttagtagttttttcactgatttattcttcaaatgtttattgagcatttactatatgccaggcacagttttaggtgccaggactataccattgaacaagacaaaaaagtccttgcccttctggtgcatacagtatagttgaaggacacatagaagcaagtaaatacacagtatagcagatggtgagaagtgcagggataaaaattaagtcagataaggggaatggaagatgaagtagtaaggaatgacatcaataagttgacactgggatgggagtcagtgtgcaagtaactggggaatggcatctcaggtagaagaaccagcagtgtcgaagccctgggtggcagcacatatggcacactcattcagggaacagcaaggggggccagcatggctggggcagagtgcctgggcaggctagcaggcgtgcttggaaatgaggccgtcacatactttgtgatcctgtttgcatcaagggcaagttcagaatgagaagggcatggttgagggcaccagagatggcaatggcagggcccttggaatgggggacagtttgttgtgtgtagctggagacatctgggaaacctaagtctttgtgccctagccctgagggtaatgctgcaggtgctaagatgtggtgcagctttgcctggcggcccaggcctcagggcacctattgagtctctccttcgatactttgatgtcagttcttggcaagatcagaggtccatgttgttgttcagagagttctgggtaagataatatggtataagggccagttgtggactagctaaatttatgggaagagctaaatttatggaggaaatgtggtactggtctcttccaatgtcctggctgggatggtgggtatctggaaaggcttgttttagctcccatctcttctctcctttttacttttactttcccatgcttatctttccctgataaggaggaactaattgatcttcatctccatatgccaggcctgcaaactccacgtgtgagtaaccaaagcctctgtttttttccagcgtgccaagggggccttgcaaagcatcactgcaggccagaaagtcattagcaagcataagaacgggcgcttctaccagtgtgaagtggtcaggctcaccaccgagaccttctatgaagtcaactttgatgatggctccttcagcgacaatctttatcctgaggacatagtggtaatatctgcaaggagcttctcaggcagtttggaatggggggatgtttctaaggtctggctggcagactgtgtgtgtatgcctgcttcttctagccaggtccctggtcccatcaccatgtcctcaaacagaaagaatcatctgtaccagtctttctttgcaaagaaaactgcgtgctgctagggtaccctattttccctagaagtacctgggaatcagtattttctgcaattccttgaaacctgcatctgttgccgtctaaattatccttgagggcattctagtgcaataggagagcccaggctttggaatcaaatatgccaataccagcttcattgcctagtagctgtgtgattttaggggaattatccaactctcttttctatcaggccctcttagtagatgtatagaatctgcttttgtctcttcacagtgggctttagggctaagtagaaactgcctggagacacccttggcctgtttatgttatcaacacctgagacacagtggccccacatggacccagtcctaggtctggcttggtagtgaggacttagttcaggtttcccctacccccaccttgccttttcagttggtagactgaccaccaaagtagagaggaatgaaaccattttttcctttaacaaatcaggtattgtcccatgtttataccacattagccactcagttgctaaaagcacattcattagttataaggtagacttatagaaaaggcgacattagtagtactcatagcagtagcatagctatcatttatttatattttatttgtgagacagggtttcactctgacgcccaggctggagtgcagtggcacaatctcagctcactgcagcctcaacttcctggattgaggtgatcatcccacctcagcctccctggtagctgggactacaggaacgcaccaccacagccggctaattttttaattttttgtagagacgggcttttgccatgttgcccaggctggtctcaaactcctgggctcaagtgatctgcctaccttggcctcccaaagtggtgggattacaggcgtgagccactgtgcctggccttatttttttttttttttttttgagagagaccaggtctcactctgtcacttaggctggagtgcagtggctgtatcatagctcctgcaatctcaaactcctgaactcaagtgatcctcctgcttcagcttcccaggtagctgggactacaggcacatgcagtcacacctggctaatttttaaattttttgtagtaacaacggtcttgctttgttgctcaggctggtttcgatctcgcagcttgaagcgatcctcacatcttgggcccccaaaccactgggattacaagagtttgagccaccatacctggcccttgctgtaatttattaagctggtacagtatgccaggcactatgctaagtggttatttcaagtatctctttatcttctcatacccactgtgagaaggatgtggtattatctctaacttacagtggtttcaggactccattttctacaagttagagaccccaaagagcctgtgtttctctgggttacatctaaacgtatttattcttattagaaattaaagcagattgatttaaaataatcaatttttttagattaaaaataacttttctaaaacaaaaacaaaagattgccatttccctgcaattttgcaaatctctttaatgtcttttttttttttttttgagatggagtcttgctctgttgcccaggctggagtacgggagtacggtggcatgatcttggctcactgcaggcttcacctcccaggttcacgccattctcctgcctcagcctcccgagtagctgggactacaggcgcccgccaccatgcccggctaattttttgtatttttagtagacatggggtttcaccatgttagccaggatggtcttgatctcctgatctcgtgatccgcccgcctcggcctcccaaagtggtgggattacaggcgtgagccaccgcgctggccttaatgtcacttcttgattcaatctattgtgatacactgtttaggttcaagtataggaagaaaattcagccttgcgtagatatgtaattggaaaaaggagtttgtttttgtttttttaaaatagggtttcactccagtcacccacgttggagtgcagtgcagtgatctcaactcactgcaacctccacataccaggctcaagtgattctgctgcctcagcctcccaagtagctgggactacaggcccttgtcactggcgcccagctaattttttaattttttgtagagatggagttttgccttgttgcccaggctggtctcaaaactgggctcaagcaatccgcctacctcggcctcccaaagtgctgggattacatctgtgagccaccactcccagccaagggaggtattttaatagtctttcaggtaattgtgtttattattctctgatatccaccaaaactcaatggaagtaacaactttttttgtttgtttgtttgttttaagagatgatgtcttgctttgttgaccaagcacctcccgagtagctgggactacaggcatgcatggctatttgtagaaatggggtcttgccatcttgcccaggtagtctcaaactcctgggctcaagcgatttcttttgcctcaacctcccaaagtgctgggattacaggtgtgagccactgctcctggcaggttcttaaaagttagttgcagtgtggaatctgaaaggtcagtgaacgtttcatactgttaacactaaaacccattggtctcttctgaatggatctttcacccatgcatccttttataacatcatactttggtcatttagaaaatattggtgcactggcctatcgacagcctccaaatgttgttaaatattattataaatttaatttttttttttttttgagacagagtctcgctctgtcgccaggctggagtgcagtggtgcgttcttggctcactgcaacctccacctaccgggttcaagcgattctcctgcctcagcatcccaagtagctgcgactacaggtgcacgccaccacgcccaactaatttttgtatttttagtagagagggtttccccatgttgtccaggatggactcaatctcttgacctcgtgatctgcccgccttggcctcccaaagtgctgggattacaggcatgagccaccacgcccggccataaatattttaaaaattacatttgttagtatcactaataatcaaaaaacttggaattttgggaagtttcaagctcacagttgtgaatgccgcttctctgaaatgctaatatttgtttgaaagcctgaattttactattggcaacagatactgacttttgttttccttgacatgacaggcgttcacttcatgcattttcaagaagatgtctgccagatacctaagtctgaaaagccatagtttgtcagtcacttttttctttttttaaattttcatagagttttttaaagacagggtcctgctctgttgcgcagcaccactgctggagtgcagtggcatggtcatggctcactgcagcctcatcctcccggcctcaagcagtcctcagccttccgagtaactgggactataggcgtgtgccatcacacctggataattttttatgttttgtagagatggggtctcccctgtgttgcccaggctggtcttgaactcctgggctgatgcgatcctcctacctctgcctcccaaagtgagggattacaggcatgagccaccatgcctggcctagtaatttttttcaaataaaactggtattccatgaacaaagcagctagtgtaattcacaactcaaacaacacagatagatttctttgagacaaccaaaagtgtcttatgaggacttaacacatgtactcaatgattaagatttaacaacattaataattttttactgcttcatcaagggatattgttacatgcaatctagagtttttgctcttttctcctaaattatgagtgtacagtggtgaaaaatgcaataacaactagtagagcttagggtcagtgccttgatctgtgctcaggtgccagcagttgtacctatcctaggtaaatgacaacacagtgacaaaggctaatagtttaatattataaaaatagccatgtctcacttgctccctgacagtgtctcaggaacccctcagaggttcacagaccacattttcagaagtgctgttataggaggtggaactgaattgcagagaacttaaacaatttatcaaatatcaaacatttgagtagttaaatcttagaacacctcagatattgggtgtaggaggctgtagtttatgcctaattgttagattgatacaaaatgtatttactgattacctattcagtaaatgaattgtcaataagtagggaactgtttccactcaataaatgaactgtagcatgattgtaagagcagatgtgagcatccacatccttttagactcactgccctgcccctctctcattttttaagccatgtccctaaggaccttctcccaggtatacctatcagacctttcattcagccaatatgctgaatgaaatatccccccgtataccaagccctatgctgggaatacgatgaggacttggggtacttacctgcttctggaaggaataaaagttctgaagtactttgccaggtcccatggtaggtgactctttttcatctttcctgttaagaacatatttcttggttgggcacagtggctcatgcctgtaatcccaccactttggcaagccgaggcaggcagatcacctgaggtaaggagttcgagaccagactggccaacatggtgaaaccccgtctctactaaaaatacaaagattagctgggcatggtggcacgtgcctgttgtcccagctactcgggaggctgaggcaggaggattgctagaacccaggaggctgaggttgcaatgagccaagatcaggccactgtattccagcgtgatctcagctctctgcaagctccgcctcctgggttcacaccattctcctgcctcagactcccgagtagctgggactacaggcgcctgccaccacacctggctaattttttgcatttttagtagagatggggtttcaccatgttagccaggatggtcttgatctcctgacctggtgatctgcctgcctcagcctcccaaagtgctgcgattacaggcatgagccaccgtgcctggccaaaaaaaacacatgtcttatagttgagtatggttctagtatttcttcatggcagagccctggagaacccgcaggggaacagttgagggaatgtaagaaggactcttgattctggcacttaactcctgtgtttactaagtttgttatagctggattttttttttttttttggtcacctagaagcaggagagggcagagataggggcagactttgacttagcaaggtctttaactgttaacatttttcagcccagagagctgccttgctctctaaaacagttactttgtcctggttcactcttccctgagtagaggacagttacctttgtgtgcaggtggacgttcctttcaccctccttccttcctgtttcctcagagccaggactgtctccagtttggtcctcctgctgaaggggaagtggtccaagtgagatggacagacggccaagtctatggagccaagtttgtggcctcccaccctatccaaatgtaccaggtatccaaagttctacctttctagggagtggggggtgcttgattaattctgtgcttcctgttgggccagaggcgagtctttgctcttaggagaactaataggttggtaaccctttcagagctaggggtctgccctgtttccagtctgccaaatgtgaagtaaggtagttgttattttagtgttctaactccttcctttgactgtaggggactgccactgtgcatggtggaccagggaaagagtcagggatatcctagccaaaaggcctttgtttccttggtaggtggagtttgaggatggctcacaacttgtggttaagagagatgatgtatacacactggatgaagagcttcccaagagagtcaaatctagactggtgagtattttctgtgtccccccagttcctgtcttggagggagggaacaagtcaaggatgcatccctttgtattgttcctggggtagctgacacttggcttgcttattcttctatagtcagtagcctcagacatgcgcttcaatgagattttcacagagaaagaggttaagcaagaaaagaaacggcaacgagttatcaactcaagataccgggaagattatattgagcctgcactataccgggccatcatggagtaggtgcttccagggtccaagggattctcagccatccaggcaagagcactctgggttccacagcacagcagacatggaacgctgaagtctctgaaagtgaagttgtaaaaagaaaaggaatgaaataaccgacccatcatcttctcacccaccctcattgcattccgctgtagtgaaaggacgagccatttctgggcacgtggcagcagtcgctgatctcccagctgaggggctgagcactggaatgctgtggctgcactggccccagtccatagaggggtcaactatgctggctggactggctgccttgttcctggcctaggacttagcttcataactatcacctgcaccgactaggctgaggtgctggtacttgccccaacccctacttttgtatttatatgtgtgtgtgtgtgtgcgtgcgtgcgtgcgtgcgtgtatgtttggtctggaccagcttctgccagcccctggcctttactttcttccttgcctatgcagggcaaacaaaatgtgaaattctgccctcagctgagctgagtaagggctcctgggggttggctggagatgggtgtggcatctgtccaggcctggaaccgtctcaagacagtgctggcaaagctgcagtattgagatgctaaggagctgatgccacctctttgtcttcccctaaaggagaacatggggataacatgggtgtgtgcccacaacactctaggtgcagagcccctgtggcaaagtattacagggtgtgggtggggattaccctgaatcggggattttaatgatggaagcaggcagagcctggtgggtgattctgtcaacagaaaattgcaatcatgcaggggctgggagggttaggatgaaaaaactggggccattggaggcccactgtaggtgggagggagctgattttggggtggggggtgggactagagggcaatactgaaggggttaaacaggtttttgctcctcaagaatttgtttgcctgggcccaggattggagggcttcacaccaataccctgtgtatacaagaatcagatttataatacttccccttttttgttacgtatgaacactataaaccaaattattttgaaaactggtgcatcaccttgtccttagcaataaaatgtgttgagcagagga

SEQ ID NO: 27 - DNA, 293802 bp, Homo sapiens
gggaagcagccgtcggcggctgccctgagccttcctggggaaggaggagggaggtaggcgcagagcgcggtccacgcctgctcgccccgaaccatgggaagatgagacaggtaaacgcctgcgcccgcgcgcttccctaccctagggaggagcattcccgggtccgggctggcgcctgcagcaggacttcccgctcagagcccgggagtagctgttggcttccgggcgcgccgcgttgaatcgcggctgcggggtcgtcccgtccttcccggggggagcatctgcggacctacgtgggattggggtgagctgggggtggggctgagaagcagattcctttcgggagaggagtctccttaggtgagtatctctactcttcttccgatagacctgtttctccccgctctgcaggcagcctaggagaggttggcatcccttcccgtttggaggttttgtttgtttaaacttaaagggcttcccagcattttgggaaagatcaagaaatcccgttgagaatcccctgaagaaagccattgaagttgttagacattgcctattgcgccgaagatctttgatcattatcggggtctgttttttttttgtcttatttacagtctcatcgtatttatgaatgcatggaaaagttaagaaggattgacagcaagtaattatcgctgagtaatttgggattatggtcatttaaacatgtttcttttatttgtagttcctatttcttcttctgacacacacaacgaacatgtacttttttactttagaaaaaatattttaagttagaaatgcagtgttggaaatttcctaatttcatcgtctatttgagagtcgtaccaaactttgtgatttttaggaagaataatttttaagagtggaagggcattcctcccctcccccacctatttatatggacctttgattcaagagaatatattcatctttcggttcattgttgaatttattttactggaaacatgatggcatcttgtcagcgtgcttgtcatagagtctaaataaatgttggcaggggttttttgttgtttttttttttttgagacggagttcactcttgttgcccaggctggagtgcaatggcgcgatcttggctcaccgcaacctccgcctcccgggttcaagcgattctcctccctcagcctcccgagtagctgggattacaggcatgagccagcacacccggctaattttttgtattttttttttttttttttagtaaagacggggtttctccatgttagtcaggctggtctcgaactcccgacctcaggtgatccgcccgccttggcctcccaaagtactgggattacaggcgtgagccaccctgcccggcctgcaagggtcttaaaccttgagtttttatttatttatttttaacccaggccaggtttgtctagcaaggaatatatgttttagggaatcagtcacctgcctcaaactgagtgaaagtgaggagtctatccttttggtgcatattcgatttagtaaataatgagaaactcaaacttagtaacagctcttcaaatatatagagcacagactgtatgtttgaaaaaaatcttgatttttgtggcatattgaggcacatattgaggcacattccatatgttatggaaagtaaacttctagaggttgagcactgtttaggaatatagtcattttcattacttagattatcagcaataaccaataaatagacaactgcattgtgtttcaggtcaattgatccaatcaagttgatttcttgcaggaatctgtgccatccaaattgcttgatccagtgaatctgctaggaaaggtctctgaggcccccgtctgctgactgcatgacaaaccctaaaggaaatgccaatcgtgatggcccgggacctggaggaaacagcatcatcctcagaggatgaggaggtcataagtcaagagtaagtaatagcaagcctgctttcaacctgtgctttgtactctttcacttatatactcttatatactgttttactatatactcttctcttttacttatgtactcttttatctagtgtcattccttggggattatctaactctggttttagcttctatccataatgtcatttaaggtcttgttactcagtccctatcagctatgagaaatgagataaggctctctttctgggcccataagtgaacatcagctctagatgttgtaaaatgcaagtagtagctcttggtgaactcttgctcagaactcccaacagaagattttgaaatgtttaagtattgaagaaaagcatgtccaaactctacaacattagttacgtttgctaattttctcaaaagcctttacaatgataaaatggtggtaatatagagaggtcaggtaacttaccatagtaactctgaggcaggatattagagttctatagcctgtgttgtgtccattgacccacactgctttcctgagttcttttagttaagagtccaatttcatgattactggatcatcacaataagaatgaataatagctaggtgtgttggcttatgcctgtaatcccagcactttgggtagccgaggtgagcggatcacctgaggtcaggagttcaagaccagcctggccaacatggtgaaaccccatctctactaaaaaaacagaaattagctgggcgtgatggtgggtatctgtaatctcagctactcgggaggctgagacaggagaatggcttgaacctgggaggtggaggttgcagtgagctgagatctcaccattgcactccagcccgggcaacaagagcaaacctccatctcaaaaaaaaaaaaaagaatgataatgataaatatagctactacagatgacgataaaggctttatctcatctatatcttatatctttttaaatctgaaggtgttattattttcacttttttaaactcagtcttatcaggaaatttcctcagtgacccatagagagtaagtgatgcattgagatttggacttagcttttctggattttgatcactttgctcttttgcctcctttaattattgcttgacacagagtaaagagagaatctggtttaaaggtaaaattcatttttaagattctccctgagtccttttggatatgtgtgtgctatgtaacctgaaaaatagagataatatctcccaggctattttgtaggggtctggttagactcaaatagcataatgtatgtgaaattactttgtaagtgctatacaaatgtaaggcattatttttactggttttaatattgaatttatggtgggcttcttgtaagatacaagattacttgtaatttgaaaaaaattgttgaagcattaagaaagctttgaggaaacgtttcttatcactgttaggtcatagaaactaatagagatttgaaagtatatttgggtcattcttgttcaggataattaaatggataattccctctggttactttcccttcttctgactttttgctttcggtgtgctgcctcttacccatttcataaaacttttaacttctgctgcaagtatcagtctttccctttttaaaggttgttcttttactccattactgtctctcttattagtgggtttacagattgggcctgacaaatgttagattgaactatatgaaactgccattttggtaggtcagaaacagtcaaatactgacgattgcagatagtttgacctaatattatagtaggtacttagtaaattcttgctgactgaataacgaaatgaaggaataaatgaaggctttatactttacattaccttagatcagagttgttaacttttttatgccatggattccttaccagaataatgtttttaaggcttaaaataaaatacatattattacaaagagtactaattacattcaaatgcagttattaaaacacatttgtaacatagtaatatgtgctgttttactaatacattaaataataagatcatttcaaatctgggaaagttaaattttgttttctaaagacaacaacatgaagactgtttttgtttagtttgtgtaagatcagtacactgggagggtggcctttgattaacaatcataggtcgggggtactgggaagcagcatagatgtctgggtcaccagtgtgaggtgtcatcatttagtgactgaatgattattaggaggagagttgcccaattgttgtccaacctcatcacactagcatttagatagaaagaccatgatcacatgtgatctaggggtgagtcttaaactactataacttagaagtagtgacaaatgtaatacctgtaattggccaggtgcagtggctcacgcctgtaatcccagcactttgggaggccgaggtgggcagatcacttgcagtcaggagtttgagaccagcctggccaatatggtgaaaccctgtctctactaaaatacaaaaattagccgggtgtggttgtgggtaatcccagctactcgggaggctgaggcaggtgaatcgcttgaacctggaaggcagaggttgcagtgagccgagattgtgccactgtgctccagcctgggagacagagtgagactccgtctcaaacaaaacaaaacaaaaaaactgctgtaattttagataacgtcaaaggcacagataatgctaatattactatggttcgttgcctatattcataattaagaaatactgaatttctagtaaaagttagtgaaaataaaggtgtaattttccctctgctcccatccaaatttatggaccacttcctccttttagactcctactgttgatttttaactgttaatcttgtttcatcagcttatgtcttgtctatcagacacttattttttacattaggaagcttaaatcaatcttgttcacacctgaagcagcaggcttacattttaaaagttgatttagaagtttgaaggccataaatcatcggaagatgttgacttgatccaaagatgtatatccatggacatctgttagatctgctcagatccctaggctgtgttaaagtattaattccttgcaatcgtggacttcaggaatagaaactatccaggcagtcttgttttgcatggtattatttcaaatagaaaatgtaaagaggctgtttttctatattttgcttggggatcccaaatacaactctgtatgtagatatagaagctttcgtagaagaacgtgatgtaagatttctttggtcactgaaaaaatgtcaactttaattgctattgtaaaaggctggctttatatcagttaaaaagattattaacaatcaattataaagtgggtgctataggagttcagagaaggaagtatcgtaatgggctgaaggagctggggaaggctgcctgaaggtggtgagactttaggtaggccttggagagtgggcttagataaacagaagtggggaaggcatttctaataggggtagtggtatgaagacagcctagaagcaagaatgcaaaagctgcttacagctccatctttgagttatgtaggctgggtcccaggagtgaatgatgtctatttctcatgaaattattcccggaaaaccaaaatgtttttaggctttcaataaagtgaatcataaaactgatctgcttcggtaattattcaaatcctttgtttttcatgcctataaaagtggattttaatatgtaccagtttctgatgtgaatgagaatataaagtcccaattttcagtttcctaatcattctgaattttttccttttagcatcacttggtgggaatatgtttttcatgacaacttcgcatattccttaagtgctttttttttttagctgaccttactgtttactctctcttttatctttccatgggttggaaatgaaaagatttctctgttagagacttggctttctacagatagtacagttagggcctgggctcttctcagctgtgtatctgttgattgtgctccccttgtcaggcattttaaaattggagcagcaatccattgtttataaatgctaaggcatagtggtgccagctggtagctagtgctagattgacagagaactttggatagtttccagagttcctgtctgagactttgtagtttaggctgcctgtttttttctgtacttgctgatttagaaatatagtggaaaaattaaggttggaagagatcataggaatcacctggcttcatgcccacattttacaggtgttaaagatgaagaagcaagcaagccacaaaaaaatccttcctgctaaaaaaggtaccctatcagcaccgtttctcacaagtgggtactgtcaccaagtcaaagaacaagaacaataagcatccacatgccatttctagaaaacggggaataaactaggtatgctgttctttgctttcttcactagaaagcagttggcagcttgtcccaagtctaaagactgcctcactcctaagattgggagccttacagactgtgcattcagagtgtggatctttttatgtttttttttttttttttttttttttattgagacggagtcttgctctgttgccaggctggagtgtagtggcacgatcttggttcactgcaacctccgcctcccaggttcaactgattcttctgcctcagcctcccgagtagctgggactacaggtgcgggccaccacacccagctaatttttgtatttttagtagagacggggtttcaccatgttggccaggatggtctcgatctcttgacctcgtgatctgtctgcctcggcctcccaaagtgctgggattacaggcgtgagccaccgtgtccggcccgagtgtggatctttttaaagttggattgggaggggctgacttggccctgagatttgtggtatgacctttgttaagggatgtggttatgtgagtttttaagagtcgagtgaatcttggccaagtggattgtattgcatttaaggaattatcagtttaagttcccaaataattgaattcaaggtatccaatatatacaactttgctgaaatgcgattagggaggcaaacagtagaaagaatacagatgttaggttcaaatacctcatcccttacttaaccagctatatgaccttaggcaggttacttaacctttctgagacagttttcctgcagttcatagtatgggcagggggattaagtgagatatgagagctcttagtttaaatcctggcacatagtagggactcagttcatttaattttatttctcttcctacctccctgccctaatgagggtgaaggtttttctgatctgtgagtaaatattcatcagcctaaaattaagctgagatttcctgaggatagggaaagagaataaagtcagaggtctttttctcccctgtggttttatactggaggaaaatatatattgttccatttagcatgggcttcctttaaaatatgtgattttaattgggatacttgtattaatttagagttcctagttcagagtcttaggatgcatcatcaaattggcttgaaaatggactatagcgtgtaaaaggagtatgtaaattattgtgaactcatcagttaggattctttatgtgtgcaaaggattacaacataatccaaatggtcctaagtaataaagagaatactttcactcatattcaggcatatcttgattctgaaaatcccactttatctcttcagtcaacctcctgctgactttctccttcaccaacagctacaggctcttctttcaaggtcacaaaatggttgttgcccttccagacttctcattctcatcctataccatcaagaggaagacaggctatcatctgtagccattatagaagagaaagaaaccattgctttctcacagagtccagaacatgtctccttaaacttatgggctccaattggtttatgtgcctatctctgaaccactaattatactggatgatgaagtatcttgattggctgaaaccaatcaaggcccatccctgaaccagggatagagttaattttaaacacacagctaagaatgggagatgtgatttcccacaggatatttgggatttgtattccagaaggaaggggaaacttgctaagcaacaaaccatagtaatctgcatcagcagttagttcaggttttgagctgtaaattaatgaaggcttttttgtcgttatagggatcatccatgcatcatgtggactggaggctgcaggagaattccagttttggtattccatgccgacgctattcttacaaaggacaacaatattagagtaattggaggtgcgtataacctctcccacagaggacggagctgggcatggcccagacgtccttgtcttaaagaagttgatatgacatatatatagggaaagggccttggccatgagaaaaatcaattgagttgttatacttcaaacattataatttcttaaattgttttctgcttatgtttttcctctgattttttttcaagaatattgtgtacatgtgttttttttttaattgtggtaaaatacacctaacaaaatttaccattttaaccattttagagtgtacaagtcgttgttgtttagtacattcacaatgttgtgcagccgtcaccactgtttagttccagaacattttcatcatctccaaagtacagccaatacccattaagcagatatccccagcccccataccaccagtccctggcaaccactcatctattttctgtttttatagattcccatattctggatgttttatataaatggagtcatgtgatatgtgaccttttttggcaggcttcttttcacttagcataatgtttttgaggttcatccatgttggagtatatatcagtcctttattcctttttatagctgaataacattccattgtatatgctaatgaatgcattccaatgatacaccacattttgtttatccagtcatcagttgatgtacattttttttgtttccacctttttttttaattttgtttttaaaatttatttattttttagatacaggatctcactgtgttgcctatgttggtctcaaactcctggccttaagcaatcctgccttggttacatgcataatccactgtgtctggcctttttccaccttttgtctgttgtgaattgtgctgctatgaatgttcacggaaaagtcgtttggacacttaatcttcagttctttggggtatacctaggaatggaattgctaggccatatggtaattctgtgtttaacttattccgtgtcaaactgttttccatagcagctgtaccgttttacattcccgtcaacaacgtataggggttccagtttctccacatcctcactaacatttgatattttctgtttcttagatcatagccataccagtgaatgtgatgtggtatctggctgtggttttgatttgcatttccctaatgagtaatttgaatatctttttatgtactttttggccatttgtgtattttctttggagaaaggcctattcaagtcctttgtacattttaaaaattgggttttctttattgttgttgaattataagagttttatatgttatggatattagacaagatatatgatttacaaatattcttactctgtgaattgtctttcattttcttgttagtgttctttcatgagcaaaagttttttgttttgatgacatccagtttatctaatttttcttttgttgcttatattctttgtgtcatatctaagaaaccattgcctaacccaaggtcatgatccctgtgcttttttctaagagttttatggtttaagctcttatatttagggctcaatagtctttgatccattttgagttaaatttttcatgtagggttatgtaagggttcaccttcattcttttgcatttggatatccagttgtctcagcaaaattagttgaagagactattcttttccccactggatggtcttggcactattgttgaaaatcagtagaccataggtgtatgggtttacttatggacttttaatatttcattgaactatacatttatccttatggtagtaacatactcttgattaccgtacctttgtattaagttttgaaattgcggattgtaagtcctctaatatagttctttttcaagatctctggccattcagggtcccttgcaattccatatgaatgttaggatcagcttttcccctttcttcaaaaatggctgttgggatgttgatagggagtgcattgaatctataaatcacttcttagagtgttgccatcttaatgatgttttctatgaacatggaatgtctttccaattttttgggcttctttaatttctttcatcatggttttatagttttctgtgtacaagtcttgtacccccttggttaaatttattcctaaatattttattctttttgatgttattgtaaatagaattgttttctcaatttcatttttgggttattcactgctagtgtatagaaatacacctgagttctgtatattgatcttgtatcctgaaaccttgctgcactcatttattagctctaatagtttttgtgtttaggtttgtctgcatgtaatatgttatctgcaaatagagagaattttagttctttctctccaacgtggatgccttttatttctttttcttccctaattgttctggctagaatttctagtacaatgctgaatagaaagagggtgtctttgtcttgtttttgatcataggaagaaagctttctgttttctgtcattgcgtatgatactagctgtgggttttcataaatgtcctttgtcatgttgagaaagtttgcttctattcctagtttgttgtgtgtttttatcatgaaaaggtgttagtcaaatgctttttccacatcaactgaaatgatatttcccccttcagcctgttaacgtggtacattacattgactgactttttgtgtcttgaacctcccttatattcctgagataaatcccactttgtcagagtgtaattgctagtattttattttattttgttttattttatttttttgcgacggagtctcgctctgtcacccaggctggagtgcagtggcacaatctcagctcactgcaacctcctcctcctgagttcaagcaattctctgcctcagcctcccgagtagctgggattataggcgtccaccaccatgcccggctaatttttgtatttttagtaaagatggggtttcaccatgttggcaggctggttttgaactcctgacctcatgatccacccgcctcggcctcccaaagtgctgggattataggcatgagccaccacgcccggcctaattgctagtattttgttgaacattttttgtctgtatttataagggatattgatttatagttttcttctgatgcctttgtctggctttggtatcagggtaatgctggcctcatagaatgggttcccttcaacctctgcttgctgtaggtctattcatattttctatttcttcttgagtcagttttggtagtttatgtgtttctaggtatttgtccattttatttagcttatctaacttgtttgcatacaactgttcatagtattcttttacaatccttttcatttctgtaaggtctgtaataatgtccccactttcacttctgattttagttatttcagtcttttctcttttttccttagtttagctagaggtttgtcaatttcgttgatcatttttattttattctttttgagtgacaaagtctcactctgtcacccatgctggagtgcagtggtgtaatcctagctcactgcagcctcagacttctgggctcaagtgatcctcctgccccagcctcctgagtagcttggtctgtgggtgtacaccaccatggctagctaattaaaaaaaaaaaagctttttgtagagatgggggggtctcactatgtttcccaggctggtcttgaactcctggcctcaagcagtcctcccagctcagtctcctaaagtgttgggattataggaatgagaatttgcacctggctttgttgataattttaaagacccaattttaaaattccaacttttgctttctcttgttttctgcattgtttgtattttatcaatttcacttatctctgctcctcttggattttaagcagtgctctgagccctggtgttagtctgtagccatcttcaaaggttataacactgtggatcaggactgtcttgtggtatggtggaaagagtgtacacttgggttctcagccattggttcaaatcccagctttggtatttcttagctgtgagtcttgggcaagtgacttagactcttttaaccggtttcattattagtaaaatcttaaccagtttcattattagtaaaatcattagtaaaatggagagaatatgatattgtgaggattacatgagctcatttaatgtccgacacatagtaggcgctcaaaacttgtgctgcttattttactgattgaataagatctactctacttgtaaatgacttttgtcttgtcccttaataagtcaggagttcagaggactgttagcattgcttctgggatttgaatcctccttcctccccaaggatccttgtgttctagtcacctcagcaagttgccaagttaccatttaaagggaagtggttcattcatgttctctgaagcctgagtaactgaagaccccttgctgagaaactccctctaaatatgatttgagccaaaatgttaaaggtggataaaaacaaatattccccccaaacatacttcttttggtctgcttgtcacataaagtaatcgatgtattctatggcaataggcggacccttcttttttagaatacctaacatttattggaaaataatatccatcaatgtcatctatttaagcaattactatttttttaggatccataagtctttttctttacacattcctgtgattaaagaaaaagccaccaaacttttctcaaattctgtgtttttgagttttctgtatctttcccagttccttgtggcttaataattttcttcaccttccttaatgaaaagaacaatttgaatgacttttggtagttgctgcctcagttttctgtattgttaaatactctcaatctgcaacttttctttttggctctcttaaatagctgacacagatctgttcagatcataagcctgtggttaaatccccctgagaagtgtatctggggcaatagttaccttctgttgatctcatcgtgttagatgccaaattggttttttctctttatgacatgtttcattgaattcactattaatatttttggtacaatatgatttctcgtgttttatttgtgaaatattccaggaatgtggcttttcttcattataaccttgtttttttcccaaattgtatgtactttaaatgtgtaaatgggattgtattttagagacaacataggtattttcagcttaaagtaaacttctagaatgaagcatttttctgtaatttgtccctgaatgtgtttatttagtaagtttgtatttgtatatactagcaatagatgtatgatgcaagctatatatgtgatttgaaattttctagtaggaaattatttttaaaagtaaaaggaaacaggtaggtgaaattaattttaataatatattttatttaacccaatatattccagaatattatcatttccacatttactcaatataaaaaaaccattaatattttatatctagtatatattttaacataacagagcatctcaatttgcaaaattttcattggaaatattcggtctatatttagattttataacttttatagtttaaaaagtaaattcatatactcaattgtttcttcccctccccacaggcaaattgtttaaaataggatttccagtaactgaatcaagtattcattcttaaatttaaattaactaaagttaaataaggacatttcaagtgcttattagtcacacacattcgacagcacaaatatcctaatcctaattctaggtaacctaattttctgatactagggcacagctacactatgttgccattaaaggagttatttttgtgttctacaagtcaaaaatgtcagctttatctttatcctatttcccatgctatttttgtttaaaccctttaaggcgtttcattgctctctaggtacttctctgtgttgacagttagattattggtttgttttcatttgctctgctgtggtctgtcctggaacttgctaggggtcctagcacttcaagttgcctctaggggcacatgtgagtggttggagaagaggaaattctgtggtctcttctatggtggaattgatgtgatgcatgttaagaggcttagaaataggatatttggcagtttgctagtagtcaaggaggaccatgctctgcctcatgtttttatacagaagaaaacatgggatgaggtggttctttcttaggcagttgggcagcttcagtttacagttgcaatcttccatttgactcttgtcatgggagagaaagcctaggcatattagtcagagttcttgttacgggagagaaagcccaggtacatattagtcagggtgttccagagaaatagaaccaataggatacaaggagacagggagggggaagggaggaatgaatgttgttataaggttattggtttatgtaattatgtaagctaaaaagtcccattatctaccatttgcaagttggagaccctgggaagttggtggtccagtttgaaagcctgtgagccagagagccagtggtatagattccactctgagtctgaattcctgagaaccaggagtgtcgagggcagagaaggtctgtgtcccatctcaaccagtcaggcagagagagagcaaaaccaatcacccttttgttctattcttgccctcaatggattaaatgattcccacccacatttgggagggtaatctgctttattcattccctatatttaaatgctcatctcttctggagacatcctcacagacacctataaatgacatttaaccaggtatctgggcatcctgtggcccagtcaagttgacacataaaaataaccatcattaccaggtttcttaagagaagcctagaaatctatatttttatatgaatttttccaattttcaatggcttagcaactaatttagttttattttgaagcatcgtgagtgacagaccacatctgcaggctaggtctggttcttgggtcactaatttgtaacctctagtctaaaatatactacccaccagccttattgcacacagagggctaccggacacagagtatatatgaactaaaaatctccagcagtgatgtttgcattctgtcattccacccttctttttttgcactactcttttggaacatgttcagtgtatctgagttgggttatagttaggtgatatggattagaagtggcttgtcactgcttactatttatgtattgtaagaatcagatttgccactgagtgtggtggcagttgtatttttcttttatattaggaggagtaggagaaataatattgatagcattttacttttttttttttttttttctgaaacagggtcttgctctgtcacccacgctgaagtgcagtggcatgattacaactcactactacagccttgacctcctgggctcaagcaactctcttgcctcagcctcctgagtagcttggactagagacatgtaccaccatgtctggctaatttttaaatttttgtagagacagggtctcctatgttgctcaggctggactcaaatttctggcctcaagcagccctcccatctcggccttccaaagtgctgggattacaggcatgagccaccacacctggcccattttaattttttaatttgctatataaaatgtataattatgtacagtgcatatactaatgacttttattatttttttactatataaaaataatttatactgtgtagaataattgtttcatagctttacatgtattaactgatttagtgcttacagctactctatgcagtaactactgttattatcaactccattttacaggtgaggaaattgatcatagagaaattaaacaatttattgaaggctacagggaggaagtggtagaatcagggtttgaaccctagtttgattctagagattctctttctctctctctctctttttttttttttttttttttttgagacagggtctcaccctgtcactcaggctggagtgcagtggcctgatcatgactcactgcagccttagcctttcaaggctcaggtgatcctcctgcctcagcctcccaggtagctgggactacaggcgcacagcaccatgcctggctaaattttgtatttttagtagagatggggtttcaccatgtttcccaggctggtttctctctctctctttttttaagagacagggtcttgctctgccacctgggctggagtgcaatggtgtgatcatagctcactgtaactttgaactcttgggctcaagcagtcctcttacctcagcctcctgagtagctaagactacaggcgcccacccgtacacttggctaattaaaaaaaaaaattttttttttttttgttagtgacgaggtctcgctatgttgccctggccgatcttgaactgctggtctcaagcagccctccagctccagcctcccatcgtactgggattacaggcatgagccaccatgcccagacttgttattattcccccttgtctcttattccccatgtaactgttctctattttctcacacaccttactgatcacctcccctgtggctgggcagtgaggggcaagcactgcagaacatgcacagaattgggttcagtccttatttctagcagtcactgtgtagctgatgatgctttgacttttcatgtgcaaaaatgttagtgatcatggttatcataatgaaaggaccagatattttttcatttttgtacacattttatttagaaaaattaaaaaccttcagacaagttacaaaaatagtacaatgaacgcatatagtctttccctggaatcacccattacttacattttgccatatttgcttctctctttctgaaccatttgagaattagtaaaatattgcatgccctaatacattattcagcttgtgactcctgagaataagggcatattctatataagcacaataatgtgtcactggcaaaatactgttatctaatccatagatctaatctatgcagatttccccattgttccaatttagtcttctatagtggttttttgtttttctattcaggatccaatcaaatattacattttgttgtcatatttccttagtctactgtacagccatttcctagactttttttttgtcttccatgacattgacatttttaaatattctagactgcttgttttacagatatccttaaatttgattgttatccatgtttgatggttcctacatgtttagattcagatttttaaaaatctgcaggaatattgcttagtgaaactgtatccccagtgtataacatttgggagtatgtgatgctattattttgcagtattggtgatggcacatttgatcatttggttaagactgtgttcaccagatggcttcattttaaaggtgccttttccctttgttataagcattctctggtaagatattttgagatgtatgcgtgtcctattccctaatagcctctccccattggtatctactgattcttgtttgaatcacttactcttatagtttttgtaaaatggtgatttttcatttctgtctttccttctacatttattagctggattctctgtaaataatagctttctcttgtgtggtaggcagaataatggtcccttaaagatgtctaccttctaatttccagaatctgtgaatatgttatcttacatggcataggatgaattaaggtttagatggaattaaagttgctaatcaactggccttaagataaggagattatcctggactatccaagtgggcccaatgtaatcacaagagttttttaaagtgggagaaggaggtagaagaggccagagtgttgtgatgtgaaaaagactacatgcaaccatggttgacttcaaagatagaggaaggggaccataagccataagccaaggaatggaaaagggaaggaaacaaatcctacccagagcccacagaaaggaacacagctctgccaattccttggttttagcctggtgagacctgtgttcgacttctgatgtacagagctgtaagacaataaatttgccttacaacaacaaatgtgttgtaatttgtcacagcagcaaaagaaaaccaatattccctctcgactccttgtaagtgtggatacatggattcttttataagtacattataatctatctctatcactattcatttttgcattcaaattgtcttaaacttggccctcaagagcccttttaagctcttagtgacatgtccctaatcagtttttgagtatttcccttttttgacattgcaagatattctaagcctattttgtgattcccacacatgattctgcagtgtttcttatgatgatactgcaaagacaaagtaatagtgactgatcactgggataacactgttacttggctttgaaagtttgcccacaagaatgaaaaggacgaagtgattgacattttaaatgttaatcctcctgtgtctgctttgcatggtgttcctgccagtgctgagtaagtagcagcagagatttatgaatatcttcacataaacttgaaagagaaattgttgtctttgactacagaggctgaatattgttctagagtctgtccatgagtgtctgtatcattcagaattgttcaattcagaaactgttcaatatgaagtcctctaaaaaaattcttcagcagaattcttagctaactttttcagttagtagtggtgcatagaaagagattgaattcagtggtccagagtaaatacattgaaatctcacatggtttcagactttccgctcccatagtggtcacaagcacaaacgcttacttggccctggcaggaaatgtgattgagtgaggcaggctggatcctgagctgaactgaagagtgtggcctgtcctgaatggggcaggtgcagttctccagctgattcttgccattggagagaagaaagcccaggtttccaggtttttttaagagacgtctagaaatctagagttgtatacgaattctttccatttcagaagctaagcaatgaattcaatttcatttttagagcaccatgagaaacaaaccaaccatgtctgcaggctggatttcatccttgggctaccagtttctaacctctggtctaagatgtactggtaatcagcattataggatacagagggctatctagagcagggattttttttttttttttttttttttgagatgaagtcttgctcttgtcccccaggctggagtgcagtggcatgatctcggcgctcactgcaacatccacctcccgggttcaagtgattctcctgcctcagcctcccgagtaggtgggattacaggtgcgtaccaccacacccagctaattttttgtatttttaagtagagatggggtttcacaatgttggccaggctggtctcgaattcctgacctcaggtgatccgcccaccttggcctcccaaagtgctggagttacaggcgtgagccaccatgcccagcctagagcaggggtttttaacctttttggtacaatagatccctttggcagtctggagaagcccatgggcctcttcgcagaagagtgttttaaaatagatttttaaaaagtacgtaattacaaaggaaatacattgtattgaaatatagtaatcagaatattttttaagaaattgtgacatgtgcttttttattagtgtattaaataacaatctagtgaaggtctattaactactataatctttaaatactatgagaataattgatattttgagatatactgtaaaataatattaaaaatatctgatgtctgttagtggcagggtcacagataatgttaatactgcctgttttgttacttaaaatcttaattgaagccattgttaaatttcaactagaaactagtgaaaaccaaggtgtaatttttcccccatctatgtctaatgacctccaaagagtctcattttaagaactcatggtccaaaatacgttcaacttatttataatcattttaatggtagcatgtaatgttattgagtataattaagccaccatgttacagtttatttttgtttttacagttaactttctagttactgaacttgattctgtttttctttagaacgttatcatttgtcttataagattgtacgaacggacagtcgcctagtacgcagcattctgacagcccatggatttcatgaagtaagtttatttttaatacctcacctgatctgctcataagctgaaaatcccagccacctaactgactttaccagttaacagggccagctccaggaagtacatgggaccaatgcttagtggtggtccagaactcagattgaattttggagtggctttaccagtttctgcttgcaatacatggaaaacgtttccagatgattttagaaaaaaattttttcttgctacgttcttgggcttgggctaggggcaccgttgcccataaggaattgtctgacacccaattaaggttctttgattgcaggcaactgaacagactttgcttaacttgaaatggcaggtggatcccaaggtcaggagatcgagaccatcctggccaacatggtgaaaccccgtctctactaaaaatacaaaaattggctgggtgtggtggtgtgcaactgtagtcccagctactcaggagcccgaggcaggagaatcgcttgaacttgggaggtggaggttgtagtgagccgagatcacaccactgcactccagcctgggtgacagagtgagactccgtctcaaaaaaaaaaaaaaaaacaaacccaaaagggatttgtcagaatgatgtgcagaggggactagcagaatcagagaaaaagctgaaaaggcaggcctttggaaggagagagaccaggacaagccccaaggatataggaacaggagtcttcagcacagccagggaaggtccccgagtgaaggtcagatggggagaggcctgcatggctggcaccgaggaggaacaggagtgttcaggatcattttctcaaggcactgccatgggcgtgactggactccattcattgtccttttgtctttccttgctcaaaaatcacattctggagatagaatgattggcctagcttgggtttggatccactccttgcaggaggggatgggtgggtgattgacaggttcttgaaaaccatggagtaagtcattctccaaagaaagttggaagattggaatgtaaacatcaaaaaggacaggcaaaaaggctgaacagacacttccactatagacactttgtgacagttgataaaagtctggttcctagcttgagatttgtaagagacattttgaggaagtttttttttttttttaattttttatttttagagatggagtctcactgagttacccaggcaggagaacagtggcatgatcatagttcactgtaggcttgaactcctgggctcaagtgattctcctgcctcagcctcccaagtagttggtactacaggtgcatggcaccactcctggctaattaaaaaaaaaattttttttatagagacagggtcttaatatgttgctaggatagtctcaaactcctgagctcaagcgctcctcccgcctcggcctcccaaagtgctgagattacaggcatgagccaccgcacttgtccgtgagggaagttctgataccagtttgtatcctgtcttgttgctgttttatttctggcacttaacatggcgccttattgttgaattaatggacaaaagaattttaatggatgaatgggtgaattctaagtcggtttgctactataaggtttatctctgatcagcacttcatactcagtttctgcaaggataaggaaagcctgagaaagaaatgcaagaatattaagagacatcatgggtttctatagaagggttaatttattttagtttctgcatcggggatttgcccaaccctcccattccttgaacttgttctgtgatacactgcttttgtctcactaggctcacgtactaattgggccaccccggtgagtacactgtggatgaaaaaatcactgtggctttttctgccattgcttttcctggagaaggggtatctctgatgtttttttgccttcttgtctttctgtctgccctcaggttcacccaagcagcactgactataacctaatgtggacaggatcccacctgaagcccttcttactgcgcaccctctctgaagcacaaaaagttaatcactttcccaggtaatgctctttgtagctgctttgcttcatttaaaggtacatgacattggggcatgtagccagcaaaggtaattagtgtccttaaagaagaggaagatgaaaatgaagaagaagaaggacttttttttttttttttgagatgagtatcgctctgtcacccaggctggagtgcagtggcatgatcttggctcactgcaacctctgcctcctgagttcaagcaattctcctgcctcagcctacccagtagctgggaatacaagcttgcaccaccatgcccggctaatttttgtatctttgggagagacgaggtttcgccatgtaggccaggctggtctcaaactcctgacctcaattgatctgcctgccttggcctcccaaagtgctgggattacagacatgagccaccacgcccggccagaagaagaaatttttctggtacggaacagcactctgcaaatcaaactgttgtgttcatatccctgagcatgaatgaacactttctaagggctatatagacatggatggttttaaaggagatagtttctggttctctttcctaaagttgagctgcttgggagtacctcatgaggatgggtttgcctttcttacttccccttcacagttactgttttttcacttttattaaagaatggctcacctagaatcttagtctggtatattgtccttaggtgtagaaattttcagggttccaaagaaaggtagaaaaaaattagtgtctaatttaattctagtaatagcataacaaatcctttttgcatgatggtagtttctatttctttgtttttaaaataattgaaggatgatataatctagctattagctgatcattaaacataattttgatgacagatcattttataattttttgatgtgtaattaggaaggagttcacagagttgagcgtcattggtgtttggatgaattgtatactacaatacttgcaatgataatcagtcatgtatatataaacagttatagccttacggtcacagggaattaaaaatatatgccaattcctatgtataattttgctgtacagaaggtatgatatgatgtaaaagacaagtattaaatacgttaggctaacctgttgtttgtgggaaatgaaagaattaaaaacaagagtgactgggggatagtgtctgtgtggcagtctgagggaggcttttctggcatgctgggaatgttctatacagaacttgagtggtggctacacagttgtgttcactttgtaaaaattcattatgccctgccgtgttctttgtatacttttctgtacatacgttaacttcattaaaaagcatattttaaaaagtgaaaattttactgacagagcttttcctttaataacattttaaaaatgaggtattgaatcttgatgttgtttaggttcccttcaatatacttaaaagtgtggtgttggctaggtgcagcggctcatgtctgtgatcccagcactttgggaggccaaggcagacagatcgcttgagccccaggagttggagaccaccctgggcaacatggcaaaaccccggctctaaaaaaaacaaaaaatttagctgggcatggtggcatgtgcctagcaacttgcgatgctgaggtgggaggatcacctgagtttggggtggtcagggcttcagtgagctatgattgtgccactgcactccagcctgggtaacacagagagactctgtctcaaaaaaaaaaaaaaaaaaagggtggtgttatgattttgtcttaatgtaatatttaccattcatcatattctttggaacaatttaaatttatgatgaaaaatcttacatgctagcttaaacatgcaagaggatatatagtttccccaaattattctaggatgtaccaagcaaagaagtttgaaaaccactgatgtggggcatctgtaggagagtgcattctttttcttagcctctggttcagtgtttgtaattccctaatgataagaattacctagggtacttttgcaaaatatgcattctcaggtcccattgcagattcatggaagttaccatctctagagaaggtgtatatttgagcactttcctagttaccttacctttccaggtaaatatgtacctagaaagctatatatttaaaaagcattgaggtaatttgtaacagggaagtttggaaattactgttgtagattacatcagcagttagtgtgggtcctggaccatctgtatcagaatcttctggggtacttgtttaaaatgcagaatcctgggcttcatcccagaattttgagaggtgagacccaggaacatgcattttttaggaagttctctaggtgattcttacatacactaaaaattgagtacctctgctctggatttcagaagagggccgtagataagaaagaaatgtttgtggtacctagatttgccaaagcagtttctgaactcatagaaagaaatttgaactgtggaacaggttgagtaagtttttaatgattaccacaaaggttcttagttggttttgaaggagtggaacaaatcatagatcaatgagtccagtcgaggctaaccaaggtgcctttttggagtactgtacacaagaatgtacccctgatataatagtaattattaccctggttttaaggtgctaattgccccgattttctttataactttgcctcttctatatccatctctcaatgatgtagttaagttctcaacggggttcctaacctgggtctttactgtaataggatcattatactctaaaattaaggcctgtcttgggtcccatctggaagggtcatttcaggcccgtggtgctagtgatgataagagttccacatagttacatgagaggttgggcagttattgctatggcaatacatttataaacgtggattagataaccatgtgtttgattttcctggacagtcctttttaaaaatatgctaaatgcttttccccctaaaaccaaattaagataacatctcagaaattctgatgttttagtagctaatctttctcaatttacattctacttagaattaactcagaattttttttttgccatgctatgtttctcagaaggtcacatctgtagatacctgtggtataaaaacttccagaatgctttggtttgggagcttgcttttagttggagtactggtgtttttttcactatctgagtaatccagatgattttatgctattagagaatcatgattccattaaagtaaaacacacaggggtcctaaaatattttataatgatttataatagtgaatagcacagactctgttgaaggttttgaagctagaatttctttcacaggttcggtttttataacctgaaattttgggtatatttatcaacagtcaaacttttttgttgttgtttacttatatttgaaatctgttttagaatagatttttatacctgtgaatcaatttttaaaaacccatttgaaataagggtcatagacctaaaaataaaacataaactgtaaaacttatagaagaaaacatagacaagatctttgcaaccttgtgttagacaaaggattcctagatgcaacaatagaagcacagtcataaaaggaaaaaattgataaatttgacctttttggtttttttgtggggggacagtttcgctctgtcacccagtctggagtacagtggtgtgatcttggttcactgcaacctctgcctcctgggttcaagcgattctcctgcctcagcctcccgagtagctgggactacaggcatgcactacggctggctgattttttttgtagttttagtagagacggggtttcatcgtgttggtcaggctggtctcgaactcctgacctcaaatgatccacctgcctcagcctcccaaagtgctgggattacaggcgtgagccaccatgcctcacctaaatttgaccttttaaaaattaaaaatatctgctctttgaaagacactgttaagaaaatgaaaaaacaagctatggactggagaaaatatttgcaaaacacataactgataaagaatttgtgtccagaatatataacaaactcttaaaactcaaccataaggaaacaaacaactttatttttcaaagtgggtaaaatatctgaatggatgcctcaccaaagaagatacagggatggcaaataaaagaggctcgtgaaaagatgctcaatagcattagtaattaatggaatacaaattaaaactatacaaagtatcagtatacccgttagaatggctaaaaacaaaagccagaaaacaccaagtgtgggccaggatgcatggcaactggaacacttttgctggcgggaatgcagagtggtatagccactctggataactgtgatcttgtgaaatatgtagttagtcttcctcgtgtttcctgacatataactccttggctccttggaatctccagagtgagaagtgtccttttatatactaatgacttaactggtgcctggcagtccctaggtagcttccggatggggattggttacaagaaaagaccaaggcatgattagagggttataacttccagcccacccctcagcctccaggaagggaagaggggctgaaagttaaattagtcaccagtgtccaatcaattatgcctgtgtaatgaagcttccataaaaacccaaaaggactgggtttggagagcttctgggtaacagaatacatggagattcttggccagtagtgtgcctggagatcgcatagaggttctgtgcctcctttctcatacctcgccctgtgcatgtcttcctctatatcctttgtaatatcctttttaataaaccagtaaacataaatgtttctctgagttctgtgagctgctctaacaaattaattgatcccaaggagggagtcgtagggatgcctatttatagccaggtggttagaagcacaggtaaaacaacttggggcttgctattggcattggaagtgggaggcagtcttgtgggactgagccttcaacttatgggaactgacactatctcgaggtaggtagggtcaaatttgagttgaattagaggacacccactgcaagattgcttgctttgtgtgtggggaaacacacatttggtgtctaaagtgttgagtgattatgttgaattgagagtagagagtaggaaaaacactttggtttttcctcaatatctcagaatatagcaggagaaacggagcttgttttcctcagaataaccatttggcagttcattataaagtttaacatatgtggtgattgtaaaatgtgtccataaattctttgacattgttttcaaaaggtttaacttaatttttctgttcttgagtgttgactggatttagtgacttgcctctaactagtggaatatgacagaagtgattatcgcttctgagactagattgtaaaagacattacagcttcttgctcactttcttggatcacttgatctgggagaaaccagttgtcacgtcatgaaggcacttggccttatgaaaaagttcatgtggggaggaactgaggcctcctgccagcaggcagccccatgtgagtgatgagccatctggaagttgggttttccatcctctcttgagcctgatgactgcagtgctggccagtatcttgactgtaacctcataaaggaccttgggacagaaccacctagctctctcactcccacattcctggccccagaaactatgaggtcataaatatatactgttattttaagctgctgtgttttagggtaatttgttgtacagcaataaataactaaaacaacttactgaacaaccaagcagtcccacttctagagaaataaaaacttacgtttacagtaaaacttacaaaaacgtacattcatataaaaatctatatggaaatgctttatagcaactttattcataatctccaaaaattaaacaatccaaatgccttcaactggtgaatggataaccatggtacatctatacagtggattactactgagcaagaaaagggacagaatactgatacatgcaacaatgatacatttcaaatgagttgtgctcagtgaaagaagctagtctcaaaaggatacacactgtctgattccacttatttgactttctggaaaaggcaaaattataaggacagaaaacaaatgaatgttttcccaggggctggaggtgattgggagggtccactacagggggacttgaggtaactttttgggatgttgaaactgttgtttatcttgattgtggtggtggttacataattgtatgtgtttgtccaaactcatagaattacacattaaaaagggcaaattttactgtatggagattttatcttaatgaaaaaatctgaccaaaaaacccatttgataaaaatgattaataagccttttggattaacagcgatatgtttaggatacaatactatcttcactaaccggtctaggactgtgaactgtaactctttagaatgtgataacacaggaaaattctgagtcatagtttactgaatggaaatacttttttgatttttcaggtcttatgaacttacccggaaggaccgactgtacaaaaacattattcgaatgcagcatacacatggattcaaggcttttcacatcctcccccagaccttcctcctgccagctgagtacgcggaattttgtagtaagtgcttgacagagaatgccccagtccccagcaactgaacctggggaatatttaccccaaaagcctcctcaaggtgtcaaccaatcagggctttccaaatccttagacaactgtgactctttagtaaaacagttgcagaggtaactttaaaaactatttttattctgatatgttcagtaaacttgtcagtatcatttatgtaagggcacactggcatcatataagcatgcccctgtcttatgtattttttgcttgaatgtcccttctctccattgatgacttagtgcctatgtaagtattatttttttttttttaagagacagagcctccctctgtagcccagaaccacagtggcacgatcatggctcactgcaccctctgcttcatgggctcaagtgatccttcctcctcaacctcccaagtagctgggaatacaggcatgcaccattaggctcagctaattttttaattttttgtagagatgggatctcgctctgttgcctgggctggtcttgaacacctgggctcaaaggatcctccactcttggcttcgcaaaattctgagatgacaggcatgatccaccacacccggcctgtaaggatactttatattcctgcatgtgaattatacatgcttccttttcggtatccctttttcgcttgccatttaagaacattctttcagccttgatttcttgtcttctgtaatttatgttctttgagggtagagatatcgcatatctttggatgttagggtttggagctacaagttagtcacattctctcccctttgagttcagactaataaaaaaaaatacacgtaggagccaaataggcacctaagtgtcagctgtatggctggtaaagtgacacagaaacacatggcctggatccagatctaaaatgggcttcttatttattttgcatcattgtgaacttacccacccaggccaggcagaggcgctgggctggtttcaggctttcctccacaggggcagagcctgactcagtaggcttaatgcacagaagagacatgagtacagatgagatgtgaggcaggtctcttgtgaaagtccaaattacggtggtaatagctaacatttactgaatgtttactttctagtaggcacctctactctggtagtattttagatgaggcgactaaggtacagtttggttaagaaactttccatgagttatgcagcttgcaaatggtagagttagggttcaaactggcagtttggcttcagaggccatgctcttcgtctctgtgcttcattgctaatggcactgggcagcgtgcatgcaatgaccattccccagtagcatcggtgtgagagaagtcacttctcccatgaggaacatcaggtgagacacacagagaggacagttttcctcccaagaagtccaagaaagatactatttctgttttatggatagacgaagtagcatggggagaagagagagttatctctagacttcctgacttttgattcttttaacatgttaggcttgccagtctctctgggtcacctagtgggttgttcatcttttggcagaggagaccagcagttcatcaggaatgcctgcttcaccatttatctaatagcgtttgttgctctatctggggccattggttggcaattcattgtttgcccacagatggctctgcagtgggtcacatagagcactaattaaatgaatcaacttcagaacttcagtgcactcaaagctgcaaatttgtagtcaagaaattttttgctatgtgactttagccaagttactccaacttctgtgtgccttaatgtccgcatctataaaatgggagtattgctggtgctgaccttataaagttgtcaagatatttaagtaggttagtatgtggaaatcacttgggatagtgcctgataggggtggcttgataaatgtttaatactatttcctatttcaggctatgtttgtattagtaatagttatgtttaactactcactatattaatactactatgtttttactatgttttactattttatttttgtatgttttgtttaactactaactaaagttgtagttatgttattaataactactattaattagtattagttaaacaatactaattaatattattatgttctggccctccagtgcttaattgagtgtgggcaataggaaatttttttggaaggaaagggacaccataaacagactggcctttagaaaaataactatgtgaaatgagtcggtggaagcagagagaagaaactggtggtctctttgaaggttactgcagtgaagtggataaaatggataggtatgagtagaaagggtgcaagaacaaacattactgcctgtgtatggggagcgaggcaggggtcaaagaggaatcctaaggtttgagtctgagtagctaggaagaccattgggtttttaaccagggaatgtaaccaggaaggcaaaggaggagctgttaaaggggtagaggaatgttacattttggacagggtatggatttggatgtcgatggggcatccaggtagtgtgttttgcaggtggcagttgtaagagcaggtttgagttctggccagagatgtagattctggaagctgcagtatggagatgggtgtgattactaagggagagaaaaaaagcagcagcaccgcagagaatcagagaggaaagggagattgaagaggaacaagggaatgaggtctcagaggaggcaggagagggttaaatcaagaaccccagtagaagggtgagcatttgaaagagaagtgggcatgtgtctcctgaaagaggagaaggaagaaggctaagttgatgacccagataacattttagatggagaggaaagcaggtaaataggtttatgttacaaattcctagccttcttagtgaacaggttgatgaggtcttatgccaggagtgaaggggcctagggatgggtgggtgtctaaaaaggcagaaagggattggaatagcctctgcagggcctttgaaagagaactgataaggattggacatgaggattgcctaaaaacactagagacaccagccaaggtgatctcatgaaggtatagctttttgttctaataagagacaacctgtaaagatatagcctagagactaatcactgtctccagagatgtgaaagcctaggtactccccaaactgttctcagtaatttgagtgtagtggttggaatacatggcacactggtctatctaggctcctgccatcactgccagttacagtatttagtagaatagaattagaggtctgtgaccctgaagaccgtgactaaggatctgttgccaactccagccattcccctcaaggggacagctttctaagcagaaggaagaaagaagcaacaaagaagaagatggggtggtaccagtatcagaaaagcaaaactttccccagaattgggctctatggccatctctagttgtaagggagattgagaagtgattctaacatgtgaattttcatgtccgccaactaattacagatgactagatttcaaagcaatgggtaaatttgtagaattacgattttagaattataagagatcttagtaaatcaggctaaattttacaaatctcattttaaagataagactaggtgatttaagcaaattacctctagagtcatatacttgaaaagccagaattacaactcagatctttctactccaggttcattgctgtttctgttagaccaagcctgctgccactgtaggaactggaaagcacttgaaagaactggggagcctgttttagtacatcttcatcctgaagcagagagtcctgagcaagactgcccggcctttgcctctgatttttcttgcttcctacccacacatttagaacctgtaaaagagaacaatccttgttctgaaaatatcacaaatcaaggagaaaagcctagcatgaaagacagtctttgatatttagaatttcaagaacattcaggattttaatcatagtgaagcaccagaagaagcattaacttctttttttttgagacagtcttactctatcgcccaggctggagtgcaatggtgtgatctcggctcactgcaacctctgcctcctgggttcaagcaattcttctgcctcaacctcctgagtagctgggattacagatgtgcaccatgcctagctaatttttgtgtttttagtagagatggggtttcaccatgttggccaggctagtctcgaactcctgacctcaggtgatccgcccacctcggcctcccaaattgctgggattacaggcataagccactgcgcccagccagatgttgtgggaagtcagggaccctgagcggagggactggctgaagccatggcagagtaacataaattgtgaagatttcatggatgtttattagttccccaaattaatacttttataatttcttacgcctatctttactgcagtctctgaacataaattgtgaagattttatggacatttatcacttccctaatcaatactcttgtgatttcctatgtctgtctttactttaatctcttaatcccgtcatcttcataagctgaggacgtatgtcgcctcaggaccctgtgataattgcgttaactgcacaaattgttcgtaaagcatgtgtttaaacaatatgaaatctgggcaccttgaaaaaagaacaggataacagtgatgttcatggaacaagggagataaccattaggtctgactgcctgagagctgggtggaacagagccatatttctcttcttacaaaagcgaataggagaaatattgctgaattctttttctcagcaaggaacagccctgagaaagagaatgcattcctaggggaaggtccctaaaatggccactctaggaatgtctgtcttagacggttgaagataagggataaaataagccctggtctcccgtcgcgctcccaggcctattaggatgaggaaattcctgcctagtaaattttagtcagactggttgtctgctctcaaccctgtctcctgataagatgttatcaatgacaatgcgtgcccagtgggacatgaaacttcattagcaattttagttttgcctggtcctgtgatctcactctgcccccatttgccttgtgatattttattgccttgggaagcatgtgatctctgtgacccacaccctattcgtacactccctcccctttaaaaatcactaataaaaacttgctggttttgcggctcagggggcatcatggaacctgccaacatgtgatgtctcccctggacaccagctttaaaatttctctcttttgtactctttccctttatttctcagaccggccaacacttagggaaatagaaaagaacctatgttgaaatattgggggtggttcccccgatagccagaagcattaacttctgataagcctagttcacaaagtagagggtactgtctccagatggctttgaccccttcccttccctgccctcccctcccctcccctccccgacttccctctcccacttccctcccctaccttcctcccgctacctttcccccttccctcccctctccttccttcccttcccctcccctcccctccctccccagggtcttgttctctcacccaggctgtggtaatcatagctccccataacctcgaattcctaggctcatgtaatctgcccacctcagccttagaagcagctaggactacagccacacaccaccatgcctggctaatttttttattttccatagagacagtctcagtaggttggccagcctggtcttgaactcctggcctcaagggatcctcctgccccagtctcccaaagcgctgggattacaggtgtgagtgagcctattaataactagcctggtcgtttccttagacatttctgtagaaccttgtacttcctttttataactctcattgcctgtaattacttgttcaatgtctgttttttcggctagtctaatcttcatgatggaaaagactgtattttttaatactgtgcgccccacacctagcaaactgatggacacagattagatacttagaggtattaaatgagtgacatttggaaagttttgttattttttgttttgttttgatattaatagcctcttgctcaggcattctgttcagtctgctcagtatctggggaaaatggcaaagtgaaaaaaatatataaactgaatacacatacatatattcagtggcctcactttatggaaatttaattttttgtcatatataactataaatatgtcttctatagcaggacttataaattatattttttgaaaggtaatatattcccatggtacaaaagaaattccaaaacagtcatcagtgaaaagactcttttctcctcttgttcctcagtcatcccattttcctccccagagatgatcagtgttactagttttttacataccctctagagatattctttgcatttactagcaaataacgtgtgtatatgaacagatgggcgtatataacatacattgccctgcactttgtttttttcatttaacaggctatcttcaagatcattccatatcagttcattaataatattcttgttttgtgtgtctgcttaatattccattgtgtagattagatgtctgcaaactatatcccttgagtgaaattggtcttctgccagtttttgtgtgtcccacaagctaagaaccatttttaaatggttggaaagaaatcaaaagaagaataaaattttgtggcatgtagaaatcatatgaaattcagtgttcatacataaaattttatgtaaacagccacacccctttgcttacatattgtttatggctactttcaagctacaattgcagagttaggtactgccacagaaactgcatggcctgcaaagcctaaaatatttattctctggctttttacaaaaatagtttgccgacccttcatacagatgcattgtagtgtatttaattaatattttgctgttataacacagcattgaaaatcttatatatgcaatattttacacatgtgtgagtagaactagaggatatagttctagaggtagaattgctcacagagttttaaattctgtgcggcacattaaattttttctaattctgttaattctgcatcaagggaaaaggcagaggaagatgggggagagtggacaaaagatctctttctttcctcctgctgaaatggtttgtggcattgacaaagtcaagtttgtgtgggaggctttgaagagactggctcatgtcagagggagaggaaagaaaaggagacaagtagttgctggcaagtcatctgggaaaaggagctgagcctagagagctccttctgaagacctgcctggtataggcccaaatgcagggtggagggaagtgtgcaaaacttcaggactccagtatctgaaagtcttgttctgatactggagccctagaaaaggacttgcctcttaataggtccaaccagaagaacagaaactatagggaactttcttaggtttatgctgttgtattctagataaactgggactgatatcttggcgcacagcaacctaggcaatttggaaaaaggaagtctttgtgagatctgctcagaaacatttgcatttgcttgatttatttccccacactattccttccctttctctcttccttcattgaagaaaaataccaaaaacaaaaaattctctcaatttttacctttcatcccatctctgctttgaaacagtactgactgctgccacctgacgtatttcatcaaaagtggaagaggcacagctgggaccagtgctctctctccagtctgggatgtgagaatcagcagcactgagagctctagcctgcttctctcccctgacttctgacactccctaagtggaagacagagctgcttttcctcagaccacttgcaagcctctgggaggcttagtgtcagttgtctgctttctcttttcacgatccaaagggatataaagtgtaaagctgaacctgggaaaggaacaggacaaatggcaccttttaatcacttgtaaatgattgtccttcctctccactggcacattgcttgatttacagtgaatttttttttataagctcgaaatatttaaggaaagtagctgtattataagaactagattttggcttacattgacactgtttgcctaaggtcctttagttaacagatgtaagcatttcaaagattcatgatgattctttgtgacagtaatagactaacatccagatatttgccttattttgttttcatcttttcattcaagaaagaggggaggccgggcatggtggcttatacctgtaattccggcgctttgggaggctgaggtgggaggattgcttgaggccaggagttgaagactagcctgggcaacatagagaaaccctgtctctacaaaaagttaaaaacaattagctgggcatggtggcccatgcctgtagtcccatcaactcagaaggctgaggtgggaggactgtttgagccccagaggttgagggtgcaataagctatggaagcaccactgcactccagcctggtcaacagagcaaagaccctgccttaaaaaaaaaaaaaagaaaaggaaagaggcgaaatggtggaagaaattactatgggagtgattttgctgtcctcttttctcctccctccttccctcgctctatttttatttttaaggcaagtccaaaaatacaggtaattttagttactgcccaacacttagaaatttgtaagatttttgggttccctgagtagataaccctttttgaaagttgatataataaactcaagttcattctttttctttgtttcctctgttttttatctcccaatattttgagcagattcatattcgaaggaccggggaccttggatagtaaaaccagtggcatcttcaagggggcggggcgtctacctgatcaacaatgtaagtatgcagcagatggcaaacctctctcctcacttgttctttcctccttcaccctttgtattggttactaatatagttccatttcattaagagcaggtgtgctcttcttaaatctgcattcagaagtgagttaagcgtaggtataacttgacttgtttgccttactggcaggaatcttctgcaccagcagttactccatggctaaaaagacacttgatcagattttaggggagggcaacctgttgtgtcagcagaaaagaggtaccttttctgcttttagcatattgtgatgttaattcctacacaccaagtattaattgatagcgtatgtgtttagcatctgttgtgagcagaactgtgggttctgttctcaaggttatcaaacaagtgaaccttaatttggtatggtatcctcgctactgctgctgcttctcctttctcctccttccttcctctttcctttcctctttctgcccttcttcgtctcatttctcctcttttttcaaaagccagcaatatcttgattctttgcaaaattctcattaaaagttgtcttaaattgaatacatacacatggtaaataaaatccctactggtctcactccctggacttacaatagtagttagtaacttttgttgatttatatttctttcattgacattacattgtatttgttaattcccagtttggcatttattgcatttacatcatgtcccaccctcccttgcacatttgtttgattagtttttatgtttatgttttaaacaataatagaatctcttcagtaactatgattcagtttctttattttatctataagttgagtaaaacatttaaactcagtggaaaccaactcttggacttctaaagggggaaatattaggataggtagctgggcagacatgagccgggcatgagagggcccccgctaccaccaaggagtgtcaggtgatcatcaggtgatggtcaggcagttgttaaactggtctctctaaaataataattggtagcagcagatgccagggaaaggcaggcacctgaagctggtgatcagccatttcccagtaagatctcaggagttgggcgagtaggctcaagcatgtgccctaagaagcaaaatgatggagtttaactggtatatgaccttcctctaggaacactcgactggtaaggcaaaaacacttcaaatgagcacgtgcacagctgcagccaacacactgtgtatgaggcccctctcaagtgctggcaggccactgcacatgcagacagcttaccccatggaaaaatcaagggaggagagatgcaaaaccccggaagcatgccaacatataaaaccccaagtctaaggtgaaacaggcacttgggtctctcaagttgtcggcttggccctcttccacgtgtactttacttcctttcatttctgctctaaaacttttcaataaatgttcactcctgctctaaaacttgccttggtctctcactctgccttatgccctcagacaaattctttcctgcaaggaggcaataagtgagttgctgcagacccacccatatggatttgctgctgccgctgacagactttgggattctgaaatttaaccaggatttaggcctggaccagttttttattcttcctcctggatatttggcaggcattttcagtctggaaactggtgtttttctttaaggaaagttatcttcttatttgtctccgcttttagaactcttttttgaggcattctagatctttccttcatgttaacttttctcgcatttttaattcttttcccatcttctagatcacaggttgaggtttatccatttattattcatttatctactgtatttttatattgggtatcataggttgatttccagaaactcatattctgatttgctttatttttatttacaaataacaaccttttgttgcataatggatgcagtttgcctgcctttccttctgaggataccaatggaaatttttgtaaagttctcttctgtcctttaattttattgggattgtcttttcccctgctattggattttctcagctttgatgatccttacatgttggaccatatttatgaacaaaagactagactgaatgaaactggccgctggtctgggtttctactgtggttgtgtaggactcttttcctaatatcttctccctggaagaggctgactgtgaattttgtgtaagggcaaaacatgttgactctcaggctttactttaggtggacatggtgagaagcactccccttccaccttgccaaaataaagtgggccatattgtgaatgcagaggaggattttggtgatctccctcttgggcagagctacctttcttttcctttttgtgtgtactggtgataaggtagcctcaagttctactcttctctatcagatttctgcacccacacgtctcctggcctcactgttccaaatgctgtttgttaattatctgattctaattccttggctgatccctgagcttcatgtttgttgagtacaagcttggaaatttgcaggagcctccttgggaaggtcactcttatctcttttggacttttctggcttcttttactttttcctagctttgatatcatttcattcttttgaaaatattctttctgtccttccactggaactctggaagggcaggggtaggtagatgtgttgtatgtgggaccagaaccctatcttaaattccccacttgtcttttcacattgagctgtttgccatatgtgtagaaactaactttctgagggatctttcacattggaaagtccttaaattcagtctggactcaaaacagtaccgtaaacaatgatggccagacccttcatgccaaagaaatataggatctggttttgatagagcaactgctacagccccaggcattggctgcaacttctgttacctggcctaggccactctggaggccttttaccctgagtctcctgtgacataaggccatggtcatatgccttggctctgtctcctcttgtctctgctctgacgttggtgttgaaggcccctctccaacagcttttccttcagctctgtgccaggagctccagtgttgtttgaatctcatagacggcactagtttgggtttaggttttagctgccaaatggaattgctattgaaagtcagctatggtacaagtttgctttttattttcttagatatgagtcaaaaagaataggatctattcccagctcatctgggacttttttcttttggaatgcttttttgccctagtgatttgttattttaaagctagcatcataaaggatagaaaagttaaactttccttggtggagccgagaaccctgcgccctaactcttccctggatgccgaatctcagtggggtgacatgtcttagagaatgtgtttggcaggctatgtaagagtctttttctccctcccacctctccctgggctgaatcctttgagaccccctgcatagatcaaagtacttggcaggaccttttgccttccccctccctctttgtgaagctttggaatgagtctgattcttttaggtatttagtggaagtgccagacagaagcctgggaggatgccaggaggcatgaggggagctggcaacatgcggacataatgggaaaatactcctgttttaccccaaaactggaattttaccaccttttacccagacctgcaaaccatgttgttaatactcttctctctccttacacaaaaggcataaccatcccctcttttccatgcctggatcctttcccatggaatatgtgacccattagccaactggatgaagtaactctttccaaggctgctgcctgctttccttttagatttaagcaggagggtgaggagagggaatgctgaggcagagggtctgggagcagaactaatgtgagtgagtgagggatttaggcagtggggatggagttggtgtgagggccaaatgaaaatatcttcccctctcttcccactggagtgagagggccacttactaaaacttccctatagtagtcataaccttttggaaactctctgcaaatagcaacttttaccattacgagaacgagataaaggatagcaaaagcatcacttttatgtaacactgaaaagagaagtgtggaccacagatggaaacatctcggttggctaacgtggtctcataaggatgtgctctttagaaatacagcataaaggaacaaagctgtgtttgctccactccttcagtaaccatgactaaatgccatattttcccaatttagtatattcaaagcaaggaggggaaagaatgggtgttttctgattaaggtatgaatttgattatggaagtcaagtttactcattcttgtctcacacatgatccatgggaaatacagtattgatacattctctgagactttcacatgttaggagagtgttaggtcactctagtccctcctatattcgtgaatataattctgtactctcttgtttctgtttgtttatgtgtttttatcttaggttccctttgtttttctcattgctcaacaagtatttcaggagtgcctactgtgttgtcactccttaaaagcttttgagaaattctcctaattattatgtatctccaattttcataatagtaccactcagtactctgagtagaatggcatgcagcaggtagtgatgaatgctgttgagctgtgggactttgtaattagaaccacatatattctgttaagtttgcagtaataataactaatgtttattgagcctaccactgtcctttctaaacataatctcacttaatccatatatgaaccctatgaggtagttattatttccttaataagtggtagagtcaaggttgtaactcaggtccagatgattccagcatagacactcttaaccactatatcattctcctttacaatgacttaacagataccatgagctttaaccttaaggtccatttagaaagatacctttccagccaggcgcagtggctcatgcctgtaatcccagcactttgggaggctgaggcgggcatatcacttgaggccaggagtttgagaccagcctgggcaacatggtgaaaccccatctctactaaaaatacaaaaattagctgggtatggtggtacgtgtctgtaatcccaactactggggaggctgaggcagggcagttgcttgaacctaggaagtggaggttgcagtgagctgaaataacaccattggactccagcctgggcgaagaaatgagatgctgtcttagaaaagaaagatgtgtttccaactttcccaacaattcagattcctacttcagcattctttgggaggcagtttgagctttgaattggaataatttgaaatgagttaactggggattgatgaaaggaaacaggcttgaagatatcaaaaagtttttcttagttgctcttcagtctgtaacgctgtgcaaagaaactatatccaaacctttcttttcttctgggagtctacagtttaattcccaatgcggatagaagtgagggataaagacaatagaacacatagtaaagttacctaaatattgtaagggtttatgttacgtgtaactcaaaggataaatgtgtatggtgagcaagggaggagaggaaatgggcatgggcgttagatgtgtcatggaatgatgaccactatcagcatattctctgctgtggagaaaagttgggtgagtagatatttattgtagcctataggttctactcagtaggaagagagctgtgattgtttgattttacgtttacaacatagcctgcagctgtatagtgattgcatcaattctcattgagcagattcaaaatggagatagtacttacgagaagctgatcaagaaatgtaagggagtcaggaaatggtatggatgatgaagttcattagggatgaatcagtaatgatgtcattgtgttcctatgatgcgtagagatgggttgtgaaagctgtgttctgactttgagatagcagcagtgggaactgagagaggactctcattctgacttcagagctgctcatactggttgtgtataatgttataggtcacaaaattatcatatgaaaaacagtagtagtattgagggtaggaaatgcattgttataaagacaaacttttgaatttgggggacaattaaatttgagagcagaatattgggaagaggtaagaataaagcctaaaagcgaagcctgtgaggaagactccctggattccgttgctgctctattgcttattagctccgtgactttgagcaggtccctaacccactctgattcttttttaatctataaaatgtggatggtgatatacctgcctcatggggttgggtgaggattaaatgaaataatcctgtgaacagacttagaacagcacttggcacatccacgtgtttagtacatttgttaaattttgtgtctgcaaatgttgatggttatttctgttgcctttactgtagctattatcaacctaattattatcactaccacttcccttttggagcccttttgtcctacatggattgtggtgacttccagctttatctaatcacatgtgaaggtttttttttttctcccagatattttaatcttgctgtttccttaatctagaatccacaataatttcctgcttcccaccatgctaaatataaactccctttgccaggggttcaaatccctttgtcagtagggtacctccctcctcattgtttaaccatgtctttcataatttcccagttcagtcttttagccccaggtctgtgaatcggcccaccctcctttctactgggcttggtgcgtgccatcttccgatgatgggctcctttcttctccaccatgtgcttcccagccttcactcatttctgcatctactcttctgggacaagtcttccctgactggtcccacctgattggtctgcactttaactttgtaacctggcatcttgtatttatagaaatgctgctttgtgttcttttaaattctatattttgctgttcctctacctaaatattaaacttttcagggatagggatttactgaatcttaaatctgccaggcagagattatatgtgttatgttcatcatggtatccccagtgccatatgcagtgtccacagtacttttctatttattgtataaacaactgtttttcattgaagaaatcttttaaagaccttattcactctttgcatacagttgcttagcaaatacccttaagtgaatcaattaaacacctatctcattttacagagaaaatgctaggatccattgtggatctgtaagttctccaaacatgttaatgaaagccttcatttaagaatagtagtagtatttttaaatttccattatacttcagggagaaagcaagttttcatttatttttaaagtggctcttattttcttggcaggtaactatttaatatcatgtatatacatctttaaggctattaggcttatttatttatttatttatttatttattatttattatgtgagaggtactgtgtaaatttatttttcctgcatcgtaattggatgcctatagtgttatagaagtgatattatatggccaactgaatatatgggtaccttggaggaaactttaaccagaattttagttttccaccttaccatttctttaaaggttaagaactttgctcccttattgtaaattaggattcctgtgtatttctattctttcattctttctctttactcaatagccaaaccagatctccctggaagagaacattttggtctcccgttacattaacaaccccctgctcatagatggtgagttgtgattaggcccttgaccaaattgggccagatttttgctcaactttttaagcttttcatagccttctctagtaagtctttattatactgttgtgaaattcttgacatgtgtggctccagaaaggcagcaggttccttacctatctcacgggatttatctgaaggtgaaatgagacaatataagagaaagtgctttataggttatatagtagtatatgtatgaaaattgtgcagtaattaatatatatgaaaatgacacacatatgcattatatatacattacagttatattaatgtatatatacattatacggtttttattatgtactatatacataatatgtatacggtacaattatatagtataattattagttatcctccgaagtcaaggtgtgtgagcagtgtgtgtttcatgtggagtgtaggaatgttctttctttcatgtttcttggtttcgttgtttattctgtaacaggaaacaaatgaacttagtttttttttgtgaatacaaactttttttttttagatttcaagtttgacgtgcgcctctatgtgctcgtgacttcctatgatcctcttgtcatctatctctatgaagaaggattggctaggtaagaagctgtttgggggtgaaggggttgggtgggtatattaagggtgggtatattaagagtggatccattaacaagtttattaaatcagatcatgctatttttacttgtcattactgcttacagatgcaatccacctcctcaactgctgtgctctataacatcaaagccagtatgcctaaaaagaacttcagaaattaggcttatttgtctgtagtctcactgcatgtccacacataaggtgtgtaaacatcttccccagcactgatccaggatcatatggtattttcctgcagtgacaattgttatgaagctcctaggatattaagataatttgctgttattcttcaggatagatgtagaaagaaaaataaaatcctacctgtatttgcctattatatgccaggcatttattttcatcctcgcaacaaccttttagttgatgcatttttgcagttgaggaaacagatttagaggtgggagaagtggaatggggatttgacctcatggatctgactccagagctcagggctcagacaatttcatgccctctcatatttggaaggtattaattgagggtttttttttttttccttaacatgcaagttactttacagtggttgtacatacattgttctctttttgttaaggtgcttttttttgtttgtttttgagatggcgtgatctcggctcactgcaagctctgcctccaggttcacgccattctcctgcctcagcctcctgagtagctgggacaacaggtgccccccaccatgcctggctaatgttttgtatttttagtagagacgaggtttcactgtgttagccaggatggtctcgatctcctgacctcgtgatccgcctgcctcagcctcccaaagtgctgggattacaggtgtgagccaccacacctggcctgttgaggtgctttctaagttttaaggtaatgtgacttacaagattaagttcaagttgttatattttgaagttttgtttcctctagccacagaattttacaggtaattgtttttgtaaaccctttaaattgtttaaaataagtatgtaactactatgctgtgttcttccccccaacaaaactaaatttttgtattagccaactagtttgccctgaagttctttttatgcgtagtgcctttgatatagagcaggggtgtccaatcttttggcttccctgggccacattggaagaagaattgtcttgggccatacctaaaatacactaacaatagctgatgagcttaaaaaaaattgcaaaaaactcataatattttgagaaactttataaatttgtgttgggccacattcaaagctgtcctgggctgtatgcagcctgtgggcctcaggttggacaagcttgttataaagcatagcagtttaggaggtgatttgcatctgtgagtggtcacgacaagctaaaaaagcctggtctgtgtatgtttctgtattttagaaaatgcaattggaagatgggaaataccatggataaaagaaggctacctatttatgtacaggtgctttgacagatattattgtactctgacaactattattttagaatggtcttttaatgattttagagacttagtttttttcacatgtatcctatgacttgaaatcagtgagagcagactaaccaaacctcgctggtggagctctgtgttccgttcgcctctaggtggcagtcacagcatttataagtcctgtcatattcttaactgagattttgagtttgagccctgggaacattggagactaccaaaactccctagttctggcctcttccttgaaaattgagaaagggaagaactgaaacatctcgcagttattagataaagggctggaccaggcatctgaacatgagctgactactagctctaatcaggtttttataggaaagaaattgtcgataatatttgtagacacacgtgctctcacgttttgaagtatcactatacaaaattaggtataaaagcctattcctggccaggcgtggtggctcacacctgtaatcctagcactttgggaggccgagacgggaggattgcctgaggccaggagttcaagaccagtttgggcaacattgtgagaccccatctcattaaaaaaaaaaaaaaaaaaaaaaaaaaagaccaagaaaaagcctattccctatattatttaaaacaaaatgatggtaaaatacagtcctgacttctcagatatgcaaggttctgaggattttcagctttataatttgagacttctgagctttctctcttttgtgttatgagtttcatcattctccttcctctgctcatcctcaccttcacttctctcctgtgtcaagttttagaaactgattatgtcctgccaaaaattggactttgggaatagagaaaagagatggaggttgtgcttcactgtttctcaaggacatcatagcaatatgttttgcttaatattccaaagatattttcacctacaatattaacagccctctctatgggtaaaatttggcataattttaagacctttctggttcagagcacaacatgagaacaacagtaccaatgtttattatagaatttactacaaatatgcaagtgctttggctactggttgtgtgttggaagtcagaatctactgaattaagtataacccttttgcttccagcagaaacaaaaaaatttatacacacacacacacacacacacacacacacacacacacaatggatgttttttcacagaataattagaaaaacagcttttaaaaaactcagaccaagtagaaccagaaagccacatgaattttcagggctttggttaggtttacctgaaagtgtaggtgaatataaaagctttatcaaagctttacaaaagcataacgcatggcaatatgatgcactgtttgcgggagtcctgcgagggcacattgttccgtgcagtaatttcaatgtgcctaagttcttgtgtcttcactaattatgtatcttgacattcacttgctttgttgtaaccctcagagtctgttcaactatgtcgatagtctgtagcatctccagatctgcagcttttagttatcttgggccacatgtaatttatgtagacataactgaagatcatcagtttgggatgagattattgggttacgttgaggctcaacaagaaaaaccataatctttcctaaagagacggaacaggaggcaaatacaattcatttccttctttagaaatgaattcccttacaccctatcacttctgttttggacctcaaattaatactaggcgacagaaagattaaattcatttcacaagacagttttgtgatataagttattttgtgtaaaattttttaacacaaaattaaattcgtgaaaaccctagtttctgtatagatgagtgttttcagttgtccttattgttttattaacataagaagtgggagagctctcactgttttctcatgtgtgggtatagtattgaagaagtgttgcaattgtccccctggtatttgggtgcagctttttgtgattcccacagtagccctcagaggtcccctgtgcttttgaattttacttgcgtgttgctgttttgcaccaccaggggacactcagtttccacagaggggtgctatgctctaccaaaatggtgcagattctttttcctgtcaggggtggactccaaaaagattttgtcctggattttacagctttaggtggatccagtattgggtttagatgagttgacagagccctttctgagatgaagctaatagccagattttcactgaaacaggaaaaataaaaatttcaaaaaaattaaaacaaaatggagttaaaaactaaatatgttgccagagacccaaagataggcagctctagcaacttggggggcatgcaagtatccatccagggagctgagttccacccatgcggcggaggtgggaagagaggattctgggaaggtcccggttggaatggccttttttctgcctcagccatattattcagtggaaattcagaaaagaccccaaaacatttgtagtgcctttccctttctccccacccccagttccttcttcagtagccttccttgctaattaacactggctctgcagggatatttaccttttctctgctggattcctgtggttttgaaagaattcaggtacttgctggttgccaaggaattcagattacctcacaggctgcacactgtccagaatctgccacagcagcaagtaggggggaagagacaccaacaagggggagaaaaccctttccagtgctcattgtcaccctccctggcaggcccttgctgtttgtgaagtttgagtcatttctggctctaaagacaagggatcaggctggtaatcccctcccagacggctctgtagggcgctgcctagtcactgcagcgctttggcagtctcccggctgcagctggttgacagcagatcagagagctcttgggcctcttgttctcttccataagatttttctgggtcaggccaggatgaaacccagtggctcctggcaaggctgcctgaggtgctgtctcttcattgtccaggcctctctgactcaaaatgcctacacctgttgaaggataactcatgtgccacagcgaggtcgaggctggccttctcttttcttggtacatttgtagtgaatgtttgtcagaaaatataactaccaaagaggatgttaagcttctacatctagaatgcctgtgactctgaccataagaagatattggtatcaaaaaaaagtttttaagaaaacagcaggacaaaaaaaaaaaaaaagaacatgtggggtcatattcttagaagaacaaactggtttttgaataggggaagagagtttaaaagatcccactaactctctgctttccttcttgttttggttccatattggtaaagatcttggagcaagcaactccagtgcagtttcagttaatgtttgccaagtccctaccatatgccaaacattgaaatcttttctccacacagacattcagacttttagacaaattatcttgattctcttgatcaaattatcttgatcactatcttgattctcagtgagaaacattagaaagcgaaaaggaaatgtaacttgtgatttaaaaatttattgtcaaaataaagatattgtccaaaacaattcatatttgttttcattgtggttaaaaaggggggagggggcggcaaatagttctatattcatcaataggctgcaaaatagtacctagggtttcaaatttaacaaagaaagtaggaactctcccaccttttgttagcttaaaggtcaaagccttaaaggtctgtcgtgagaactttcctaaatcttgatctcattaagagggagatacaagactgactccatcgtgtaaattttggtctacattaggataagtgtggtcatgtagtcatgtgctttataacaatgggcaaggaaggaccacatatactatggtatcccataagattgtaatggagctgaaaaatttctgtcgcctagtgacattgtaacatcataacacaatgtattactttttctatgtttagatacacaaatacttaccattgtgttccagttgcctacagtattcagtatagtacaatgctgtacaggtttgtagcctacaagcaagaagctgtattatctatcctaggtgtgtagtaggctataccatccaggtttgtgtaaatacgctctatgatgttcacacaacgatgaaattggcctatcaatgcatttctcagagcatatccccattgttaagtgacgaatggttgtatgtgcaaacttggtcctggggtacctagtaaatagtgctcttttaggttattgttaatagagaaatggtgttgaaacttcagacctagagaagatgaaatttgataatatgtgatggtctaaatcaaaggtcactaacataaatgctcacaagtacattcactgaaggaagagtggagactggagaatggagagtacatgtctcatctaaaggcatttactatttagtgccagcagctgatactggtattgccagatctggtttgttaagtgaggcttgaacatgtagatttttactgtgaaacaaagcacttttttacacttttaattttgaaaccgttttgaacttatagagttgtcagagctgtaagaattatatgaaaaattaccttttaccctatgtctagagatctcattccaattctgccaattgtcctaagattttttttttttttaattacaaaaggatccaatcaaggatcacatgttgtatttagccgtcgggtctccgtagtctccttcagtctgaaacagttccttagtctttctttgactttcatgatctcagcatttttgaagattacaggccagtcattttgtggattgtccctcagtttgggcttgtctgatattttctcatgaagagacctaggtaatgcatttggggccagaataccacaaaagtgatactaattcttgtcattgcattatatgtgatggcacatgctagtcatttagtggtgtttgaccatttgctttaggtcatctgctagattcctccactgtaaaattatttggtcttaccctttgtaattagtaagtattttataaggagatactttaaatcatgtaaaatttcattcttcatctcatttctcatttttaagaaaaatctattgatttttcttgccttaatgaattattgctgtaatagttgccaaatgatgattttttaattccatcataacttttatttcttggcatttttctgtgaggaagagctttatcttctcgtttatttattcatctatttatttataccaatgcagactcaagcgttcctgttttatttaatgggttataattctttactatcatgatttattttgatgctcaaattgtcccagatttggccagtgggagacctctcaagctggctttgtgtccttttgacatgtctttatcattctttgagcacaagatgtttcaggctcatcttgttctttctctattctatccctggaatcaaccatttctccaaggagcactggttgctttttcttggagtataatatttagaaatcaatatctgggtgctagatacgctcattgttttggggcatttctgctttcagaccctggccatgagcagagttaggaaattatgtatttatgtacatatacacttgtacatctgtatttctatatctgtctctaatgtattgttgaaaaatagaagtttatactagtacgcacaattctagttcaaaactacagagttccttcttgttttttgcttttcatattttaaaatctcttttccaacagcaggaaatctggctcgcagtatctttaacatatttatttatttgctcaattcctttgtatgtggccagtttcctgaccccactgggccactgtcccattcagatgccgtttttatatggatttatacccttatttggtggcctccctgcttagaaaacctccttgtgcttctggctgacttcccaccctactcaccatcttccttttttttttttttttttttttgtaactcaccatcttcctcatgtgggccctggctacccctgggctgcaagaaggaaggtctgatttttatatgttgttcaggtaattaaagtttaaaagaaaaaacaaagcttttgtaggttaatcagaacttgaccagtaggtcacattcaagactaatgtgacctgtggtctagacaataaaaaagaaaatagtggtcagatgatgatgatggcttatttactatggattttagtgagagctataagctcttactggggtaggaggaaagatgaacatgcacaccttttctctccatagtgtatgttccccactagactgagggagatatggagtggagcactttcacccttcaggggaacttttcctttaagcttttttgtttcactttaatttttgctgcttctgcttcatacactcagtttagaattccacgctttgatattagaaatcttatccttgctggggttcagaataaaatgctccagtgaaaaggaagattaggaagaagaaacatgattttttttttttttagatgtgcagccctcttgaaaaaaagaatataggaatgacaaatgtgttggtacccgattccagctcaccacagacttttgtcaggcttttcatgttgaccaagttagatcaagtacttgtagtaactacaagagatgaaaagcctctttttctgaagcagaagctttcccctccttctaattcattgttctttgaggggagaggatgacaggagggatgtcaccttgaggtaatgtctggctgaggcaggcagccagcacggggcccctttgcatctcacaagaattcagagaatgacagtctgcaacttgcttggacaatctattagaggaagattgggatgcataggcaagggttactcaccagggcactggggtgtgacatggctagaagttaagtgataactactggaagttggaagtttctagaaaatctggggtccttctcaagcacagacataataatgctcatcaaactcttgtcttttagcctagtcatcattttctctttgtccacatcctttttcctagcctcatgtttgtttattttagttttttgggtttggggttttttttcttttcactattctttctttggctcttgtatatttctggtacagggaattagggagtggagatagtgggtggatgagaagaaacagagaagaggaaagttttttaatgctgacctttaatgtggtgaaaattcatgttgacttcatagtctgagtaagcatatgtaaataatttgtaagtcatatgaaaataaacttgtggccttcttttttttttcacacacttggatatgcctcttgggaaaaccactctagtgaagggtgatatggttacagtggtatgtaaacaggggttgatatctaccataaccattcgccttgagtgtccttttgttgatactgagcatccttttgttgatattgagcatcactggaaagttctctctttccctggttacttccttcagaggcacatgtattttatactttggtcttcttttgacaacagtccgggatatcaaattgctaccctgttttcagtgggctccatgtttaattcctcttttgccttcatttcaaattcaggactaagtctcttgcactgtgcccatatttatgccgttttgctttgtctgctgttaatgctgtcattatcattctttttaaatgagtattatggatcagttctattctttctatggatgtcagctctaagcctacatatagctgtgctgtcattttttctttttgcttattttttttttcattgaatgctatagtaccaggcactgtgtgggcactcagtcggtgtttctgttgcctaggctggagtgtagtggtgcgatcacagctcactgcagcctctgtctcctgggctcaagcagtcttctcaccttggcctcccaagtagctgggactacaggtgcacactaccacgcctgcttaattttttaattttttgtagagatagggtcttgcagtgttgcctaggctggtctcaaactcctgggctcaagcaatcctcctgcctcggcctcccaaagtgttgagattagaggcatgagccaccatgcccagccagttgttatttctggaccagctaatgctgcatctttcacagtatcctacacacaatttcccaggttgtaaatagctatattttcaattttcattcttcctattggtgtaatgttctatataagagaagcaatgtcttgttgtgattaagtccatgggttttggagttggtgtgatcttgaacaagttatttaatagaccacatttagttttcacatctgtttttcaacttggatacgatattatctacttcatagggttgctttaaggattgaattaagtatgacattataaaacacttagaatgggagttagcacttagtaggcacttggtatttgttaggtaatgatattaccctcctttattattatctcattgatcctcagttccagcctgtatttccttgaaactctgttcctggcatttaacctgtttcccttctatcaggtttgcaactgtgcgatatgatcaaggagccaagaacattcggaaccagttcatgcatctgacaaactacagtgtcaacaagaaaagtggagattacgtcaggtactggctgtgtctgagccagaagtcagaggtgtcagtctcagatgtgggtgttgtagaggtggaaaggtaacatgtggcactggaggacaactttacattaatgtccatgtaccatttatggaaatctgtcagtcatataacagtgttgaggcatatctcctgctgcttctccattgcctccccggttaacggtgtcacctttctctaccaaaatgtgccttcacaagtttttcttcctcactgccttccctcacttgacttaggaatgggaatttaataggcatatggaacgttttagaagttaagaaatgaggtcatttcagcacttggcaaacatatcaaaagcttaaaaaatgtctgtaccctttgaccccatggttccatttctaggaacttaaccttaaggaataaaagatgtacacacaggatcagtgataagaatgttcattaccatgtattcgtaggtggaaaaagcaggttatcagatagcacatgcaacttaactttcttgcttgaatatgagatatctaaagctgcttatttttgctgaggggggaggaaaaaaagaccagaagtagtaccgaagtgttaatttagcttaactatagtgggtaggattgtgagtgggtgatttttattttcttctttgtgccattatgtattttctaaatttttctaaaataaatacttgtatgatcaagaaaaagaaaaggaaaaaatcaaagaaagaaagaaatgaggccatctcagaaaaggattcagtggaagggagtactagcccagctgtgtggaaatattctttttgctctgttttctttcatgccgatatttttgccagaaagtggaaaagtggaaaagagacccaaatagttactttctactcagactaaaaataggttcctagcaggtccaaggaaagaaagaaaggaatctggaagtgatagaatagttgctgaagctatataggtttcagcaaatatcctgtgagcagcatttgcattgactgaagagatcatacctccactgtgaaagatgagcaaaggcacaattggtggagagtgggatggtggtagggagtgaggggacagctgcaaaacacaggttccagattgcggggctcttccaacattcgtgggaggctgtgccattggccactccgctgccatagcaatagtatacctcctcactcttactgtcactccagtgcactctcccttcagtgttacctcaaaaaaatcaggaaaagccatatctactgccaaagaggagggaacctgcttcagatgccaaagcaattctgtgtggggttatttcattagcatgctgcaccagaataactcactcacccattccaactcagttctggtctgaaaatggcatcagaggttgttttgtggactcaggtgacattcacctcaaaggttaattgtcttttaacttgttgtaaccattcttaaatttgtttgccttctttcacacattgctttcactctttcttgatgcataattgtttggttaagaaagaatttgccgccttcttccccaccctcttgaaaaaggcaaactgtatgcattttcatttccattgaagaaattggtatgaaaggatatatgacaaaaaggaccaagaaaaaatgagtaactggaagtcagcaaagtgaattaaaaaaaaaactttttaaaaagacaagaaggctatttgcaaagagtcttgttattatagccaagcctagttacatatgtgactttgatttattaatttgttttagttgtgacgatccagaagtggaggattatggaaacaaatggagcatgagtgctatgcttaggtacctgaaacaagaaggcagagatacaaccggtgagtactgggcctttttccttcttgacttctcttctttggataactttatcattgtctcttgccaggaatcattctctgttgctttgatagtgttgctgagacgggatgattgtccttggtgttactttttcctgcagttgacaagctggggaacaggttttccattaccctcaaaatcccttttcttgtttcgggtctgaaagacataactttttccttttaatccttagtgaatttacccttcttgaatgttgaactgctgactaaaatatggtcagctttttatataacaaattgcctgtctccatattggccccaagtttcgagttttctaagttaatctctctcattcatgttgctgagttggagaatgggcactgtttgagcacagggcttcaaatcaaaatggacacaattgctgagccttgagcagaacgggaaactgtgtgccaaaaaagacttttcatttcacaagggaaagggtcataggggaagtgtgagaagggaagtgaggctcctattccattatgtgtctgtcttttgtcataagaggccacctgagggtatcccttggcacctacattcttgactgtattgatctgttcacagatatgcctgcctctatagcacccattcagaagtctgccatatagaggcttttttgaatgagcacacatgcttttatagttatattgttatctggaatccagttcataatccatgtattttgatattgagtctgaaatttaaaaatttttgtttgcagcattgatggcccatgtagaagacctgatcattaagactataatctctgctgaactagctattgctactgcctgtaaaacctttgttcctcatcgcagcagttgttttggtaaggagactcaagaagcttaacatgttttgtgaagaggatcttgggaagttggacgggattttagggtagagaggcttagtgattctatagcagtaagaggtatgtgatggactcttctttctaagctcatgtagcatatgaagagcctactaagaggccaatagtgagcttggtcagaagtcccctgaggagtaactagctttctgtgtgggaagcagggattggaacgaacgtgttggtctttctgtcagagtgcagtcagaaaaagtctgcaacggactgtacaggaatccagctctaacaaatatattccagagctccttggcagccaggctgggaacagttccaagaagctctggctggtaccagtatgtgctttctcccattttccgatgactcctcctttttgtttgagtcttctttctagtgtgttcctccccctcctctctttctcccattcctcttccactttcttttctctttctctttctcttcctcttctcctccccttccactccacccccaactccttgactgcacagagaaggaataagcagttcacaactacagaatcaggaaatgttacctactgaccccctagctataatggtagcactgagggtgcctatggacattgcttcctatgtggaaatgaatgggtttgtgattgcccatgtgaatgtgtttaaagtcacataggcttttggcagtgttaggctttgttagtaaaatacactagggtctttgatggggaggatgattaaagtgtggtgtggagtaatacaggtagtaaggatatgagagtcgtgctttggttagaaggcagagtaacagggaaataaagaatatgggttttagagcctaacagccttagtttgtaaccatgtatatccatatctagttttgtgattttcagcaagttactctaatcctgtttcctcaactataaaatggcagtaatggtggtgtctacctcctgagaataccatgaagatcaaatgagatgatgcacgcaaagcacttgacacaatgtctggcccttacgttgtactcaataaaaattatttgttatttttgtaattagacatcataattcctgatctctttaacagattatcgttaacaggctatatttgagggtcagtaaacaaagggaattgttgagattgaatagaagatggtagataaatcaggacctaaaattatatgggaaaagaagaggttgtaatatattttttaaaatacatatctgatcatgtcttctgaaatccttaaatggttccttaggcttaaattgtataatagaaacttgatatgacctgaaaggcttctaaggtaactcaggtaactcttctagaattccatttcccctcatataccttataatccagctgtactatagtatacttctaagcactctgtgcttttgtgccactgtatgagttctgctgtttggcctaaaaactctccttctgtctctgccttgcatgctcccatttcttttctaagatttagttctccacattgcctcctccctcatgctgttcttttttttttgagacaaggtcttgctctgttgcccagggtggagtacagtggcatgatcaccgttcactgcagcctccacctcctgggcccaagtgatcctcccaccttagcctctcgagtagttgggactataggcatgtgtcatcatgcctggctaattgtttaaaaaactttttgtagaaatgtgacctcactatgcattatgcttttctgtgcttgtttgatcattctcttttcctatcacatcatgatgttttgtttatacatacactcagccgtgtctgagtttattttcttgaattcataacagccagtgtgtcctttcttcccatttcaccctatttctgccaaaccagagctttcaacatttctcttgtcccctttttaaatttttttttttagttttgtattagagacagggtctcactgttgtctaggctagagtgcaatggcgcaatcgtatttagctcactgcagccttgaactcatggtaccaagtgatcctcctgccttggcttccccaaatactgggcttacaggcatgagctaccatgtaagccctcgcttgctacctctgcacctgttttaccgtgtgtctgaaatacctttcttgtgttactttacctaataaattacagacatttttcaagacaaagtcaagtgtcacttctttggtgatgtttttttctaatgctcccagagttagcctgctctgcccttatacccccagcactctgtttgtaactctacaatagtatctgtatgttgtctggtagtcatgtgtatatttgtctcctgtagccgactggaaactccttgaggacagtaagaatatctccgtcagttttgcccccaccatgcatggcagcacttttttttaaattgagacagtatctcactacgttacccagtctggccttgaactcctgggcccaaaggatccacctgcctcagcctcccgagtagctaggactataggtgtgtgccaccatacccagttgcatgtcagcgtcttttgctcttagagaatgttcaggaaatgtttcttgaatgaatgattggcacttgctttaattgctttttggtggcctgacagtagacttcccaatggatctggtttggtaatggcctagaactcttagaattattgcagactgtttgaagatggggatgaggggttgggactaggagcgtaactccaacttccaaaacctcattagatttaaataataaataaaggtttatttttctacatctacttggctcttatatgagggtaaatttctgatatcccttgctgtaaaaatctttgttctaaataattataaaaccttttctgaatgtttccttttgtttgtttgtttgtttgttttataacttgattgccttttggaagcttgggagcttcattattgaacttattggcaatagaatgttccgacgtggaagaagctgtgactttctctgactcagtgaaataccccttaagtccatttcatcagccatgggtctcctttcttcctccctacttgtgttcagttttaataaactgagtgcatctggagttttttaagttgttgactatcttcttggcttttgtggttctaattccacttcctgtcagccctgggattttgtgtgcttcattaacctcatcccatcagatatgattttgtatacgtgtgtatatttgtatgagtctctgcctcccactgactcctaacttcccctggggtttaagtcacaaggaataagctagttgtttttttttttttccatttattttagagtaaacaggaattgaaagcttcccagaagattttggctcaaacagagcattggtgcttttaggggaaaccaacagaccagacatggggttcgctatattcttttggtggttgttcctgtccttccatcttatggatctctgccaggggcattcccttactatctcagtgtttgtatcctatgatttctttcccatcctaccacctgtaatgttcaactatgtttccaggtatcttcaatatcccatcctatttatttatacatttaatttttcttcagttcctgctgtgggcaagtcataggttagcctttcggcagtgtattaccatcaagtttgttcctctcaaaccaaattttatgtaggatgagatacagatatagatatatatatacctccattgcactattagtgtttaaatgtagacttgagaacctatacaaactacccgaaactttgtcatttaatgctttttcctagatttgcacatctggcaaggaccttagagaataattagttcagatatagaaattgaaaccctgagaaatgaactctatgttccaggttctagagttagtgagtgaaataactcaggtcaaaatgactcagcttgtatctatggggcttcagaagatgggttttggcaatcagataatcttgatcataagacttttgatttatagaattttttatgcctccctcaataagacagattttttacaatctaatttttactgccttccaagatcgtgaaaatatggtaccatgtgaaataatatgcttaaacagcaatcctttaaatatgcttaggaaattggcattgtgagatacaactggctatgagaatagcttttggatcagttgaagaaaaacagccaaaaacaacaggatgttcgctgctctttaaagatgttgctgctgacagtgggtttatctctgtgtattagcatggctgaagtcatgggttgtgacccaggcctgggatcatggggacaagttgtggagccacttgtagaactgatcagcctggacttgttctgatcagagcccagtgacgtgtttgctccgcaccagccatgcccagtacacctctgtgttgacgatacctggtttggttttctgttgctgccattcttgaccatttcacagggtaacctgaggttcttatagggaggatgtccataaataattgttggaggaatgaaagcaggcagtgtacattctccaacaatgtaaactacttggccacccacagaaaaataatgagagtcatcaatctcttcactttttgagataatctccttttttggtttatcatatgctcctgtttagatgggaaaggaagtttactacagaagaaacttatgtaggaagtatctactgtttatcaagcaaacattggttatttcctttaatttggtttcactggttatttctttttagtcttcgacaattttggttggtattatctgtgttttatagacatggaaaaaagattcagaaaggttaaataagttgtcctaggtcatgcagctaataaatggcaaagccaaatttgggagccagttctctctggctctttctccacccacataaagacatgtccttatgagtccggccacttttggcatgccccatatcctggattctccctctgctctcccgtaactagatactcaggaaaaatgatatcatcctttctagcagatcaggcctgaaaaggacactccttttgctctagttaagcatacccagtcctaaatactcctttcaaatctacctttacatctggtaaccagatagcatattgatttcttggactagttaaccaattggctgtgggcattttcttttcattttcttgtgggtctgcttttttccaaaattctccttctggaccccatataaagacttcctctttagctttttcaatttgaatccaaagccaaggtaaaaagaatttccttcatacaatagcatttcagtgacagtgagttctggctaatgtcagcactttccattgcctcagggaccacagcttcagctgggactttatttctggggagagttagtggattgatccaaaattagtggtgtgacatgtttagtaatctattaggccttggatggattattattttcttgagaaaatctttatttcctcctctctccctaaactaacttttatcaggttttttcttaatacagctttaatatgtaaagtttcctaagaatctctcttattttctttatgattggtggctttattataaatatttcaagtgttgtgatcagggttattttgtaggaagtggctgccaattattttgtctttctcaaaaactatgcattgtttttcacttaaaatatatttttttcattcagtatttctgaagtatttcctatgtgctagttatggtgcaggctacttgtaatacaacaatgaatgaaacatggaccctgccctcaagtgatagggaggagcagacatgaaatgataaatgacattacaagtagtataagtgactcaggtgctctaggaatatataagatttactagctgtgcctaggggatccacagaaagccatttttaacagcaagaatgtagtatgcaacatacagtgtcatgacaggatgtgatattttttgaaatggtaagaagtatgactaaatatagcgtgcatagaatgggggaatagaagatagggttatggaggtggatttgggccagaatataaagaattgacaagtttaaattcatcttgtagctaacagacagccactggaagtttttgagcaggggagcgataggattattattatttttctttaacttttatcataatttaatccaaagcttaggatgacagaattacaataaagggaatacagtacaatattactagcaatgactgacttaaaatcttctaggaaccaagctgacattagtttctgttgttggaccaattcactgcctacctctatgtgactgctaagtttgtttttctaagaaaagtataattctcatggccttgaagaatggactacaattgagagaggcaagtgctagggaaatgactaaggtggtaagaggtgtgcagtgataatatatacttaccatatgacccagtagtcccactcataggtattttcccagaagaaccgaaaccatatgtttatacgaatatctgtatacaaatgtttatagcagctttattaataattgccaaaaattggaaacaatccaaatgtccatcaactgttgaatgggtaaataaattgtggtatgtccatataatggaatactactcagctagagaaaggaacgaactatattattggtatgtataacaacatagataaatctcaaaagcacaatgctaagtgaaagaagccagtttcaagaaactacatattacattaatttcatttatttgactttctggaaaaggcaggaagcagacaaaaatgagatcagtggttgctgagggtgggagtgcgactggagaggggcacaagggaatgtttgttaaaattgtcctatgtcttgtggtggtgttagacaactgcatatatttgtcaaaactcaccaaaatgtatactttaaaagggtgaatttattgtatgtaaattagactttgataaatctgcctgaaaacaaaaagcaatgatagatggatgaacctcagaaacatggtagatgaaagaaaccagactcaaaagagtatataccatatgattccatttatgtgaaattctagaataagcaaaactaatctgtgatgaaagaaataagactagtcgttgtcagggatgggggaaagggcaggatacttactaggaagcagcacaaggagtccttttggggtgatggaaacattctatgtgggctgacaggcatgtgggttacatggatatgtccaattatcaagacttgtcaagttgtacacttagatctaactatttcatcatatgtaaattatacctcaaaagggaatagagaagattaaagagattaaagaggaagaaactggctgggcacagtggctcacgcctgtaatcccagcactttgggaggccaaggagggtggatcacttgaggtcaggagtttgagaccagcctggccaacatggtaaaaccccatctctactaaaaatacaaaagttagccaggcatggtggcaggtgcctgtaatcctagctacttgggaggctgaggcaggagaattgcttgaacctgggaggtggagattgcagcgagccgatattacaccattgcactctagcctgggagacaagagcaaaactccatctcagaaaaaaaaaaaaaaaagagagaaaaagagactaaagagaaagattaaagacaagaaagagagatagagatttggtgatatcttgtatttgggaggtggtaagagagtgtttctagtttggagcctggtggatggggttaccattctccaagatgaagaataatagcaaaccaaacagttttggggaaagaaaacaagggctattttgttgagtgttgaatacctgtggaatatcctagtgaagatgtccaaaaggcaatttgaattatggatttggtgtccaggagacacttggctaaagatgtgatttgaatattatcatcatcatcatcatcgtcatattaattgtggccatgagaatacctgagattgcctaaggagaaaactagaattgagaaggaaggagacctgagagtgtcaccctgagcaaacctaccattgaatatctgggtagaagagaaggaaggaaaggaggagtggaaaggggagaatcagaagagagcagtgtcctagaacccaagggagaagaaagctccagtaagtcaggggtggtcatcagtttcagatgtttgggcttagcaataaggtagtctttggtgatcatattgagaacagtcagttattagagagggagcagaagcaaattcttagggctgggaataaataggtattaagaagttcagacgttaagtgtagattgctttttcaaggaaccctattaaagaggtaggaagctaagtttgctttggtttggctaggggctgaaggaaatatttcttactaaggaaaattgtcctggggaaatgttccataaggcatgcaatagtcctttgaaaacacttgctcttctgtcatgataaagacaacacagaaagaggagctctcagaactggaaaagcccagctagcttgcacccattcatgacaggaaagttggtgtatctcattgtggatactgagtttttaaaattctcgttactgctgccaaaacactcaatattaaaagatgaggaagttgattatgctcagcacaacctactctttaccttttaaaatcttcaatgcccatagaaaataccaaataccaatagtaagtttaaaaggttctttaaggactctagttgcctgccaaggacccaaattatttttcttaagctgaattgattgtgttcaaagaggaaaacctgatacagaagcaatctttccaccccattccccccaccaatgccagcctttgaggtgagctgggttttgcactatgttataatgctgtcacataccaatatatatttcttctccaactcttaaatgatagtaggtccaagcctggtatgtgtacagatgtagttagattcaaggctggatttttttagtttgggcaccctctctgtagaggttgtttagcagtaacaagatttattcatccaaatgaaaattaatttagctttgtgaaggatgttttctctctaggtcattttcccccctcatatttcccagaatattggttctcagcctgtcaactgagattcttggaatttgcctctggtttggggaaatggttaagtaaacctgtagctgcttaatgcaagatacttaaatagtgggtttcattgattgttaatctgatttgaatttgtcttcatttgtagctgattctgtaaacctgatcaatatgtgcatcaattactattttcaccctgttcttcttacttttaataatattaccactttatgaaacagttgaatcctgtgcttcagcttttaaacaatgaagagaatattctttttcgtcaatcaaatgttgtattctctcttgcttataaaatgtttatgtagacttgtagattttgcaagtagatttttccttttaaatgccttatttagtgctatatcacagatgattttttctcaggttaaaggggcaatattctaaaagattactgaagattagatcagctattgagaagaatgtattagctgttaaaagctatgaattcattgcgaaaagaagagatgaaagagcttccttttctttacgttttaatgtataggcaatgtataaattttgtatagttacttgaaggtgatcccatctcaaactcttgtatagtttgtgatgatttttgcaaattaaatggaatcccatataattactatggaagccaactcattcatggaaaattttccctagaggatttagaatatgaatgtctgagttcatactgccatatatctgtaaatagcatccagatattgacagtgattaataaagaggctaaaggaaaccaaatgatgccaaagaaatctcagagagagaaatgatttccccaagttccacagtgtagaatcatggggacaactaaggtctctagattcccattctaggattctttttttttttcacccaggctggagtgcagtggtgcggtctcagctcatttcaacctccaccttccagtttcaagcgattctcctgcctcagcctcctgagtagctgggattacaggtgcctgccaccacgcccagctaatttttgtatttttagtagagacggggtttcaccatgttggccagggtggtctcaaactcctgacctcgtgatctgcctgcctcggcctcccaaagtgctgggattacaggcatgagccaccatacccggcctcattctaggattcttaatacatcatgtaacttcagactccctgtgttctagaagagagttttggcggccatctttttagagtctatttttttgttttctgagagtattgagaaatttaaaaatccttcttgaagcaaggaaatttgtatcagaattaatttctggaaaatacctcgttgtgttctgtgggtgtgagctctggtctgtgacctctgatcaaacagtaaggaaggtagtgtggtagtgtttacttctagagaaaaaatataagcagtttttttgagggtcacaggatgggatgtttaggagtgatgttttatatatatatagatatagctataaatatacacatacatacacacacacacacacacacacacacacacacacacacacacacacacaggactgtacattaccgtgatttttgtagaggaagtctcagtaataataagaagggtttcaaagttaacctctcatccctgaacttgttaaatgaaaccaggcattctgggaagaacacttgcttctgggtcttgctttctctttgcaacagttgggaaggtagagaaagagaatcaatacagaatccataaacttgatctctggctcctacccttcttaaataatattagtagtgcaaagataccttgtcacacctgtgctctgctaccactgatttctctttccttgtctgtcttttggttcatgttgggctagagtgttttattttctgtcttcaaagggaaattgaaactgtaggagaggggaaagaataaatacatttatatgtcttcttgacctaagttgcaaaagcaatatcttggtttaagaaaatgtgatggaaggattctagagaaatgccttcaggagatgtttctgttttcaaagttggcagggagggattggggaagggaaattcagagaaggcctacagcagtgttggtgttggttgtgcttgtttcattcctttccccgcctcttttttttttttttttttacgcccataagcacagcagaatcgtgcttgttaactattctagagtcaggtcgctttctatgtaggatttaggaacatcaatagacactgcatgataaaaacagtggaattttatagcattgttttcttattcctagaacttgattaatttctcttgaacttgaaagattcttgaaagattctctgcttctacttccacttgctacttacactcagtgagtttctaggcctgggagttaatgagattgagtcttctagatctttgtgtagttgtgacatggaaaatgatcttgtgtattgtgttgtgttgtatttctagaactctatggctttgacgtgctcatagattctactctgaagccatggttgttggaagtgaatctctctccttctttggcctggtaagtcagttccatcaactaaaaaaggacaaatcttcaagtagtacttaaagcacttttttttttttgatcatttctcttggcactagaagactgtttttttcctagttattaggtggagataaccagactttcttaaatcagctggtttatggcataatatcaaagtgcatatgacaaccatggatctctgtcttcctagtcaatttacaattatatcattcctgtttattaggtttctaagggatgattcttgcattcagttttatccctgtagtttttttaatagtaggtcttctattaagggtaaagaaatacataaggtatttccttcattaccgaaagttttacaggttcaaatccacatacactataaaggtataaacctggatctagggccatgtggataatatgtggtccttttaccctgtctcatgtttaaagtcatccaagtttaaagtcaaaaacttcaaacaacttaaaaatcttttttttactaacctattgtttagaagaaaagaaacatatttttcaataccagggaaaattcttattatatttgcagctacagccagaatttctgttcgctgtacacttctctaaactgagaactctagagatttatgccaaagaccacccagctgctgagtttttaaggatgagagatattggcaaaatgccaaggaatcaaataaagacagattgactacttttggagtgggagtttggcttaacctccatagtaaggtgtagagctagatattacagatgcttcagatgttatgcaactttcgtcaagtcagccttttgcaggttgcccagtaaagtatattatactatactttaaaagtgagaaatccccagaacgaggcactgagtatagcggccagagcagtttggttcatggaggaacacctcagcactgaagccaccgtggccgtcactgccgcagggaggcctcttgcttttggtcgatgttgtttttgttttcatgtgggttcccgcccatctggtgagattttggtataacttgtatttttttttttctttttttgccgtatttgcaagcctgcaagcctaagaaatttgttttagagcagacaataaagactttaaaaagtaccagtgtggccagagttgcttctcttgcgtgtgaatgtgacttgactgttgcagcagcaaaaagtaatttgaatggtggtggacatactcataaaagagcatactgaaaatctgaacctctaaaatccacagttttaatgaagtggtattcttgacttgtgcaaattttgaattgcacaagaccttctggtataaagaaaattgcatgttagagaatcaatggatggtgctgcgtttgcattacagaggacgaatttaacaccaggatttcatttctcatatttttgcccaggatttttcccccaccgcccccgtggattttatgggctttatgtgttgctcttcattgacatttggaaactttgctatattgggacccatcagagggcggctattctgttaacctacacacttatcaattgctcttttctttctctgttctgttagtgatgcgcctctggacctaaagattaaagccagtatgatttcagatatgttcactgttgtaggtgagtagtagtattttctgaactggactcacataaaaattaaccggagcgtccattttatcagactccataggttttgccaactggcaggtcctaagccatgctgaatggtttgtactaaaaaattatattttcagggaaatgtttatatgtttctacgacacttggctccatcctgtcctgaggctgaaccacaactaaggctgagacctgaggcacaggaattaggagctgaggaagagaattagcaaagatctggagaaagtgtatttttctccaagctgggaaagtaaaacccactgaagaagccttgttgcaaaggagactggctatatttctgctagacagtctctactggtctcaacgtgatcccttctgtagtagttataaccaaagcagcccaaagaagaaatctcattttaagtagataagccaaaactttgaagtggagatgcgcagtcaggtgggtattttgtgggcttgttggtttttttttaggtactataaaaagacataataaaatatatttgaaatgaactagtacctgatgtaccagcgaatgctataaaacttagctactctattctccctggatgggaatctgcttctttttaggaagtaagtgaaattagctgaagtccaatttccaaagccatagataatctacaaagccaattttgaaagttgccaatagaccaccttctgcagttccagaagtagatcatgtaacaggatgagactgttcacttgcttttgtaaaaataactttattttccagtcatcatccaggtagccactttaaagtaacttgtttttattaacaactgtgtgttttaaaatggtaatttgcggttactcttaagttcttcaaaaatctacatctctttctcactcagaatcacatttcagctacccaaccagcaaggttaattcatctggagatttcccttttcttctctctagttatggtggttcagagttcagagggtgtgtgtgggagagttgtgcattatgctcctgaggatagatctctgtgatatttatgacagtgaaactgagtttgtgtatctaaagaaaaggtgcagccagacctgctaatttcttagaaaatggcaggttttaatgttgcccattccccattcaggatttgtgtgccaagatcctgcccagcgggcatcaactcggccaatttatcccacctttgagtcttccaggcgaaaccctttccagaaacctcaggtaagccaattccacagcagggagcctgaaggaggcttactgggaagtggcggctgatgtaactgtgggagcagaagcactgtgggtatgaggtcacttagagcaggagaatttggggatcactctagacaggaggcagttatattcagctgtggctaatagcttatgctttcaacattttccaagaaacttactccctgttttttgttttgtcttttctcttggctttttttcattatcttccttctttctgtttttaaaaatcacgttttttccgcctcagattgatatgctcagaaacaaggcacagaaaaggagcctattaattcttagtcattactgcattctttctgatcttcagactagctttgtaaagaagatgctttgttgaaatagtatcttctctacaagtaattctcctcaaaggaccctccatgatcatgagttattgattgaggctaaatgagataaaagcccaaagaaacttatacttgtctaaaatatcatttgatcaagcattgcttcggtctttgtgtactctgcatttttgttccagttaaaccaatcagctgatccttctatttactcattccatcatcttgtcagtccctgtctgttttgaccctgctaattttccacttttgtttcttggcctttaacatttcttcttatttaaaaaaaaatccactttgctcttctcttcccatctggtttgattgctttgcctgctcagacattttggaagtcttttcttattaaatccatcgtcacctttacttttcattttaacatttatttacttgttctatattacattgttttgcattcattgatttgttgcttttaaattgttctgtactctcctgccagattgtaggctctttgaaggcataagcagctttttcttcctactccccattttctctttccttttcttctctccttttatccctgccccaactccactttaaccctttactcctcacttttttcctcccttcttccactcccattcctgctcttgttccttttgcttgctagtctcatttggagtagtgctattttctgtttgcgaaatccatatactattatttattcagataattttttattagaacagggttttcaaactcaaatgcttagagggcctgcaggcaggtaatataaatgagtaaatagaggcaggcataaaacagccaagagtgatatgactgaggtaaactggagagtgcatacctcatctgaaagggatggctgttttactaatgtgctctagctaattactatcaggcataagtgtgggccaggtgttatgagatcttgctattgtcaagagaaatcagaaatcttacttttaagtattggcagccacttcattagaaacaatactttgcaggccaagcataacatgtctttgagctagattcagtctatgcctatctatgaccccgtgctgcagaattattccctaattaatgttgggatgtggaacagggtgtactgtattttaaaggctattatcttggattaaatataaaatcagttaccagggttgtacttgatcagtgcatcatcagagatcaaagggttttctttaatttttagtaagaaaaagtagaggattaacctaggtgtactagaaaaacttaatttaggcagtcacattcctttgcaaattgtttcctgcagtatctgtggcaagaaccacagaattatgtataaaggatcatgaacatttctgtgcagctttaacacagtttctgccaagtttcacttctagaggtagctgtattgccagtcttaaatgaattggtcccttttcttagtttgcctgtcagctttattggcaactctttgcaaactctagaaaatctgttcaatgcttgttttgccaactggtaggtaatggcatgattacatccataagcagcctacaggacacttacataaaggctaaaggaactgtagattggtcatgtgtactgtgtgaaaccagtttgtcaggtggactagttgacttcaggatcttcagtatctggcagtaggattgtgccctcagtggtgagaagttgaagctggaatatatatggcataggagaaagcagtgtgaaagaaaataaatgttctaaccttccaaccacaaagtgtagggctcttgcttttggtttctgcttggagattattttttccttttttatatcatagatctaggagatggaaaatgtaggcatattaggagaagataagggtttattccatttttctgtcttttatagcgtccagtatctgcacagtttcagtcgtcaaaggccaagcaggtaagttctagatcttttggagacttcttcaaattttattttcattctccaaatggaaagttttttagctttagtttttcatggtacatatttttatgtacctatttttttgcgcagtttaataacaaagtgaatgaaaatgaatgcatagaagtctttttggttataggatataagagtagaggatgcaggaacttagggatcctcttttcctgatagtgattatactgagatggagacagttgaatttaaatgaggaacaggggcttgaaggcatatctatcactttgaccaaaataatccaggaaggaaattttccagttcacaaatgaacttcaattttttttttcagacatcttatgaaacatactgttgtctatagcttaatattggaaatgttttcacattgggtgtagggttgtatttgagttccttaacaggtgacatttcaaatatgtagtgatctgcagtttataaatcttagaagctctgccacaatagtgtctcagatgctacctttgaaatacaaacatctttctttctgaatgatcagcatttgctttcttactgtttttgttagcagtatttgagattaaccattgctttcttctgcacagatttaaaaaattctttttgaagtaataggctagcagtgggggtcctgtgcctgctatttgatgctttagtatgagggatatagatattctcatatataaacgtgtcactgcaactgttgtttagcaaaaagctccagtatatttattttggcgtttgtactctctgatgcaatttctggtaagcttgaatgcttgacatgtaacttttcttagctactgtttctgataaagtgatttatatggtttatgtgaatccaagaaatgaaaaataacttactggatgccttgtctaatatttagtaactgattaatgtggctctgtagtatgagttttggtgcttagttggtggaattcgaaactctataatatgtagtattttatatttagtaaatacctaagtatgctagttgctcccatggcagaaaacaaaacaaaataatgctgttgacttcaaagagcttatattctaaatatacctggaactaatgtactgaaaggagtacgttaggaaaggggtactctttcatagcctgtggcatttgactgtaaagaagtgtctttgataggtaattctaatttatttttacttacttatttgagacagcgtgtcactccatcacccaggctggagtgcagtgacgcgatcacagctcactacagcctggacttcctgggctcaggtgatcctcccaccttggcctcctgattagctgggactacaggtgcacaccaccatgcctggctaattttttgtatttttggtagagatgagggttttgacctgttacccaggttggtctggaactcctgagctcaagcgatctgcctgcctcggccctcccaaagtgctgggattgcaggcatgagccaccatgcccggcctttgatatgtaattctaatcttaatttctcattatcaattttaattccattacatctagttgcattgcttgaattaccgtaggttgtaataggcttgttggagagcaagacctctctttagtagtaatgtatctgaatacttgcttacgtgacataaagcctttctggctttattcagccagctttatacatgttgaattctttgacttttattgtactttgcaatgttctattttgtcattgtctttctgttaacgaagcactcttaacttcacagtattttcattggagctaagtaaaaaaaaaaatttctttgttctgaccagttagactgtgtcaagctttctttttctgttgctgtcagattgtgaattctcttagtcctttgccctttttctgccttttcctttttaaaccattatctctatatttctcctttctctttaatgtctatggttcaaattttccactcaccagaaattgtatggcatggtactgtggaaagaatatggacttttacagtccgatagacctggattcaaatttgagctctgccaaaaactagcaattagacctttgggcaagttctcttacctctctgaggctcaattcccacatctgtcatatggggataataatatatacatgaagttacagtgaggaagaaatgataaaatggaggtaaaatattcaggataagtgctagacatgtagtttacactaagaagatttactccccttcacacttttgagtcttttgattttcccattgtcaagatctcttgttattttgatattcacctgtttgtagtcatgtttttcacatttgccatcatccacaaatgctattttgtttttccttccagatgttaatgaagattctaaataatgcttagttaatacccattccagaaatcactttctaacttgattcactgctatttatcttgcagttacactgttttcagtgtttgttgatgtgttatattctggcactaacccctaactggaaatataatttagaataaaaattttgtgaaattttctcaaatgcttctctaaaatccaaagacatttaatatattgctatagttccccttttaaaaatcttgtcctaaaaatgaaacttttaaagcatgttttaaaataaagcattcttcatactattcttcataagcccattatcctctaagttattagggattttttccttttaatatttgttccattattttactagggattcgagttaggtttaccaggcagtaaccaccaggagcatacttcttacatttttgaagattagtacctcatttggtttttttctaaactggtacctcctcagttcttcatgatttttcaaacataattataagtggtttgggtaagttttgtttgtttttaaagccaatttccttaataacaggatgcatgtctctcagacctgctggcttacatttattccaaatttctagatgctgttacacaagcctacttgctttctcccctccacctgccaatttcaaagtataccctgattatcagtatgtttaaaccttctcttagaagccatttttttggtccatttccattcagatttattgataatgtggtcttttccatttgttttctttcatttgatagcattcattttacttttaaacttgattttacctgttgttttttagatggtaaaatgtatcacatataaattgagctatttctagttcctttgcttttaatgaagaattccaaactttgtaaaactgcattgggagatttttattctttgcatgtgttctctgtcaagcaaattttgtttttgcccctcaattatgacatagtcttaggatatcttgccatttttccccattccacattttgttaagttcttctcatcattggtacttgccagctttttaaaggctgagagtcattttctgattcaacatctgtttcttactactttgattgagtggagactggtggttccttgtctcaataatttcacactttcagccagttgttccttagcaatgatggttagatatgtaaggtttcttctctgggaagatttctgaatcgtaagttgtactattgataaattcatctttatccttggtgcatgttgcatggcagaattcttgacagtaatttgacagtttataatttatctgagcactggatatctaaatcatgtatcttttagccagaggcaatggttctcctctctaagttcagaggaccttacttccttagtgcattcagtcaactcatgggaatatgtggatttattatatctaccacccagagaatgtagttgatgtgcccaaaggcaaagctgcagaatgacttgcgtttggactgttttgcccttgtttttgatagtcttggtggcctttcaaatcagtctgattcctttttttttttttttaactttgctttgtttttaatctccaagtgtgtctccttgacactcataagcatttattttctttttttctgtccatcttatcctttcttcttcccttctctctttctctaccttttctttcacctgtgtctataactcaggtcacagaattagagacctttctcagagctcttaaataccccaactagaagcacagacctgaattcctacatgcctctacccgaccccaaacattcacaaataatgtacacagtagctagacctagaattgtaggctgtaacaaaggagtggttgtgaatgtatatgggagacaagtctttgaaagtgattggcagagaagttttaagagttttggggtgctaattcattggttacagaaaccacattaggttagtaggagaaggttgccacatcattatctcaatttctagaagccaggaatattaaaaaaaccattaaaaacaatacccaggaattggaagttctcattagatgtcattcaatagtgatttgacccctgttcttttaaatacagccatgcattccttaatctgtttaatagttaataactttttctttaagtacttttaattgacctttgatatagcttttagtttatcaaccttctaagtaacattctttctgttcttaaatgcttaataaagatacctatttttattatatcatttaaatgaatgtttgtttcttactctctctttacgtaatttgagatttgaggctgtttcttactctctctttacgtaatttgagatttgaggcccttaaatagtgtcatgtaagaaagctacttaactgtagaggactgactgccagtggctttattgttttgttttgttttgttttgtttttgagacagagttttgctcttgtcacccaggctggagtgcaatggggcaatcttggctcagtgcaacttccgcttccagggtccaagcgattctcttgcctcagcctctcacgtagctgagaccacaggcatgtgccaccaagcccagctaattttgtattttgaatagagacaaggtttcaccatgttggccatggttggtctcgaactcctgacctcaggtgatccacccgccttggcctcccaaagtgctgggattacaggtgtgagccaccacaccaggctttgccagtggctttatgatcagagacatgctgtgatgggtgaactaggtaagtattttttggcaaacaataagtagtgtgtgatcatgagaaaagtcatcaaactatccatttaatatttttgactttttccaaattatacattaaataagtgttcacactttttaaagatttataaacaatggttatattatttatatttgtttccttcctaaatctttcaactttcccctataaaccctctcattttaacatctactgtttaatttattcccagagattgaggaagtaaaaatatttcccaaaatccttctgcaaagtttacttctagccatgattgatgtcagcactttcacgtatttgtttgttcaaccaatatttcttgattgacttcatgccaagtacagtgtattgttctggatgttgaagataccacagtaaaagcccctgcacttcacatgttgcttacatctgttgatttcatcgttttcttgatatagatatccatcatggagttgccaatcagaaaatttagcttttataactcccatgctagctttggagattggttagttggtctctcttgtgtccaaagataaaaccatccatggttggttatttgtgtacatgaatatattagtctgttcaggctgtcataacaaaatgccataggctgggtggcttaaacaacagaaatttatttctcacagtctgaaggctgagaagtccgaggtgccggcaagataggcttcattctaagtcttttttctgttggcttataggtctccattttgttgtatgctcacatgacctcttctttgtacacatactagctggggtctgggggagagagagtgagatcaaactctctggcatcgctcttttttttttttttttttttttttgagacggagttttgctctgttgcccaggctggagtgcagtggcgtgatctcagctcactgcatgctccgcctcctgggttcacgccattctcctgcctcagcctcccgagtagctgggactacaggtgcccgccaccacgcccagctaattttttgtatttttagtagagatggggtttcaccgtgttagccaggatggtctcaatctcctgaccttgtgatctgcccaccttggcctcccaaagtgctgggattacaggcatgagccaccgtgcccagccaccatctcttcttataaggacactaatcccattacaccagggccccactctcatgacttcatctgactttaattaccttccaaaagtcccatctccaaatgctgtcacattggaggttaggacttcaacatgagaatttttgagagaaaccaacattcagtccataacaacgggtgttgctaaaaaggccaaaagttagttaccacaatgcctttgaatagatattctacaaatagagagagagaaataatacctcgtgacaatggggctgctgctctctggttgaagttacttctaagaatcaagaggacaatttgcacccatgtgggtgaattctttcttactttttgtacttggcagatttgtcttatttttgtctgtcacttcatctatttcaataatagtgtattattatgcttttatactgacttccttttttaccttcctatttctccactcgcataaaatcaaaatcacttaaaacttgtgttttcagatgacctccctcatcatcatgtagaagctgaaatagccaagatcctcttctgggatcagtgatggacagggcccatttggctgccttcttggagtacccagggtagtcacgtttgtgccaggcctcttgaagtccagcaaccacagtgatagccttttggccacagctcttttctgtgttactgatgtctctcatctcaatatttccccctcaaattgtaaaacatttcacagcccaactttttcatttgtgatataatagattgttccttggttttgtgtcttatgtctcaattctcttaattgttcatctcctgtgctaaaaatatacccactgaaataaatacacatttatttttctattgagggcatcttcagatttttccatatccttgaaatattggatgtgctctaaaaccaaggtttgggttaaatactagcttagaaagtcacgtggacctcattctttctttcttctcttttctctctcaacccatagtgttcttttactgttctgttttctcctcttgcctttgagtttattagctttcgtctgttttccagggttccaggctgagattaattacagaaagtgggctatgaatttgagcttataaatctttagaaaaataatgatgttgagggaatgaacagagggtaatgaggagtaatgaaaacttaaaaaattttttttactattttcattttcttctccttagcgttgccgtccactctctgccagtgatgcggaaatgaaaaacctcgtgggctcagcccgggagaaagggccagggaagttgggtggttctgtgcttggtctgtcaatggaggaggtaaagataagttcattttaggcttttgtgggttaacacagggtttagtgaaaattagtgagtgattgataatattcatgacaaactcatgtcttacattgaaaagagaaagattcaagattggagaaatgttttctcagggaagaacattttaaatggaattaatttctcccttcatgctactttcatattcttgggtcataactatcttcctttgtcctatagccacatggactccggttttcaaaataggtactcattttatcttatttttcatctagatcaaagttttacgaagggtgaaggaggagaatgatcggcgaggtggatttattcgcatatttcctacatctgagacatgggaaatatatgggtgaggtgactaccttttttttttattctttacctgaggtccatagaattagattaattgtgatacactgtcatcactgctccccccgatgatgcttttcttattttgtttatttataatatgataaatattatccaacccgagaactagattattgacagtaatttaatatacctgtgtattatttctcccttttaatcctctgcctccctcctaactagcttcctatcccagggttagggactgtcctaaactttgtgtttatcattaccttgatttgaaaaaaaaaattgtttatctatatgtgtatctaagcaatatattgttttattgagatctagtttatatgcagtaaaatgcatctattttaaatgtacagtttgaagatgatttttggcaacaataggcaccagtttaaccactgctactgccacaatgaagatataaaatatttccatcaccctcgtagccctctttatccccttttatattcaatcctccacatgaccctgggcttcagacattatgacctgccttctgacattacagtttttctacagttccacataaatggaatcatacagtatgtactcttttgtatctggactcttttgttcagcgtagtgtttttcatattcatatgtgttggtttatgaagaatagttcattattattattatatactatgtcattgtttgaatataccagaatttgttgaatataccagaatataccactcatcttttgtagacatttgggttgtgttcagttatggtctcttttgaagaaagccgctgtgaccattcatgtacaattcccagcacctttaaaatgtcttttcgtcattttcaggcttgcgtttttctgatgagaagcatacagcaattattgtctttgttcttctatgcataatgtctttttttcccagcttgcttttaggattatctctttataactgatttcctcttttcttttcttttttttttttttttggagacagtgtctcactttgttgcccagactggaatgcagtggcacaatcttggcttactgcaaccttggcttcctgggctccacttcaagctatcctgccacctcagcctgccaggtagctaggactacaggtacatgccactgtgcatgactcatttttgtatttttttgtagagatggggtctccccatgttgcccaagctgatcttgaactcctgggctcaagtgatccatctgccttggcctcccaaagtgctgagattataggcgtgagacaccgtgcttggtcacagctgattttcagcagtttgattatgatgtgccttggtgtcattttcttcatgtttcttgtgctcgggattcattgagcttcttcatctatgggcttatagttttattcaaatttggaaaccttttggcctttatttcttcaaatatttttttctaattttctcctttcctgtcttcttttgggactctggttacatgttaacttagtttatattttaccacaaatctggctgtgctcatgttttttcagactttttttttcttgctttccttaatttgggatggttttgtatttctgtgtgtctctaaggtcattcatcattttgtctgcagtgcctagtcctctattaattctacccagtgaaattttcatttcagatattttatttttcatcagtttttgtgtgtcctttttctctttttcattatgttcatgatttcctttacatttttgtttacatgttataatatttgtaataaatgttttaaaatacctttttctgttatctgtcattttggggtctgtttctattgactggttttcctcatgtttatgggtcacatttttgtttcttcacatgtacagtaatttttttaattgaatgctagacattgcagatgttatattgttgagtgtttggattttattgccttctttaaacccttttgaatttttttttttttggtcaggcacttaagttacttgtagatcagcttatctttttcaggcttatttttaagcattgttatggtttgtttatagtagctttttgtctagatccaggttagttcctccactaaagagtcttttgaggtgtctgttaaattacctccacgttcaatgagatcttttcattctgtctggtgggaactcaatttgcaacctcatgtgagctctgggaattattcagcttacaccttaccttctccttaatttgttctttatcctgatagttgcactttgctcagccttgtggactttcaccctatacctaagcagatttgtattcacccaaacattcaaggggtccctcatgatgatttttgaatatcttcttctgcacaacttcttctccaggacattgctctgaaaattctagctactccctagaaattagatttctcttgtctcttttcagagacagttgggctctatttgcatttcctctctgtctgtgtagtctggaaattgcctttaggcagaaatgtagggcagttgtacttcgtgtatttccctctgtcagagatcacagtcctgtgctgccagttgtttaatgtctgaaaacagttatttcaaataacttgtaaacttttctagctgtttatggtaggagagcgtgtcctgtaacagttatcctctcatgtatagaagcagaattctattgttttgtttgaatcacttttaaactttttcttaaaaaaaaaaaaaaaaaagacatgttctatgtatttttgcttttttcattcagcattttgtaattcaggttcatgttacatatagttacagtacagttttttcaatgcttttgtatttactgtgtgtttatattgctgttaatttttctgttctcctgttgttaagtatttgacttctttctggtcttttgctgttaaggacagctgtggtgcagatattcttgtatgtgtctgctgggcatgtatctaggagtggaattactgggccttaaaatatgtgagccagtaaatggcctggtgccactcatttcagatccgttgctgaagtttttgtataggctcagtgccttaagacatgtgaatgttaagctttaaaaggtaatgctttaggaaaaaagataaagctaaattgttttccaaagtggctatgtaaactatcagcaatgcataagagagtctgttgatctgtatcttctccaattgcagtactgtcagacttcttaatttttgtcaatctaatgggagtaaaatatcttattttggtcttgatttgcatttctgtgatttctagtaaggttgacactctttgtacttgtttataggcaacacactttcttcctctggtgactgcattttgacctagttgggatgttcgtggttctaagtatagaggtagaacttagagaaataaaagaaaaagccatttttaaaaatttgcctgcttgttttgaaaacctagctgttcatagagaaatcgtccttttatcttttaaaatatgctattcatgtagttataccttatgaagacctaggagttcaacagaaaaatattacatgggttttcttgaaaattatatatatatgtatatcttttgaaatgttttttaaagaatttgaatttttgcatttcctagaaagtgtatcttttaattaatgaaagggggaccatttacttttgagtatttcaagatataggaccttactttgagtatctttttctatggaatcaattacaaataatcttgaggtctcttaaggaagtccaacaatgatacctttctttactaggttggttttgaactagttgagaaataaaacaaggactaaaatagatagaaaccaaaatactgtattttttactgataaagtctaggttgggggaattgattgtaactgtctacaagcaaatgcacttcctgttgagcttcagaattggacggacttatattcctattgtaagcaaggttggtctgagccatgtatggggagtgctgaccctataggagcagtagaggatatgtatttcctaagtggggattagctcccaggagaaaaaagagaggtgctcagtgcatcattttctgtttatttttcctaaattaccaatcacattggtaagttactctaactctcttggtgcgttctgagaaaagaggctcaattaatattaattgaactgcctttacatagaatgtgggaggtatgtttatctactaacaaatatgctattttattagtacacatatattatcaacaaatgtctacattatgcttggttctttggtgtataaaataaatattaggtgggctccctgtcagttgagagttaacagtatgtttatggaaaattatttacacatataataagaatagctttattactttattcctaataataatcttaataataagaatagctcatatttgtatagctttttgtaattttaatgtactttgtatacttcattgtttcactcacattttaatgacagggattctaaggctcagtaaaacaatgtgacttgtccgtaaccacacagtgagacttgggtcagatattctgatctagatctacttttttcctgctgcatcatacagctttcctagaacaaaaagtttgctctgtaggcacaggttatgagaggtccttaggcatacagtaaagacacgttagggcatatcagggaaggctttgtacagcagggtggacttgacctgctttttgaagggtgtagtacagtagaaaactgcttatcagcagaggattatcagcggaggataccttccaagagcccctgtggatgcctgaaactgtggacagtaccaaacagttgacccttaagcaacatggatttgaagtaaaattatacatggattctcttctacctctgccaccccgagacagcaactagatcttcttcctcctccttatgattttcttaatacattttattttctctagcttactttattgtaagaatacagtatgtaatacatataacatgcaaaatacgtgttaatccactttttgtgttattgataaggcttctggtaaacagtaggctattagtaattaacttttttggggaagcaaaagttatatgcggatttttgactctgtggcagggccagtgcccctaaaccccacattgttcaagggtcaactatatatactatgttttttactatatatgtacccatgataaagttaaatttattaattaggcacagtaagatattaatagtaactaataataaaatagagcagttaaaacaatattctgtaatacaagttatgtgaatgtggcctctcaaatatcttattgttctgtacttacccttccttttgtgatgatatgagatggtacagtgagatgagatgaagtgaggtgaacgccataggcattgtgacgtggtgttaggctactgttgaccttttgtattcctgaatgtgtgtaaccatcccttatttgcagtaaatggcttggtgtcactcatttcagatcccttgctgaagtctttgtatgggctcagtgctttctggtgtgacacactgctgtcacttgctcacgtcttccaccccaaaatgtaatgtcttttccacctgagcacttatcatgcactgtggccatcacttttgcaatctgaggtgtgacagcaaaactagcatgaatttctttcttcttcacgatgtcatggatagaaaatttgttcttattttagcagctccagcatgtgatttctttttccttaagtcaagaacttttaccgtttcaccgaaaggaagcactttacagttctctttggcatatgcagattgccagcctcactactcttatcttttggggccattattaagtagaataaggattctttgaacacaaacactgctaagtgattcatgggcctggagtgtctacagtgcagagacgctggacaaagggatgatccacattcctggtgggaaagagcagaatgcatgagatttcatcacgctcctcaggacagtgcataatttaaaatttatgaattatctctggaattttccatgtaatattttcagtctttcgttcactgtgggtaactgaaacatgagggaggaccactgtatagatgtagaggagatatggggagaagataaccagtcagaggcaaaagatcagtgggaggtgagagagtgttactggaaagggatcccgatccagaccccaagagagggttcttggatcttatacaagaaagaattctggtgagtccataaggtaaagtgaaagcaagtttattaacaaagtaaaggaataaaagaatggctgctccataggcagagcagccccgagggccgctggttgcccctttttatggttatttcttgattgtatgctaaacaatcaagaaataaggtggattatccatgcctctcctttttagaccatgtagggtaacttcttgacattgccatggcatttgtaaactgtcgtggtgctggtgggagtgtagcagtgaggacaaccattgttcctctcactgccatcttggttttggtgggttttagccagcttctgtactgcgacctgttttatcagcaaggtctttatgacctgtatcttgtacagacctcctgtctcatcctgtgacttagaattcctaaccatctgggaatgcagcccagtaggcctcagcctcattttacccagcccctgttcaagatggagttgctctggttcaaatgcctctgacaagaggattctaaggagacttggctgactgtactgcaggatccgtgttgggcaactgtgtggagaaagtgtgaatgaattgatgttacagatgatccaacttttgaaagtttggaagagaaagtatttgccttaagcagtagacatcgaggagccactgaaagctcttaatttgggaataacatgattgaaacagtctcttatctacattttcaggccctttatgcatctcctattcccagtttcatttgacctatatataaatttttgttaatttttcttttatctttcagtcttattttctgaatttagtatattacctattattaatccaagaaatgctggtttttctttctgttttctacattaaatcctctttttccatattctttttattctatttgtttctattctagtatcttacgatttaaatttgagcaactgtcttttcctttgccactttagaaacagtatgtttcattaaaaacagtatataagtacccctgttatttctgtgcttgattcatggttgtatttctacattttcctcttgaactagcttaagaaataaccagtttctttctttgcttttcaggtcctacctcgagcataagacctcaatgaactatatgctggcaacacgcctcttccaggacaggtagagatttgctaaactttaaatttaggactagatcacaagattaacagaaagtacatgtcaaagaaggaaacagaccttataaaagtctttatgtaaaatctctgctagaaaaaaaagtcctgtagaaagcatgctatcatgactcatttttccagaatttatcatgaactctcagcactttgtaacatttccaaaagacaaaaatttaactataaagatctttgagcaattttaacagatgccttaaactttattcttctttaaggaaggcctttacttagtgccattatattttagatgcagttttaatagacacgattatctgtttttctagacctgaagatactagaattatcagattggaaaaagtggaggggaggtaattcgtaaaataaatacactgaaacttttataagaaatgacaactgataatctcagtacaagggaaaatggaaatgatggaaaacagacattggaatttaaatagcacagcaatcagggctgcttagtcccacatacttttgtagcccctgaaacataactgcattgcagtacagttcattaattgattatcaaaataaggcaccctagttatttagagaaacctatattattttgaggatatatgtacgtttttgaaggattcttaaaatagatacccatgttttaaccatctgcaatttcatgatctactatcaggaaatacatgggatttgcaatttgtctctgtaaatttgtggtaattacgattgattaatcacattgtgtagattctaaagaaagagatctttggatttacgtagaagacagaatctcatttctttatatgtataaaacctgtgggtttttcctcccctctatgaaaacttttacaaggtttcttttatctttagagtttagatactttgccaggatgtgttctgatacgtcatttttcattattttggttatgcagtgagtgcggcctttcagtctttcagctgtgggaagtatttcccttatcctttcttttctctccttgtggaattcctgttagataaattttggctataacctccatatttctttactgtttttaaacttttggttttgcttcttagccttaaattcttggagatttcttggattttgtcttccaaaactaaattaatcttcaaccatatctatattgttatttatttcccacacaggataggggtgtttaattaagttttttattttggcaagtgtgtttttaatatacaagaactatttttgcttttcgattagttttagtatttcatggatgtaatgtcttttcagatctctattttagattgtttaaagttcctttctgttttttgcattattttaattcttctggattagttgtatttattcatcttattctttctagttttaacttctatatatctgcaaatgtatggtgatctttgtccagtcatatttagaagtaatgaactgtttgcttaagacaggtagtttgcttcacaggttatataggtctgtttctgaactgacatggacactgcacttgaggctggatctttctatacttgaatttcccaggaaggggaaggagggcagagtaggcattctggggaccactgcattagccaaaatgaggaagtatctgcctaggagtagcaaaaaataaacaatttgaggtataataatatgtgtgcctctttgttaacatattaaatagtaagagctagcagcagatctaatacctaccgtaatttcaaacagtgataaatattgacagtatttcaaaatagttgtaagaattctaaaataatatgaagaaagatgcattatttcttttggtaatgaagtcacattaatccactactgtggatagtttcctacatttatatggaggaaatgctaaatttcagttagaggatgtaagtttttttctatccaagtttgtatattgcctgcattctttcttgaggccccagttaacagctcctgcttatgaagcattctaaaaactttgattaaaaaaaacataatttggccaggcgcggtggctcacgcctgtaatcccagcactttgggaggctgaggtgggcagatcacctgaggtcgggagttcgagaccagcctgacccacatggagaaaccccatctctactaaaaatacaaaattagccaggcttggtggcgcatgcctataatcccagctacttgggaaggctgaggcaggagaatcgcttgaacctgggaggtggaggttgctctgagctaagatcgcaccattgcattccagcctgggcaaccagagcaaaactctgtctccaaaaataataataataataataataataataataattttccctgtttagctaagaaaaaccctcatggtctacccatgcttacctttttagcctaattgtcactttttcacaccaactgatggccatttctacttgctcttttatacatccatattcttacaaactccccttcttttggaatggccttcaatccatccctaaattcttctagctttgtccttcctcctctatcctagattagaaagaggtactcccagcccttcttttatccctcagtctaatttagattcccagattgtataattgcctgtttactaatttgtgctttccaggttggctcttaagagtagatactttgttatgttcatctttgtcagtatcaagaacctaccacatggtaggcacacacacggaaacatgcattgaaaaaaatgagattgtgtttgtagcaagtcctagtatcttccaataaatctgttctctcatcagtctaaattgatattttccttcttgcagatccaattaattttgttattattaggaccattttcaaactaattctctactcatttcttttaggttaattttgactaccttccttaccttcttgactcctccccgacctacccactctgttctggcaaacagtatcttacatactgtcttatactatggcagttgctttaaccctggcttatgtcctggccacccccccaccgccccccacccccacccagagtgaagtattggtacttactaaaagctgcccaggtaattataatgtaaagtcatgattgcaaattactggagaaaaccattatctgggtgaaaaacttaaaatcattttgagactttctgatgattacctgacaatatcaggacattaacatggatagaaaacatgggaaaggaaagacaaaacatcttggtgaagacttaccttttcactggatttttctttgcatatcatctacattgcatttgtctctttacaaaaaaaaatcaaaacatgttatgtgactctatataatatttttgaagtgacaattttagaatggagaacagattaatgaggcagggtttaagaggtatgggtagttataaaagggcaacataggggatcttcatggtgatataatcattgagtatcttttctgtggtggatacatgaacctacacaggcagtaaaaatgtactgaattaaatacacacgtacataaatgagtacaagtaaaactggggacttttttttttttttgagacagtgtctcactctgttgcccaggctggagtgcagtggcgcaatctcggctcactgcaacctcctccttctgggttcaagtgattctcctgcctcagcctcccgagcagctgggattatgggcccatgacaccacacctggctaatttttgtattttgtagtagagatgggtttcgccatgttggccaagctgatcgcgaactcttggcctcaagtaatccacctacctcgacctcccaaagtgctagaattacaggcatgagccactgcctagccagaaattttttaagagtgttaaatgaaaggaaattgaatgagagtgttttaaaagaaaaacaaaagcctattttaacatgaatagcactcaatttctgtggttagagcccagtcttagtttagagacaatggagagtatcttttttcaatagaggttttgttgttgttgttgttgttgttttgttttttttgagaggagtctcgctctgttgcccagagtggagtgcagtggcatgatcttggctcactgcaacctccgcctcccaggttcaagcaattctcctgcctcagcctcccaagtagctgggattacaggtgcacgccaccacgcctggctgattttctgtattttagtagagacagggtttcaccgtattgcccaggctggtcttgacctcctgagctcaggcaatccccctgcttcggccagccaaagtgctaggattacagctgtgagccaatgcgcccgtccttttaatagagatttttttttaattgtggaaaatatatttctgatgagcatcccttttgaaccccatgagaattgagcttggtttcttttcctaaaacagttcagtgaaagtagaaagagcactacagtttgagacctaagccagaggctcagatgtaagccctttaagctccggccatggcaggtcaaaaaattattttatcctgctcctttctataaatggagcgaattaacaaccttcttcacatggtggttgtgatgaataagcagtttgctttgtaaatagataagcaagtacaaataattattataatttttctctataatttgtccttttttgttttttattgatgtccctccagctcacagcactctactcttttatgagaatgttctcaatttatctgtctgcttttctgcaaagatgccctccttggcctaatgtcatgttgaatttctgtattaaaaatttctggagtgcatgtgtgtgtgaacttaagagagactacctgaatagcattctctaacccggttgtcctttctgcttctgtaggggaaacccaagaagaagcttattgacaggaagaacacggtaattgacttttaaaagttgagaaatgctttccatgtgcataatgtgtgaccatgcacagactaagcataataccttatataaccatttttagtttggttcagcttgaatagtaacataaaaattttttctattgaaaaagtgttttgtcgccactttttacaagctaagtttgagatttacttcactataactacaggtatactattctaactgaagatggtattctcgtttagctgtgtgagagagagtattaatgagattttgaaactactgtcatgttagattcaagtacagagtttgtgttttggccttgacatacctgaggcacacagctctgtgcctcatggtacagaagagaacctgtttctagtttgccacagaactgaaagtatacaaaacacctgtggactttcatttaggcagagagccctttaaagcataaatctaatttttctttaaagaaggaatacattatgattgccatttagttaagggaaaactgagataaatcaagtttgtagcttgtttccaaatagaaagtcacacttggtgtataagttttctccagttttgagtcaagaaatatgcttcctataacatactgctgttaacttggaaattgagaaaaaagaaaaaaatcttaaacattaagaataaatgaagagcactgagttctgttgttcattttttggcactcattttatattgccatcaatagggattttgggccctgtagaggtgtaagcagatgcaagctggcatatgatagaccatatgctggagcatgaaacaagtcctaatatatttaaaaggattaaaatgatacagagtatgttctttggccccagtagaattgaatatcaataacaatagaaaatcttcacatatttgggaattaaacatttctaaataatccatgggtaaaagaagaaatcatgaggaaaattagaaaatactttgaactgaatgatactaaaaatatgtcaagatatgtacgctacagctaaagtagtgctttgggggaaattataagtttaaatgcttaccttggaaaattgaggactgagatcactgttctaatgtttgttttaagaaactgaaaaaagtagagtaactccaaagtaagtggaagaaaggaaaggcagaaatcaaataaaaaacaaacagtaaagaatgttaacaaaatccaaagtgtgttcattgataaggtagcataattgataaacccttaggtagactgatctagaataaagagaaaggacactaattaccaatatcatcagatagaaaagagaggatttcactatagattcaacagacataaagtggatgctaaggtgcggaaaaaggatattaaggcaatattattagcaactttattccattactttgacagcttagttgaaatgacaattctttgtggtggtgggaaagttgggggcaacacccaaactgataccagctgaagtagaaattttgaaaagccctgtatctgttgagaaaattgaaattgtcctgaaaaactttcctatagagaaaactccaggctcactggtttcactattgaattctgtcaagcatttgaggaataataacaccaatcttatacagattcttttaagaatataggaagggacacttcccagttcatcttacgatgccagcatgactatgattccaaaacctgacaaagacattaaaatagaagaagaagagaaaattacaggctaatatccttcatgaacatagacacaaaatttcttaatactagcaaatctaatctgccattataaaaaggataatacatatgactgagattttccccagtattgcaaggttggcttaacatttgaaaattagtcattgaaattcaccatattaattacaggggaaaaactagattatcatttcattagatatcccaaaaaagcaactgatgaaattcagcacatatttatgagaaaaactcagcaaatcagaaatagaaggaaacttcattgataaaggccttatatgaaaaacctcttgctatcatcatattcagtaaaatattgaaggctttttccatatgatttgtaatagggcaagatgtccactcataccacttttattcacgttgtacattagtatagtaaagcaaggcagtgaaaaaagaaatgcacacagattggaaaggaggaagtaaaatgtctatttttggatgacacgatcaggttagtagaaaatcctaaggcatctgtaactacaagaacacagaagtgaacttagcaaggtcttaggatacaagatcgacatactaaaatcgattgtatcttaatgtactagtagtaaataattggaaaatgaaattttaaattatatttacaacagcatttgaaaatatgaaatacttaggaataaatttaacaaaacatgttcaatacctatacagtaaaaactattaaatattactgaaagaaattaaagaagacctaaataaatggagagatatgccatatttgttgattagaagaattcatatagttaaaatagccattttcctcaaattgatataaagatccagtgcaatttcaatcattattctggtagatttttttaaaaggaacagaccaacatttaaaaatttatattcaaatacaaaggactcagaatatccaaagtaatcttgaaaaagacttaacgtacttgacctaaatactgtaattctacagtattcaagatattggcaaactgatcacattgaaacagaataggaagcccagaaatagacccacatttatatggtcaaagtaatccaatggtgaaaggaaattattttttaaaaatgaggatggaacaactgaatatcgtatttttaaaaatgaaccccaaccgctgtttcccatagaaattagagatgattcatagatacaaaaatgattactataaaacttattgaagaaaacataatatctttgtgactttgggcttggcagtgtttttagacatgacacagaaagcaataaaaaacaaataatgttatattttctcaagattaaaaacttcattataagatactgttaggaaaatgatttggcaagccactgactgagtggaaatatgcatcaaacatatctgtcaaaggattgatatctaggaactatcaagaactcctacaactcaataataaaaagaccatcaacccaattacaaaaggataaaatatttgaacagacacttcaaaaggaagatatatgagtagccaatatgcttatgaaaatgtgcttaacaacattagttatcagggaattacaaagtaaaaccacgttataccactgaacatctagcagaatggcagatattatactgacaatactaaatggtggtaaggatgtggaactaacagaactgtgataaattgtcgttgacagtgtaaactggtacaagcactttaggaagagactggcagtttgttagaaatatacaaatttcactttgagatctacacagaagaaataaacataatcacaaaacagcttgtacaaataggttcatagtagctttattcataatgctccaaaacaggaaacaacctaagtgtccaacaacagagcagataactgtgggttattcagacagtgacctactgctcagaaataaaatgggatgaatactgacacacacaagagtgaatctcaaaagcatgctgagtgaaagaagccttatacaaaacagttcatactgtatggtttcatttttatgaaattctggaacaggcaaaagtaatacatgatgaaaaatttacaacagtgattgcctttaggacgttagggaaggattgactggataggagtgggaaggggcatgagaacttctgagttgatactaatattaagagtttaggttatatagctctaggcatttgtcagaacgcattaagtggacatttaatatttggatatgtcactgtatgtaacttttagcttacccaacacagttctataaaacaattattgaactctagatagtaatgatatgcatgttgaaatgtttatgagcaaaatgtactgatgtctctaactttgaattgctttaaaaattagatagactgatggatgaaggatatatgattggatatatacgtgacgaaacaaaatatagtaaaatgttaattgtagaaactaggtggtaagtaggtatatggttgttcactgtacaattctttaaacttttgtttaaatatttaaaaaaaaaatgttgggggctgggcgtggtggctcacacctgtaatcccagcactttgggaggccgaggcgggtggatcacgaggtcaggagattgagaccatcctggctaatacggtgaaaccccatctctactaaaaatacaaaaaattagccaggcgtggtggcacatgcctgtagtctcagctacctgggaggctgaggcaggagaattgcttgaacccaggaggcagaggttgcagtgaatcgagatggcgccactgcactccagcctgggtgacagagcaagactccgtctcaaaataaataaataaataaatagttggaaaaagtaaatgaaaaagatgtagctaaaagatatccaacttatttttaggaaattcaattgtttgttaattaaccaatatttatggcaagtcagctgtgtgctggacagtctcataagcatctaggatacagtgatacaagacaaacatggtccttgccctcatagaactattattctggcttatcagattcatattttacccagcattccctatcctctatcccttgtactatttaggatttatctgtttatccagggtctcttggttcttagttgttattttaaaatatctttagagaaagagatttgtagtagcttctccatatctgtgagcttttagcgttcatgttttcagaagtttattttttgagtttttgttgataaaaagaaatctttttttcctaaagaatggagttcttgacaatgtagacggtataatgtagacaatataaactcttgtttatataatgaacagtggttcgtgaacgtaaacactgggctttaacttattagggtgttgaattaacttccactcatttaattaggatgatctcaaacattagattgtctccaatcacattaagtttttaagagacacgtcattggagagagagtttgtgtgtttatgagataatgatgtcggtgttaagctatgcccatgtttgtccatatagttatcaaatttgaccaagtttaaaaaaaaatacaaaattgaccaagttagccagacattattgaataaatggtttaaatgattttatctttctatcagatttgttttattttctttattattgaattggctaaaagtttatttctatagctctctctctgtgtgtgtgtgtgtgtgtgtgtgtgtgtgtactctttgggactctgataaaatacattggaaccatttttaaagttcattgatttgcttcccatttctgctcccagtgccaggaccttcctgtttttggctctttgtcttactctggagagaaggcctccaaaagacttaccatccattccatccacccagaaatccctatcagaaaggtcctaaatagaccaaatgacacagcctttttattatactcagagactgaaaactcccagaggagttaggatgatttcttgacctcaaagggaacacactttgagttctagagagttcagagccaaccaattagatattgcgtttgagcgtagagagttggctacatgctttcagtcactgatatagatactgcttttctgacctggtgacccagagccctctctttggtgacttggttatggctgcctctcttgtattttgctcagtccttgtctagactgggcctcatatcagtcactgcctgatttgtgatttgtgttactttaatgcctaatgtagctggtgccagccccctttccacatcccatttctcattcttgacttgatgtatttagccttgtcctatctctgctgccttcccttgtctgtgcctctgactgtaactccagacctgtacttaacgcctgtaaagtccctgccaccttgctccaccttctcctgtatataatcaggatcttaaaggagggtgggtgccttggcatttcctcatgttgggatgcttgagacttggtgagtccctagggcttggtgacttttcactaagacacttctatgcgtctcagtcaactcggtgctccctcacgtattcacagatcatcagcctttgttcccctcatctgaacctctgctaaatccatattgtttagattttatatacattcaaaagaatatttataaaatgctgagtaagttataatgggtagaaatgaaacaaacaccatttgccaccactcaacttaagaattaagatattgtcgtttttaaggtataaagtattttaaggtataaggtgttgggtggcactttataatccctgcagtaaagtaataatcagtatcactgaacacttaaaggtcttaaacattgtctttagctgcatatttttttagaacatttaataaattcaaatgggtcactagtgaggttttaacgtagattctagtgttcctctttatctgtcaaacttttagaattcacttgagttaccatgtccagtatgtcagcattatggaattctgggaagcttagccttggaatgaaggagagaactttctgaaggccatagctaccatgttgcttttcccctagaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccaggtacctgctggtgagctttcaccaaactcccttatctggatcctgccagactgagttaaccagctgcttactcagtatttcatgagtcagaatcttcctgatcacatacaccttttttatatagttttttctctgaaacttaatttcaacaaagtcttaagtttttaaaccttccactctataatatttgtattgaagactatctgaaacacatacattttggcctttgctcttatgtcagcatcatacaaatacctgatactctagaaataatattagcctgagtttaatggaatcctgagcattactgttcaggttttttataattaggtaagttcagttcattctttaacattgctgaatggcataagtattttagataaagtggaatttctttctctcctagcttctacaatgttgtaggtctgtttataattgactgatatactgatttcctttttttctctccttccctcctgtgaacgtctgtgtcaggcagtgtgttagtcactgaggttttgctggtaaataaaaaagatatggtctctgtcctcatagaacttacaaggcgatagagaaggataatgaataaacataggatagaaagatattcccctgttctttatacctccgtgaagggtgctttttaaaaaatctctaatacactgtagaaattactaagccaagggttttttgtttttttatttttattttttgccttaagttgtgagagagtgatgatgagagtatgatgaaaaatgtatactttaatgaagattattaataggttttagaatatgtaacattaggccaggcatggtgcctcatgcctgtaatcccagcactttaggaggccaaggtgggcgaatcgcttgagcccaggagttcgagaccagcccaggcaatctggcaaaatcctgtctctacaaaaaatacaaaaattagctgggtatggtaacatgtgcctatagtcccagctacttggaaggctgaggttggaggactacttgaccccaggatgtcgagctgtaatgagccgagatcctgccactgccctccagcctgggcaacagagcgagaccctgaatcaaaaaatgataataaatgaaaacaaaaataaataaaagaatatatgagattagagagtgacatgtgggtgctattaattctgtgccttgtttgtggtttggtttagaaatgggcttttactaaaaagagaaaaggaaggtattgggagagaggaacatttaatccttttttcagcaacattagtgattcttcgtatttagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttaggtatgtatcttttataattatattagtaaaactgataacagctaacttgtactgtgtaccagctactattttagtggttttacagtcatttttcatttaatatttacagaagtcctatgaaataatgactgtgattagatactgttattattaaggaaactgagccttagagaggttaggtaacttgtctaaggtagagctatgatacaaacccgggtctcattggttgggcatttgtgtcagtcactgagtataaggtaactgggacaaggagctcaagcagctcgtcgtttagtatcagagacagagagctcaggccatggccccactatgaacaaagtggtcttaggacacagaaaaagagtgattggtctggcttgggagggctagaaaggcattatggatgagggaaaatttgaatcaggccttgacagatgagtagggtttcaggagctttgggaagtgatggttaaatgtgggagtgctaggtagaggcaataaagacgtagaggtggccaagctcagtgtctcacacctataattgcagcactttgggaggccgaggtggtcggatcacctaaggtcaggagttcgagaccagcctgaccaacatggagaaaccctgtctctactaaaaatacaaaattagctgggtgtggtggtgcatgcctgtaagcccagctactcgggaggatgaagcaggagaattgcttgaacctggaaggtggagtttgcagtgagccaagattgtgccattgcactccagcctgggcaacaagagtgaaactccatcttaaaaaaaaaaaaaaaaagacatagaggtgtgataatacagtcattcattaagtccctcagtgagtttttattgagcacctgccctatgccagttgtgctaggccatatcacattactgtggggaccaagataggcctggagtttacagtctagtggggaagaatgacagttaacaaagaaacaaggtcatttcaggtcgtgagaaatgctgtcaggacaataagatggtgtaatgttagaatgtaattgggcagagttacttaattgcagtgatctggcatgaagaggtaacctttgaggtaagtcctgaatgatgaggagtcagtcgtgtgaatagtaggaggcagaatactcccagcagaatagcaagtacaaaagcccagacatcgtaatgagcttggtgtgtttacaaaatacagactagaggaattatataaggagaagagcatggtaagaaatgagactaaaaaattggatgttgttagattgtgaagggccgtaagaggagcctaagctttattttctagatgacttttaagcagataaatgatacggtgagatcttgttttagaaagtaaatcgtgcttgcattgtgggatagtgaaactaaaggcaggggggtgagttagggactgttagaattgtccagagccaggaagatgaaggccttgatcagagtaatggctttaggagtggagagaatgggatggacttagtaaaatttgcaaagtaaaattgatgagactaagtttttcacatttggaaacttggtggtgcctttggtcaatataaggaacataggagttggtttcatgttaaaaacaatgagtttgatttaagatgtagtaaggaagaagggttctgggctaaagtccaatagacaggtggacagctttgttgatcaaggttgaacaggattgtatagttggtaggtaaagtcttgcgaatggataagattgttcacaaatttatttggttcagcaaggataaaaaaagaattgagccctggggaataccactgttcaatgggtaagtcagtaaaaaggtcaagatgtagcagttagagcaatagacataagatcaggaaggagtagtatggtaaaagctgcagaatgagcatttcaggtctgtagagcctcaaacagccctagttaggatgaatagtgaaaagagacttctggatttgtgacctagggccaactgagtaggtggaagaccagttgtgagtggagaaaataagaaagcaagtgtgaactaactgtctaagggtttggcaatgaaaggaaggtaagaatgcatcagggagacagccagctaaaagaaacggattttttttttttcttttgagaagaggttctggaggttgtttatagactaaggggaaggatttgaggataagaggattagaaatgcagaaatggacatattggtagagaagagtactaaaggaaggtgggaagaggccagaggagggagtatctcttcctatcagtcagaaagaaagtgctatgggatgaatgaagttgacagaagtttaagagcaaggaagtttagccgtttatgcatgatagtctttatttctaaattagaggccagttcttatactgaaaggctggagggtgacattggagtagcaggggatagagttaaggtttggaacagtgtcatggagaataagaatagttctgtcagtggagaatagaatatgctaaactcagtcagaagacctgagctctggctgttttagtgctaccaactggccgtgtggtcatagacaagtcaaagagcttctataggcctcagtttccttttctgtcaatccaagatgtggagttagacaagtgttttttcaaacttcttcctagagggaaagaagatttcactgaattgaaaatagagcatttgaaaaccactggactgtattctaaggtcctttccagcaataacattctgcttagttgttgtagaaataaattatttcttcatgaatcttgtggctctcgctttgaatgagtaaactgttaaaattgcaggctgcgttagtgtcaatcagtggttttcagactgtgttccctaaagctgctcattgttcggtgaagtgtctcagaggctacttaggggtttggggaaagtccacgcacagccagggttcaaaactctaaggatcgcgtcattgttgcatatcttatatactgagcatctgcataaccttttgttttttaaaataggtttctttggtttttattctttctggtttttattctttcatcttttggggggtttgttgcaagtgactagctgaacaatgtgtccaataccttagagacagtctcagaattaacattcgtgacgtttatggaaatggaaacctcaatatttgttcatttgctttgcaacagtgattcacaacaaaacaatgattgaagtctcaacttatgagcaataatccccttatttaaaagatcttcaagttttagtataaagggatgaatccgtggaattggatattctgctacatttgaaggtgtctgaaacatgctatttcttgctcattatattgtaggtgaatttattgacccaaactgaggatcttttaaatttattttgacttgagaataatttgttgtggagacaaagcttataggattgattcagggtaaagtgatatatgctctctgggtaaacaagagtataattattgtctttgaggaacagttgaaaatgtacatttatggccaggcgtgcaggctcatgcctgtaatcccagcactttgggaggctgaggtgggtggatcacctgaggtcaggagtttgagaccaacctgatcaacatggtgaaactctatctctattaaaatacaaaaattagctgggcatagtagtgagcacctgtaatcttagctacttgggaggctgaggcaggagaatcgcttgaacctgggaggcagaggttgcagtgaaccaagatcacaccactgcactccagcctgggtgacaagagcaaaactctgtctcgaaaaaaaaaaaaaaaaaaagaaaatataagtgtattatttcaaaaccatattatgctcccataaaaaccatccctgctagtaacaaagatgtagccttattcttagttcatgttctgaagctcttatgtattaaactctcaaaagcaaatcttctccccagcctgactcccttgccctccaattctccaacatacacatggaagctagactggagccctcttaagatgtgcagcttactttagccaaatcctacctcctaaccttgtgaaaacagtcagtagaaagcattcagtgattgcatttgtggggattgtaaacaaagtttgtgttgggccctaatcttcgctgatataattttggctacagtatcagaaggccgatcagctgaagtaaccaaaatctggcctgaaagaaaacagatctgccatgaacagcagctgaggtgaaaatcatcagtgtctctctggtacttctgtcttccaaactatagcttgatcagatttccttatttccagcctaggccaccaggcagaaaatagctgcgttctttaatgatgttgctaaggtgcttttcacaagacttgaggatttctttcgcccactgaacatctgggcttgtcctgcctggcccatcagttcatctgtgccaaactctgttggacctccctcatttgctctgggctccagccattccatcttgtagttgagaacagtgtggccttaaatttggtcttaagagtccctttataggatttatctatttcctgctttggacacttttatatactagaaatattaattgccattgcaaaatccacacttttgcttttgtactaactgataagttcttatggacctccaaatgtaaaaaacattttctcattaatacagtggtttttgtgaagattgagtacttctcctgtctgttcccccaagaaagttgttaaaaagttcaaagagggtcaagcacagtgactcaggcctatatgtaatcccagcactttgggaggccaaggcaggcggatcacttgaggccaggagttcgagaccagcctggccaacatggtgaaaccccgtctctactaaaaatacaaaaattagctgggtgtgatggtgtgcacctgtaagtccagctagttgggtggctgaggcacaagaatcacgtgaatccagcaggatggaggttgcggtgagctgagattccaccactacactgcagcctgggtgacagaatgagaccttgtctcaaaaaaaaaatttcaaagagaaggagtaagaaatctaattttctattcttctttttttcccttatgctaataatgagaaaataaataggattctccatctctgattcttttaataggaaatttaaaaagaaaaaccttcatgtactgcttagaaggaatccttattcacaggctgtaagatgggtttcatatttcttagccatcataatagaagcatcctcaaaggccacttggagagaagcaagtacacattttgtagttttacacttctgtcacataacggtatgttgttttggatttctatagcaaaatgcaggcccgaatagcattctctgcctatctccagcatgttcaaattcgcctgatgaaagacagtggcggtcagacgttcagtgccagttgggctgccaaagaggatgaacagatggtaaggcttttcttactgaaacctttttactttccctttttctttcttctttctgtatttttttttttttttcctattagggtaaagtgcgatatttttctggtgaaaggattattatgtaagaaggtttttagatttcttataaatctatacttacaagatttatatatacttatttcttatacttcaatgtgaagcaaatctttgacctggagctatgttcattacaccatgtagtgaaggcatcaatgtatttcattttgaattggaaattgatttctcattggacgtgaagccctgtgcaaagccctttaaaagaataacaatttacagtcttttctcaagcaacctcacattattaactctgaggtaggcattatcatccctgttttacagaagagcaaacaaagacctcgagaagccaaggttccacaggttatacgtgatgaaaccagaacttaaactcagatgtactttacttgctcctccattgctttcatgcattgtaaagcatttattttctgtcctgaggagtcaaattagctctttgaaagtcatcaccttatcataggccctgtcagaatataccatcctccaagttggtattttttactttactagttgtaacctcttaagattcttagattgctagaatcaaacttgtataatcatttttactgtatatcagtcatttgaacattcctgggattcagtattctaggacagttttgtgtgtgtgaatcagaatgatggggagctttaagctgtttggtaaggtcagagtttatggaagaagccacagcccttccatattcttttttttttttttttgagacagagtcttgctctgtcgcccaggctggagtgcagtggtgcgatctcagctcactgcaacctccgcttcctgggttcaagctattctcctgccttagcctcccaagtagctgtgattacaggcacccaccaccaagcctagctaattttgtattttaagtagtgacggggtttttccatgttggtcaagctggtctcaagctcctgatctcaggtgatccaccctccttggcctcccaaagtgctgggattataggtatgagccagcgcgcctggccccatattctttttaataacagggatttgtcaccaaaaggagaggggcctttaagtctgagaaagctgcattctttgttccactcagtggtgaccttattgtaatttttagtcctccacatacaaaaggcaagtctttatgccaggcttattgtaaaaacatgttggttatcccagaaaacaacttatgaatttaaagtagccaatggaacccagagataaaaccttgtgtgttgtgaataatccttcaaccatcagtggaaaatgttagctctgctctttccaagtggaaaattgaaactgcctttttgagagtcagtttgtctgctccactgtgaaaaaaataatgttttaatataacagcttaaaccaccctatagtaaagacagcagagtagaactatgaaattcaaccctctggttatgaggctgtttcacttatgctggagtaaattggcaccaaaggacaatgaaccaaaatcaaattcaagaagaaaaaaaatagttcaaaaaagaataaccactgcggatgctggcttggaattcacacagtatttctttggggctttctacaagaatattgaggatcatcactacaaaacttaataccagttctgtgaattctttcttgaaaatatatctaggctgggtgcggtggctcatgcctgtaatcccagcgctttgggaggctgaggcgggtggatcagttgaggtcaggagttcgaaaccagcctggccaacatggtgaaaccccgtctctactaaaatacaaaaaaattagctgggtgtggtagtgcgcacctatagtcccagctacttgggaggctgaggcaggagaattgcttgaacctggcaggcggaggttgcagtgagctgagatcacaccactgcacttcaggctgggtgacagagcaagataccgtctcaaaaaaaaaaaaaaatacatatatatatatatatatatagagagagagagagagagagagagagagaaagagagagagagagagagagagagagagagagagagagagagcgagagtacaagccttaccccattccctgatgattgtagcagtggtcttgcttttgaggaaggtagatgtagagttggcctctgtgttccagcttaggttagagattccttatctcataactcacagaaggcacatcaacagaacgtccccagatttatcatctgaaggcagttttattgtggtttttggacaacaacatctttaaggctcttggccttataaaatctctctttgaagcatttatgatttcatcagtaatctgattggtatctgttcagatttcaaaatcctttgcccccatcttctgtgagatgtattctttctttaccttaataactttccactgtgccctccttgacaacccccaactctaaaagctcccttattcttggggaagaaaaaaagctattacctttcaaactactgtgatagttctttctttgccttaatcacgacacttttaaagtcattagtttctactcttcacgtatatttttcattacccatgcattttcttaatgtcttcttgtactctctttattgaaactgttttcttgaaattatccctcagtggtcagatccaaggccttgtctttgtagtgggcctttccagctccagcctcttggaagcatttgacatggaaccctttcttcagttggcctccatggcactattttctcttaattttctttttttttcttttttgaaatggaatcttgctttgtcgcctaggttggagtgccgtggcatgatcttggctcggtgcaacctccacctcctgggttcaagtgattctcatacctcagcctcccaagtagcggagattacaggtgtgtgccaccacgtcaggctaatttttgtatttttcgtagaaatgcagttttactgtgttggccaggctgatctcgaactcttgacctcaagtgatctgcccacctcagcttcccaaattgctaggattgtaggtgtgagccaccatgcccagcctattttctcctggttttctgtgtttctggtgtttctaactttttttttttttttcctgatacttcatcatcttttctatctctaaatatgaatatttctgtattctctgtcttctcacctttgatactttcatctgcttccacagttttagttcctactacctgtctttgaatgctaccttccctaaatagtgctatttgtgtatgtactgtggtacttttacaactgctactttattacatagttatttacatacatacttgatttaaattttctgattgccagctgattgagggaagggaataagtttctttcatttttgttttgtctttctgtatgcttcttatacctaacctttttgttctgggtcttgtttgttgaaatgtgtaatatatgtcttcttccatctctgttatataatgccttcatagcttgtcttctgttgcttagcaccatccctcctttttttttctcccacgactctttaatttataggagctggttgttcgtttcctcaagcgagcatcaaataacctccagcattcactgaggatggtattacccagtcgacgattggcacttctggaacgcagaagaatcctggcccaccagctgggtgactttatcattgtatacaacaaggtaagtctttttctgttagtcttgtgctttggattgccatacactgtcagaaacagactagatagaagcctctgtccaactggatggagacactcttcttctgttctctggcatcaccatcccttatgtattactgttaggggaagcaggaccccacaccttaactcagctggtctgaaaaactatttattacttctgaaggcccagtggccatagttaattcttaattcttatcaaaaggcatattccttttgagcactgagatgaatcctaggctgtgtgagtctgcacggttgttagtgcctgtagaaagtggcaaattgaccattggagaacaaatttgagctgtggattgaatgtaatgacatattctttcttgaacgagttatactttcatctttaaaacattttatacattacagaattttacagtcaagcccaagaaatatactatttaattagaatattttgcaaagcattctatatcccgggatctcagaatgcattaaaaatatcattttgggtgtttgggtttgggaggtttggtcagtttgcagaaggaaaagctgatagaaatttaaatggcttttctaaagttgcatggaattgttggtagaatatcagtgcaccaaactcatagccacaatttactccagatctgttgagaattttgttatgtcttatataagtgaagaatttattcagtatggaagctggtataagagtaccttccaagatctgtctttcctctcctaattggaacaaaatactgtgtctctgttgtcatattgttaaagctacaagggtgatcatagatattactaagctactataaaaacctctttaatcaatgggctgtgtaagtagaaagtaaaaacatgattaaaatttacattcattctgcaacttttacttgggaatttcaaaatgttttacaaaatcatggccaaaagtaatatgtcaaatttataggtggcaaaagtacatacaagaattaaatgtctttactataaggacagattaactcaaggctattgaaactacatgatgaagtgcatatttattaggagtcagttttatcttgttgtttttctgtggggtttgggcactgggtaggaaacagaacaaatggctgaaaagaaatcaaagaagaaagttgaggaagaagaggaagatggggtgaatatggaaaactttcaggagttcatcagacaagcaaggtagtagacattcttgattgataaaagctgtcttattccatcttccataatgctcattgagtacccagcattcctttgtttctgatacatggatgtgaatgaaatcactcttaaagccgggcacagtggcacacccctttagttctagttacttgggagcctgaggcaggaggattgcttgagcccaggaattcgaggccagcttgggcaacatagtgagaccctgtctctaaatgatgaaaaaagaaatcattctcagaaggagaaaagattgtatgggtttggcctctccatatcttagccaattatgttgctattttcatggcttcagttatcaaaacattactgctgggtagcagggctgtagttctcgacagccttcacagtgcacatctcttgaagtcacatgagagctctttggaaagttgaaattagaggcatctcatatttactgggtctgaatttgtccctgacctactcatggagtagaaatgaccacattttgcctacattgagtaggctgaggaatttgcaatttctccactctgtgagggttacacctaatttatataaaatagaacaagttcttcatgcttagggttagcctttagaaatggaaaatctcgatattcatctctctatcttgataaaagtcagccaggccattttgtccatttatgttggcttacaaaggaagagataacaaaggcacttaattttaaatcttgtaaaacttacactggaggatttttttctaaatagagagatgtgcaaaaccattaaaataaaataggataaaaaaacagtaagccccattacttaggcttcaactgtcaaagtcacaaatagggagaaaatcagtagaaaatctaccctatgttgattggtgaagttaaatgaggtaggggtaggagcttatcaatcaccagcataatataatctttgtttaatacccttttcagacctcactatcatgcgctttacagcaaacaaatatatcattttgtaggagtccataattgtatggtgttatttgttgacatttttgagtcttaagtaatatgattgataaaacaggtatagtaacagcttctctcatcaacgttataaaaacagaaaaggattaaaaaaaaaaaacaaaaaacagattgtgtccagaaaatagctctactttttaaagctaaaagataattttcaggtttatcctaaggatcttcaaaatccctaaaatatatattttaaaaaacccagcctttaaaagaacactatttcccaagcaagtctaactggacactaaaaatgaattataacatattgttaactaattatatagatgtggagataaaatgcattggaacataattacttctgattggggattaggtgttgattgttgggaaataatgtggtgacgtcagttcttcttttattaagtttggtttgagtacatggatacttttcagggctggtaaattcaaatacttgctggagtcagacaggaaaacataaattatgaagtgggcaaaggataagacagatataaagcagcttgtattttgaccaaccgtaacctttgcctttcagtattctgtgaagggccaaataaaacacactgacaggcaaaggtttgcaccctcagctgtagatctttgatagtcacttgagagacttatcttgtggcatttggctactttgaagactttagggtttacgctgagattcataaaggtggtttctaggttctggttagagtgtgttttctgaagatgggatataggttctctgtgataatgcaggcattcttcacttaatagccactttcctagaacgtagccaagcttcaagaaaaagaaaaagaaaagaaaaaggccattgagaagctgctacagatgttaaagtccatgtgtgatatgttcaatagaagaatccactagcctctcatctgtttccttatactttctattttgtggctgttcataaagagcatataatttcagtaatttgaagtgatttagagatgatatactttagtctcgtgcattatatagatggttagggaattctatggttattggtggatttccttatttctgacataggcaatgaaaatgacaagtggctctttaagtgaaggtacttcaattatctagaagtgagctgaacaaactgtaaaggtccagataataaacatttcagactctgtgggctacatatgggtggtggtggtggtggttgttgtcttgttattgttgttttgcatattctttaaaaatattttaaaaaatttttggctgggggccataaaaacaagtcgctggtcaggtttagcccacagtgtgtagttgtttgccgcctgttctagaatgtggctgtccaatagaactttttgtgggtgactactgaacacttgaagtgtggctagtttacggaaaagaatctttaatttaatttgaatttaaatagtcacatatgactgagtagtcgctaccatattagacagtgtagatctagaaaattcactgcgggatgaataaagccttatgctttaaattttttagattgctttcatttatattttattttaaccacctattaatagggaattttcagcttgtgcttttcatttttcccttttccagcttgctctgttttcataataaaatctggtggaaagattttccagaatagcttcctgtctgaccatactttttctcctcatttcagtgaggctgaactggaggaggtgttgactttttatacccaaaagaacaagtctgctagtgtcttcctggggactcactctaaaatttctaagaacaacaacaattattctgatagtggggcaaaaggtggtaagtatactggttaatgaacgaaaaataagaagaacaagtgaagaaatgagaaatgcaaaggagaatgaggaataatgtgttggctaagcactaatagtccccaaggtaatgagactttgcagcttggggagggagtggagaatgggggacagtactttttgtcctaaaagcagaagaagggcatggtctgattttttttcaagataattaacagcagagagattttcaagaaaagctaataatagctgatatttagtgaacacttatctttctgtctgctggacatggtcttattttttacttcccaaaaccatatagagtgggcactactacagaacctctttacagatgagaaaataagctaaaagagactgagtaacttgcccaaggttattctttatcgtgcagggacaaggaatttgatacatagcctgcctgactcaaagtttgtgctcttaatatattcttctgtctctcttaatgattatttctgactcttgtcaagtttgttactttctctaacttaacatcattggcattttgggcaggagaattctttgtcgtgtggggctgttccatacctggtgggaagtctaatatacttggttccaagcctgacatgccattagcttccgccagccattgtgataatccagaatgcccctacatgtttctaaaacttcttactgctgggggattccatggttggggattttggaattgaatatggatgtggctgtctagctcacgtcaccatgataaaaaaaaatagcagtgacattctgttacaaacaaagctctgtgctttaaatgtaaaattaacttaaaacctagatggaagcctaaggcataggtaatcaacctactgatgttgtcagtgtgctaagtactagattcaaagatggagacttcttccctgctcttaagttatgataatctaatatggaaatagccaggaagattggtcatttaaaatgtggaatgaattttcccaaagaaacagtgttaatcttttaaaaactgatttggttcataggccaatccacataagcctgtttaactcatggtatgattgaattattgtattactggaagtcctgaatccagcccttttctttgagtttttctaacttcattcacctgttcattcattctttctatacttttttttacttagcacctattatgtgttaggcattttcatggttgctagggatacaatgaccaggactgtcacagtctttaactttataaagtttattgtctggtaggtaaaagtcaggtgagtgaatagaataagaaagctggcagaagctctgaaaaactcctataagagttttggctaagggagacaaaggaattcttgtaataaggttggaatagagaaaagcgtgctaatttggggaggtaggggcctagatggacattcatctagtaacttctcccctggcagtaatgtggaagccctaacagcatgtggtggcgacatcttttatactgataggtcattcaaaattctagggtttgtgttttaaggactacctttacataagatccatacctgtgtaaacttgttaaggataactggccggcgggggcagtaggaagacgtcaatcaaggaaacaacattatgacatttgatagtatagtatctggagtcatttcaaacatgaacaaacaagtgtgtgacagtgttaccactgctattggcgatggaggggagaaaattcgtatgtctttattctttcactctgaaagatgatctataaaatggcctttcttaagtttttgtatgattctagcccttgacaaagattttggaatatttttatatatgattagctctggctattctgtttcaaaattctgtagtggaaaaaattagttattaatgtcaaaattgattagagtgatactattattgaatatactgatcaacctatctccagtaaaactgaagagtttaggccgggcatggtggctcacgcctgtaatcccagcactttgggaagctgaggcaggtggatcacctgaggtcagaagttcaagaccagcctggtcaacatggtgaaagcctgtctctactaaatatacaaaaattagccgggtgtggtggcaggcacctgtaaatcccaagtactcaggaggctgaggcaggagaatcgcttgaactgggaggcagaggttgcagtgagccaagatcgcgcaattgcgctccagcctaggcagcaacaagagtgaaactttgttcaaaaaaaaaaaaaaaaaaaaaaagctgaggagtttaagatacagagccatcgtagtatccaggtattatgccaagaaatagtgggaccgctcttgctgtctcggggtagcttcgctgctccatatatattgtaacttcttggctccaggggctaccaccaaccagcgtgatctcttagaaccctcagtctgaattcctggcataaatctgactgcccttattattattattatttttccagataagccctagcttgttggctgtccgtggatggctgccctgggtttaggtaccgttcgccagttcagttaactgtagctgggattgggaatagctgggaatcatttaattggttgcctactccttagggctgtgggtgtcttcatctttggaaaagtgtgatgagacgtgccatgtttcccagcattgattagcagttgtgttatatttttgggaataaaattatgtatagaacagcggacttgcaattgattataagagagtccaagctcattatttcttatttcagatcaccctgagactataatggaagaagtgaaaataaagccacctaaacagcaacagacgacagaaattcattctgataaattatctcgtgagtgatttcaaacctacctagatttgctgctctctgataatttcctaaaagaaggaaatagtcatcagatattaaatatttctaaagcatggaacattaccccaaagaaatatttttctttttccttttcccttagaattttctcttatctattgataagctattttccttccaaagactttttcgttttcttaagtttagaaattctaagtgcattctttgttcctagaagggtgaaaagaagggggagaggaattagctgttgctagtggagacttcatcttgatgtcctaacatgtgtaagacatgcctgctctgtttcatagaggtagtcccaactccagcttttagaaaggaataaaagtaaattcctatttctgttgccaggttgtttctggtaggcaaaaatcattaagtttatgatgaacactcattaaagtctgtatttttcatgatttctgtttcatgccaagattattgtgatgtttatgttttaaaaatatttgttttatagagattgtatgtttgtttttcctataatgatgtcttgttttgttttgtttttaataggatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtcccttttcttccttccaaagtgctgcacacatctatagccagaaactgtctcgtccctcttcagcaaaggcaggtgagtgagagaacgaaagacagtccacaatgtgagctcctccccagccccaataaagaaaggatgtcatctcttccctttgcctttttttaaattttgaaatggaaatggacacacactgcattgttctgacgtgactaaagaagacttttgcattgcatccagtagcatgccttcattgacacaaagggaaacaggacttcttttaggtactggagataaagagatgaatctgacaaggcttctgttcactaggagcctacagcctagtcaagagatttcctgtcacagataaccatctatgagtgtgctatatgcattctctgtgcttcaaatagttattcccaacatcagacaagttagtttttaggcaagaatgacctgaataaataaccaaagaattcttagaataggttatatcattttaactgaaatagacctatagtgtcaagtttgtcctccattttttaataacagctttattgagatataatttacattctatcaaattcacccttttaaaatgtacaattcagtaattcagtggttatatatatatctatcttcacagacttgtacattcgacaccagtatctaattttagaacattttcatcatctccaaaagaaaccccatacctgttagcagccacggtctgtttcttcctcccccaagcccctggcaaccactgatctacttctctgtttttacagatttgtctattctggacatttttatataagtaaaatcatataataggtagtcttttgtgaatggctgctttctattctggacattgtatataagtaaaatcataataggtggtcttttgtgaatggctgctttcacttagcataatgtttttcaggttcatccacgttgtagtaggaacttcattccctttatggctgaataatattccattgtatggatataccacaatttgtttagccattagttgaggggcatttgatttgtttataccttttggccattatgaataatgctgctatgaacatttgtttgtaagttttcgtgtggacatatgtttttatttctcttgagtgtatagctagagtggaattgttggttcatatgataactttttgtatttcctctttttgaggaacttctaaactgttttccaaagtcgctgtgcccttttactaacagcaatgtttgagggttccagtttctccctgtccttgccaaaactatgagttgtctctgtttttgattttcacatcctaatgggtatgaaatagtatctcttttttgtggttatgatttgcatttccctaatggctaatgatgttgaatatcttttcatttgcttattggatttttgtatatcttctttggaggaatgtctatttaaattatttgccctttttaaaattcatatgttttcctttttattgttgaatgtaaatgttctttatatactctagataaaaaccctttgtcagataggatttataaatattttttccctacttgatggttatcttttcactttcttgaagcacaaaagttttagattttaatgatgtccagtttatctgttttttttctattgtcacttgtgcttttggtatcatgtctggaatactgttgcctaatcaagtgtcacagagatttcctcctttttttttttttttttttttttgagacggattgttgctgtgccgccaggctggagtgcagtggcacgatctcggcccactgcatcttccacctccaggttcaagcgattctcttgcctcagcctcccgagtagttgggactacaggcacatgccaccatgctcagctaatttttgtagttttagtagaggtggggtttcaccatgttggccaggatggtctcgatctcttgaccttgtgatccacccaccttggcctccccaaagtgctgggattacaggcgtgagccactgcgcccggcccctcctatgttttatagtttagactcttacatttaggtcttttgtccattttcagttaattgtcctgcatggtatgatgtaggggtctaacttcattcttctgcatgtggatattcagttaaatcagcatcatttgtggaaaagagtattgtttccccatgggattgtcttggcactcttctcaaaaatcaattaattataaatgtaaaagtttatttttaaggcctcagttttattccattgatctatatgtctgaccttatgccaatatcacattgtcttgattgctacagcattatagtaagttttgaaatcaccaaggatgattgttccaacttcactcttctttttcaagattgtttaggctgttctggatcccttgcattttcatatgaattttaggatcagcttgtcaatttcctcaagaaaaggcagatgggattttgataggattattatctgtggatcagtttggggactatcttaacatcagtcaagatttaaacactagtaatagctatgttaaggtgagttacagctaagacatgttttataaatagccagtctatatttcttaatacctgttttcaaatgaaatggatattttaatatgcagcttgagtcagagatattaaatggtccactttaataagtcataaatatgaatatatacatatgtatatatctgctaattctgggtgatcttgttcttgtgatttaattttctaaaatcggtaataataatgatcaataatgttctagtttgaactattttttccccatgtaagaaattcagtaagatgaatgtcttcagtggcctgtgttatcataaaaactttttcaaaaccctcccttttgatcctttccaagagaatgatagtgaacaaaagaagttggtgagttcataaatattttctgatatctattgtgatttcttttttgactcttggattatttataaatatattgtttaattttcaggtagttgggattctttatttttgtaattggtttttagcttatttccactgtggtcagagaacataatctgaatggattaaacagtagtagatgacaatatgcggacaaaaatatataattgacaacagcctgtaattgattggagttaaatttttctgtggtaattgagtgattttggaataggagtaagattttatttaactctatagactttttaaagttaaatatacagcatcaaatttcaaaggtcatcactaaaagaataaaagtataaattctaatggggagaagaaaaatgaattgtggataaaaaacatgcagaaacttaggtgtatgcaagcaagaagcatagaaaaagcaagataaatagaaatttaaaacatagtaaattggccgggcacagcgtcttatgcctataatcccagcactttcggaggccgagttaggcagatcgcttgaggttaggagttcaagaccagcctggccaacatggtaaaacccaatctctactgaaaatacaaaaattagccaggcatggtggcgctggcctgtagtcccagctactcaggaggttgaggcaagagaattgcttgaacccgggaggcagaggttgaagtgagccaagatcacaccactgcactccagcctgggcacagagcaagactccatctcaaacaacaaaacaaaacaaaaaacattgtaaatcaagtccaaatatatcaagaagcaaataaacataaataggttaaacttgacagatttttaaagtttaaaaaaatccaactatatgctgtttaccagaggcacacctaagtttcaggacacagaacgtttaaaagtaaaaaattgaaaaaagaaatacgagatgagtactaaccagaagaaagttggtatggttgcattaatatatgctgaaataggcttgaagatataaaactttcttacagataaagagtaactacataatgacaaaaggttcagttcagtcaaaagttaaacaattctaaaagtgtctgcacctcataaaatagcctccaaatatgtaacacaaaaatggaaacaaccacatgaagaatgtataaatccactatcttagtgggtgatttccacatacttctattaattattaatacactaaacagatttttaaaatgcagaaaggataaagaggatttgaacaagatgataagattatttattgataatatataggaccgtgtacccaataattagacaaaacgcctcaagcgtacatgatatatttataaaaatctgtcataccctacatcataaacaagagaacaaattgcagagacttggtatcacacagccacattctttgtccacattgcaattaagttgaaagtcagtaacaaaaagatatagaagaaacccccatgtatttcaaaatttaagagtcaaagaagaaatcctgatggaagtaaattattaagttttagaactgaatgataatgaaaaagctgtatgtccaaataagtagagagcaatgcaagtcagtatttgaagggaaatttactggcttaaataattatagttggtgtgcacctgtagtccaagctccctaggaggctgaggtgggaggattgcttgagcgcaggagttcgagaccagtctgggcaacatagcgagatcccatctctaaaaataaataaataaataagtaaataagtaaataaaaacttatatttgaaaagaagacaggctggaaattaatgtgctaaatgtctggctttagacattataaaaacaacagtatcataaatctaaataaaggataaagaaatataaagataagagcaataattatagaattcaaaaataaggcacagtagagggtggcaaagccaaaagtgattttttgaaaagcctaataaaatggacaaacctctgatgacacctatcaagaaaaaagagaagacatggataaataatataaggagtagaaaagcagacatagaaaatataaatacacccaaaatgacaaaaataatgtaatcttaactttattccaataaaattgaaagcttacataaaatggaccaaactcatacaaactataacttatgtaaaaatgactcaagaagatgaagaaagtctgaatagtcctataagtattttaaaaagtgatacagtagttgaaagtcttaaagaaaacataaggcctagatttatgggtaagttctaatctttcaaaaggtagataatttcaatatatttttaaaaaaactcttctggagtgtggaaaaagagaattttcctcaacttattctgtatggctagttttatcttaataatacaaacagttaaggacagtattaaaaaggaaaattacagactggctttatttattaacacaaatgcaaaaatttgaatcaaaataaaagccaatcaactctagcaacatctaaaagaggtagtacaccatgagcaagtttattcaaggaatgtaagaggggtttaacattagtaaacctataaatatcatttgccatgtaaatataataaagaaaaaaccatattcttcatcatggtacatgcagaaaaagaattcgataaaattctgcactcattcatgatgataactctcagctcattaggaagagaaggagattctcttaaaaaaagggtatttgccaaaaacctgcaagagctatcagcctaaatacggaaatgttgaaagcattctctttaacattgagaacaagtaaggatgcccattaacattccttctgtccagtgttttactggagatcagaaccaacatagtaagataagaaaaagaaattataagcataaggatcatcccttcttagccttttggctaagatcaagtataagcataaggatcaaaaaagaggaaacaaaattgtgtaattgcagataatatattgtctacatagaaaacaaagtaattacagatacattttagaaatagttattttagcataagatcaatatttaaaaattaattgctttcaaaattacttgccagaagtgacagaaaacaattttttgattgtagcaaaatataaataacataaaatttaacattgaactattttaaattcagtggcattcagtacagtcacacttttgcagccatcaccaccaataaaaatgtttttaaaaatatcactaataatagcataaaaactgtgttacctaggaatacatttagaaaggaaaggaagttttataagactacattgaaagacacagatattagacattaacaaaaatttaaataaatggataaatataccacgtacatgcataggaagactcaatatcatcaaagtttccattttcatcacattgatctctgtattcaatacggttccaatcaaaatctcaacaagtgtgtcattggattttttaagcctattctaaaatgataatagaaaggcaaagagccaagaatagtgagaacctactgaagaagaaaaataaggtggaggagcaccttattaatataaaggtctgatacttaagacagtgtggtattggcaaatgtgtagacagattgaccagtggaacagaatagaaagttagaaacagtcacacaagaagatggaaatttcatgtatgacagagatggcattgtagatcagaagaaagggagagatgtctcaataaatgcttctggggtaattgttatccccacagagaaagatgaaattagatccctgcctcacaccatgtataaaatcaatttcagttgtaaaacttccatactgaaataaaataataaaataaaggagaccatcattaagaacttgtggtatggagcaaaagtaaaaacaaaaacacaaatcgtgtaagtcaataagaaaaagatagcccaatagaaaaatgataccagaaaagaggtagcatgttcaacatcatcattaatcaggtacatgaagactacaatgggaagaattaagacacttgacaatactaagtgttgaagaggctatggatcaacaggaattttctttctttttttcttttttttttttaatttgagacagggtctcactctgtcacccaggctggagtttagtggtgcaatcatggctcactgcagccttgacctcccagggcttaagcaatcctcacacctcagcctcctgagtaactgggactacaggcccatgtccccacacccagctaagtttttgtagagaagagatctcactttgttgcctaatctggtctcgaacttctgtgctaaagtggccctcctgcctcagcctcccaaagtgctgggattacaggtgtgagccaccattcccggcccaggaacttttttattttgtttgttggagtgtaaaaaaataccattttggggccgggtgcggtggctcacgcttgtaatcccagcactttgggaggccaaggcagacggatcacgaggtcaggagatcaagaccatcctggctaacacggtgaaaccccatctctactaaaaaaaaaaaaaaaaaagaaaaattacccgggcctggtggcgggtgcctgtagtcccagctactcgggaggctgaggcgggagattggcgtgaacctgggaggcggagcttgcagtgagccaagatcgcgccactgcgcttcagcctgggtgacagagcaagactctgtctcaaaaaaaaaaaaaaaaaaataccactttggtattactacataaacttgaaaatttacatactttgtgacccaacaattccactcctgggcatatacaagaggagcttttctatacgtgtgccagcagatgtatgcaagggtgtttatggctgcgttgtttataatggcaatatgcttgaaataaccacaatacccattgataggggaatagaaatataagttgtggtgtatttataaaatggaatgccagacagcaaggaaaatgaatgactttcagctgtatttatctaggattaatcttggaagagtagagttgaataacagagcaagtcccaggaaatatctatattaggataccatttttgtagatctcaaaaacgagcaaaattatctggtattttgtttgtatatgcatatacacacaaatatatttgataaaacttttttttttaaaagaatgtttgataaggggagattaggaatggggaggaacaaccacataggttagtacatattgttgataatgtaattcctgggttgggtagtgagttcacaggtgttcattacagtatgcatataactacatatacagctattataaatattttgtatgtactaaataatatagtaaacgtgaaaaagttacagattcagaaaatcagttgtatatgcagaatgatcattgttatattagcattaattttaaaaagacaggaaataggttatattatttctacttttctgagtttaaagattttttttgaagagatgtgacttttacaatcaggaaaaatgtgaatttttattttattttatttttagagacaggttctctttctgtcacacaggctggagtgcagtggcatgatcatagctcactgtaaccttgaactcctgggcttaagcaatcctcctgcctcagcctcccaagtagctgggactataagcatgagccactgtgctcagctgaatcttgattttatattaaataatttctttttgccagaatttcagtgcttaaataatagaatgctctgatattacagttgaaagaagaaaatttaaatctgaaagggaaatcagtcatttgaaaatatacacacactggggcctatcatggggtggggggaggggggagggatagcattaggagatatacctaatgtaaatgacgagttaatgggtgcagcacaccaacatggcacatgtatacatatgtaacaaacctgcacgttgtgcacatgtaccctagaacttaaagtataataataataaaaaagaaaacatgttttgactaaaaatataaaaaaaaaaagaaaatataagattattgttatttttctgagtatactcgattttgtttttatccctgtttcccttttgagctttctaagtattatggatgatttgacagtggatgccacagactgttgacaagtacagttacataacaagaaaaacaagaattataatgagtttcaaatatgtattttttattcagtaagattagcaaattataggattggtattccccactacatataatgaaaattcttctttgtgaagctttcattataagcaaaaacatattaataaataatgcatgtggcagtttggtaataggaagagtttctaggttatggtaaccatttatttttgtgatcatttgaagatagtttatttctcctatattattaaagatccttagggttcagtaaagtatctgttgacctgagatttctgtcattatcctaatttttttcaggcctttttttcctaaatgagtgaaaacttttctccgttttagcaggatcgtgctatctaaacaagcatcattcaggaatagccaaaacacaaaaagagggagaagatgcttctttatatagcaaacggtacaaccaaagtatggttacagctgaacttcagcggctagctgagaagcaggcagcgagacagtattctccatccagccacatcaacctcctcacccaacaggtacggatggtctggggtgtccaagagctctttggacctgaggatagaattaatgacagggtactttgtctttccctgtctttactattcccatatactgatgcctcttgaatgagtattattaatagttggtttcaagctaaattatcaagtttttcctcttcaaatttaaagaaaataactttctgttacaggcattgtgaagtaagtctgctactggatatgatgtacctatttcatggataaacagacttgaatgttcatctgtaaatataattttaaaggatctttaaaaataagttcttttctttggtaaaattttccagtgagttctagtcttataaatctttttaccagaattttataacattaccctttaaaaaaatttttttctatactgcctcttatttcatgatctcaggatgttttatgggtaactgattaatttcatatttcattatacccttatccaatataatatcattctccccattttacagatgggggaacctgaggctgaaataagtgatgtgatcaaggtcattcaacaagctgggtggatagaaataaataacaggatattgtccttatgctatatagatattaacaatcttgcaacacagtgaaggtagatgacactttcaagagctttgtgaattctctttgtccttcttgctggttatccctatggtgtttaattgaaggaaaagccatatctcttattccttaatgttaaatggcatcaaagtcctccaaaggaattatcataatttaactccacagttatattttgctatgttgctgatgtgccaaattccttaattggtagtaactctgtagtgataatcaagtctcgaaaaaagtgaagctgaaaattactttaagtacatgctaaaagtaggcaacacactgctccctggtggtaccctacttatctgtataaaatttaggaccaaaactaaagctaagcctctcatggaattagttttacttcagcctcatcccagcgtgtgaagcagtaattattttctttctcaaatccttagttgtttgaagggagtaaataagaaggcctaatgtgaaataggaagcaaagaatattataagaacaatgttgattcttggagggagttgggtagttagattttagtgatagaattatgggaagagggaataggatactaagatatgatgggaaggaattttcaaattaaataagtggctatgagacgggaaaggccagtgctctgctacacttttatcattgggtcactaactagattatatgtttccggtttataaatgggcagctagaagcaccaagacattgagattttgtgattgtagtaaaaaaaaaaaaaaaatacccaaaatagccaatattagtgcttacctatctagctcctatcgttcactagactgcaaagcctacaaagtgaaaagatcctaatcctgtaggaatccaaggtgactgtatcctgattgggaagtcatcccccttcagttcatttttttcgtctataaagaacttcagtgccagcgaattaaaagtccattagactatggtttgtagggatctgaacttgccattagatgtcagtgttaacttttagagtcttggtaatagggtggtcagtactgagggaggtgctgtaggatgtaataagcaggatggagtagtggagaaagagctagattagccatccagagacttgccactgactcctgtgtgatcttgagcagttcactccattgttattctgacactgactcctgtatgatctttggcagttcatgccactgttctgtcactgattagctatgtgatcttggacagttcactctactcttctgacactgactagctgtgtgatcttgggcagttcaccccactgttctcctgccactgactcctgtgtgatattgggcagttaattccattgttctgacactgactagctgtgtgatcttggacagttcattctactcttctgacactgactagctgtgtgatcttggacagttcactctactgttctcctgccactgactagctgtgtgatcttgagcagttcactcaacttctcttaacctcagggtcttcactgattgatgaggaaaatacaacagggtcatgaggatattatgcaaaacctctaaatgcaatatatgtggaaaatattgttatttcagccataaaaggctttcaatagtaaatggcttctaatttggttagaaacaagtttttagataaagtgtactttttagtagtttttcaaaaattattgtgggtacataggtgtatatatttatggggtacatacgattttttttatttcagtaggtttttgggggaacaggtggtgtttggttacatggataagctctctagtggtgatttccaagattttggtgcacctatcacccaagtagtgtacactgtacccaatgtgcagtcttttattcttcaccctccttccacccttccccccaagtccccaaagtccattatataatccttgtacctttgtgtcctcatagcttagctcctacttataagtgagaacatatgatgtctggttttccattcctgagttacttcacttagaataatggtctccagctccctccaggttgctgcgaataccattattttgttcctttttatggatgagtagtagtccatggtgtatatatatacacaccacattttctttatctactcattgattgatagacatttgggctggttccatatttttgcaattgcaaattgtgttgctataaatatgcatgtgcaagtatctttttcatataatgacttcttttcctctgggtagatacccagtagtgggattactggatcaaatggtagatctacttttagttctttaaggaatctccatagtgttttccataatggttgtactagtttacattcccaccaacagtgtaaaagtgttcccttttcacctcttccatgccaacatctattattttttgactttttaattatagccattcttgcaggagtaaggtagtattgcattgtggttttgatttgcatttccctgataataagtgatgttgagcattttctcatatgtttgttggatatttgtatatcttcttttgagaattgtctattcatgtccttagcctttttgatggaattatttttttcttgctgatttgtttgagttccttgtagattctggctattagtcctttgttggatgcatagtttgtgaagattttctcccactgtgtgggttgtctgtttccttgctgattatttcttttgcctgcagaagctttttagtttaattaaattctatctatttatctttgtttttgttgcatttgcttttggggtcttggccatgaagtctttgcctaagccagtgtctagaagggtttttctgatgttatcttctagaatttttatggtttcaggtcttagatttaagtctttcatctatcttgagttgatttttgtgtaaggtgagagatgaggatccagtttcattcttctacatgtggcttgccagttatgctagcaccatttgttgaatagggtgtcctttccccaggttatgttttttgtttgctttgtcaaagatcagttggctgttaagtatttgactttatttctgggttttctattctgttctattggtctatgtgcctatttttataccagtaccatgctgttttggtaactatatccttttagtatagtttgaatttgggtaatgtgatgcctctagatttgttctttttgcttagttgtgttttggctatgcaggctcttttttggttccatatgaatttcaggattgttttttctagttctgtgaagaatgatgatggtattaaattgcactgaatttgtagattgcttttggcagtgtggtcattttcacaatattgattctacccatccatgagcatgggatgtgtttccatttgtttgtgtcatctgtgattcctttcagcagtgttttgtagttttccttgtagaggtctttcacgtccttggttaggtatatccgtaagtattttattttattttttgcagctgttgtaaaaggggttaaattcttgatgtgattctcagcttggcggcagttggtgtatagcagtgctactgatttgtgtacattgattttgtatcctgaaactttactgaatttatttattagatctaggagctttttgggtgaacctttatggttttctaggtatatgatcatattggcaaacagcaacagtttgacttcctctttaatgatttgaatgcccttatttctcttgtctgattgctttggctaggacttccagaactatgttgaatagaagtggtgaaatgggcattcttgtcttgttccagttttcaaggggaatatattcaacttttctacttttggtataatgttggttgtgggtttgtcatagatggcttttattaccttaaggtatgtccattttatgccaattttgttgagggttttaatcatgaagagatgctggattttgtcagatgctttttctgtgtctgttgagattaccatgtgatttttgtctttgattctgtttatgtggtatatcacatttattgacttgcgtatgttaaaccatgcccgcatccctggtatgaaactcacttgatgaaggtggattatctttttgatatgctgttggattaggttagtggcagaaactgcaattacttgtgtaacaacctagaattttgttggggatttttgcatctgtattcatcagagatattggtctgtagttttctttttttgttaatgtcctttcctgggtttggtattagggtgttactggctttatagaattatttagggaggattctctttttctctgtcttttggaatagtttcaataagattcgtctaattcttcttgaatgcctgatggaattcagctgtgaatccatctggtcctggacttctttttattggcaatttttaaattgccatttcaatattgctgcttgctgttatctgttcagagtttttatttattcctggtttaatctagaagggttgtatatttccaggaatttatccgtctcctctaggttttctagtttgtgcacgtaaaggtgttcatagtagccttgagttatcttttgtatttctgtggtgttggttgtactatctcttgcttcccttctaattgagtttatttggatcttctctcttcttttcttcttctcttctaatcttgctagtggtctgtcaattttgtttatttatttttttttcaaagaaccagatttttgtttcatttatcttttgtattgggtttttttgtttgtatcaattttatttagttatgctctgatctttgttatttcttttcttctgctggatttcagtttggtttgttcttgtttctctagttctctgagatgtgaccttagattgtctatttgagctctttcaggctttttgatgtaggcatttaaagctatgaactttcgtcttagcaccgcttttgctgtatcccagagattttgataggttgtgtcactgttatcattcagctcaaggaatttttacatttccatattgatttcattgttgacccaatgaccattcaggagcagactatttaatttccatgtacttgcatggtgttgagggttccttttggagttgatttccagttttattacattgtggtctgagagaatacttgatataattttgattttcttaagtttgttgagactcgttttgtggcctatcttgtggtctatcttggagaatatttcatgtgctgatgaatagaatgtgtattctgcagttgctgggtagaatgttctgtaaatatccgttaactccatttgttctagggtatggtttatgtctgttgtctctttgttgactttctgtgttgatgacctgcctagtgctgtcagtggagtattgaagtttcccactattattgtgttgttgtctatctcatttcttaggtctagtagtaattgttttatgaatttgggagctccagtgttaggcgcatatgtatttaggattgtgatattttcctattggactagtccttttatcattacgtaatgtccctctttgtctctttaaactgttattgctttgaatctttaaagtttgctttgtctgatgtaagaatagctacttctgctcacttccgttatccatttgcatggaatatcttttttcactcccttaccttaagtttatgtgagtttatgtgttagatgagtttcctgaacttatatgttagttgagtttcttgaagacagcagattttgtatcttttaaggggaacatttaggccatttacattcaacattattattgagatgtgaggcactattctgttcatcatgctagttgttgcctgaatacctggtgatttttgcattgtgttattgttttataggccctgtaggatttgtgctttatggaggttctattttggtgtatttcgaggttttgtctcaagatttagaactttctttagcagtttgtgtagtgctggcttggtagtggctaattctctcagcatttgtttgtctgaaaaagactatctttccttcatttatgaagcttcgtttcactggatacaagattgttggctgataattgttttgtttaaggaggctaaacataggaccccactcccttctagcttttagggtttctgctgagaaatctggtgttaatctaataggttttcctttataggttacctcatgcttttgcctatagctcttaagagtctttcctttgtcttgactttagataacctgatgactatgtgtctaagtgattatctttttgcgatgaatttcccaggtgttctttgagcttctcctgtttggatgtctcgatctttggcaaggccagggaagttctcctcgattattcccccaaataagttttccaaacttttagatttctcttcttcctcgggaacaccagttattcttaggtttggtcgtttaacataatcccaaacttcttggaggctttgttcatttttggggatgcctttttctttgtctttgttggattgggttaatcaaaagccttgtcttcgagctctgaagttctttcttctacttttttgattctattgttgaaactttccagtgtattttgcatctctttaagtgtgtcttttatttccaggagttatgattgttttttatcgatgctctctatttccctggagattttttggtccatgtcctgtattattattatttttttagtttctttaaattggtttccacctttccctggtgcctccttaaataggtaaataatcgaccttttgagttctttttctggcaacttagaaatttcttctttggatccgttgctagtgagctagtgtgatcttttgggagtgttaaagaaccttgccttgtcatattaccagaattgtttttccggttccttctcatctgggtagtctgtatcagagggtctgggttgaagggctgctgttcagattcttttgtcccactggttggttccttgatgtggtgttctcttcttcccctagtagggatggggcttcctgagagccaaactgcagtgattgttactgcccttctgggtctagccccccagcagagctgctgggctctgggctggtactggcaagtttctgtgaagagtcctgtgatgtgatccatcttcaggtctctcagccatggataccagcacctgatctggtggaggtagcaggggagtgagctctgtggactctgtgagggtcctttgttgtagttttgttcagtgagctggttttcttgagcgctggttgtgctagtggttttttgacctccagccaggaggtggcgctttcaagagagcatcagctgatacaagcttgccctaaggtcgccttggttaagtatttgagtgtctcaggtggtgggcggggccacagagctcccaagatattacgtcttttttcttcagctaccaggacaggtagagaaagaccatcaggttggggcagagttaggcatgcccaagctcagagactctccttggacagggcttgctgcttttgctgtgggggatgggggtgtggttctcaggcccatggagttacgttcccagagggattatggctgcccctgctgcatcatacaggtcaccagggaagtaggggaaagccagcagtggcagacctcacccatttcccacgcagccaacaaggccaatctcctggggtgcataagatattttgatacaggcatatagtgtgtgttgatcatatcagggtaaaggtgtccatcacctcaagcatttatcctttctttgtattacagacaatccagttatactcttagttactttaaaatgtacgataaattattgttgactgtagtcaccctgttgtgctatcaaatactagatcttattcatgctaactatatttttgtacccattaaccatccctacttccccccaccctctgtattttgtgttgcaaagctcaattataggttattcaaccctttcccttcagagaaagtgattccttaatttggaatttggaaaattctgtcattgattattctttttctggtaaataactaataacatgttataatggtttagtatagattctggtatatttgtttactaacagtttccctttttctctagttatatttaaaaagaaagttgctttagtttcttactcactgagtcaagtgatacaatgtctgtagctttctagaaagaggtagatttccagtcagaaagtggtgagagttctgctcttctctctggagttagggcctgaaaacttaaacttagctattatcagaaacaagtttgtgtccagtaatcactttaaatgttttttgtttcctcttacctgttttcatattctcgattcttattttctgtttgtgctttcttttttttgttttcccttttctaataggtttaattaatattttctccccttttaaaaataagatttattctggatatgtttattcattctattgttttctaattcattattttcttgccttatctttactaattccttctttctgctttccttaactttgttccactatttcaatatttctccccaccttgagttaaatgcttcatttattttcattcactcttggtatttttttcactatataaaagctatgaatttttctctgaacattgctctcattatattacataaattctgatctatctttaattggctttctgggcaaggagttaagagatattctactaagcaagcaaagttgaatttaaattacttgtgctattttggaagatgagtatagaatattgaagttgttgggtatttctgaaaaatcattatatttggcctacaatttcaactgcttagcctattaaaacttttagtggcatttcctgcaaaactttttatttcattgtgtttgtgtgtgcatgtgtatatgtatgtatttaaaaaacattttgctaggctcttaagagtcttccaggctttggtactaagccatggggatgatataacacatagtcctcagcatgaaataactcactctcttgtaatggtggcagctacataaacagatggtaatagtaacatggaatatgcatgacagagatagtctgagggaataacaaccactaaaagaggccccgaacccagcttgtgggtgggaatggggaaaaagctgaactagccttcttggaagagattatatctaaactgaatcttaaagataggcaggtagatggcagaagaaggggagaaacagtttacagaataaaaactcacttgtgcatatgtagcgaaacgagtgacaggctaaggatgtcacaggatggagagtcagcagggactagctaggaatgaagttgggcgagaaggcaagggctggttcagggagagctttcatgccgtgtgaaggaacttgtcctttgtctcttagatgatggagattctctgagacacaattgctttgccttttagctggaccactcaggtagcttgaagaggatggatttggaggatgaggcagtgccactcctttttcctccatgctcgctggtgaagataatgaggaacagtgaactagctaaaggtaaagaagcaaagtattctgacaagccaaaaatttgatgataaaacatagagggactcagaatttacattagaggttagattcttaagaaatctgtgtggcaaaaacagaagctcatatcctgtgtagttactactactcctgctgtgatttaactttgtttatagcctaaaacacataaaaatatcaaactttccctgccatgtgagcagcggccacttcaaaaaatctgtgcaagcacgtgtatacttgaaatataaagagataaatgttctcaactaccaccattcaacaaataacttagaaatctgagcagagagcaggtcaaatttaattctttcccttggcccaagagaggctggttgtcttttggagatgagattttttggaaatctatgtgtatgtccctgaaagcagggttttctagaaacatcttgcacctgggctgggggcaggagaagtgtcgtggtggccaatagggtactgagcttccgtgtgaagtctcactatctctgcctgactccatgctggaagggagtgtagtgctctgaagagatgtagccctttgtggttattgccattagtgaacagaagaatgtggtgaattagcccagctttgtggtgagaagtgggaggcagggaatcagagggagcgctggccctctccgtgcaggcaagcctgagactgcaggacccagctatcattaggagcaactccagctcttccagcctgggagtttaatcaaagggataacagcagaccacccaggcgggggctccagtgtgaacgaatgtgctgtgtcagtctctgctccccaaccagccagtgcccgggatgtggccaggcctcctggaaatgtgctgacagatacagagaggggaggagatactttttgctcttcacatttttcatttagatggagagtgggaaaaaaaaaatccattctatttctttcatttttcttgctccttaccctgagacttccctgcctggtcctagagaaagatagatgcggaggtacataaagcttgattcacagcagttaaactctctcactctctctatacaaaggaattctttatcatttcttctgcttccgcagctaacaccgtaagggtccacagtggaccctgagtgaatctcaatttcagaaattccaaatgaagagagacggagctaaatctttgaaatggttacagatgttctctaggattgaggcagatggcgcccagtttatcacaagcttcagcaattggcactggaaactctttctgcctccttagtttatctggacacatttgaacttaggtacatttgtgctcagattttgtggccgtttgttaaccctagttcctttagtttcatattctttcttagtagaaaaagttgttgttctttttaccatatacattattctttcccatttctagaagcaggaaagggtaaatagaaaaaggcataagctcttgagtcagcaagaccttggacaagttgtttaacctccctgtgccttgatttcctcatctgtaaaatggggtagttttggtatcaagaccaattcttctcttggctacttgtgcctctctgttccaggacctggctccagttgatctgatctaatttcctagcttttctaggtcttgaggcttgaagctctcattttctttagttcctggcctactgcatggtctcttgttttaaaatagcctttgttttactctgccacccctttaaactcatcttacttgtactgccaaacttcttttaaaataacacacccttgttggctctagtctcccttctgcccctccacccctacacacttgctcttgcagtctgacttcatctcttacatttgtccatctctctctcaaaggccactcatgacctcagaattgccaacttcagtcactatttttaatcttcttcctttagcatgtggcactattatcaacggcttcttaggtgaaaatttcccttagcttttctaacccttcagtaattcctctgagaaatcattgcttcctcctgctctccctgaaaactagattccattttcaacatgtttttcagagccactggcatatagatcttatgtgtataaagttgatcatagcagagtggctctggttgaagaaggtggagtggcccctgggcatctgcttctccctggtcttttgggatcctccagcatatctctgaattctaggctgtaatcctcagaacttctttttcctctccatactttcccctgggataaagttccttttcctgtgatttcatcctggtacttctctatggatttctcccaagtatatatctttagtttgagcctttgctgagagtcaggtccacatttccacctgtgagacatttctacctaactatattgcagaacattcaaaatacttgatgtattttgaacatattttgaaaatactcagaaaagtcttaaacatatttaaaacttatttgcctctttttgttcttctctatattagtgacattgcaattcttggaattctagaatcccagggaatttaggaatggagccattggtttatcagtgcctctcttcacttcctcattctatgtccaggcagttgtcaagattctacagtgtctctgatacctatcctgtttttcacttttccatctactgtcctgcttaaggcctttattatctcttggatggagagctgcaattaccttttcactggtttcttggccagtctcttcctgttcaccctagtctttgctttgctctgaaagattcttttttttttttttttgagatgcagtctcactctgttgctcagactggagtgcagtggtgcgcgatctcagctcactacaatctctgcctcccaggttcaagtgattctcctgcctcagcctcccaagtagctgggattacagatgcctgccgccatgccgggctaatttttgtatttttagtagagatggggtttcaccatcttggccagagtggtttcaaactcctgacctcaagtgatctgtccgcttcagcctttcaaagtgctgggaattcaggtgtgagccactgtgcccggccataatggatcctttcctaaatcacaagtctcatcatggtactcttctgcttaagaatctcgagggccttctgttgtctataatgggaagcccaggctgttaaatgtgattcaaagcctttatttagaatctggctccaggctacttttccagcctgtctccctactatcacacatgtttttgtgcagctcaactagaatttctgttagtctccatgccttatgctatcttctcatggaaaatgttccccagttgccatgtctaatctgggcatctgtccaggctcagtgtagatgccacttcactcatatgcatactctttcactcatcacactaggtatgtcaagatagctctctcttttaacagacagtgaactccttgagggcagtgtcctttgctgcctcagcacctgactcattggtagtactcaaaaaatgtgctgattcgactggactacaaggtaattcattgagaattggatcatgtccatttttttcaccagttttttcccagcctgctagatattaatagtatgcactcagtacgtattttttgaataaataagtaaatgaagaaccctctgctgccttagccagaagtcatctttctattctgtgtgctccttcattccttcattactttttataacagatctattataattattttgcatcttttctttcctgttttgcactaaactacatgatgcagttctttctaactcatcacctagcgcaaggcctttcacttggcagtcatcacatgcttgctaaattgaaaagaatttcttttttacattttgtaggtttttatattttctttaaaaacgattgatggctgggtgcagtggcgcactcctataatcccagcactttgggaggccgaggtgggtggatcgcttgagctcgggagttctaggccagcctggggaacatggcaaaaccccaactccacaaaaaagacaaaaattagccaggtgcggtggcacgtgcctgtagtcccagctactctggaggctgaggtgggaggatcgattgagcccaagagctgcagtgtgccataactgcaccactgcactccaacctcggctacaaagtaagaaagaccctgtgtcaaaattttttcattgataacaccatacctgcccttcataattaagcagttgacattaatcagatgcttactttgtactaggcactgtgccaaggactttatatgcattatctctttaaccctaatgaggtgtaggtacttactttttgccaattaagatgaagaaatagaagctggtaggataagtgactctgctaatgtcacacagatggcaagttactgtgctaagactcaaactcagctctgtctgactctgtgctctttacctcagtgtttttctgtctctttcggtgtgaataaggactcaaacctctcattagacgaaagtgaccgaacttcaccctgtgagcttgttgttccatgatgttgctacagagttgtagccaagcctatacttgtgcctgctcagagaaacaaggagttgaactttgttttcttgatttgaaatgcttctctagttcttgaagcagcttgcaaaacatgtggctctgttgagaattatcagttatttgttgggcaaactcctcatcagattattttatagtatagtcaactgattcttcgaccagacaaaactcagccttgttaatcactagagatgcaataagaatagatcttatgatggcagcagcaactccccctgtcaacacacaaaatctacatgtataaattggaaaccctacgaagagatttgcccattttgtcaggtttcccaggaatgtctctggcaaatcttgatctggaactctgtctggattttggaacactaaatgtctatatatatacgtatattatgaaaatgatggagctcagcagaaagagaagatatgccaagagaatttagtgctgaggtattggaactgcagagattccctgcttttcctgaccccctttaaaatataattaacatttaacccttctctcctggtgattggagtgtgaatttcttgaggtttattttatcagcatccaggaattgaagaaggaattgaattgtggctagtgatttaataaatgctcgtgaagtgcttttggaggactgttcaaaatgtaactgtttaagatagttcttttcatttttctgattgaatatattctctaatatttctccattggtgaaaatcttgtaattggtgcagatctggcacttttggttttcctcttcttttaccttgagtgaaacagatcttggtccactgatatttcctattcaaggattaccttttgctctagcaaaacaggtgaaaacaggaacagatcctgttccagatcattcagagccccatggctgcaggaatcaaagctatggcatgttcaattgatccagtcatattctttttttcttattttttaaaatttttatatagaggtgaggtctcactgtgttgcccagactgatctcgaactcctgggctcaagtgatcctcctgccttggcctcccaaagtgctggattataggtgtgtgccaccatgcccagctgatcctgtcagattttgatatagctatacatatcaggatatatataaggaatatatatatatatattctttatatatgaacaccacagagaacattattttcaaatgacattgaggtagttttgaggataatatgaatgcacatttagacaaatttatccttttatcagttgaagtgattcttaacctttttggattcagaagtctcttggagaatctaattaaagctttattcctcctcctgaaaaaatatacactcaaacttataaatttgcattaatttcaaagggttcaaataccttcaccctcaatcaggctctgtcttgatgctccatggacttatggtctctaagttaagatcccctgaaagtgtttaggtagcatataaccattaatatcaataatttggcccaaactccaaatctatgagtatctttgttttatacattctttatatatttcagtgatagccccacattaggctgtaatctccatgaaggcaaggatttgggggttattcatatatcacagtgttacatattttggggggtacatatgatgtttagatacatctatacaatgtgttatgatcaagtcagagtaattgggatatccgttgcttcaaagatttatcttttctttgtgttgggaacattaacaagtcttcccttgtgactattttgagatatacaataaattgttaactgcaattttcctactatactttcgaatactagaacttattcattttatctaactgtatttttgtactcatgaatcaatatctcttctccttcccctttttcccttctcagctctggtaaccatcattctattctctatctccatgaaatccactcttttagttcccagatatgagtgagaacatgcaatttttgtgtttctgttcttcacttattacatttaacataatgacctccagttccatctatgttctgcaaatgacaggatttcattctttttgtggccgaactatattcctctatgtatatatgtcacattttttttaatccattcatccgttgatggacacttaggttgatacccagcagtgggattgctagatcatatggttgttgtatttttagctttttgaggaacctgtatactgttttccatattgactgtgctacttgactgttttttgtcattgttttatccttaatgctcaaaagaatggcaagcccagagtaggtgcctgagaaatattagtttgaattagtgaactaatcttaggaaacagcattcctagaccttctcagacaagaattatctaaaatttttctggacctgctacaatgaggaaattgagctatggcaagattataaactgcattgggaatgctttgctaccagttactcccatgttaagctcttattaactaaatcatcttctctctctctctctctctgtttttctttttgagacaggatcttgctctgtcacccaggctagagtgccacccaggctggagtacagtggtgtgattatggttcactgcagccttgaattcccaggctcaagtgatcctcctgcctcagcctcccaagtagctaggactacaggcatgcaccaccatgcctaattttttaaattatattttgtagagatggggtctcttatgttgcccaggttggtcttgaatttttggcctcaagtgaccctcctgcctcagcccctcaaagcactgtgattacacacatgagctactgtgcctgaccctaaatctttaatgcttaattttcttctccatttcgataaataagatgcatgaaatttgcagacatccttagtgaacctgagattagtttgagtccattgcaaatggtttcttaggcctttgcagtttcaggggcatgaagaaacaaatatacacattgtgtgcacaaggcacaacatctgtatgtcaaagctgttatttcatccatttaagatcaagcaaaaatcctctctaaaattattcagggcacagcaagagcaacacatctctcaactctagtcactgatcattttatttccctgaattctaaagcagtccctcccttgtggcccaggcaaaaagaggtgatttgggactcctaatttccttgatagccttgcagagacattaaccacttttctactcaactggtgaaactagctgctaactggaggtagggggtgggagggagaaatagagggggtggggaaagagagggaatgaaagaaagagtgtgtgtgtgtgtgtgtgtgtgtgtgtgtgtatgtgtgtgtgtgtgtttgggagtagaagggtctgcaaccaaggttctcatatagcatggttctgtcagaacctgtgagcaggcttactgttgtctactagatcaaggacagaatcattagtctgacattcaagggcctccccaagctgtttatctgtctgtccctatcttctatgacgcgaagcttttgctgaattagactactttctgtttctcagatgttctccctgcttgtctgacgatttttctttcctcctacctattattttaggcccagcccagatgccattttttaatttctttagctgttcttttatggcacttactgcattctggaggtcttaaatactgctttttgtcttacaatcttgtctggcctagtaattataaattccaacatggcttgagggcagggaagggccacgtttttatctgcacatgcgttagcgctttcctcaaggctttacctgtgataggcaatacagcacttactatctttgaggtgtggacttctcttaagcattcgggactgcagcatttttgagagcatgcagcattgaaatagctaggcttgtcttcaaaccctcttcacataccaaaaggttatgtatctgggtggatggtgggtatcttctaagaatcaacagggaagctccatcatattttaattatagtgctggcagcagtacgacttttaacaaacagcagtaacaagaagtaacacttgggcgggccagccaccggaaattggcctctttctctgggtttctcctacccccttttcaatccatcacctggatttattcctgctataatttaaacacctgtctagatggtatgcatgcaatgtgtccctaccccacacattcagatatttgctcacctgccttattcggaagattggctctaaaataaacagtgatttggtactaaaggaaaaacgcactgaggtcaccgtggcaatggacatgaggcagagaatgggagtggaacatctggataagctgctccaggagagtgggagcagaggaagaggaaaagcaggagcagggggaggaggaggagagcaaggggtgaaacatctgccaagcaggccccaaagcttaggtggaggtaggatcttgtgaccagatttcccacaggcagttactcacttagcagcagccagctagagggaggcaggggcagagacatgtggaacaagttgactgtttttaggcttaaatttcttgtttttttgttttttcgttgttaccactatttctcagggcagcatagcaagtaatcttggaattttctgaagtttgtcctaagctgttttgtccacttttgcattcttggcatatttaatgattactctttttaatgtttgagcatctgaacaacattgagaaatagtaaaaccttaaagttgctaatgaaactattttcccttctcattcccctttgttgttttgtaacttgtcttcaccccatcaaaggcatttctgctgttttttggaaaatcccctgcccgtgagctttgtggaggagaggaagcattgaatggttccttttacctgttctctcgtttccttagctaccattcctggtaacaagtgcttctcaaactctgcaatgcaagtaagtttcccgtggatcttgaaaatgcaaattttggttcagtgcagctggggctggggctggggctggggctgtggctgggccaagattctgcatttttaatatgctcccagtaatgcaggtgctcttggtccagagaccaaattctaagtcgcaaggctcagtggtacaaggcagtgagataacacagtgattaaaacaacaagattgggagaattttcatcaggcagaccaggaattgaatccaggggctgacacataataattatttgttcttgagcaagttattttatctctcaacctcagtttccccatctacctgtcttgaagactaagtaggttaatatacataaaatatgcttagcatgttgcctggaacaagctgtgtgtgtgtgtgtgtgtgtgtgtgtgtgtttcagacagggtcttgctctattatccaggcactgtgtgtgtgtttgtgtgtgtgtgtgtgtgtgtgtgtgtgtgtgtgtgtgtgtgtgtgtttgagacagcgtcttgctctattatccaggctggagtgcagtggtgtgatctcagctcactgcagtctcaacctcctgcgctcaagcaatccttcccacctcagcctccctagtagctgggactagaagcatgcaccaccacactcagctaatttttatatttttagtggagaaggggtttcaccatgttgcccagactggtctcgaactcctgggctccaacgatccacatgctttggcctcccaaagtgctggtattacaggtgtgagccaccgtgcctggcccaaactgtttttgaatttagccgtcattagtattaatatagttttgttgttattattactgtagtggatctaaaacgtagcatattaaaattgattatagtagaacgttttaaaggtccaaacacagacttataagcttcttatgtgtatatacttgtgtttttcacttaaagatgttgattagctttaccagtagggcatgttctttgagtcatggtttcaattaaaaaaaaaaaaaaaagctataggttttcaactatctcctgtctgttttccagacccctttgtgaccaataacatgaattcgtaggttggcaagcctagatttaatagcacagacactagttattagcccagagaagccaactggcccaatggctatgacctccactttaatatcctaatataggttgagtgtccctaatttaaaaatccaaaatccaaactgctctaaaatttgaaactttttgagccacctacatgatatttcaagttttcagatttgggatgctcaattggtataatgcaaatattccaaaatacaaaaaaatctgaaatgcaaaacacttttggtcccaagtatttctgttaagggacagttaacctgtactactaacaaaaatggtgagccagtgattgattttgtgagtggtgctgtctcttcatgtactgtaagcctgttcttttaaaaaattatttagcaatgaaatgttgatcatcgttgtatatcaggtacctgtaagtgctctttatcactttctcttcatttgatcagagctggttttgttatgttatttggagaaatgtagatggatagagaagtggatgtagcctggtaacgtctataatcatcatctttctgtcctgttagggaagaaaccttcaggtatgaaccctaattggcttgtagggtttattaaggtctcatccgatactgggagattttccctgcccttaggtcttctctaggcaggacaaggcagttctaaagccagaattgatgcttagattcgtttttgttcagtgactccttctgcccattctggaaaaaagtgggaagctgaaaagaaagaccagaggttttcttacttaatttaatctagagataatttgcttggtgcaaaatttagtcaggtgtaaatctgtatacgtaacatttagccagatctgattgagagtctagagctgtgctgtgcaataaggtaaccactagctacatctggcttttaaattttaaattatataaagtttaaaatccagttcctcagtcatagcaggcatatttcacatgcatagtagtcacatgtggctaggggttactgtattgaacagtgcacattacagaacatttccattatcacagatcattctagaagatagaaaatgatttatttcacttgtttttctgatagatcagtgatggctacttggagaaatgtgtaaagaagattctgagaccatctccaagtcagccccgagttgcttgattatgggttagcagtatgagtcctaggaagagactgctgggtgagggatgtaggggtgttagctctggcatatgtgctgagtgtcttctagacaaaaaatccacaagtctaagaatagaatatttaatctagaggggcaggttattatcatttggtaggaacagattttttgttttcttttagcaggaatcctttagagagaaaggtgagaagcttttaaagttttctcattccttgtatagtctctcatttaagtagcagtcacttttgctgtttctcaaattaacaatgatactttgcttttgcataaaacaaaatcacagtggctgccacttcttggtttatccatcacatcaggaatggttgttatgtgaataaacgtaaccctccaataatccaaaagtaatttcatgatcaagtcactttttacctgccaagaaacaaaactggccgaggatgtttttctttgttttacttctttaatgtcttctgatgaaagataacaagtgggaagtaaaatcaaagggaaagaaggaaaagctggtatagttttgtcaatctctgtataatcactgttttaagaatttgaggtctgtatctgatgatattttaaaaatctctaataattaagggtaactaggattgttttcctactagtttccaaactagaaaagatttttaaaactggagtaccagttctgcaacttttatgtgactttgagcaaattgcttatcataacctctctgagccttagtttctccacttgtgaaatggtgtggaacagtatctacctctgtgaataatgggtaaggactaagtgaaatataaaacccagagtgcctaacaccgctactgtaaggactcattaaaccatattatttgggaaaagtagaccacatgcgctggaaggcgaacactctctgttctgtcttggccctgccacttacaggtgtgtgactgttgtctagttgtttaccctcttttgactttggcttccccttttgtaaaatgggtaacagtagaacctgttacaaagggattgcttggggttaaatgagataatgcacttcaagatcatgcaagaacccagcactttgggaggccaaggcgggtagaccacttgaggtcaggggttaccagcctggccaacatggtgaaatcctgtctctactaaaaatacaaaaattagcctggtggcaggtgcctataattccagctacttgggaggctgaggcaggagaatcacttgaactcaggaggtagatgttgcagtgagccaagattacgccactgcactccaacagagtgagactctgtctccaaacaagaaaataaaaccataatgcaagatcattgcacatagtgagtgttccataagtggtaactgttaagatgcatatgatgatgtttaaattaggggcagtcttgccaaaggataggtttactaaatcttttatctcctctcctttccattcactaatctccagacgatatcatttatactaaacatggtaaagtgtgcacattgtttatttattgatattcccctataaattattaagcctcctttattaagttcttggcacaactaaagcagtaattggagaagctgttagttatcataaagacctttctcactgtactttttctgtaagtttcaagatcatgtctaatataaaaggtctgatggtcaaatcagggcaggaaagcagaggagtcagtgtggggcaggagtgagttcaggagtacagggagtctggttcattgtctgaaggcctgacctacattgcccctaggatataggaagaaggacaaggcatttcagagaaactagtggccagagaagttactaccataatttgctactatatcttccctgtcttattttttttttttttttttttttttgagacaagagtctcgctctgtcgccaggctggagtgcagtgcgctatctgagctcactgcagcctctgacttctgggttcaagcaattctcctgcctcagtttcctgagtagctgggactacaggctcacaccaccacgcccagctaatttttgtatttttagtagagatgggatttcaccatgttggccaggatggtctcgatgtcttgacctcatgatccacccgccttggcctcccaaagtgctgggattacaggtgtgagccaccacgcccagcctcttccctgccttttagttagcatatgcccttcttctcccccttgtagaagcagtaggggacagaaatgataagtcatatatggccggtgagtttttcttccaaagactggtccacactagagggtgcagcctccacagacactgggaattgctcctgacctatggaaaacaactttctttccaagaaaattatttttagtcctttggtgtaaagacacagtcctgagttgttttcacttactgaattctataactaggaatgaaacactatactcttgctaaaaatgaccttttttctttcagaatttttagggaaaaaaaatcataattctctcatttgtagtttcaaaattattaggcccttagaacattttatagccaaacatttgccttggaattaacatctccagtctgatgactttcactactgttctctagtgtctcatgcttaaaatcctgcattcagctttgtgtcttctctctcttcaacagtcccggtgcatcttactttgaaatgcttctcacaaccattctttcttttcttttcttttctttttttttttttttttttttttttgagacggagtctcactctgtcgcccaggctggagtgcagtagtgagatcttggctcactgcaagctccacctcctgggttcacaccattctcctgcctcagcctcccgagtagctgggactacaggtgcccgccaccacgcccagctaatttttttgtatttttagtagagacggggtttcaccatgttagccaggatgatctcgatctcctgaccttgtgatccacctgcctcagcctcccaaagtgctgcgattataggcgtgagccaccgtgcccggccccattctttcttttctgattccactaccactgcccaggttttaaatacatctgtatttgccataacaactttaaaataattttttattataaaaggtaatacatgctcagtttataaaatttggagaatatagataaggaagaaaataagttgtaattcagaaataaatgctacttatagtctggatttttacttctagtcttcaggaatgtcttttcacttgtgtttgtgtgtgtatgtgtttaaagaaatttggatctactctatacagtttcatattgtgatttttgctaccacgattttttttacttgagatattagcgtgttcctatatcattatttttcttttcttttctttttttttttttgagatggagtctcactctgtcacccaggcttgagtgcagtggcatgatctcttctcaccgcaacctctgcctcccaggttcaagcaattctcttgcctcagcctcctgagtagctgggactacaggtgcctgccaccacgcctggctaattttttttttttttttttgtatttttagtagacatagggtttcaccatgttagccaggctggtctcggtctcctaacctcgtgatccacccgcctcagcctcccaaagtgttggggttacaggcgtgagccaccacgcccggactatttttcaaaaaatgttaatgcatacgtaatattgtcttacttagggcaaaatttatttaacaatattgttagccatttagatctcctttttcagtattaaaaacaatgcttgattttcagtattcacagtataatgtagtgagtaagaaaatgggctttggcagttgaaaaactatggtttgaattcttgttctgccatttatttctaggcctcaattcaatcataggcctcggtttctttcttgtaaaatgagtattatggtacttaccaacagacttgtggcaatttaaatgagatgtgtgcgacgtactcatttacacatagcttggcacctagtgagttctaataaatattgactgctattatgatagccacctgtcattaatcatctgcaattgttttgttgtatagttcccagaagctagattgtagtatcaaagtatacaaatattgtaatatattttaataaggtattgccagttgatttctaggaagattctaccaatttatagtcacacaagtagtataagtacctaatttcaccctttgccatttgtggatactatctttaaatattgtataccaaagtgatatgcaaaaatgatgtcttgtaacttgcatttctttgtaatttgcgtgtctttcttataatttacatttaccagtagaaatgatgactagttttacatgtttaattggctaattgtattccttctttgtacattatttattgaagtccatgactatttttctcctaaccgtcttttttctttctaaatcagtggattctttgtgtattataataatgttatttataactaaaatttactgagcatttagaacattcagatgaggtaacaagggcagaaagactagttcgcctcgtttctttgaacattgtctactcagtagattcttgctgtttttgttatccgtctttgtttttcatagacccggcacagtccagtgccctgcacttagtaggagcaaaataaatgcttgttaacttacactgacactgaccactctcacttctgctctttgtgcacaggagccattccttcctgagtgcctttgtcacagccacagcttcagctcagaggggtcagcatctgttggccttgacttgattttgcctatatgttgttaatgatgctttttaaaaactctgtaaagtcaggttatttccctcgctttatttctaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcaggtatgtgaagggccctgcaactagcatttgggttactcagggatggcctgtgtcccaagcaagccattcccaccttgagttctgtatggagatagcactaaggcatatgccctttctccacctgcctcgatcctctggcacctgactaagagagcctcattttatttgtaagacagttttcaagcatatcaaatgaaaaggacatttctgagatagttaagaaaatcaccttagggtaaaagagcaagaatttacactatgtttaaaccttgcttatagtcatcatttttatgtgccaactttttgcactttgtccttgtctcttagttttttttttaataccttgtgttgtttatagttttttttatactacattgtgtttcagtaactgtagactctgttcttttgaaggacatatttgtttcttatttttttatctagtttcatataactgaactcaaacaacctcgctgaacaatgctcatttgggaagtgggaaggaaatttcctttatgtagttgagagatgtggctaaagataaaatccacgtagcttctggcaataatgtaagcagcttccaaattaaaaaagaaaccactgtattgaattctggtcttgctgtgtgttttaattacccctgtattaaaaaaaaaaaaaaaaagaaatggattcccagcacatcttgctttagtgcctattaaatatggattaaattgcatcagtccctgagtcgaatgcgctagagagaaatgtgactgttacagtgaagtattttgaccagctgagatattgttccctccaaccaaagaagttttaccacaggtgcccgaccaagccctcacgccccatgccagtacttccagcctctgccttttagtatgctgctttgccctgagattcagagggggtactgaagacttggacatggaggaaatacctagttgttggtaaagtatctattggtgttagaattattacttaaggaactaatttgggaagcagaagctctgcccaggaagcagcatagatataagcacattacatcatcctgcggtacggtgtctttcataccggtgatcattgtggtcggggcgaaaagaatcatcttaactgagaattataaagaaccgaagaccaagacgcaggactttttaaagcagagcatcctccacacagttctctccccaggagaagtctgctgtaaaacatcagtcataaacaagaaattctgtttataccatagagctttattttccataaaaaaatttccagatattccattttcattttaaattcagagccttgtttttatggaagacattttcactgcaattttggatataatgtctgtatgacaaggctacaggcattgctcctactgtaaacaaaatgttaaaaccacacattttggagaaattgagttttagcactttttatacttgtagatggaatgagggaaaacatttttaataacaattgtggctgggtttagagctttcttttggtagcgcctgttagtagtgagatgaaagatgatgagttcggttaaggatgtgccaggacctaaggttcagtactgtgagtggccttctcccagccagactgcccacgaggctgcgataatgctcatggtgcattacacgatttacttctgacccattccagccaaaaagcaatccccacaaagtcccctggtcttttccttttctttttacccacagcagccttctctttacctcctcttcaaacacaagagccagttttcaagtcccatttcagttcagggtagccctgggacattttcctctacccccaggtgacctctggttgccagcactgcctgcaacctgagcttgagagtcccagttccacatggaattcccagaggcacccaacctaaaggagccctgagtgaattctcagaggtctttccagacttggctgtgatataggccgcagccagacctgcagcatacaacctgcacagcccaatgtcctggtttccatttatacctggtaagtcactgttttgtggatatttagtctcttgttgttcctcctttagtcgtaaggatgactaagtttaatgaatacaggatttgtagcttagagatctgagttttattactggtttgacattaagtgaccctaagctattcatttaatctttttattgggtaagcatacttacatatgaagtggcctgttttgagagcttttagattgcctttaaagcactttgatctccctggaagtaggtgctaggtaaataaaagttactctcaatagtttttctacagtagcaacagtggattccagtttagttctgataattcactaaactaggggctgccttgtaaactgtaataaaatgtaaagagaatcccattgctagctgtacttttcatctctgcatgtcagagaattcactgacttggtagccacaggaatgaaaactggtgactcacaagaactctgcaaatggtgttatttttcatttccctatggtgttgctattgttcccaattttatggatcacacaagttttcatcaaacgaccttgttctcccgctgttttgacatcaccccaaatgtagcctcagggttgtcgtctcccattgggtcagtgtaagctcagcccagcgcctcaaatcccttggttcctttggtctgtctggagtcctattcaggctttgttgtgggagaagaaggcaaagagcccacgacttgcccagacagtctgaggcctggccatgtagcttgcagttccctagacactctggagttggacttggccagccatccctctgttgttacttttcagaggtaataagtgagattaattgcaggccattctccggaagagaaagtagttagagccaaatacagtcacatgtttagaagcctgaggtgtgcctccaagcaaggccgacttagaattatacagtagggactccaggatgcaggtaccaagtgtttatgacctctctcttccttaaagtgatgttttcagtttctaggtgctgatacgtgggtgtgttaacttttctttagccaatgagaaagattagatttttcaagctgccttttaattatccatttttggggtacatgggaagtcattaggagctgaaagttgatgtgcagagccatctcatcattactgccagccttccatggaattggactgcatcagggaggattttctaggtgtggagcactcagtgggttcttagtgcgtttttctttgtgagacatggaagggttactgtaaagtcttggctgctgcttggaatgatttgggaagaacagggcctcagacagcttggcaggaacctgaggccctgtttttttccagtccagcccttccttgtggatcgagctgtcagggaatcccacgaatgtctggctcctgcccctttgtatgtttttccagcatttgtcattgaattatttttatccacctctggctttttcacacatgcatcctgggcatttgtctgttcctcgatatgaaagatgggagaatttgcagaaagagcacagctgtgagtttgttcctacttttttgtgataggacaagacattgtgggcatgggctgctccacctggccagctcccattgtctagagaacatctgtatgaacttgaaatgccaccgaggagtgggaaatcttgagaagttggaaccattttcgatgtcaccctgtccttctgccctcttattcaacaatagattataaatagcttggtattctgctttgcgtaattttaaggtacacatttttcagagattctgattctagtttagttaataatactttcctcccttcttttagattattcttagaaatgttgctggagattcaggtctctaacttctcatcttttcattctcagtcagtcctcagaaatactgaatttgttaatttcctttaaaaatatgtcttatgcattttctatatgtcaggcattgtgttagttgctggggaggagcagtaaataaaacagaatggttcccaatctcaaaatttactctctagggtatatcttccatgttctcagcacagtattgggtgctgggtagggcctaaaagacttttgaagacataatgtttgatcactaagaggctactgtctggcagggaaagggagtgtatacacatgaaacaatcagagcagtggcagggggcatatgacaaagatctgaattttatgggatagacaatttgaagaaagggtgtcaagaagggcatgtaaggagtcagtcctgtcccggatgaaccttgagggtcgtatgctcagtgaagccagccagtcacaaaaggacaaatccattcatacgaaacatctaaagtagtcaaaatcatagaaacagaaagtagaaaggtggttgccaagggctgggggaagaggggagggggaattagtgtttaatgggtatagagtttcagctgtgaaagatgaaaatgttctagaaatctgttgcagaatgatgtgaatgcacttaacactcctgaactatacatgtaaaaatggttaagatggtacatttaaaattatgtgttttttttttttttttaaacaaagaagagtatgtaaggatttaagagagctccatagttccacaaaaattacttagtggccaaatggcaaggttttgtttttatcctctgcctctgttataagggaattattctgaacatagtcctttaaatacttctctttcttgaaaagcatgttacctttataggaaatgggcccagcaatttctgttaggaagatggcatagtatggtgggaagagaagggactttagagtcagacagacctaggtttgccttattaagtgtgtgaccttgggcaagttgcttagcttttctgaaccataatttccccatctttttttcaatgcacatagttaaacccacctcattaagttgttgtaagattaaactgagttgtgtatgtgaaagtggccagcatggtttttactttttacttttttggtgtaggtttcttggtaactctcagttccctttccagaaaaaagaaagaaagaaagaaacttaaaattgaacttgcttgggatatggtattgctcaccacttagtttagtacctagtttacatcactctggccatcaccctgtgcagtacgctcctgggactggataacagaaatctggcctttctagccgaggatgggaaggcatcagagtggggccaacaagagactcttcctttttctttgaccccttggttggaggtcagcttctttctactcagcaggccctttttctctgctgtctcctgaatgttgaaatttccattgcagctcaatgttccagccagtaaacactcatattttccatctatcctgggggtcgagctttgggagagcttttctctggagcagtttggagcttataattttgtactttatcctgttatataaacaatgctttccagccaaagagcacaatcaaagagaaactactttttgtgggggggactaaaaaaaattcatattcagagtcctgtagaagtgatatttcactccttatgcctctttcttctctttcataaaataaagtttacctcacctttctcctgagtcttaactctcactattccttcccctgaggaaaacgatttctccagtacatgtatgataaaggcctgtacttccatctgaattttctctgctacttttctcactcagccagacacgtaacctctcaagagttatacgctgcatcagttcaagctctgtgacagattctacagttcctccttcaccgagagagctgagtgctgtcagtgtttgtgccaagagcaaaagtgattggcttctgcctaataaaggaacgttgggaagcttaggaaatctgtcaaagatagctggctggacgtcataccagggcctaggtagcataggttcgggaacctggggccgagtgtcaggagtgaaaaacgtggatctttcttatccacaagtcagaataaagcatggaatgcagtgtttgcagtttgccagtgtcagtttttctagttaagtttgcctctctcactccactccacactgctttgaagtattaatgataaaccaccttctatttccttaggatacgcgtacacacacacacacacacacacacacacacacacacgagtctttgttagaggcaaaacctatgtgaatatacttacactcctgaactgtacacataaaaatggttatgatggtacattttaaattatgtgtgtgtttttttaactacaacgttaaaaaaaaaagagtatgtaaggatttaaaagagaaccccatagtttcacaaaaattatttactggtcaaataatttttttatttaactgtttaatcttatttaactgtttactttataattttgtaactctacaaaatggatgattattttggttttaagaggcctggttatgacaaagttccttacactaagctaaatgagactctgtttttagaattaggaaattataggagttgttttatttataatttagtttaattctcctggcatggtttttctatcagcttctgtcccttcaagttaactggtttaccagctttggaagagcctgggaagatcacaggcgtgatgaaacacagtctttctttctgactcatgtagaagaacattgatgatccatatttaaagcttacctagtattgactcaacaaatttagaaggaaaaccagccagttttcctgatcctttaactaacccacctgcccttctcgctgctaaaagactctcagcgtattacctacccagtacagctaagaaatcaatgctcttttttaagaggtctcaggagttaagatgctaataagaaaaaactccctgtatttatgctttcataaaataaaactatagaactatatatctgcaaaggaataaaagtcctctctttcctgaagctgctttgtgggacaaagttttggtataggctcttagtagctaagtcttagttccctttttttgaaagaaacaaaattgtacttgcttggtatatggtatttgctacactgggacacagtttagagtcaactggccgtaactcacgtacaataaaatacagtattatagcagggaaagcagtaatatgtaatcacaatactaaggttgacattatttatttatattgtgaagtaagtacccacttattaaaactgttattataaatcattaaaatgctcgtaaagaaagataattaggaaaagccaaattttaaatgtttatttaaatagggagccaactgttctttgggtgatgtgtgcaaagctagtgagagaggcagtgtatgagagcttagggatttgaaatgtcacaacatatggcaggcccaggtgttcattataagttacaaactctcgtcctgcttggaccattcgtatgcttcaggagcagtaaagggactactcatggttttcatgaattatcaagctaagattcatattaatttcacttcagagccaataatcaataccacatttggcttggttctttttttttttttttttttttttttttttttgaaacaaggtctcactctgtcaccaggctgaagctcattggcatgatcacagctcactgcagcctctgcctcctcaggctcaagcgatcctccctcagcctcccaagtagctgggactacatgtgtgcaccaccatgcctggctaatttttgtattttttgtagagagggggtttcaccatgttcccagactggtcttgaactcccaggctaaagcagtccacccgcctcagtctcccaaagtgctgggattacaggtgtgagccactgtgcccgacctggcctggctgatcttaaaaataagttttgctatctttctgtgatgagaatgaaatatgggtgcatctcaatgatgtgactataatttaaaaggatttagatgagaaaagcaggctttctggcatagtaggtaaggcagccataaagaggttagtaaattggatgtacttaaaggctagaggaaatcaaatcacaattgacccttgaataactcaggtttgagctgctcgaatctacttatatgtggcttttcttccatcatctgccacccctgagacagcaagacaaaccccttctcttcctcctcctcctcggcttacttaacctgaggatgacgagaatgaagacctttatgctgattcacttctgcttaatgaatagtaaatatattatttctcttccttatgattttctcaataaattttttattctctagcttactttttagtaagaatacagtcccataatacatatatcatataccatatgtgttaattactgtttatccgtaaggcttccggtcaacaataggctattagtagttgagtttttgtggggggtcagaagttgtacctgaattttcgactgtgcaggggttggcaccccaacccctgtattgttcaagggtcaactgtacattcttttgaaactgggttgcaccaagtaaaactaagtaaatgaaagaccctgcctatactgttgaatactctcaaatatcttactagctgcttgagcccagtactgacatttgaaatataagcttcaaaaagagttttgttaccttcttcaacaaatatttagtaaattaaaatatgtgcaaaagcaagggtgaaactggtagtaagtaatgtttcagctaggaaatgatttcatctgatagttgttacagtaatgttatcctcaaaaagttaacatgtaaaattactgaatatctcctcagtgtgagagactgggccctgaaggaggtatcagacaaatccctgtcctcaagaaggaaaattactgatcataaaatttactaatgcaagtactataaagcaatatgtgcttaattattgaataggaagatgaaaaccttttcttaagtggtgagagttccgaggagaaatttatcactctggctggagaagctggcgaaaacttcatggaaaagaaaaggtgtgagttgaacctggaagggtagatggggcttggataggccaacaggctgatattcatcacttaagagataattgcacatatatttggtgcttggcactatgtgagaatctgagaggatcaaagaattgtaatccatactcttagtaatagctcattattgaccagaagccttatggataaacagtaattaacacatatggtatataatgtatgtattatatactgtattcttactaaaaagtaagctagagaataaaaaaatttattgagaaaatcataaggaagagaaatacatttactattcattaagcagaagtgaatcatcataaaggtcttcattcttgccatcctcaggttgagtaatactgtcctatacatttactttttttttttttttcatgtaacacagaaagcgagtgattttaaaagagcatatgggttcagatgagttcacaattcaaaaaagatactaaagacttgggtgaaaatataaggttctgcagaggaagagtttaaggtagggtgtaaattcagtcccaggtgtataggctacggataggttaagaaatggaacaaaaaagaagataatgtgcaagatatttaaggtatttgcagggacagtaagtgggagccagtctggctcagacagtgtgtcagaaataatgtattagtcaaaacacttggagtttcaagtgatagaaactgaaatcaagctggcatatccgtaaaggagattttttagttcatataaaagcctagaagttggtgtgggggaattaggaagtatcattaatcattctcctttcttccaagttcacaactaaatgagaaatagtagaaaagttagagaaatagtgagatattggctgtattgctaaggataaattgttggggatatagcataattaggcttctacctctcaagtctgagtctttctaatttgttttctgtattctaaatatttcctgtattgacattttggtcacttggataattaaaacaaattttttcaagaagaaggaaaaggatccaacacaccacaatgtgaaaaacaaaaacaaaaacaaaaattgtggcctgatttccaaagtgagcacctgcatctgggtccagtccaccttaccacttgcattcttcttcataagttcagtgtcagccaagtcaacagatcaaaagtaagcctattattgtacaacatggtgactataattaataacaatgtattatatacttgaaaatcactaagagagtagattttaactcttctcagcacacacaaaaatatgtaaggtaaagcatgtgttaattagctcaatttagccatcccacaatgtataacatattccaaaacatcatggtgtataccataaatatatacagtttttattttttcattaaaataattaatgaaacatgaaagataatattttggaacacaaatatataagccttgtatattttcccatcaccacatcctcacttatgccattctgtagcacttattctatttgtttactgtttactttctatcactctttcacttaagtgtatgttgtcttattcattattgtatcccagtgccttggtaagcagtaggaacttattgatgtacaaatattgagtaaaagcatgagtgaatggatatcctgttctcacacagggctcagtttattgcagtcttcctgcaaccttccctgatgtcccaagcagatcttattaggatttctcatccttaatgcctttcatctattggaatcatgctcctgagagatataattcaccatgatgtccagtatggtagccacgagccacatgtgtatatttaagttttaattaaaattaaataaaatgaaaatttcagtttctcagtcataaaagccacaagtcaaaagctcaaaacgagcttacgtggctcatgactaccatattggacagctcaggactggatagttgacccagaagatgtaataaagactcaaacttggttagtgaaataaaaagtaaaaaggaatgagtttctaagaaaggtacattgttgatatcctcttaggatcttctgtaggtcttgagcttcttttgtttagatctggagatttactacagatgctgttcttgaactaatttgtggtcctggaaggggaatattctaatgccttgggaatctcacaagatcagagcttcagtgtaactagtatttaacctatcagagctaggccaactgagaggaaggggtttttaaagcagatcccagcattatctttttattttctgagatgtgtccatggctagatgttgggggagtcttgcttctctaccctccctctactgcccacagccaccgccacccccacctgcctggctggaggttctgacatggcttctagagctgctgtaactctggggaacagagccaaacatgcggaagtggttacgtgtactagctcccagggaagccgtggctagcagggggagtgggtggggtcctgcctgatggcttttcagagacgccaaatctttgaagttttgttttagcagctgccaggtatgctgtttcagcactttgcagactctccctgtgttcccatatcacattttttctttactgtgtgtgcatagtatacacaatggagcttggctgttgggagggcaaatataaaattgtggagtaaggaactaaacacaacccttttggcttttggcttttgctttttactatgactctgatatgaaatagccactttaatgccctgttttcagctctgtccgtttctgatcacttgccaacggaggggtagagtcctcttctgttttgggaacatagtacagtttgaaaaactggaggtcctacatttctgtgatagattggggtgtcactcttgaggctagaacttctccctttttacgaaagaacagatgacacacacccccacccccacagcaagtaacccggatactgctggtctcagagtaaacttcttgctcaccattggctccttggcattgagcacaatgtcaacaataaatatttgttaaatgattgcacttgcagctgctatgctggaggagaagggctggggaggtagaatacacctttaaggcccagcctctgtgctttccctgccttcttagtaatccctttctcctatccagtctacagtcacctgaagcctttcccaattgcccccaaatttgctgcttcctctgaactccactctcggagtttagtgtatgttcttttgtgtagttaactgtcttttctttctttcctgagatgtaagctacattttatttctggaccaggaatgggaagacctaggtgccagccacaggtccacctgacttggggcaaatcatttgacaaaaccaaagcctaattttgctatgtggaaagtgatgcctggattgtcatgggaattcgatgagatcccatatgtgaacgtgctttgtaaactgtaaagtattacacatgattgggtcttttcagtactaataacactcatcactataaaatagtaatgtttgtttctgctgccgatgtacaaagactaatctctcccagaattgaggtaaatcaccagtttagtctcacgttactcagttagtttggcacaggtttaaagcattaaacggtccattccaggcactgtctgtcatcgcttctctttcagtctgcaagctcctccttttggagctgtggggtggttgttttcttaagtctcccttcttctcctatcaggcccaggctgagctctctcttttaaccacctctgttcttagggcagcaggcttgtccatccagttcccagtttcagcgggaattgctgtactggtgggccagtctcctcagcgtggccacctgcctcccgcagctctgcccatcaggaacaccaggtgccttcatcattctcctcagccaagccccatgcccttatcagcacctctcagcctcacttcctgcgttcctctccctgtgcttatttttctgccaggccatcccctagcctcctccctctttcatatcatttcatcctgcattttctttcgttctctgagttctgacctttcatccagaaaggctgtttcatatttcaagactctgctgttcggtacatcttcaccctcctgtcacccagtccccagcatctgaaggcagctccttctcagagaagaataggataaataagtgctgccacattttgggactatcatatggcctgagaagctcccaattttttttattttaaaatatcgaagatcttccatgtaagtgttatgacctaatgtttgaaagcatgtagttaagaggcagaccaatttggattccttctttttttagccactcactagctattttgcctagggcaagttctttgaacttaatattcttatctctaaaatagagaataaatgcctacttcctagggatgttctcaggagcaaatgaaaactaaatggcataagaaaagcacttttactatatataatgcctgccatagagtacgtgcccagtaagtgggaatccatgtaaacatttctatgtcatctacccttacccatacccatacattagaaatgttaaaaatggagacccagagaaatgaagtagagtgtgcaaattctcatgcttacctagtgataaagtaaggagtggaatccagggcttctagttctctgcctgataaattttccatttgatctctctgactcctcaaagggttatttgtttgagtttcctttctttaggtgaagtatgctattatcccagatagaggcatgttcatttattcattcatttttcattcaacagacattacatgaccaaaatgttaccaggctctgagtgtacaaagaccagtaatgatgaactcactgtctcaatggttagtccagtagggaagaaatcatcactgtgaagaataagtcacagtacaaaaaacatgctagtaaaaggcatgtggggcctagaggaacaagctaaatcagaggaaaaccaggattgattttgcagagagtgaattattggttttttactagatgaaaatggcggagatttgtgcaaaggcagggaggtatggaagagcatacctgaagtgcagtgttgtgggagcatcacattcaagtaggggagtatgtggttgaggataaagtgggaaagttgaaaagttaaagtgcttggtatgccatgttaaagggattttatcccattgtcagcccttttaatcagtgtgaaatgaagaaatcaagggagtttttaaaaaacatttctgcatctttatacctatgttttcatgttttcactgtctttccccttccctttcccattcttatttggcaaacactttttaccattgtggatctagcccagttctaccccttactctgtatattttttactccctgccatcccaggcagtctaaatacatacctatgcccaaaattcacagaccggacttctacctgggcagttctttagcctactacaagaagtcacacaccatcatttaaaaagaacttttttattctgtagatggattaggtcaggactttttcctttaacaagaaccacaattcagcatgcttaccatcattagaacttgcgctttgggctgggcacagtggctcacacctgtaatcccagcacttaaggaagctgaggcaggagaatcacttgagcccaggagtttgagaccagcctgggcagtatagtgagaccctcatctctacaaaaaatttcaaatattagccgggcatggtagcatgtgcctgtagttccagctactcaggaggctgaggtgggaggattgcttgagcccaggaggttgaggctgcagtgaatcatgattgtgtcacttaactccaacctgggcaacagagtgagaccctgtctccaaacaaacaaacaaacaaacaaacaaaacaatttgagctttgacttcctctagtaaggtaccctagcactcagctggccaaaaacctgctatggcagcagttgtcattcttcatgtctttgcaacacacttccacatacaagaactttgatcaacacagttgaagggatcaaaagatgcaagacaatactcaacccagtaaatttcacctggtggaatcaatattaaagtagagcattgtctcccagtgtccattaggtgtctatagttatactcctcattcagtcatccttcaggaccatgtggctgttttgagtattgctatttatttattgccctcattagactctaatatactcacaggacaaagtttcttcagactgtagtaaacacacaatctctatttgtcaccaggttgatgttatgcttctcttcttgtgtattgcaaatggactctgctctataccatgtgacaggagccaaccagctcaacatttcatctgacaaagagaaccattatgttgtattaaaatatgtagttaaacccacagaagggagaaaatatttgcaaactaaccatctgataagagattaataatcagaatatgtaaggaattcaaacaactctgtaggaaaaaaactaataatccaattaaaaataggcagaagacctgaacagacatttgtcaaaagaaggcatataaatggcaaacaagtatatgaaaaatactcagcatcattgatcatcagagaaatgcaaatcaaaacttcagtgagataccatctcaccccagttaaaatggcttatatccaaaagacaagtaatgatgctggcgaggatgtggagcatagtgaaggctcctacactgctagttggaatgtaattagtactaccactatggagaacagtttggagattcctcaaaaaactaaaaatagagctaccatacaacccagcagtcccactcctaggtatctgcccagaagaagggaaagcagtatattgaagagatatgtgcactcctgtgtttgttgctgcactgttcacaatagctaagatttggaagcaacctaagtattcatcatcagatgagtagatgaagaaaatgtgatacatacacatagtagagtactgttcagtcacaaaaggaatgagatcctgtcatttgcaacaacatgatggaactggaggtcattatgttaagtgagataagccaggcacagaaagacaaattttgcatgttctcacttacttgtgggagccaaaaatcaaaataattgaacttgtggagataaagagtagaatgctggttaccagagattgggaagggtaatgggggttaggggtgacagggggaagtggggatggttaatggatacaaaaaaaaaatagaatgagtaagacctagtatttgctagcataccaaggtgactgtagtcaaaaataatttaattatacatttttaagtaactaaaagagtgtaattggactgtatgtaacacaaaggataaatgcttggggtgatggatagatactgcatttaccctgatgtgattattacacattgcatgcctttatcaaaatatctcatataacccataagtatatacacctgctatgtatgcaaaaaaatgaaaaataaaaataaaatatatgtaatcaaatatattatacatactgatcaaactttacacacctgtgaagttttctcaacacagaaaagttgaagcctctttcccaagactttaatgaagagatgtgttgtaatccagtgatagaccatcatgaaaatatgccctaaattgtgctgtgttaggagagcaggccactatgacatgataatgctttaaagctgatttttttctttttaaaatttatcaatgtgattgcattggttacctattgcaacaaaacaaattactgtaacatttagtggcttaaaataataaacatttattatttcagcctctgtaggtttctgtaagaattgaggagcagcttagctgggtgtttctggctcaaattctcttataacattgcagttaaggtgtcagccaagagggttgcagttatctgaaggcttacctggggctagaggatccacttccatgatgtttcactctcatatgcgtaatgagttcatgctggctgtcgacaggaggcctcagtttctcactacatggacttttccacatggacttctccactggctgcttacatgacctcatgacatggcaactgacttccctcagaatgagtaattcaacagagagtagggtagaagccacaatgtcttttatgacctagccttggaaatcacatatcatcatttaaaaaattattattttaaaaattgtggtaaaacacaatataaagtttaccatcttaaccatttttaaccatttgaactgtacacagttcaatagcattaagtacattcacattgtgcaatcatcaccaccatccatctccataattcttttcatcttgataaactgaaactctatactcattaagcaataactctacattcttccctccccccaacgcctggacactactgtggtattttctatctatatgattttgactactctaggtatctctattagtagaatcatagagtacttatctttttgtgactggcttatttcacttagcataatatcctcagggtttatctatgttataatgtgtcagaatttccttccttttacaggctgaataatataaaatatttcattaaacatatatatatgtgtatatctagatatatgtgtgtgtgtatgggagtgtgtgtgtgtatatatgtatacacacccatacacacacactacattttgtttactcattcatcttgatagacacttggtttacttctgctttttggctattgtgaataaactgctacaaacatgagtgtacaaatatcttttcacctccctgttttcagttcctttggtttatgcccagaagttaaattgctggatagtatgttaattgtgtttttttaaattaattattcactttatttttcctatataaaagcactacatggtagccagagttggagcctgcatcctttgcacagaggctctggtgcaggtctttactagatggccagtgaattcccaattaggtgatttggtaaacacaatctttccagaagtaagaggtcagatagctaaagatcttggaggtggcggctgggcgtggtggctcacacctgtaatcccagcactttgggaggccaaggtgggtggatcatgaggtcaggagatcgagaccatcctggctaacacagtgaaactccatctctactaaaaatagaaaaaaaaaaaaaattagctgtgtgtggtggtggacacctgtagtcccagctactcgggaggctgaggcaggagaatgacgtgaaccctggaggcggagcttgcagtgagccgagatcgtgccactgcactccatcctgggtgatggagcgagactccgtctcaaaaaaaaaaaaacaaaaagatcttggaggtggcatcaaaggtagtcttggcacagttgctcagagggtggtgcaacccctggctaaggtgtagcagtcatgagtaccaggtataagcagcagctttttgagtgcaggacctaagatgttgacagtgcctttgggggcgagggtgaggcacatcagcacagagccgcagcagccagtcacttgcagtgcagagtgtggagcttgctgatcttgttccattggatccttgctgcatggggatgatggagagcagggtgataaccccacagatgctactgtccgcctccttggagcaattatccagactgatgtagccattgtagtcccttatggtaacaaatgccttgaacctggtccactggccagtgtgggtctgcttttgccacaagtatagtcttcaaaacctcacctgtgagagggtgtccccagaaatgtcgatgatctcagattccttgatgggcagggagaagagagagatctgctccagggacttgattttcatgttcttgtccaggcagcccagcatgcggatggtgacacactccttgtacttggtcttgcttctgtgagctctgtggtgtgggccctgagcacacctgcggtctagaccctcccatagcgctggtgtcatctgccatttgagattttgtcttggagaagaagagtaattctatttttaagttttcgaggaaccatcatactgttttccatagctgcagcaccacttcacattcccaccagcagtgcacaagggttccaattttgccacatcctcaaaacttattttctgtctttttgatagtagccatctgtattagtttgttctcatgctgctatggagaagtacccgagactgggtgatttataaagaaaaaaggtttcattgactcacagtttcacatggctggggaggcttcaggaaacttacaatcatgacagaaggcacctcttcacagggcggcaggagagagaatgagtgccagcaggggaaatgccagatgcttacaaaaccatcagatctcgtgagaactcactatgatgtgaacagcacgggggaaaccgtgcccattattcaattacctcccaccggtccctctcacaacacatggggattatggggattataattcaagatgagatttggggaggggcacaaccaaatcatatcaccatcctaacgggtgtgatctcactgtagttttgatatgcatttccctaatgattaggaatgttgagcatgtttttgatgcttattggctatttgtgtatcttctttggagaaatctctgtttaagttttttggcaatttattaatcaggttgtttttgttattgttgagctttaggagttctctatatatcctggctattaaaccctcaacagatatatgatttgtcaatattttctcccattccattgaatacccttttaccctgttgacaatgtaacccttgatccacaaaagtttttaagtttgatgaagtctaatttgtctattttgttgttgttgttgcctgtgcctttggtgtcacatccaagaaatcattgccaaatccagtgtcatacagcttttgccacatgtgttctaagagttgtaatagttatagcttttatgcttgtgtctttcagacacagtcattttttatatatgtatacttcaagttctgggatacatatgcagaacgtgcaggtttgttatgtaggtatacatgtgccatggtggtttgctgcacctatcaacctgtcatctaggttttaagccttgcatgcattaggtattactcctaatgctctccctccccttgccccccaccccctgacaggccccggtgtgtgatgttcccctccctgtgttctcattgttcacctcccacttaggagtgagaacatgcggtgtttggctttctgttcctcagacacagtcattttttcagcattctgttggtttatacaggccagccctattcagtgtgggagggaactacgcaaggatgttaggaatactaggaggtatggggatcgttgggggccatctcaaaggctggttcccacaataattcagaactatagttttaaaagttaaggcattctatagggtttataatgaaaatgggaatcccttgccttttctcttcccactgctacccaaccttaatttccatgccctagaaataattgctttcaactttcttgtaactgctttttctgttatttaccttctgtgttaattcattcttgcattgctataaagaaatacctgaggctgggtaatttatgaagaaaaaaggttttattggctcacagttctgtaggctatacaggaagtgtggtgccagtatttgcttctggtaggggcctcagaagcttccaatcatggcagaaggtgaaggggagcaggtatgtcacatggcaagagcaggggcaagaaacgggagatcccagactcttaaaacaaccagatttcgtgtgaacgaactgagcaagcgctcactcatcaccaaggggatggtgctaagccatgcctgagggatccacccccatcatccaatcacctcccaccaggccccaccaccagcattgggaatcacatttcaacatgagatttggaggggacaaacagccaaaccgtatcaccttcatagttctaaatcatgtttattctgccatttttggattttaggtttagatattatctattaactttctgtcagaaaaagattttgcactcttactctacacccttcacacccacacaaacacacatacccacagcattctttccttccttccatccttgcagtatacttagaatacagtttttggttagattcgtattcactggtttcattaccatgactgtgactgggaacttttgggcctcttagagtcattatttcttctttcctatttattcctttctttgtcatctggtctgactttctgggtgattcccttgataattttccatatgatctacttccctaagtctgacttagtacatgttgtgaagttaagaaaggttctaatttttaaatttcttccagttcaggacagtttacatggggctgtaaatcgggggattgggaagggatctacatatttacttttttttattttctgtagactgaaatatctatgtccatacttaaaaaaaatagttgtacaagtggtacacacatgtagccacatgttacagtagtctaaaaaatacacatatggaaagattaggtggcaaataaaatcttctcagaggtagctatacttaaaaggttggtttgtatattttttcatgtatttttctgtgatgtttttctatcctaatatgtctccatgtttttcagtctgttcatataaactgacttaaatatttttaaccactatgtcgtttttgaaagtatgaatgtgccataatttgtttttccatccttctattaagaagcactaagccgtatcctgatgaggcatctgtagggaactccttatacgtagatctttgtgcatgtgtgtatttctgtaggataaactcctagaagtggaattgttggatcaaatgtccactttgaatttttatagatgctgtcaaattggcatccaaaaagcctatcccagtatatcctccaatctggagtacagaaacatgccctttttccacacccttgccagcattacataccattgacctttctgtctattcctctggactgtcgctctcccacttttactgatgatgaaatgaggagtggaccctatcttcagatatattacttcaagggtgttttgtttggggcaggagtacaactgagaggaggccgagaagcaggagggtaaagggttctccgtgggctctttattttcttaatgttccttaagactagaaggaatccctgtgagtcaagttcatcttccctccacgctgcttaggtcttttctctcctggttttgtttttgattgattttacccagggagcctgatcctctccccttcctaagtaatgaataaccagaaaaagttatagaacccagcaaactgaatgaaaaaagcttaaggaaaatattaaaaaggaagaaaagtgtttgatgtacttttaatgtaaaatgtggaaaaagtagaaaatgggtgggggttggggaaaggagggaggaaagagattattcacggtaatgggaaccaaatgttggctaggaaagctgcagtattctcacactcttcctgtaaacccagcggcttttcaaagtgataataatcaagggctgacagcacaggacacgccttaacccttccatacctggacacttcctttgagtcagcctcaaaggtggtgtccactttgaagaaatcctggtatatttcagtgccctttttgcctccatagcaaaaagaagaaaggtggaggcaagttttgaacagcaaagcacctgcttgctaaaactcctttcagtatgcccaaatttcttttctgtggacagagagcagcctgcctgaccagtccaggatattttctccccttgctgtcctgagaggaacttgaaaggagttgagaacctccttgtgacagataggattctctttccatcagtaataatcgcgtttacttgaaaaccctctagtctgaagccctcctagatgccagtgtggaagtgcatgcacttatttggaggcttagacctttgtttctcttggaagtccactcttcccactgtggaactgagatgtaaatatactgttcagagctgaagggctccctgagcttatgacttccagctggtcaagaacagtcatatgcctcttggcctaaccattcatccaaggagggagaaggaaagggggttactaaatgaagttcctggttcagctggatcttcacatccatctagatttaaactttgttgagacacctttaaaagttcatcttacacaagaaggaaatgaaatcttattttttgttgtcaactatttcccatttcagaggagcagccaccacatgtagggcaatggtagcaataaggcaggtagcactgcagagcagatgagtgctcagattctgcagttagctatgcctcggttgcctcatctgtaacatgaggcaaggttaaagtgagataaagcacagaaacatttagcgcagtgcctggcacctcctcttctttttctcatcattgtcctcatgtggcatacaactgaaatggaagcatctcctttgtttgaaatgtttttagaagtcatctttgggatgattttatagtttctcattttatatttattttattttgttttgttttgttttgttttattttattttattttattttattttattttgagatggagcctcgttctgtcacccaggctggagtgcagtggcatgatctcggctcactgcaaccacacctcccaagttcaggagattctcctgcctcagcctcccgagtagctgggtctaccactactcccggctaatttttgtatttttagtagagatggggtttcaccatattggccaggccggtctcgaactcctgacctcatgatccgcccgcctcagcctcccaaagtgctgggattacagacgtgagccgcctggcctggctcattttatatttaaatctgtgatctaatctgagttaatttttgtatgaggtatgagattttggttgaggttccttctttgcctatgtatgttcaattgctccaacttcatttgttaatacacaaatggtttagaaaggttattgttcctccattgtattggttttgcaactttgtcagaaatcagttgagcatatttgtgtggatctttggatgactttagtatttctaaaacaaaggtctgtagcaataattgttagaaaatctttagcaggggctattttaagttatgattttctgtttctcattataattgtggagacatcaagacttaggttcaaaagcagctctttcctttattctgtatgtccttaggccttaacctaaccctcagttttctcatgtgtaagatgggataatacctgtctcaacaggttgctatgaaggctaacaaagataaggcatataaagagctcagttgggagtctggcatttagaaagccctcacactaatgatggtagtggtggtgagacttggctgtcctcattcttggtcactctaagccacactcactcatgccctttccattacccaaacctaatttttttttagccttttcattgcagcttcatcataagtgcatgaatgattccagttaaagctgttgtgcagtgctttgcctaaatggaagttttgaccagtaacatttctatttctgaatatgtgagagatctgcatcttaccagctttcattacagcatctctccaccctccacactcctgccatttagccacattggctttcctattgttccctgttcttttacatagtattcctaatgcccggaatgtcctttccagttggcaagttactggtcatcttttgagatgcagataaaatgtcatttctacatggaaggcttccttgatttttctccatagccagttgttcccttctcttgttttctaaagctagtgtcctgttcccagcacagtggcatacagagttggaggagtagcaggagttttttttcttaatttaaaaaagtgtacacctatttttaaactacataaatatatccattatgtgttgacattaatactaaatgataaagatgaatagtatgatcacaatgtactggtcaagactggaatgagacataccgaaggactccccgtggctgtagaatggccctaggggtgacttttttccttcttctttgcactttttagtacttacacattttggtagtcagcatgtttttaatttttaaattaatttttatattgtttgaaatgccctacaacttgatattagttcagaagtatttctcccttattttgaaataagaatctgtgctgtaagttgtgaaagagaggaacaggagaaggaaaagggagcttaaccacatttactgagcgcctggtttatgccagatcctgtgctttgtatgatttgtgctgaacacagggttgtaatgtgggtattgttatcctcgtgtgtaaatgatgaaattgtcttagaggtgataccatttgtccatggtcacacctgaggtaactgatggcccaagaatttgagtccaggtctttctgatgtgaaagctcatgttctttcctctactttaactttcctagttttagagggaggaaaatcagtaccagtctttacacaatggcgtcccagaccagcctagacctgtttttttggtgatagcgtacaaaggacagatggaaatatttctgaaaagaaactatcactggtggattataagaatctttctgtgaacaaaaatgaaaaaaaattaggggctggtgcgatagagttcagcattacaaatatctttaccctagtctatgcatttgtatagtgttttacttttgtcaaatgccaattccatagagaagctttgagtgtgggcagaaaacatcagtagcctgaagaggctaactatcaatatatgacttgtataatatttacaatttagactaaattttgtcttgctttgtatgctgactctcctgaatagaacttatttttttaaatagatataaaccagcaggtcaggcaagtaagaatggttgttttagttggtggggaattacataagggaaatcttgtgactctaggggatagaaattgtggattttttggtcctgatgaatttttacaatggcctaatcacacaggtgttggtcaatcaacacttcttgtaaatgtgatctgtcattttagctatggtttaaaaagcatatggtttaatagttacagtattttagaagcgaaccatgatatcatgataagatgtaaagaattaaaagagatactggccgggtgtggtggctcatgcctgtaatcctagcactttgggaggccgaggcgggcggatcacctgagatcgggagttcgagaccagcctgtccaacatggagaaaccctgtctctactaaaaatacaaaatcagccaggcatggtggcgcgtgcccgtaatcccagctacaagggaggctgaggcaggagaatcacttgaacctgggaggcggaggttgcggtgagccgagattgcaccattgcactccagcctgggcaacaagagtgaaactccatctcagaaaaaaaaaaaaaaaaaaaagaattacaagagataatgaaagagttccctgttggcctccaggccatttatggactcgaagtgtgaggaattagtccataaggcagacatagagatgaatcatgcatttcttccttggcaagtgtaatgtctgaatttagagctttagaggcaaagaattacattggattaagttcctaaaatacaagttctatatttcttttttttgagagggggtcttgctctgtcgcccaggctgcagtatagtggcacaatctcagctcactgcaacctctgcttcccgggttcaattgattctcctgcctcaacctcccaagtagctgggattataggtgcccaccaccacacctggctaatttttgtgttttttagtagagatgggatttcaccatgttggccagtctggtctcaaactcctgacctcaggtgatccacccacctcggccttccaaagttctgggattacaggcgtgagccaccgcatctggctgtatttcttttttttatcacattaataccaaagctgattagcttctttataccaagagggtccagtttgccatagaggaatatggactttctcttggtttgtgagaaatttggattatgtctcactgaacctcaaaaactagatcataaataagaaataatagtaacaataataattaaatgctttatgtaccttaacttatgtaccttaattcatttaataattaatgtttactatgtatacaactgttctgaaagctttatatgtattaatgattcagtgctcacagctgctctatcaggtaagtactgttatcatccccattttacagatgaagaaactaagcacagagaaatgaaatcacttgcccaagataacacagttgatgaaaggcagtcaggatccaagcccaagcaatatggtggcagaattcgtgctcttaaccactctgccagtgattctttgtgtgtgtcacaatcacctgacaggcttgttaacacacagattgctgggcccaaccacagagtttctaattccagtaggcctggagtgaggctccattattttcatttttaacaagtttcaaaatgtggctgctgctgttgctggtggtccggtaagagaaaggcttaattataagtatacattttcttttcttccctttggtgctgtttttttttttaatctcttgtgatttctctggtattttccccattttataaaaatatctttataaagaaagaaaaagtacaggtggagaaggtttaaaaaaaaggtggagttttggagttgtctcctatttcccttggccaactgaaggaagggggcagaggcaggttactggagccagaaaaactgtaggcctcactgttccaagttgcctgatattttgcttcctggggaaaagagaagtgaagggagcctaactgatgtgatggggcaggaattctaaatttgtgacactttgcaagctgtttatgtgcactaggtttgaacccagctacaattcaatgtagaagttcttggaaactggcatgtcagctgccctagacaatctgcacattaacttccactctaaaaacttttcctggcttgcctttgcagagtgtgaaagctaggtgatggcggtccagttttacaataagggccagctgtgcttatgtgtgctgatgttactgtcacaaagacttttcccttgatttgataaaaatcctgctgagccggactcagtcttcattgttgaatgaactggtgtcagggagttctcctttggctttcttaaaggtcattctttgctcacttcttttttagttcacagctacatttttttaggcttcatgtggtatgctggttatgccaaaataaagaactggatcaaagacatttcatgttcataaggctgaggaccaatctgtcttttcagatccagactcctaatagataaaggaccagggagtctctatctccataaccagctcactgctagaatcctaagttgccttctacaacagtgctgtgaacttaaccttttgaaaggtttggtttttatatccagctttttgttccataaagcttgctcccagggtctctgccagatgtactaagaaatccagctttgtccttatttcttcctcctggggaccattccattgatcatggagtggtaggggtgtggaaacagcagaagtctggttcacattctctatccattgtcaggtccagctggctggaatctcattgtacttttaaaggacagacatatcagcttctagctttttgacatgatacctcaatgcattcttcccaaatttatgtaattgtcacacagttatttaataaaatcaaagtaaagttagccaaaacatctccctccccagcatcttcccatcatcacttctgctgctttttccttttctgtatctctgcttattgagtggctaatcagaagtctctcctcaagagcttgtaattctgtgttttaaattagatattttatttggatcctacccatattcttaatctttttcattgagtcaaccttattctctctgttgaatttactatatccacaaagagcagttcttatgatggctaatttctgatttatgtttctggtgcttgtgatagtgattcagtagatgatttaatgcacaaagaaggaggtcatatgctgggaaaagaaggaagagatagaaataagttagacgccgaatatataaactggtaattgagatgtcagttttaggccaaaatctaatagatcagcaaaccaatgagttggcagtccttagagaagtagaagggaatcatttaagcccagcactgattcatgaaaaaagtaagttatgctagagtaacttcatttcccttcaaggtagaattactttggtaagagaagaccaggggactacaaaggaatgactgtaactaggtttccccaaggcataatgaaatcttgtgagcacaaaagagaaatgtgaatgtggtaatactgtcattaagaatatttggtgactggtcgggtgtggtggctcacacctgtaatcccaatactgtgggaggctgaagcaggtggattgcttgagccaaggagttcgaggccaccctgggcaacaggtttgagaccatcctgtctctaacaaaaatacaagaaattagctgggcgtagtagtgtgcacctgtagtcccagctgcttgggaagctgaggtgggaggattgcttgagcccaggaggcggaggttgcagtaaaccgagatcatactactacactctagtctgagtgacagggtctcaaaaaataaaaataaaaaaaaaaatctggggccgggcacggtggctcatgcctgtaatcccagcactttgggaggccgaggcgggcggatcacttgaggccgggagttcgagaccagcctgaccaaaatggagaaaccccgtctctactaaaaatacaaaattatccgggcatggtggcacatgcctgtaatcccagctactagggaagctgaggcaggagaatcgcttgaacctgggaggcagaggttgcagtgagccaagatcacgccattgcactccagcctgggcagcaagagtgaaactccgtctcaaaaaaaaaaaaaaaaaaaaaattggtaactaaatgtgcagctgtacccaaacaataaatcaaagtttgagaattaagtttctgggactctgtcattgactcatagttcccagtgtttatcaatgaatttattcattcatatttatttaggtgcctagtatatgctaggcacttaggtaggtagaagacacgtgaatcctgttctaagataacatgaagtaggaattccatggaataatgaatacctgggatgacaggcaggattcaccgtgatttaaacgggctagaataatgaatctaattcatggaatttaatagggaaaaacataaagcctttcacatgagttcaaaaattcaagtgtaaagaagactttaagggtttaggttgactttaaatataatagaatttaacaatagaaggacaggtgcagtggctcatgcctgtaatcccagcactttgggaggctgcggtgagtccaggagttcaagaccagcctgggcaacgtagtgagacctcatctctacaagaaataaaaaattagccaggtgtgttagcacacacctgtagtcctagctactcaggaggcggaggtggcggagggattgcttgagcctgggacttagaggttgcagtgagccacgattgtaccactgtactcggcctgagtgacagagtgagaccttgtctcaaaaaaaaaaaaaaaaaaaaaagttaatggaataagaactgccaaaagcacatattatcttgtgggaaaatgttcataacattatcagatgaaaaagcaggttataaagcatagagtatggactcattctgtttgtgcaagggaaatacacacagaggaagaatatacgtcaacatggtgacaaaatgtagcagacgtctttggttgttggatcacggatgaatttctctatgcctttttgtctctcaggttttaggcattgagaatataatacttttattcttaaaaaattgctttggttttgtttcattttgaaaaggtgaaagggtatatagccgctgctggtaatttagccttgggggaggggaggaagatttggtaatctttctcattcgtcagtgctcacatccagtgcctgaaccattgcttctctctggtaatcagcattattagtaaacccccacttccccacaggagccactctgcccagaattagagcattctgcagcgggattggcgtggagcagcaggcttccaccataggaaagtcccctccagcaggggccaccgtgcagccgctctctctggcgggtgagactggcaaatggactttactctcctgctcacacatctgagtgattctggcgtcttttttttggatccaatagtttggctgccctcatttatcacccaggtgatctcacatagacacaaaacttggtgtaaaggcattgtaaatactgctttgaagtagtatacttcttctttctcagaagcagtgcttgttgtttagtacccttattggttaccccgtgccccgaaagcttgggttcactttccatgggaagaatgttaataatagctaatgtttactgaacatttattatgcatgccatgtgctaaacgctgtacatagattatcacatgtaatttttagaccaaccctatgagagatgggattaatttttattctcatttcacagctgaggaaaccaaggcacagagaggttaaacatgttgcttctagtggtagagctaggatctgaaccttgcaggcttgcgctcgatctcagccttagtcactgcattgctgcctccccttctgcaggtggtcctgtgcagacccgtggtgtggacccagagtgcaaggcctcctgaattctcactatctcagtgcttgcattgggtttgattccttcccagcacccaaaaccttttatttctttttgtcttctttcttggattatttctttaatcctttcccaggagactttcatcctctcaagtaaacaaattatttagaagtttttaagtcctttcaccctgttctcaagcaaggagaccagcttgcacttacaatttcgtgtagttatgtgcttttgacctagcatcaaaagttcacatagtttttccagattatttctgagcttttcatgatctctaacaccatccctattatactttaactcttcccatagaagaaccatttctgtataactccataggttcaaaacaggaaaagcagaagagagtatactcttatctcaaggtgtaaactcaaaggttaaaaaaaaattaatttctttagtattataatttttagagatcacttaaaaatcttgttctaacacataaattctctaagaatcaaagcacttgtcaccatgagtgtgaactcttggcaggtccgtctaactcacttaaataatgttaagcacagatttcatttggctagctatcagtgttcccagtcagcagttactgacagttattaacagttatagttaatttataatttaccttttacattaagatttcttagtagactgtttcagtatgtattaagtttatatctaagtgcaattcagcttttcttttttactaatgagagtagttatcaatcattcattgaacgcatttcataaacagatttattctttacagagcctccactgtgcaatttcagtgctaaatttaactattatgacccttgactctcttctaactacatttgacttttattatcaatatatcatcaagcttactttcagagccaaccattctttctgcccttcatccacaggactcatttacaccaagattgtcactgtctttgcatttctcacttcttcagaccttcatgccagtttactgggtcattcggactaacatgattttcatcactaatgttaacatataagctagctccccttgattctgcctaacatctcctgggctttaaacccctgtgttaataccacctattccagagtcctgctattcctgacattttttcacctcctcattcttcctgtggactcgcctgacaagtcactgctctaggtcatgagcttttaaaaagcaggaactatgtgtttttcttcttggtagtccgtaagcacctaggaacagtgtccaataaatgtggattgaattgcactgaaatgaaataactgcttaggcatgtatctttacatatgatcccagtattgcaaagtacaagagagaaaaagttattttatagctaaaatcaggaaattataaaaacaggaaataataacaagagttttaatgaaagataagtgaaaatgctgtaactttttgtttgcatgtttgtctgtttaaaattgaggtataattatgtaaactaaaaaatcatctattttggctggacgcagtggcttacgcctgtaatcccagcactttgggaggccgaggcgggcagatcacttgagatcaggagttcgagaccagcctgaccaacacagtgaaaccccatctctactaaaaatacaaaaattagctgggcgtggtggcacacacttgcaatcccatctgctcaagaggctgaggcatgagaactgcttgaacccagaggcagaggttgcagtgagcggagaccatgccactgccctccagtcagggtggcagagcaagactccgtctcaaaaaaaaaagagagagaaaatatatatatattttactgttcaatttgatgagtttcagcaattttatatatctttgttaaccaccatgcaacacaacatacagaacatttccatcacacttcaaaattcccttgcgtctttttccagtcgatactgcccctccccactagtaatcattcttctgactcctctcactgtagatttgctgtgcctgttcatgaatggaatcatacaatatttgttcttttgtgtttggcttctttcattcaatacagtgtttttgagattcatctgttttgttgcttatattagcagttcattcgtttttattgagcaatacttcattgtatgaatacaccacaatttatttctgtaatgataggcattaggattggttccagtttttgactactatgaatacaaattcagtgaaaattcttatgcaacttttttttagccacatttttatttcttttgggtcaatacctagaagtagaattgtcctgtcgtgtaaatatatgtttaactttataagaaactgaccagtagttttctgaaacgattgcatcattttacacccccgtcagcaatgtatgaaagttctagttgctcttcatgctcactaacatctgatattgttctccatttgattttagtcatgttagtagatgtaagatgttagttgcatttccctgatgagtactgatgttgagaacttttcatttgcttgttagccagtcacatattttcttttgtaaattgactgttccaatcttttacatgttcttaaatctcattatttttgttattcatatcaacagttaccaatagggcatttttatattttatcactagaaatcctttgtcacatatacatacctatattgcagatatttttcctcaaaggcatgtcttgcttattcattttcttttccttagtgatgtcttttgatgagcagaaatgtcttgatcatggtagttttatagtagtcttgaaatcaggtgatgtaagttatctttttcaagattgttttgactaatatagattctttgatttttccctaatgtggcaatcaacctttcctgccaccagaggtatgctagaagaaaaaaaaaaaaaaaagaaataagaaaaaaaaaatcaacatgtcagtttcttcaacaacaaaaacaaagcctgctggaatttttattgtgatcgctttgaatctgtagattgattagggggtagtttccagttctggctaagtctttatctgatcaacctacttgataaaatataaaatacaactatttaaaggcactggagggtgaacaaaagctgattgatactggagatgaatcaacatttgaaagaagggaattgccacgggtgagttttctgggtttttgtttgtttgtttgttttctgttgttgccttttcacttaagggcaagtcatagtttgcaccacatggagcagataaaacttgccccaaaatctgcagtctaactggcttggtgaactggaagatggagttcaggataaccacatctgctgtagagggagaggggaactctggaaatgagacatctccagaagaggggagcctaaattctatgtagaaagttttcccaaatctctgactgacccctgactaatgcatatgcaagacatacttcaaagcatgcaggtaacacaaaaagaactgatctgagctgcagcccacggaggagaagaaagaattgcaatttgagtttctccaggttaaccatctacttaaaacacatacacacacattctttagagcgacataatacaatccagtctctacaacatatcattcacaatatccaggatacaatatgaaattatttaatgtaggaagaaataggaaaatatgacctatcctcagaataaaagataatcaatgaagaccaatccttagaaggcccagatgatagaattaacagacaaggattttaaagtgactcttataactgtgcacaaggatgtaaaggaaaatatgctttaatgaatgaaaaatacaaaatattgaccaggtgcagtggctcatgcctgtaatcccagcactttgggaggccgaggcgggctgatcacctgaggtcgggagttcaagaccagcctggccaacatggcaaaatcccatctctactaaacatacaaaaattagccgagtgtggtggcacatacctgtaatcccagctacttgggaggctgaggcaggagaattgcttaaacccaggaggcggaagttgcagtaagacaagatcatgccactgtgctccagcctctgaggtacaagagtgacactccatctcaataataatataataataaagacagatttccaaatggaaattgtgaaactgagaaaaacaatatctgaaatacagaatagacattctaacaatattgagtctcccagtgagtcaacatggtatatctttgtacttatgtaggttttgtttaatatctttcattagtgttttataaattcagtgtagtgaccttatgtattttctattagatttattcttaggtatttgatgtattctcatgatattataagttgtattgctttttttttttttttttttgagacagagtctctctctgttgcccaggctggagtgcagtggcacgatctcagcttactgcaacctctgcctcccgggttcaagtgattctcctgcctcagaatccccagtagctgggactacaggcacccgccaccactcctggctaatttttgtatttttagtagagacatggtttcaacatattggccaggctggtctcaaactcctaactttgtgatctgcccacctccgcctcccaagtgctgggattacaggcgtgagtcaccacacccagccgagttgtattgctttttaaaatttcattttccaattgtgtatttctagaatataaaaatatgatttcattttgtttatggaccatgattactgcaactttgctacatttatttattagttctagcagtatctctctaaagtttataaggttttctatgtaaacaatcatctgtcaatgaataatatctttttttcttgtcttaaactggctaggtcatcctttactgctgttgaatagaaatgttttctagtttactaagagtgtctgtcaggaaatgggtattgaattttgtcaaatgcatttcatgtctaacggtattaatatatgacttttcttcattctcttaatgtggtgaattatatgatagattttttttctaatgttacccttgcattcctatggtaaatgccacttggccatgatatattatcctagtgtatttgattggttggttgattagatagatagatagatagatagatagatagatagattttattagctaatattgtgttaaagtttttttatgtatctgtgttcatcaggcatattggtctgaaaagaccaaaagaaagtaatttttttttgtactatctttgtcagatttctgtattagagatatgctaacctcatgagttgggaagttttttttttctctgctcttttttggaagagtttgtgaaaggatggaattatttcttcttgtttgatagaattcttttttttttttttggtggggagggggagacaagagtctcactctgtcgcccaggctggagtacagtggcacaatctccgctcactgcaacctccgcctcccaggttcaagcgattctcctgcctcagcctcctgagtaactggaattacaggcaccagccaccactcctggctattttaatatttttagtagagatggggtttcaacatgttggccagactggtctcgaactcctgaacttaagcgatccgcccacctcgacctcccaaagtgctaggattacaggagtgagccaccacgcctggcatagaattcattttgtaatcatccgggcttagaattttccttctatgtaagaaaatattaaggtttttaaaaaggtttgattacaaattaaatttttaaaatacgtattgcagcaggtctgtgattctcaaagtgctattattggacctgggggctgcggagaggttgggaggaggggggatcctcaggaccctttgaggaagccaatagaatcaaacattttcatagtggtactgagacatttctacttttttcactgtgttgacatttgcaccgatggtacaaaaacgatggtgggttttgtaaaactgctcgtgccttagcacagatccaggcaatggcaccaaactgtagtagaagtcactgtattcttgaccaccatagcattttcacttgaaagaaatgccagtgctacttaagagtatccttcataagcagtaatattttcttaaactcaaccctggagtgtatatctttttaatattctgtctgacaaaatgagatgtacacataaagcaattcggctgcttagtatgtaatagttgtctcaaggaaaggcatttgtgaccctgaacttgaaagagcatctatctgatagacaaactagggttatttggatttggatatttggcagttgtttcctcaaaagtaaacagtgagcctatcacttcaaagaatacaactgacagtatttgttgtcaatgataaaattacagcttttcaggaaaagtttgacttttggaaaacgtgtatccaccactgtgagtttgacatcttcctaatacttgaagatttaaatatctgtacatttcacaaagtgccattgaagtgaatagactttcttgtaaagaaataatttctccccagaaagcacctccttcatggccttatagtgtttctcatcagaagcaccactggcattttaagcagcacacattttcttaatacaagactattcctttcatttctggatatttaacaccctgacctccgccaattaaatgtcagtgacacctccacccccatcattgtgacaattgaaagcacactcacagttgcaagcacgatcaaaaagagcaggggcatccttgtacatggtagcttgtgtttggctggacttgggtggaggaggctgggaagatggaccgtggaatcaccctctatacaagtgtcacagtcctctgcatatctttatggagagtgcaacttccattgagattttgctttacatttttcagattccctccaagttccctaaaaccagtatccatttgatggaacagatattaaaccagaggaaaagtatagctcttcaatgtttattggctggaggttgcaggtatgctgcaggaagggcagttgtagagaaaaacatttcatcctgcagtgccacagtacaatatagaaagtaagataaagttctaaatggataggctattaagagaatgtagtatttagaaaaatttgcaatattgttgcctatttgctacatatgtaaaggggaaatacagcctaattcactttgaatcagatgttaagcacagaaccttcccacagctaattctcttggctctgtgtactctgttgtagaagtaaagtaaatcaattagaagatatttacggggcctgtgtacaatattatgttttagcattgagcaaggaaaaacactaaattttggagagaatgattgaacctcaaaatttttggtaggagtagaaaaaacattattagaaaaatagaattcgttgaggttcaagaatgggatggaattttgcattgaaatagaaagtatgagatgcctagaaaggaatatttagatatataaacttgggcaccagaaatcaaggaaaggccaagttatggtacacctggcctccgctgtgtcaatcattatagcattagcatactgcaaaccccaaggcttgtgctttaagtgtgagaaaccatgggctgagtgacacccactgtaactcaaagcaagcaagtttctcgtggcacttattacattacacagctgagcatttctgcccccacccagtgttgcagtgtaaaaatgcctgcctctttgctaaaagcctctacttgcttgagaaacttccttttgtgatttgtagactgggcttatgttactgaggagattaaaaacagatttcattataaaagtttatgatgttccagtccgttcaatatgtgtgcagttggaggaacacatcctttcttatccataattccttatttgatcttctcttgcccactgtcctaccctttatatatccacagacccccacctcatattcacacacctgcaaacctgtccatgatcatccccacataaaggggcctggtttggtttcagactttgatttctgatacacaagaaggcattaaagtgaatgtctcctggggatatttgttattaaaacagcttttagcaaatgaaccaatctagccagtgagatgaattctgatgtaagcttcatagttatataaatactgtaaaatctaatcactgagtctagattgctttctgtagctagcaacttctgtaaccagcaaagcaggaacgaaagcagaaccactgttgatgggctttctgaactttagtccagttgtaactaatagtttaattctggattcaaagcagcacctgccctaattggtgtggaaatctcaaggttagccagctaaagcagtttcttctttttcacctgtttctttcctttgtattcatttgttcactggatcagcccactcctgccttgaacctagatacctttcttggtggctccccctttcgttcacagctcactccgttcctttagctgagccagtagctgttgagtagttttgggtgttttatcttcagtaagcttttctcttccctcactaatgagaaaagagataataggttcctcaggctcctcctttcctaacgatgtcatcctgttttactgtcactcagcaccctgctttgtgaataatgttaacatttcactaatgtattgaagtatttatttatatttgatcagtgctcaccatgtttctccatacgtctagaagtctcttgggaaagatcatgcccttttaactgtctgataacatgcacactgaggcacttcaagaaggatcactgaagatcaaatgtcgcactcagaaaacttaatagataagctctgagctttttggtgtgttctccaagaagattaggagatggtatacaattgagcaactgaactgtgggagccaaactgtgggaggagatgagtaagggatgtgacatatcagaggtgagattatgggatagaaagccgaaagaatacagttcacggacttacccttaacgagagatttggaaatctctctaagagagttgggaaaccaaagcagaggcccgaaaagaccaggttgtgagggagggcacaggcaacagaggagcatggacttctgagcttggcaaacatttcactttgctccctccttcagtgctctgttgagtcatcaggacccaggctataaataaccctatgtggcttttaggtgaggactctggaaggtctgtgtagcctcacttcagggttcctacacctctgtcattgaaatgactttaatgacaaaggaaagaataacactgatttaaatcactatgaatacttttctcaatttaggcaccctttcatttttctaagcccccttaaccagggtttggagcaaggttgttcattatgaaagtcttatgtttcttctatgtacaattttcctgtcactgtacctaaaaaggaaaagaaatacagtgtaattaaagatggtcccaagaagaataaccaaaagtgttaaggagatggaaggactgacaagactgttctcaaaagaaatgagacctttagaaaatcatactaaaatatatttagcataaaatttaccattttaaccattttaaagtgtacaattcagtggtatttagtacatttatactgttttgcaactattagccaccatctgtctccagaactttgtcattatgccaaactgaagctctgtactcactgaaaaatgacttcctattccctaattccatagcccttgataatcaccattctactttctgtctctaaaatttgcctattccaggtacctcacataagtggcatcatataatatttgttctttcgtgactgacttatttcacttagcataatgtcttcaaggttctgtacatgtgctgcagcatatgtcagaatttcctttctctttaagcctgagtaatattgtatgtagattcatctgttgatggacatttgggttgttttcaccttttgcctattttgtacaatgctgctatgaacattggtgtacggttattagttttgatttcaattcttttctgtatatatctacaagaaaaattgctggatcatttggttattttgtgtttcactttttgaggaacccctaaagtgttttccagagtaactgtaccattttactttcccaccagcattgcacaagggttccagtttttccacatcctcagcgacccttgttatcgtcaggtattttgttttaataatagccaaatgggaatgaagtagtataaatggggtcttttctactgggaaaagtgatctgagaggggaaatgtaggaggctatagttgtaaagacttctgctaggaagtacacagacatggtcaccagaatctagaatttggagctgggtgcagtggctcacgcctgcaatccaagcactttgggaggctgaggtgggcagatcgcttgagcccaggagtttgagaccagtcagggcaacatggttaaacccccgtctctacaaaaaaaatatataaaaattagccaggcatgatggcacacacctagaatcccagcttctcaggaggctgaggtgggaggatcacctgagcatggggaggttgaggctacggtgagctgtgattgcaccactgcactccattctgggctacagattgagaccctgtctctaaataaataaataatttgggcaaggaagatagtcaaagtatttaacaaatactataacatagcataggtactgactactcaaaaaggccaccggcccttcgccttcctcaggtgtacagattgtcagcctcagtggggaccctgtgaggtaaatttggaataatgaaaaaaagtgtcttcccacaccatttatgttacccagtcatagggacataagctcaaatataaacaacttctaaaaaatatttagatatttaactgatgggtggttgagagaaaacaaattctgtgtgatgaacccttttccttttgaagttgatgttagagaaaatgatcatgcatctgttcctgccttaagttagccccccatcctgcattggaagctctctggactcttcttgtaggtcttctggcaatcacaggggaatgaaattgctatttcagttgttttacatccagctaatatttattgtacattgactgtgtgccaggccttatgatacgtgctaggaaaagaagagagtgcaaaacagaccctgtccttgtcatcatggagctacggtttagtgggggagtgagataatatcacacaagtagatttgtaattccaaactgtgcttggttccatattggaaaaatacctgagatatttctctcctttcctctagattgttcatacagccactcactctaagaaacctgcttgcttttctcttcaggagcctgcagacagggggatttgcctgggaaggagaagtagaaaacaacgtgtacagccaggctacaggggtggtcccccagcacaagtatcaccccacagcaggcagctatcagcttcaatttgccctgcagcaacttgaacaacaaaaacttcagtcccggcagctcctggaccagagtcgagcccggcaccaggtaattcaagataagtcttttccatgtgttatatcttcctgctgttggtaaaaaaaaaaaaaaaaaaaaaaaggtcagtgaatgagaaatgtaggattagttttccaaccccgtgccatcctggcttggacagctcatggggagtctactcttgaggaaaaactgttctggagccataacactggctttgcttgaaagtgatgcttaaccagtgtttgacatgtttttttttcatttgaatgcttctatacaaaaatctctattgtggtgtttaccctttctgttgtatgatcttagtttataacctcccatagggtctgattctaagatacctgaaagcttgtattttaagcatctttatttctaaatgttctactttcttgccttgatatacttggcatatgtgcgtgatattactcattatctaacaagattttcaaggaataaataagttgcaagttcttctggtgggaaatggacatatgttagcatgcaggtcatctataaatgatagctattcattcaacaaatgtttactgtgattctactgtgtactaggcactgttttaaacagtggggctataaggtgactgtacacacaaaaatccttgctgttgtgcaacttatgtgtagggagatgttgattcgctactcactgtctataaaatgccagaaactactgagtgagggagctatataagtatatagcactaatatattagtatggccccaattgtagagaaaggatgacctcaccgaaaattcaggagttaaatttttcttggtgactcaggatcatcattagaatagttactgtgttctacagtggggttattggaatgaattagtactgattctataagcttttctgacatttggttatgtgaagaaataactttttatcagtttgatctcctgatcatttttttcttataaaaatgtagtacatagtgtgtatgagtttgtgcaaaattatttactcaaagactaaagcaacatttcccaaaggttttttcctctaagtaaaacaattattattatagtctgtcttatcttttcaactaccacccataataaaatgtcattttattatttcaacatagttcatcaattgatcatctttacctgcggtagtatactctgtacattatattaattcatcataattgagaaattgtaagtgccggcatttgcaaagtagttctttagaccatttttactggagaaaaataaaatctcttaatctggaaagcatagaatatagcatctcattgtaatcacatcactttctgtcatgtaaaattttcttcatttagaaaatcttgaggtcttgaggatagtagacacatttaagccagtttgcattttcacaattccagatacaaatgtgtgtcttagttgttgttttttttttttaatctgtgttcttaaatttcttaaagctttttaaactttaaactccctgtcattcagagtacttgagaatgccaacttaatcagatactggatagtggaagtatcactgtatagcctgaagatcaaaaaactacttctcaggtccttggctcattacctgggccacagaataatgtgtgcaccaaacccccgcaacacgccatttaccttcataacaaacctgagcatgcacccctgagcctaaaatacaagtcagaaaaaaaaactctctggctctaatgaatctagacagttggtaccttttaaactatgcttcaataccttgaaatggaggatgactggggaaggagaggcagttttgttgattttcacttttagaaactgcttcatttttaagtccttctcatagttttgattagcttccagcaactcacattcctttgaaaattcaaagtactgtactactattcttgtgtggaatttcttttcactgaggattatactggtttagtttcactgaattatgaagtatatggaaattatgttttttagaatctgtcagaatatctgttttagcgaggaggcagaactcccaagaagggagttatctcgttctcctggagagcaaacagaaaatcattcatcataattgtatatatgtgtgtaacattatttcttctccccaacaccccgaacccgttcttctaaaccacagctgatttaggtaaaaatgagtaagggtgaagtttctgggactgtaggagagagctaaagtaactaaattccattagcttcaagagtttataactaataagataacaaataagatattaaatattctaacaggaagaatatgtagaaacttagagcactttattttagagggtacttagaatcattccacagtggaagcaaagccctagtagattttatacctttgtagcttagctgtgctagatctgaccattataattatcactaaattgttgattgaagcatggtttacattctcagtattctgtatttctgtcctggggttaccctttagatagcaatggtacttttccaatgaactccttgcacttggattcatttctctaaagtgtagggagccattggtataactcacagtgtggttaactgcctgtttgaaagcagtagatagaattgaaatctgatttacctagcattcatccataaaagaggcctgtttatggaatgcgatgttaaaggaggccttatatttatcttatatcatattatgtttatgaacagcatctttcacatagtaatctcctaataatgtctggggaaagttcatgcagcctttctctcattgtgtacataggaagttctccattcttttcggcctccagtcagaacacttagatatccaacttattgaaggtgttaatttctgcttaaactctgattcaggatatgagtttggaaatggacatctctcagtattcatggggaatgagctttgatcttcatctcagtatagcattgcactcataaatgtagcaattgtcatatacttaatccactcctgcaaaagactgatcctgtgacatgggagtgagagaggaaagtcacccagagccagtggcggaagttttcaggaacagagatacaagaaacttggcgtgatccagtccatatgatagagagcataataaacaaaataagacaaaattgaaacaatgagcttttacacactgatggtaaaaacagcagtttgaaaaacattgttttaagtcagagcagaggtcagcaaactttttctgtaaatagccagatagtaaatattttaggctttgcaggccatagcatctctgttgcaactactcagctctgccatggtagagtgaaaacagccataaacaatatgtaaatgaatgagtgtggcggtctttcaacaaaactttatgtacaaaaacaggcaatgggctggatttggcctataggtcctagtgtgcagacccatagactagagtaacagaaccatttgaagggcttgttaaaacaattgttcctccatcccatttctgattcattaggtttggaataacctaatgaataggcagaatcctccctttttgttttaataataatagccaccacttaagcacttgctgtgttccaagcactattcagggttctctatacacattaactcatttaaaaatgaatttcagggccgggcgtggtggcttatgcctgtaatcccagcactttgggaggccaaggcaggtggatcacaaggtcaggagttcgagaccagcctgaccaatatggtgaaaccccgtctctactaaaaatacaaaaattagccgggcgtggtggcgcatgcctataatcccagctactcaggaggctgaggtaggagaatcacttgaacccgggaggcggaggttgcagtgagccaagatcatgcccctccactgcagcctgagtgacagattgagactgtctccaaaaaaaaaaaaaaagcaaaaaaaaaatttcaggatggttgtgggaagtactgaatctcaagagttaggaatgatcaaacaaatctgttatatattgatacagcccaatgcatgtcttctaattctgtctttcttctcctgctgtcttcctgcccctgaaggagaaggcaaaagaaaacttttctttcagctgagtcggggactttcttgggtaacagtgactactggtgacatcagcatgagtagctctccatgctggggtctgtgaggagggctgcaccggctgtgaggcctgactgacctgattctaattgcagacattgagctgatgttattcttggcgcaggacagagcgattactcagtagtttctgttaaagtgatcctttgttaaacttctgctcccaacccactccctgcttccttccctcccactctcttctctgcctcatccacagtgaaaaagagccccaaaagcagaaaaattaaggacatattgatggccaacacagaattgccgaagtttcctttaacaatcatgggagaaaggagagattttaaatacatcttaattcttcactggttccggtctctttcgaaaccccttcaatttttagtagacttaattttcaacattagtaaataactcaaggtaggagaaaactgtgcgtcctaaatttctctcatccttctgccccatctgttctttacttttcccttcccaccatgtccaagtttaccaaactaatctggattcaataatcctagcagaaactaatgttcctataacaggcaggactggcagcagctcattgttcacatcaagaggtctttcagtttgctggtaacatcttgagtgcagtgtgtaacaagctttttgctaatgctgtgtgtgtatatacacaatcccacaggtgtggaaaggattcccatataaaccgaaccatgtcttgttattttgctcctaaaagttcattgcacgtgtctaaaaaaattctgcctcctcctgcaggaatgaattctgtttcgccaagccttcagctgctgtgtgtttgtgttgtggaggaggggaggggaaagaaagagaaattcagcaggcaccctgtctttttccaagcagctggcaataacatgctagctcctcagcgtggcacaaagagcaggcaaacagtctagccatgcaggaggtgtcttgatacatctttataatggcgtatcagagaggaaggttggactggggacatgagaggggaggagtgtgtgtgtgtgtgtgtgtgtgtgtgtgtgtgtgtgtgtgtgtgtgtgtttaagttccagagcatattgactccggaacttaatgtcataacctattgcttcgttgtttttttgtttggttggttcttttgttctattttattttcccacttgacttttagcaggaactcatacttagtgtctagcttttagttattattgattttcctaggaccacttgatttagtagattttgccaagccaaacttttattcttatttaatgaaaatacatagaaaatacatgaaataatactgcattcggttgttttggaaataggccactctagacaggctttggagtcagataacccacagcttaagtcttggccctgtctagtccgtgacttaagacaggttattcaaacttttaaaacctcattttccttatctctaatttgaagatgatgatatatacctgtgtattatcatgattgtagttctcaggatgtgatattgatattaccatatgtcaagcaccaaagtggccatttttttgtattatctcagtggatctttacagctgccctcttattagcctcatttcacagatgaaaaagcatagtatcagttagataactttctctgtgtcacataagtaataaatggtagaactgggatttgaacccaggtctgtcagcctgcagcatccaagctcatggctattatgctatatgctgcctcctgctgctaataaggcattcaataaacagcaactgtaagtactattacataaattctaacttgcaatgtatacattcaacaagtattttttttttttttttgcgatggagtctcactctgttgaccagtctggagtacagtggcgcaatctcagctcactgcaacgtctgcctcccgggttcaagcgattcccctgcctcagcctcctgagtagctgggactacaggcgcacaccaccacgccaggctaatttttgtatttttagtagagatggggttttcaccatagtggtgaggacggtcttgaactcctgaccttgtgatccacccaccttcgcctccaaaagtgctgggattacaggcgtgagccaccatacccagccaacaagtacttactgactccgatgaaactatgtttgaaaagttattatcaggtctcttcaccagtctcctactattcataagcaccatctcaaaagaaaagttttcctgcacttaggcctagacgtcatcccaattacctcaatcttttttttttttttttcctttttctggagaacggggtctcgctatattgcccaggcaggtcttgaactcctgggctcaagctatcctcccacctcttgcctccctgagagctgagattacaggcgtgagccaccacgcccggcctctcctcaattcttaatgaaagaaatatcttaataaggtgttcttgggcgtaacaatcttggaaatgcccatcctttaccctcccttgtacttttattaagtaatgggtttagcacctaacaacacatgcagtatcctgacgtttgttctagaggtttggatagtaggagcacttgtatgggttgttactaattcctgtgttattaataatacaggaatgatttctgtaattattattttgtcctttcaacactgttactggtaatgctattttaattttatttctatgataggtgtttttcagaagactcccaggaaacctgacaggtgtctacaaatgtgactaccacagatgacatgtttgcttaattcatattatgcttgctttggttttttttttttttttgagacggagtcttgctctgtcgcccagctggagtgcagtggctcgatctcggctcactgcaagctccgcctcccaggttcacaccattctcctgcctcagcctcccaagtagctgggactacaggcgcccgccaccacgcccagctaattttttgtatttttagtagagacagggtttcactgtgttagccaggatggtcttgatctcctgaccttgtgatctgcccaccctcggcctcccaaagtgctgggattacaggcgtgagccaccacgcccggcctatgcttgctttttcaatatcatataagtctgatcttagtgtattattacaatacagactttctttcattgtgttaacttattactgatagtagcataagtaccctggttatcatcatgttgctttctaagctgctcctaggggaatattcttctggaatcttagaggaaaatgaacacgcagtaaatgcttcctgtgcaccagatgtagtcttatctccattccactgatgaggaaatcaatgttcaaagagtttgggtaacttagccaagatcacacagctgcctgattgtggagataatatttttaccaggtcagaggacttccaaagcccctttccactctaccgtcctcccccacgacagaattgactcttcgttttctttttagtttacatacttatcagtcagataaggcattccagcattattgctgctgcactgctatatactctcgtatacacaaatctttaaaaaaaaaaaaaaagggtcagtgtaaccaattaagattcagaactcagcttggttgctgcagctgtctggtgaccagttttattctcttccctcactccgtggcctgtggtttgtttgtttgtctgtaggtatatgagggactcccagcagtaactttgtgtgagatgatgaaagacttcaatccatccatctgagatggtggcagccaggggaaaaatacttaatgaatatgtgacagtaaggtctgtataagatatgcacagtaaaccaaccatgtgagatcctgggccaaacaaaacaaattatacatttgaagacagagacaagttagatgtttataacctcaaagttgtaaaggaaacttagagattgcctttgactaattatttcattttagtaatcaggacacataagatacagacacgttaggagaacggggccctgatatacaaataatttcttataagtactaacaaataaaagttaaaacacacaattgaaaatgaagcagacctatctttatttagccagttgagctttctatctggggtcatggctgatcctttgatgttatctgtatacatactcacactttcactttaacaataagtaacaaacatttgcttacagacaataattttttttcaaactttcctttccttctcaagaaagagaatgatcttggagcaaggtgaatgaaatttgtctttatatacatctggtggaaactggacacatttctacgtttgctttagaaaagagatatgatttaaataaatttgctttagatatgtttgctttaaaagggaatcagcataacataaataagaaaggcagcatagtatagtgaggttcttaaatcatactccatgggtttgaatcccagcttactactcagtacctctgcaattatgaacaaatttcctaacattttttgtgccttggtttcttctgtaaatggtgatgatgaggagacacaggtcatatggttgggagggataaatgagataacataaagcacttaaagcaatgcctgacccatgataaaaggtcaataaaaggccgggtgtggtggctcacacccataatcccagcactatgggaggctgagatggatgaatcacctgagattgggagttcgagaccagcctgaccaccgtggagaaaccccatctctactaaaaatacaaaaaattagctgtgcgtggttgcgcatgcctgtaatcccagctactcaggaggctgaggtaggagaatcacttgaacccaggaggcggaggttgcagtgagccaagatcgtggccattgcactccagcctgggcaacaagggtgaaactccatctcaaaaaaaaaaaaaaagtcaaaagttagttgctcttataattgtgtatcaccttttttttatcatttaggtagaaaacatgtaaatgtatcctcttaacaatttttatgtatacagcacagtattgttaactatatgcatactgtaccacagatctccagaactttttttttttttttttgagacggagtctcgctctgtcccccaggctggagtgcagtggctcaatctcggctcattgcaagctccgcctcccgggttcacgccattctcctgcctcagcctcccaagtagctgggactacaggtgcccaccaccacgcccagctaatttttttgtatttttaatagagacggggtttcaccgtgttagccaggatggtctcgatcttctgacctcgtgatccgcctgccttggcctcccaaagtgctgggattacaggtgtgagccaccacgcccggccctccagaacttttttatattgcatgactgaaaccgtactcattgaacaactccctgttttcctctttcccatccagcctctgacaatcaccattctactttctgtgagtttcattacctcatgttgagtgaaatgattttgtcattagattcttttacttagcataatgtcttcaagattcatccacgttgtagcgtatgacaggattcccttcttttttaaggctgaataacatttcattgtgtgtgtatacacatatacataccatgttttctctttttttagttttttttttttagtttttttgggtactacataccacattttctttttccattcattcattgatggacatttaggttccttttacatcttggctattgtgaataatacatcaatgaacacggatgtacaaatatctcttatgtataatttttaaccgtaaatatacatggcattatgatgtcaacttgggggttttacttaaaccttccgggccagaaacagaaattgattaaaatgatattaaagaaagtgtcttaggagaagcccaaggctcattaagtattaattagcacatttttaaaactaatagttacttacttgaacaattaaatatggtatgcaaattaatttgttcataattattagagctatgagaagaataaaaagcatgattaataccatgattaaatggttattctttatttatttatttatttatttatttatttttgagacagagtttcactctattgcccaggctggggtgcagtggctcgatctgggctcactgcaacctccacctcccaggttcacaccgttctcctgcctcagcctcctgagtagctgagactataggcatgcgtcaccatgcccagctaattttttgtattatttagtagaggcggggtttcaacatgttagccaggatggtctcgatttcctgactttgtgatccacccgcctcggcctcccaaagtgctgggattacaagtgtgagccaccgcacctggcctaaatggttattctttagaataatatctgtgtagattattgacatgtttgtccaaaggcataaatatcttacaaacataaaaaggacaagaaacagcattagcatcaattgtgagctagcttttcatcgggtgcaagctgctttctcaaagtaatcaaaggaatgataagtaaatttaatcctttcagacatactgatgaaatacaaattggtacaacctttcctgagagcaatttgggaatatatgttaaaaagttttgaagcagaagaataaagagatttctgatctggctattctactttgaggaaattattttaaggaaatgatccagcatatgtgaaaaggtatagataacatgatgtttatcacaacactattcttaaaaagcaaagtaaactggtaacaacctgaatgtgtgtgtgtatatatgcgtgtgtgtgtgtgcgtgcacatgtacatatggtatttcaaaatggaactataagattttgggggtgcttttctgtttgtgacacagagaaaaaaaaagacactgggggccttttttttttttttttttgagacggagtctcactctgtcacccaggctggagtgcagtggcgtgatcttggctcactgaaagctccgcctcccgggttcacaccattctcctgcctcatcctcccaagtaactgagactacaggtgcccaccacaacgcctggctaattttttgtatttttagtagagatggggtttcaccgttttagccaggatggtctcgatctcctgacctcctgatccgcctgcctcagcctcccaaagtgctgggattacaggcgtgagccactgcgcgcggcctatattttttaactcaaaaatctattgtgggctgggcgtagtggctcacgcctgtaatcccagcattttgggaggctgaggcagacagatcacgaggtcaggagttcgacaccatcctggccaacacggtgaaaccccatctctactaaaaaaaaaaaatacaaaaattagctgcgtgtggtggcacgtgcctgtaatcccacctacttgggaggctgaggcaggagaattgcttggagtcggaggttgcagtgagccgagatcgtgccactgcactccagcctggcaacagagtgagactccatctcaaaaaaaaaaaagaaaaaaatatattgtgaacatatttacatatttccatagcttcaaatatagatgtatctcagtgtgtcaatttatagcattgatgattggtgaagtataataaaccatagtagaaaaaatgccattaaaaacagcagtctaggtctacgtttatagatagggaaaaatgctcagaataggtatttgaatgaaataaaaacaggctccaaaacatcaggtgtcatgtgattccgtgttttgtcagcacacagaaatacatgcatacatacatatagaaaataagtttgtatatgcatagaaaaacatctaaatgttaacaggttatctctgagagcagaattataaatcattttgaatgaacatttattaaagaaatttgtttcaaaaagaaaaacatcagtctgccaacctttttatgtatgtgtgtgtgatcaaacagtgctgggcattgaaggagatatgaaagaaatgtaaagcaaagcagagtctatggtcatctgagtctgaatttgcatcagaacgtcaaccagtgtctgattggttttgtggctagatgaaggtgtggctgctaataagggaaggtcacccatgtgatgtcttagggcaaggtggtttcactggcttttgtggtcatgaactgcagccctagtcttagccagctgtgtcatagctacactgtgctggtcaggtcacacactagtccaagctcagttttgagtatatgtgaatatctagttgtaattatcttcattgcttcttaaatgttggcaagtacagttaatttagggactctctgaagaatcacactgatctcaattggttagtgaacaatagtttcgaaatttttctgtccaggtaagcatctgtctttgtatcctttagagtaggtcatttgaggtagtaagaacctcctttcctactcactgaaggagggggagcttcgtaattggttttagaaatgagaggatatgttggaaggcttccgacacctttgacagctccatatcctgtctcaggtatttgtgtgcttggtctctctatatgaagaggagcaacttctggattgctgtcccattcctattggagtcgtagtactgcccagtgctttatagcagcaccagaaaagttgtactgtttctcttgctcagcacccagtcttgtcccagccgacaaacactgtgaatggaagacagccaagaactccatacagtgtgagacaaaggccttttggaagcttacttttgccaaaatagaaacagttactctcactctcaccttggctgcaaggtttttacagcatcacagggttgcataaaagtctggatgtgttctttgctctgaacagtcttggcctgattctaggaaggtgagtgattagtaacttacatgctcaagaaaatgtaccttctcaatagtttagcttccagagggaaacggacaagaaatgtctttgcatatgtcatgggaattttatccaaattgggacacaatctaatgtggggagaatactgcatagaaatgtttgcttgtcttaaattagagtacaagggtcacaaagagacattaacctactcaaatagagagtagcgtttgcctactttatcccccttcattctcaaaaaatgaatttacagaattatttcactacaaagaggcatccagctctgctccatcaccaggaagcctgagtgaaggctaaaaggagtgtttttctggaaggaattaaaaaaagaaaaaagtcctcccagaatttaatctctaaacagtattatctttctagtaagagagcccagatcttgcttccctggaaccttccaagttgcagtctgtgttctgtctatcagaaatttttccttcccacccatgagcacccttctgttgtgggagaaggagggcctttccagtcttttgcctggggccaagccaaccctcaaactgtggtttttctctgagtcttcttgctgtagtatggctgtttcccacacccagcaaagaaacaagagtcatgtatatgctgagtgtatgttgactaggtcttgagtggaggccagtgcttacacagctctctcattcccaggacattgactaatgatggtgcagctcctatgcctgtgttgttaatattgtatatcgaaacctcatgtttcttacaaattattagagagaacttcatctaattcttctgtccttttatgaatgaatatcaggacagaacaattcacatgatggagcagttcagttggtggggctgtaggattggggccagtacaggactctcagggtgcctggagaggctgatttctgctgctagtttacacacaaccatttatatgtctgcttttaacattgtctgagtgtgttcctgggtttcttcttatcaggtttgattgctttaatcccatcccacttagccttggctttggtgaaacacctggggacttgtctacattaccgactctttggagtttcagatggcatgcaattataatcatttcattatccgttcagtgtattacagtataatcaccaaaccacaagtcgcaacctagaggccttttactgtatttggaaagagtgtctgccttctgttgttgtattgaggcttaggcaagcttgaatctgtggtagattgagaattatttctagtatcagttaagattccgtttggctgcttataacagaaccctctctaccaccaatagtttaattaagttaaaagggtttttttcccacatagttagaaatctagagataggctcttgcagacttcatggtgccatcagaaacccatgctccttctgtctttattctctgcaatccttagcaaataacttttaccctatgcctatccacctcttgctagattccatgctgtaggtgggaagaagaacagggaacatgaaagggcataaggtgtgcaccagccgagtctgcccatttaaagagctttcccaaaaactgcacccagaaacttctgtttccatctcattgtccagaacatatggcatgtgttatccctaggtaaaagagaggtttagaaatgtattttctttagctgggcaaacattatgacccaaacaaagtcagagtagtaatattaagaagaaagggagaagcgattttatctaggcaagtggcagtctcctaggcagtaagttctcctaaattattttattttattgtttgaagtgaaaactaatcttatataaaacatcagtatctaaggtcctaccataaattttgcatttaggaaggtgtgaagttatttttgtttgagatctgcagaagggctgacatattttgtgtctgagtatgagttggacacaaataacacactaggcactgtttaaagtccagaaaatggtccttttacaagattacatctggatataaatacacatttgcctattttgttgtgtaggaatttagtttttgctaaaaaaaagatgaatagttgggattggtgtttttatttttaatttttaattttttccatttattaagcacctttctactagtcactgtaggggaaactaaaattaatcatatataaattcagccatttccagtgtgaatcacccagaagggagaaaaagtacacacgtaagtggctataatacatggtagaatgtactgtgatgagtcatacaaatacatttttctaagcattcagaagaggaaaagattatttctgccagagagaattgagtaaatatgatctggggagcctaaacatatgtttccgttttaagaatttgctttcacaactagtgagtgtcataagtctggaaaaatatcttgaagaaatgcataagcaactgccattcacaaaggattactgataggtggacttcgctgtcatcccatcctttagtttctcagtagaactgaggtaggtagaggtttgggaaggaatggaacatttgttgagtgcctactgtgtgcctaggtctttgctttatttcaagaaatccttattgaatgcctaggctaaggttacctacatgatgacctccaaaaatccaatgaagtaattttttttaattaagctcctcatcttctaaaggtgaagtaattttaactgcttatgagacagctctgagaagttaacttgaaaagatcacccactttgtaagtgacaaggcctacatttgagctgaggtacatttgaccgcaagccatgtcttttccatttactctgggtctctctgcctttcattgatgacctaatctgcttttctagccagtgttgaacagttaattccttctttagcccaatctaataggaatcctatacccagctggttaaaacttgggcttcacttgggtatcttgatttgtactcacagataatgtattacctgcttaaatgttactggaactagacttcttttgtcttttaaataattagtttatttttgtaataaataactatatgcacgcagtatgaaattcaaaagatacaaatgacatgtagtaaaaagttagtctccctcctgccttgacccctagctaaccaattcttctccctgaaggctaccagttttttgtgtatacttccagaattgttctgtgcagatactaggagagagagagagagagtgtgtgtacatacatatatagatatatatggtgtgtatgtattctttttaaaaaaaacaaaaataggagctcactaaactcactgttctgaacctgctgttttcactcattatttcatttgtatttacatgtttcagattttgggggaaaaaattatgaatttgaaaatatagttgtcaccgtggcaacatttattgaatagatgttcttaccaatggcagttcccttacaacattaaatatataatttaataaagaatattttgatttccaagagctcttaactaacaacattttatcccctcctctactactcacccagggaatttctttatggatggctcagtgtagaactgttcttcagccctcattctgatttttggtctcttcccatcttgaatgaggcacttcccaaacactccttacacctaacctcaattattaggatgtagtggtgaaaatagaagcctggggcagcctgttcctgtgtccctctttacttccaattgagtttctcacacagattttaaggccctcaaatatggaaacaacagctgcaaagaaagggtttgttgtagaccctgtcccagaaggctgcctcctgctggaagctttggttccttgtcctgaggaggcctgctttagcagggtcagggctccttgattctcttggaccatccggaaacctccccatgtgtacatgctcaacagtgctgccctcctggctttgcccatgaccttgcatctgtctttgttcctcttccccccgctttttttgagacagggtctagctctgtcaccgaggctggagtgcagtggtgcagtcttcaccctttgcaaccttcacctccctggctcaaaggattctcccacctcagcctcttgggtcgctgggactacaggcaggcaccaccacgtctagctaatttttgtattttttgtaaagacagagttttgccatgttgcccaggctggtttcgaactcctgagctcaggtgatccacatgtctcagcctcccaaagtgctaggattacaggcattagccaccgaacctggctttgtctttgttcctcttctgtggatcagagatggagaaaaattgtagctcttcactttctccctcaggtggtttacacaggttggggacatctcagtcagattggtctgactgaaaatgctcagaccctttacctctgaaatctctttgttctttgtcaagcatctcagtgaaacacatttactccacacaagacccctggatccccctctcatatctgcttagcctacgacctttgacacatttcctgaaaatgagacattttatgtcatgcatatagaagggttggtgaacattttactaaaattacccagttcatcttttaaatctgaaaaaataaaattcataaagggcaaaaataatactagcaaactctgtctagaagatgaatatttcctaagagcatctcatattatttcatcctgcctcaccatgagtcctttacatgttgtaggtacaaatggaaatcaattgccagaaattgttttaataaaaaatactatgtattttgtcaatgatgttatttttctcttaatattatttctcatttaaagtttttacaatgcatgttgaaagcagtattaatagtattgaaagactagtaacaaaattgagacacaaaaagaccatttctaatgagataaataagttgtaagaactttttaagcatctacttgaaggaagaatacttttacatcctaattatatatgttgacatttgtgatgtttagatggtgatttttaggtctttatttataggcttaccctctgagcaaaaatatccatttgtcgattgtattcatgtaactagcatttgtatagtaattttactttgaaagcgctttcaaatgtaaaatcttatgttaatctttaggtcaacaaagtgtttctagctagaattctaaactagccctcaagattataaccaggcctggctcatggttcctgtcgcaggaacctcatctttctgtattgctcaccatgccttagccacactgactcctccccttgcctcctgcctgcaaactttctagaggagctcagagttttggattgggcaggaatcaagtcaagctgcaagacaattttattctgtgctctatttctagtacttcacgcctcgaaagagacattcattaaaaaagtgttgaatttaacaatgatggaaactacactgagagatcagatgcttttctaattcacgcatgtggaccaacacttagtatcgcaggtgccctgattcctagcccagtgtactttcaacaagaccatttcaacaatctgcttcaaaatattccccttctctgaatctagagctgcactggcaacattagagaagtttttccttaaaaaaaaaattaacagttgtccttttctttttgccccttgacaggattacagactagttacatacagtaaatgggttgtgaaggtgatgtccatcgatcatttttttccttttttttttgtaggcaatctttggcagccagacactacctaactccaatttatggacaatgaataatggtgcaggttgtagaatttccagtgccacagctagtggccagaagccaaccactctgccacaaaaagtggtaccacctccaagttcttgcgcctccctggttcccaaacccccacccaaccacgaacaagtgctcagaagggcaacatcccagaaagcttccaagtaagtttttttctgttcaatttctactgagttttatcagttctaagctaatagtactctttatttattactcttcaagaccgttcgtactgaagtactggaaacaagaacacctgctgggaaataaaggctaaccctagttctcagcgtgggctacaaattagaatcacccagggaactactgaaacaagcagatggcagggctttaccctgtgggagggacaggccctgcagaatcagatcttttcaatttcatataaaattcaacatcctgcttccccttggtttgttcacttttaggcatttgaaaggggagatacaggattgagatttcatctaagaggataatataacttcattgacattagtcaccaagctctgtgtagcaacagtgtttttaataccttttgtagtctacctgtttacaccaaaaagacatttcctttcctgagtcaaatttttgttaagtcaaaatccttcactgtatctccagccactttttagccagtgaactagaaatagattggtgaagagcgttggttctagcagcccttcttcagtttaaacttggggaacttttagagatgtctggaagaggcacgcattgcctgctgtgtttttgtgtcgcagacatttgtgtatttctcttgctgtcattgaggcttctcattcatttgtccttcggaagatcaatattagttgtgagaagaatcctaaaacatagaaaaagtcattactgttttttcctccttggatggtaaatcaaattctggatttagatagaaaacaatcccttgtggctgttttaattatattgctgccattattcatttatccaacaaatatttattcagtgcccactaagtaccaagcgctgttctgggaagagctggcattgtaatgactgcagaactctctggagtagtaggaaagggcagtaggaaggctgcagtttgtggttgaatgccagtagcaaaataggaaatgtgtgccttctcaccctggaaatagtggagtcaaatccttaggtctgcagcctctgtagccagactgcctggattcacatcctcaggccacactttactaatatgataccttctgcaggttacaagttacttaatctcctagcctcagcttcctcatgtttccatttgtaaaaataaaacaataagagtatctacctcctaggtcagttgttaaatgttaacagagttaatatgtgtgaagtacatagagtaaggcccggcccaggtaagagctcagtaagccttggtcaccatcatatgcattctaaaaccacactctccttcacagatttggaaagcccgtagttaactaggaaaatttttgagccaaatgcgaatgttgaatttgccagtgtgccccttgtggattctctgattattgccagtaccctcagaaggcccttggtggcctgtgtggctagctggtggagaggtgggcccaggcggcagggctggacatttgaagacgctgcttgctactgccctgaactcactgctggcaggagaactctgcagcctcctgagatggaattgcagctctttggacagactttgctttgcagcatttttgtggtttcttctttgtgacaggcaagagtgtgggaaaaccggaaacagctcagcatcaaaaatgcacagaaggggggaaaaagcggagatttcttcagaatttaagtaatataatccaggtatcaaaaggcatgctgtgaggcgttgttccaggaaatagtttccaatttgcctctaaaactctaggacaagtctctgaagctaagttaatactaataaagacttgaacattctctcacttacatgtgaaatgtacagcgttttggggaccccagtgttttcagatattctcctgacttttaggaaaaagaatagcatggcttttcatctgaacagtgaaaagttccccctatgaagtatcctgataaagttaaaaaaaaaaaaacaactgggccaagtgtggtggctcacgcctgtaatcccagcactttgggaggcagaggtgggcggatcacgaggtcaggagatcgagaccatcctggccaacatggtgaaaccctgtctctactaaaaatacaaaaaaaaattagccaggcatgctggcaggcacccgagtggtaccagctactcgggaggctgaggcgggagaatggcgtgaacctgggaggcggagcttgcagtaagctgagatcacaccactgcactccagcctgggtgacagaacaagaccccgtctcaaaaaaataattaattaattaaaataaaaaaactggccaggtgcggtggctcacgcctgtaatcccagcactttgggaagccgaggcgggcagatcaagaggtcgggagatcgagaccatcctaactaacatggtgaaaccccgtctctactaaaaatacaaaaaaaattagccgtgcatgatggtgggcgcctgtagtcccagctacttgggcggctgaggcaggagaatagtgtgaacccgggaggcagagcttgcagtgagccgagatcgtaccactgcactccagcctgggtgacagagcgagatcagagagttctcacgtaccacttgcccagtgttttttccattgttaacatctgacattgccatggggcatttgaggaatgtaccataccaggaaactgtcattggcacattactatgaactaaaccccatactttatttggactgatgaagtaatttttttaatctagagaagcttttcatggctctcgaaatcaggatcctgagtatcagttgatatattctcactgttctgtagtaattcttgttcctagccagcatagcaagttactcaacatctctgtgactcagtttcctattttaaaatgggaatagtaatagtacctgcctcatagggttattaagataaatgaattgatgaatgtcaagcacaaatacagtgcctggtatgtaatacatactaaatcagtgttaggtactattatgcatttcaagaaattttcatgtaaattttttactttcttcctacaagatgtgttgcttcatttgcttggatcttactgtggcctttactccggctcagttcagattaatcaggaaccctcagttatgactggtgatactgagtcacactcaggaatgccatagtcgcctcaagagacacaactaatgagaagttgtaatgagcttttgaccatgccaagccctgtgtttttgggttgaacttcaaacttcttctagcacagaagttggcattagacaaatatagaagcaatttccaagagcatcaaagtttccacatcctagagggttgagttttgagtttagagaagaatagaacgttaaagatggaatgtcacttggattttggtgcaaagggagttgagaatcagaacagtggggtcctgtttctttatgataatactcaagttgctttccctctaaaggtttcattttaccatctgtaaaacgaaacccactgtccctactgaataattaaccaaaatgacttgttttctgtctattccattgaaagcttttttatgagcacatttgctctttaatcctgatgctttcaagccattttcctcagcccctcttgtcccagcagttctttgttgtagttctcaaattcatatacttgtatttcatttagctaaatctcatttgtcagttctgtgaagggaatgatttaaaatttttttttttaccattttcctggtgccaataatctttcttgattttcttctccaatgtttgcaacacttcataatttagtacccgcttcagatcctcctttcaaaactatttgtggtatttcttccaagcagtcagctgaactgaggacgacagcctacaaacaactacatgcatctgaactgtctcttgtaaatgagcttttttcagagccagaatcatactctccaggaaatatggagaaagaaacctgaggagattgaagtttgccaggcacaagggcaaaactcagactgaatgaatttgaaagggtggggccaaagatgttgtaacctgggagacttctctgaagaaagaaaactgtttaagaaacacagactgaactgcagtacttttccttaaatagctgagatgaccttctttaccctgggcttaggtgattctcatcagggtgacctgagtggaagttggtggtaacgactgttctgtgtcagcacccaggacagtggtgtctgttaaggctgccagggattagcagggaggaaagccatcaggactgggtagcctggtagcaccaaatcccaattaatgttacctgaacatgtggtgaggtcagccgtatgatgaaagatgtttaagagattaatgtcagaagaatatgaaaataaacaccggcttaaaaaatgttatatctttttaacatatgagtcattaaagtgagaagatttaagggcaaagtaattaggacttaataattgtccaaaagttcttgaggtgagcatagaagataccatattgtgtgttaaccatgttctgccagctttttattatgtgcagtttcaagaaacatagttgaatctataacatattcatccttaatacaggcttctctacattatgcatttccaaggtaggtaattataaaatgtttttggtagaagataaagggatggaggcatagttgtggggatatgagtacaacaaggtacgcaggtgttcagtggctgagctcaaactggaacttatatgacccgctgtgctcacctcagactcttccccctacatcactgatttcaaaggtccctgccaatctattcatctatatctgtctgtacagcaaatggcagatcaattatcctaaaatattgcttttgaagaaaatacaatgtatgcacttaggaactcactcctctctttttccataccagttttaccacttaaatgaccaggaaatactgaaaatgaaatactcaaaaggaggaagaattaatgccactcgtattagaggtgctgggggaatttcttttagatgtagcacaggaagactggattgaagaacaacatggagggcttttgtatagtgtcttctgggagagtgcattctaggaaatgaaagggaaacctggaatactgcagacaataataccctctgactctgaggggcagggcctgagggtagaaaggacatgagcgccagtcaggagctctgccacttagactctctgtcttctagtaatcctcgtcatttggacctcagtggtggcattaggaggtctctggggttgcttttggcatggacagtgacgtcagtcagagggatgggtgctacaaccacacctaatcaaaagttgcgtgatggtgtgtgtctcattggggaggaaagctacatgagagtcatggaatgatgggtcttcccttgctgattcatattggcataatttaaattaaaatccgacttctcatgcctgcctcctgggatgttaaaatggttgtcgaaatggtaatataactgctggatatttcccatccctcacttccctcgtccttcacctgagtatgaaaacgcttttttaaaagattttggcaggaatttatgctaacctctgacagaatccatccacatcagtttctccgtgaatataagcccttggcaaatttagaccttctttaaggatgagcaaatactggaatatcttggggcctggcaataggtggtatagcttaaaagaaggcttcagttgggcacagtggctcaggctgggcatggtggctcatgcctgtaatcccagtgctttgggaggccgaggcgggtgggtcatgaggtcaggagttcgagaccagcctggccaacatggtaaaagcccgtctctgctagaaatacaaaaaattagctgggcatggtggcaggtgcctgtaatcccagctactcaggaggcggaggctggagaatcgcttgaacctgggaggcagagatttgcagtgagctgagatcacaccactgcactccagcctgggcaacagagagagactgtctccgaaaaaaaaaaaagaaggcttcatggagaagattcagaggcttctaacctctggaatgagtttaagcaagaaataataacattttagaaaatacctaatgtgtattcttaacaaaatgtaagagtagagagcatctgtgtggagaactagacaaagctatcatataaaaggagcaaggggcctgcagtcagggaggattgcacagagatgagaactacgtaagtgaaaaattgggctgaacacagtgaatagaaattggccactgcagaaaattgaattcgcaaactaaaagacaaatgccaaaaatttgaggaggaagtatacaaagataaaactgatgacagaaaagacagattcaacctaaaataacaaattccagaaagagaatagaaataatagtcagtagtataggcaaaaaagacccaagataaggacataaagggattagttaataagattaaatcaatagatacataactttgtgccctacagagatcttgtggaatagttttctaaactggaacgtttcaattaagtcctcaaaaagtagaaattatacatgcctcattctcagaccactttacaataaaatgagatattaaatataaaggctgggtgcggtgcctcacacctgtaatcccagcactttggaaggccgaggcaggtggggatcaccggaggtcaggagttctagaccaaccgggccaacatggcaaaaccccgtctctaccaaaatatacaaaaattagccaggcgtggtggcatggctcctgtggtcccagctactcaggaggctgaggcatgagaatcgctcgagcctgggatgtggaggttgcagtgagccaagattgcgccactgcactccagcctgggcaacagagcgagactcttaaaaaaaaaaaaaaaaaaagaggaaggaaggaagggaagaagcgagggagggagggagggaggaggtcaggcaaagatatactcaaaggtaatctgtcaaagaaggaaggaagggagggagggagggagtcaaagatgtactcaaaggtaaattcataatcttcatcattttcattactaaaatactgaaagatgaaaaagaaattaaccaagatacaaatggtaaattggcttcaatagataaactggcttcaggtgattgcccagtgttgttttggaaagacccatgaggacttccctgagctcagcaaaaaagagtgctttgataggttagtagcatccgccacacatagggaagatgctgagagtcgtgaataggccgcatatttgtcataactgaagtaagcttttatcacatgaagttagaaaaggaaccataaaacaaagctaagaaaaacagatttaaggaaattaagaagaaaagtaatataaagtgaaaagcaagcagtaaaattagttaagttcaaaaccttatttagtttgggtcaggggaacccagaagaagaaaataaacatacttctgccagaagaataagagcagtaaacataagaaaaatactttaaaagtagatatagaagagactgaaaaattaggagaacacggcacactatgtacaattttaaaaactagatgaaagataatattttgaaaaatatcaagtataaattggttcttcttgaagaaaaagaagatttaactagaacatagaacaagtggaaattttcaaactgcctaaattggttcttcttaaacacatgagtaggcccaggaaccatttttaaaaatcgtctccaaaatagttcttcaaactatttttctgaaatcttttttgtttttgtttttgtttttttgagatggagtctcgccgtgtcacccaggctggagtgcagtggcgcgatcttggctcactgcagcctctgtctcccaggttcaagcgatactcctgcctcagcctccagagtagctgggactacaggcatgcaccaccaagcccagctaattttttgtatttttagtagagacggggtttcaccgtgttgcccagggtggtcttgatctcctgacctcatgacctgcccacctcagcctcccaaagtgctgggattacaggcgtgagccgctgcacctggcccatttttctgaaatctttggaggcttccaggtgcgcacaagataaagttgagagtcctgactctgacattcaagccttctgcaatatgacctctctcctgtctcctgccttcttcatactctatcaccgctttgcacacagactgttccacacacatgcttcccattctttgttcctacatatccatgtcatctctgcagagtgcccttaggcctcttgaacctaagtcctgcctttaattcaagattgggttttagtgtctcaccttggtgcatccttcccagctgccccttcgtcacctcctcatctgactctgccatctacctcctggttttatttttccttttttcatatgttctgctttctatagctctctcaaagacagataccctgtcttcaccctttcatcacatatatattgaatgtctgttttgctcaacattgccctagacagcagtgtccaatggtgataacaccagtggacaagacagatcagatctctgcttgcatggtttgtttttgagagaagggataaactcattcccagtgcctgagatagcttatattcgtaagttctcagcaaatggcagtggtgatggtggagatggaagtggtggagatagtgatggcagtggtggtggtgacatggtattctgtgtcaagtcatatgcatcaaagatcagtaaataacaatgatctcattatttatgccttgtagagtagcgtatgggagacagtagagtacagttgttaatagcctggaatttgaaatgggattcggattctggttccttggcttaactaacttttctagagatagcactaagcttctgtttcattatctataaaatatcacttatgtcttggagttgttcatagggttaaatgagataatgtgtttccctgacatatattgcatccaatgtctgctggtcagcgtagttgtattctgcagctgctcttgtttcctactaaaagaaatcacatttgttttgttggtaggttgttatttataagtgtgatttggttctgctggtgagcctgtggaaatttaaacatattctgatttcctcaacactaataactctaaaggcaattgaagacaaaggctcagtttcaaacaaaagaaaaaattagatttggagttactgacttccaggccagttggctcccaaagttcacactttcacatccatttcccccctgtgctgcaaatacatagctatgatggatgaacatttaaagaagaaaacctacgggacttagctgtgcttcaaaacaaggcacatatctccttggccccaaaatataccaaaataaacgagaatcaatgaatgaagctgaagctacaggctttctgaagcaggcagtggcaagctcctgtgtcatattgggagctgaaagtgccctacaagaggagaacctaaagccacgctcattacttgaaaataattgattttcaacctgggacagtttcccccccaggagacatttggcaatatctggagacatttatacttgtcataactgggggagtgcgactggcatctagtgggtagactctacagatcctgctgagcatcctgcaaagcgcagaacagtccctcactacaaagaattatccagcccaacatgtcagtagtggcaaggttgaaaaccctgcactgaaggatgcagtgtgccctcctaatgggagagtagtaaaactggcatgaaccgactaactgagtctgtctttatatgagactatgggccttacagagtcaggaaggcaatgacatacccttccaactgttcctgtctcaaaactgcctttggtttctaaatatcactgaggcaagtgccccaaaatgccaccataatgcctggtttggggctggtgtcaggggtctgggtgaaggcaactatataatcttcagacacggaggaatgagcaagcacagagaccagggcggggaatgattcccattcaaaataagcccgcaaaccaaaattccaaaacacatgaaaaaatctaattctaagaaagattgccaggaaaatcaagaactggaacgtgaattctttacagataaattaatactttaaaacagtcagacatgttagatcatgtgtctaataggagtatctcgtggaacatgatatgtgactctgataggagtatcacaaaaaagacctaaaggataattggacaagcaacgcttttagaaaatgacagaattttccagaattgaagaagacatgagtcctcagctaaaaaattcattcatgtaccaaaataaatgtacctctagacacatcatagtagcaagaaaccagaacattaagcgtagagagaagtctaaatattaccagggagaaaatctgcgtaaatgacaaaggaacacagagtaccagcattcttctcctcagcaataatgagtgctagaaaacagtagccaattacttcgaagtgttgataataaactttcagtctagaattttatacatagctaaactggcattcaagagtgaaggcggctgggcacagtggctcacgcctgtaatcccagcactttgggaggccgaggtgggcggatcacgaggtcaggagatcgagaccatcctggctaacacgttgaaaccccatctctactaaaaatacaaaaaattagctgggcggggtgacgcacgcctgtaatcccagccactcaggatgctgaggcaggagaattgcttgaacctgggaggcataggttacagggagccaagatcgtgccactgcactccagcgtgggcaacagagcgagactccatctcaaaaaaaaaaaaaaaaaaaaaaatagtgaaggcaaaataatttgagacattcaaagtctaagagtatacctgaaattcaaactaggaaatagtaaagactgtatagagatagaagtgaatccagaagtattaggcaacaagaaacaatgaaatacaacaaatccgtaaaatgtcaataaatgttaatgactataaaataattattggtctttaagaagatgaaaaccatttagagataacaaagataagatacagggacctagagtatttaactgataagggtccgtgtcgactttgaggtcaggacagaaatactgaatgactttacacttaggaaaaaatagctaaataattaagatgcaggctgtagtgttcaaaccaatagagcagggaaagggaaatgtagatactttattaattcagtggaagataggaaagttagaagcaaaggaggctgggcgcagtggctcatgcctgtaatcctagcactttgggaggccaagacaggtggatcacctgaggttaggggttcgaaaccagcctggccaacatggtgaatccccatctctactaaaaatacaaaaaattagctgggcgttatggcgcatgcctgtaatcccagctactcgggaggctgaggcaggagaatctcttgaacccaggaggctgaggttgcagtgagccgagatcacacgccactgcacttcagcctgggcgacagagcaagactctgtctcaaaaaaaagcaaaagaaaaggatgataaatagaaaacaaaaactaagatagtagaaatgagtccaaatatacaagtaaccaaaataaatgttgacaaattaaactcttccattaaaaaagagatgatcaaattgcatctttttaaaaacttaagttattggctacatgaaagagacatacataaagtaaaatatcaacaaaagatagacaataaaaggttggaaaagagcaattatgaaatactaatcagaaggaaaactggtatagcaatattaatgccagataaaatatagcaaaaatcactaaggaataaagaaaagcacttgtatgcacttaacatcataaacttaaaaatatagaaaccaaaagctgacaaaattataaggagaaacttgcaaatcattaatattagtgggtaatttatttgaatatacttctgtcagtaacaactcaaaaattactgaagacttgaatatttgaaatgcagaattaacattttgctttaataagtgggttttcatctttttggaccagcacttaaaatagaaaatacattttaggggcacatgttctcaggacttcctgaggggtatgtcatgggcgaaatgatctaaaaaaagaaaaaacattttatatgcaacccagcaaaaatacttatctatatgtatgtgtgtatgtgcaattaaaatttcactaaatactgtcttctattttttaacgctgattctgagccctgaaattcattttacaacccaattatgaatcacagctcacagcctgaaaagcagttacagctatgcatggactcctgcactcaatggtattcgagtatatgtggaatgtttataaaaattcagcacatactatgtcacaaatgaaggctccgtgcacttcaaaatatcaatatcaaacggttcacactcttcaaccacaaagcacttaagttagaaataataaaaagaggtttttttttaaaaaaaatccatgtgttggaaattttaaaaaaatagagtacctattactcatgcattaaagagataatcataatgaaaattataaaatattttaaactgtatggctctaaaagtactacacatcagatttgtggaataaccaaaactgcactcaaaaataaactcttaatacatttatttaaaagacaagaaggattaaaaataagtgagttaattgtttaattcgaaaagctatgaaaggacaacagagtaaactaattaaaatatagaaaggaaaaaaatacagaaatctacaacagtcaggtgcatggcagaacattagagaacagtgcttccaactgtatctggcatgtggtagggggtcattaaatacttgttgaaggaacgaatgaaattgacaagtactgggatggcctctggaaagactaatgaataaaaagagaaaagggcctactcaggaatgaagaggactataaccagaaatacgggggaatagataatatgcagtatatttataaaatggagtcctgagtgcctttactgcacaaaagttgacttcactaaatgtttcatgatttggttttggaacctgaccctaattaataatgttctaattgttattttctaaggattagcattaacttccatttcagaatcataaaccctagactgagagataaaaggaagaagcagcgtatacctgtgtgtgtgtggatatgtcgaaaattgtaggctacttactatgagtaaatgtttggtaggaaaagtcagggtatgtattttttgttttgttttgtttcttttttcttgggaattgaaagaggttggttattgctgtattttataaaaacgatcaggtttgggggtgtttgttttcagcaccttcacagatgcagccatgtctgttttgccacagccctggtaagatcagcatttgtagctttgctcttcctgtaaaatcttgagcattttccttttgtgagtccttccttctacagaaaggtcatctctgatgtggtggcatgagtccaagataaacttatactaaaccattgaaatagaaaactagtacccctgtgttggggatgtggaaagccttgaaaagaacccaaacagaaataatatagcagcaaaccacagtcaaccttgtgaagtaatgaacaaaacagaccttaaagaaagcatatcgctttcagaaaagtttccactgatcaaaataatgggcaaaagaagaacagaggaaaccacaaataaagaaatgaagatccacgaaaaacatgtcagaaaccttaccagcaaaagggatggtggggctattgctcattataaccctcctggactgggttttatgtataaatatatgttatatagttatataggctggctatatggtgtggtcttgatgccagtggaattcctagccagccagttgattggcttatattccttaaatagagacttgtactagaaaaaatttttcaaaataattaatacaggatgtaatatccctataagatgaaatacaggcatttcatcttacaaggatattatttgtttttaatgcatctttgaacaacttctttgaaaggcacaggagagctgttccctcagagtaggaataatgctcatttgaggtgctttctcagacctcagaaaaatggcagaggcaagatgagtagatagatgtgaagcaagtgagtcaaattcagggttaggaagtgtacatgtaatatttaggtaaactctttagctgccagctgtgaacatgtcccaaggaaagagattttgccttcatagagaggagcatgcgactgttcattgagttcttcgaattctttgttgctactatatgtggtcatgtgtcttattatagtttttaagtggctaaattaatcaggcagtgtgctcttaagcagtttttattttattttatttttatttattcatttatttatttattttttgagatgggagtttcactcttgtcacccaggctggagtgtgatggcgcaatcttggctcactgcaacctctgcctcctgggttcaggtgattctcctgcctcagcctcccaagtagctggttttacaggcatgagccaccacgcctggctagttttgtatttttagtagagatggggtttcaccatgttggccaggctggtctcaaactcctgacttcaggtcttcctgcctcagcctcccaaagtgctaggattacaggtgtgagccaccgcacctggcttaagcagtttttaataatcattgacagtttatcctcagagaagaacctaaataagaccattaccagagctgagattgtagtaagcttcttactctcaacctttcactacatcaagcagctttccatctcctagacagttgtaccatttccaagaagaacaattaaggactagatattcacatctatcactcttctcatgtttgaactctaacttttgtgtagtgtaaagttaatggcaccttttgtcccatcttttcagtatttctcactgtcaagctcttgatacttctataactccagtttttctaacttcatctttagccacttctttatattctggtgtactatgaccagagaacatcagataatggaactgtatcacacacatatttaactttatacattcagctattcagagagaaattgattgtaatttcaacaaagtggctgattccaattgattttacacttaggataagatgggagaaatatcactccagtcagtcagtttcagttcccgtgggactttcttatagcaagggcatcccactgcactcttattctcacgcttaaagatacatattttaggccaggtgcagtggcttatatctatagtccccgcactttgggaggccaaggcaggcagaccgtgtgaacccaggggtttgagagcagcctgggtgacatggcaaaactctgtctccacaaaaaatacaaaaattagccagacctggtaccacacgcctgtagtcccagccacttgggaggctaagataggaggatcacctgagcccaggaagttgaggctgcagtgagctgtgattgtgccactacactccagcctgggtgacagagtaagaccctgtctcaaaaaagtaaaaataaaaatacatagtttatacaacatgatcccataatacaagcctacttttctaaatacaaacctacttcatttggtgcacagttgaataaatcattctgacactggcagaaaaatacatattagatttattaagagataacctgtcaatctcaaatgtggcgtctcttcctaagggatcttaagaataatttttactatgagatttttgtcttataggctgccagttaattaccttgtaactttaatagcaaattgctgttaacttccaggttcagaatgcctatggccattcttctgtagtttagcactaatatttcagactgatgttggagtcaatgagtcattcaatttgatatttctgtatgtagatagacttatagtgaatgcagagagtgttaagcagtattgctaagtaaaaaatgacaatactactactagtaatagttcatgtatatttagtccataatataacaccagtcactgcttagatgtgctttatattcaccatcttacgtagtcttcaaaagcctataaggtaggtcttgttatccaggtgttaaaccatagtaactgacttaaagacaaccaagggaacacatacatacctcccaacgtaaatatttcctaaaacacatgtattcctaggaaagcagcaaagaatcattgcaggggcaagtgcaagttgacatgcaggctctagacaagctgagtttcaaaagttctcatttaggggaaggttgtccagaagttggaatatattttcccaaggaaatgatgttatcacaacaaaagcatatttacccataatgtgcctaaagtagtaataacagacctaaaccattttgtgtaccagtgtttccatggaaaaattcactcaaaagtttccccttggattgctgtggacacatttctacatcacagggagaatggggactctatgctagaagcagtagaatcattagaagtgttcaaattctgaatctgtggtggtctccaaggcctttgatgggagttgatgggagggaagaggatggaagagtgagtgaaactgggaaccagggaccatagggttagaggatcttcagtaaagaacgggataaagcctaagaaggtgaagggtggattgggggttccagagaggagagggaaaagtttcaagagttttaaagacccagaattcattgagtctaagcccccagggactcttctcatccctcaagcagttttctattattcactaccagtttctactactgacccaaagattttgccggcttcttccctttttttttttttttttttaaaccactaatactttgtgaaattgagaccagcccagggctttgctccactcagctgctcctaaagcaagcacagtggctctaatggtttttaacttctgtaaaggaaagagcttatcttaggccctccagaactttttcacttggacatggaagagcaaacatcatctacagatgctttgggagagtttttgggtcccataaggggctgaaataaaatgcgtgaggatttccgatgtggctgtccaaggccgaggctgatgggaaaagggagaagctctctgcccctttctctcctgcctctgtggctcccttgtcctcaaaatgaaagtggaaaggagagggtaggccccaaattgcttgccagaggggaggggctatgagacagtctgatccttgcgccaatgctgggctagaatcttctcaagcggcatgtctctttcagggttgtagggactgtgtgggcacctcagacaccacctgactctccaggtgcacctcataccactttgctctttacctactagccaatgatgatatgaatcacctgggcacctggggcactgtccccaggctcacctggaaagctgtgtgattaacaagtgaccccaggtcattcctgtcaaagacattcagcaaacactgcctgactgtccccacccctatcctatctccttagctggtctttaaaggttcctgggacattccaagcccctttctgcctcagagtcattatatatgcaatttcctcgtgaaacgctctttcctctccctcctcctggctaatgcctacctctcctaacttcatgactcccttgaaattatttccacagaaagaccatccttgaccactgttctcatcatctaaaccaggttcccctgcctcgttctcataacactgtgtgctttttctctttagcatttagcacacactttgtgttttatgtacgtgctttaacgtatctcctcactagtacagaacacaggaaatgcttgataaatatttcttgtgtgaatgactgactggaaaaatagtgtcgggagagagatactaaaggttgggttggatgttgctcaacaaaaacaaagaactgagcatgttgaaagctttgatctctcaggtacaacttttacacatcaactaaaatcaaggcagatagacccaacaaaaatattatattataaatatacaacaaaaatattacaaatatttcaaaaaaatttataaatatttgatgtgtgcaaaatgcagcagcagtgaataagaccaatacaatctctgtcattatggagcttacattctagcaagggtgatggatactaagcaaccagttacacagtttcataattataattttgaaaaatgcaaagaaggaattagagctgtaagcgcctttaacagggaggcttgacttgggctgtagggcatcagactagtcctaggatttctgagacatatggctagggaacctctgcccaaagaatcagatatactctgtcatatctcttgtcaaagttggcatgaggggagatgctgtgtacatttctcagtcttgcgattattgacaccatggagtagataattctttgtttggggcattttcctgtgtgctgtggaatgcgtagcagtattcctggcctctgcctgctagctgccagtagcaccccacagttgtgataaccacagatgttttgacattgttgggtgtccctggttggctcaggggacacataatctctccttccccacttccccagttgaaaaccactcttccacatgagacttgcttttttaaaaatgtgttttcatatgatttaggtaagtcaatgccagaaatataattttttccttcaataaacaactatttattgagtacttgttatgtgtcaggcactattctaggcactggagacacagcaatgatgaaggcccatgctttcttgatactacatttcagtagggagaaattaacaataaatctcaaaatatatactatttcagaagtgtggaggtttgtcatagagtcttctctgataaggtgacatttgaacaaagccttgaaggaagtgagtgaatgagccacaggagaagcagcaccaagagcaagaagcgaagccatcagaggtcctgcacctgacctcacctttccgcctgcaggtctgaccaagctcctttgtgtttcagagggtcctccgcggaagggcagctgaatggactccagagcagccttaaccctgcagcctttgtgcccatcaccagctctacaggttagtgggcaccagctcttctgcaactggatagatgacagggaaggtgttgggcttggcacattctctcttctgcctccaaagagagccccagttcaaagaatgaaacatctagcctctcaaaacattggcaaatgggcatttttgttgcattcttctttaaaatagtcttggcagcctaaaataggcattttctggaactagcttggggtaaatgaaacctcgccatcttataaaatgctgtcagatttgcagcatttaatacagatgtcccatattgactggtatttcactgtctatgttgtatttccgcatgttgtatctctcacttaattctcacacagccctgtgagtttgatcttatcccctccacatgaggaaacaggctcagaaagttgagggcttgttgaagtttatgcgtggatgcagagctggagctctggtctttgatctacgtgttgtgctaatgccatggtctgtggacaggttgttactgacagcctgaagcctctcagtgtaggtgcatacagataagttaggcagtgttggtccagagatagtttctatgaataataattaataaaaatgaactattaagtcagaaaattgaacaaatatttattattgagtacctactctagagaaaataacatgctgggcactgagatacacaccgggtgaacaagacagtctgctcttagggaactttaaaggagatagaaaagtcagcagggaatgtgctgcaaagtgggtattattgcatgcctgagacacatagaataacaacagactacattgactgaggatttgctatgtgtcaggcacagttctgaatgctttatgtgtaataactcacttgttcactgaacaggcacataatgtaggaactatattccccatttatggctgaagaaataaaggcacaggcagattatcaaacttgtctgaagtctcacaactagtaagcagtggggcatatttgaacctaagcagtcgagcccagatctctagggactgggaacggcttcctagaggaaaaacatcgaagctgacactggagtgtggacgagtcagccaggagaggaaaggcacaggtggaaggagttctaggaagagggaacagtgcaagcaaagaccggggggaagtgaaaacgtgctgtgttccacaggcttccatggatcagtgtggctggggactggggcatgagcagggagtggaaggggaaaaggttgtgaggtagtagggccattttatgagccatgtagggaacttggtcattgccctgacagcaataaggagccatcgaggagttttaagcaggagggggctgggtggctaggggtcagggattgacataatacaccttaaaatgattacaagatctctgagaagctcaggccaggtacagtggctcatgcctataatcgcaatgctttggaaagacgaggcaggaggatctcttgagaccagcctgggcaacaaagtgagaccctatctctacaaaaaaaaaaagtttttaattagccaggtgtggtgtgacatgccgctagtcctagctactcaagaggctgaggtgggaggatcacttgagcccaggaattcaaggctgcagtgagttgtgatcctgccactgtactctggcctgggtgacagggcaagaccctacctctaatttaaaaaaaaaaaaaaaagccagttacttgactacatcctggggataattatatgtatctcataaggcttatagtaaggattaaatgaagcaatatatagggaaggcgctataactactgtaactacacccgggccactactacctcataaccttttctctttccactccctgctcatgccccagttcccagccacactgatccatggaagtatgataggagtataaggatgtgttctccactgaacattttagaacctgaattcaagaaatacttgatgggtatctattcacctcactcctccaaaaaaaaaaaaaaggaaagaaaaaaagaattactagaacatggtagttaactatatttttaagaaagtaaaccttcacctgggattgttatgaactgcgaagtaatggcacaagggaatcatggccaagtgtgaaggatttctgtgagataccctatgagaacccctttggctcttcaagtttgcttctgctggagaagttcacaaacccaaggagttccctgactatacttcatttgcgtgtctgattgataaattaagtgttgaattgaactttgcatgcactccagctgagccagttggaaacttgggtggtcaggtgggtcatacttgcagcatcttgaccgtgaattactgtttactgactcttggtaacgttatttagaagattttgtggcactcatactgaacttggtgtcagtatgaaaccacagagcaagaagaagaagttgtatttcttcctggcttctcatagtgacctttccctgctaattctactttatggtaacaagcagatcattcttcttcattgtttaggtagtttattacttactgcttttgtcaccaataggctctgggcctctgaacttttcgaatttgtttctactctgatttttctggtgttcctgatcgttagttaaagaaacactgaggtgcatgatatagtaagcttcaggcattttctatacttcccaatgaacattttaccttcacagcattagtaactaaatctgttacagttatttgtacaactagtaagtaactgccaggcacaccaacatttgaactgaaaatcatttgctttctgtattacaagtagatttaaagcagttctatcctaggggttcagaaggatatcctacaaaaaggagattaggttcctagtagcaacatttttctgtaaacccacaagaaagaagaacaactctcataataagtctaaaagtttacacctctccctgagacctgggaagcgtgtgcctatgtaggaatccctaaaccatctttgaaaggtatttagcccatctggtccagttaattcaatccgttaaacatgatattgagtccaagactatagcagaagtctgttttctagttccttaattcttcctgtaagtcttgcctgccaggctttcggctgtgtgactgttctctcgcagtctgaatgagatagtgattcgtcccagggcactgttgaaaaacaactcagagtcctttcctatagatggtggcttaatggcattcttggtattatgaacattaaatgagatagtgaattgaaagctcttagcagagtacctggagtactccatgaatgtggtttttccttgacttaccaacctcaggctttatattagtagtttgctgtggaagggaagttttagagtcagcaaatttggaaacttgagaaggaagctggagtgagagctcttggcccaaagccaaagtcgttggccttccttctttataactgtggtgttcttcttgagttctgaggtggtgatggtaaactaaaatagcagagagcaacagattagataactgacatttctctcatgctgatttgataatgtaaactaccattactgtaggagtctgaagccgcagcagctgccctcatccctgccccttagcttctgcctaagcctttcctgttctggagcccaacctctccctccttttatttttaagctcttagtagtctgcaattggtggaagggaccttaccacctttagaaaatcaatgatggatttcatgtgcaagcagtgagcagtgtccttattaaatgttcgttgtttctggccctagtaaaatgtactatagctttgtgctttttggatggggatggggcaacagcacatcagtgtgactctgactgcccacttcgttgggtccctgagacaacaagagaaaggaacattactatatagtaaaccctgtggagccaaaaccctaaggatctagatgtcactttaactttcaagcaaaattacttgcctggcagctctcaacagaatggcctattttcatgatcagattcttactcttttcaccacgtgttgtatagtttttggagctcctgggtggatctggagtacagtcacataaaacccctgattgctccccagattttctttccagagccagaggggtaagaatttgggttgatcacccacttttacgctgttcaaaagcaaaagagagactgtgaattggaatttgacaggaagtggggtggcgttatctgggggaacggtgatccccttaacctagtttcagattttaccttgtgtcctttgggccaaaatcaaatgtagtgttaagtagagatacttttttccatttttcaggatctttggatactccccaagttattttcgccacatccaaacccttgcccacacaatctgaagcccttgctacagttataggacagagaaaatcaaagtcggtgaagtcagggccaatttaaggtaacggtaagaataagagcatatttttatcattttcacttgctgactttatactacagcaagagacttagtggctaccaaaagaagttctagcttctcaaaatgacagtgaagttggggctttataaaccaaaacttagaaggatgctcccaaactgggtcaaagttgagctccaaatagtttgctcctataatggtctaccagtaggtggcgctgtggcagtaagaactttctctactattactagaggcttttgtttaaaaatacgaggattttaagacaattcaaataaagaaactaaaaccataattgagttatcacaaagtataacataatatatgggaaaacatgatatttgaaggtaaagttgcagtagttgcaaaagagaatggatatttattattaaggcttttagactagaatttataaactggactttcagattatgggaggcagggagggaacaaattttttttcaaattttggtgaggttgatgaattgtgtttttgctgagttacttaaataaacatatgctataattagcagcaaaacaaactgtaaacctcatcctccatccaaccaaaaaaagctcatacaccgaaggcatggtctaacttgattttgtgaagctgtttccacacttcaccagcactgccgtcagtattttgttcccagccatggccttcaaaattttccagaaaattctgcgaaacttcaaggctttgataattcctttcctctttgttctgccctacacactgatgcattaacggcacacctgccatgaggctaatactcttcttacctctgggggaatatttataaacttatttgagaaacgttattcatcagaataccccaggagtgcaaaagagagaggaaaattatttacccaccacaggattcatttacattggatcagcaagcttcaaatatctttccctagcccatctaaactcttcccagaaaggaatgagaagagagaagggaacaccaaatccatggcttggtcatataccaaaatttactggagaaactgaaaacaaccagagttcttttggtaattcttagccaatggccctttaattctgatactaagcagcctgtccaatgatgaacaactaataaaatatagaagactaaagcaagaaggtcagtatttcccttaggagactggcagccagaagaacaaatgtgacaccaagctccaaactaaactgatggcctgccaagaagtactcatgtccatctgcttctaggactgtgatacttggacctgccacagttataatatcactttccttgaacctcattcattagtatcctttacaatccaccctgaacattacatggcaaaatgggaccatcagcaaaagaagccttgggaaagagcccatttctcaacattttgatctctgttgcagatacagccatgctgagcctgagctgtgtataagcgagggatgactgatgctgtgctttgtgattagctgaggcgatgagacagcatgtgtgtatggacaaagaggacagagtggatcagagggtctcagaagtccagctcctatgacacgactgtcactgctgggaagctgcagagtcaggcccaccagcctggcatgtggccgatggcagtgggctgcatctcttgagcagaagaattaggttgtttacaaagtgaggaggcagaaccccacaggcctcagccctcacctgaagcatgctttctttttattgcaaatgcagtgcaggcagcagaggtcccttcaaccataatcacgaacgaatgtcatcaccggccatgacagtcctagaacctcttcatatgtgggtttagagaggcagtcaggttagagaatttgagttgtgtttgcattacatgttttataaaactgagaaaaacgtcagttgtccttatcagagtggagggagctgtgctgaaggatattaggagcaaagcctgtgtatgacccctgtatgctgcccagggcaagtgtcatatttaaatacctacattgttctttgttttcttagattctgtatttgtctgttcatcagagggctaattatattaactatattttcttattttctgtatgtatatatatatttttttagacagggtcttgctctgttgcacaagctggagtgcagtggtgtgatcacggctcactgcaacctccgcctcctgggatcaagcgatcctcccacctcagcctcctgagtagctgtgactacaggcatgtgccacaatgcacagctaatttttcatatttttagtagagatggggttttgccatattgcccaggctggtctcgaacccctaagctcaagcaatccacctgccttggcctcccaaagtgctggtattacaggcgtgaaccaccacacctggccattttctgtattcttagtgccctggcatttgggatccttgcaggcccaggcgagagagtgcctttcacagggctagttaattcctaaacgtagtaacaacttgtccatgagcacatcttttatatgcaaaccaaccagtcctgagtatctacacccaacctccttatcaaactttcacacaccaacccaaaatttcccctgccctaaaatcgtctcagggccaggtaccaggcaactagataccatccctataccctgaagccccctggaattatctaaactagccaatccagccaatccaaagctgtttaattgccctgccttgcctttcctatggaagccccagcaaaggttctgacctaggcttttccccccactgctgtcttctgcctccagactgacactggtgcattcactgtgaccctgcttagtgtgcagtgaccccctctctgggagctgtcagaataaacgataccttccttcggagccttgtttttgttttcctcctgtggccacaccaactttgacataccgtatccaacatgtacattcttagaacaaacattaagaggataaatatctttaacttgcgatacaaggaaccaggaagaaccatgaattaggtttacatcacccagttctaagcaactgggcatagcacttcatccgtagcctgtgttacacaagtgatgttttaacagtatgtgttttgctggcattgacctggctgtagccacacaagaaggatgtggatccctctacatggcagaatcacctggctgtcagccattgaagtgcatgcgttcctgtcctgaggcctcttgcatttcatttagtaactgtttctacattcagaaacaaaacccaagtatagctgaacaacctggttggaagtgaggaagaagacagcctggcttttagtttgggggagagaataggggtacttctaagaatctatccaaaaggggttcattggccttgaagaaaaccagagaactccatttctaaaatggattaagagataggctatggaggaagataacatctgaaaattgatatttttttcttgctgaactggcaaaatcccaagagaggagtgatgattcttcagttattaacaattactactttgttataaagagacacgggaagtacagtggcccctttctcaaattacacttacattacagaagcacacacacctcttggaaaaaaatgcctggcagcctggattgttagaattgtgcctactcctacatcttgctgcagagttgtgtggtcctgtgtaatatccatgcactttggacagaagacgatctagtctattcttgcagtcctgaactgggcaagtaaccagcataaggctgcccttctttctgtctttatatatatcactccaggttatcgatctgttcactgtggttatccatcctgtgaacccacacatcttatagccacatacctttgctttattgtcctcatatcctcagggcataattgctcctgaaagttctaaagaaagaaaatgacatgctaagccacgcctgtctttggaaaaagcaagctttccacacggaaatatttacacctctgcttacctgatctgtagagtttgaaccaggtcccaaaaagtgtaggtagataatagcagggcttggagaatgatgacttgaagtgtattgccctgttggcatgatttgtattgatttttatcctgtattctttcaaattgtgattataaagaaaaagactcagattctcttaagtcctcaaaatgaagagcattactaaaactaaaacagtagtctcttatacttctttgttctcgtcttttgaacatgcaggtatttccagtttgcaccatagatgtcaaggggctcccttctcttaaaacttgaatgcagggtttttttgttgttggggggtgggtggttggttgcttttgtttttgtttttgtttttttgagtcagagtctcgctctgtcacccagccagactggagtgcagcggcatgatctcagctcactgcaacttccgcctcccaggtccaaacaactctcgagccttcgcctcccgagtagctgggattaccggcatgcgccaccatgcatggctaatttttttttttaatttttagtagagacagtgtttcaccatgttggcccggctggcctcgaactcctgacctcaagcgatttgcccaccttggcctcccaaagtgctaggattacaggcatgagccaccgcgcccagtctggttatgcagttagttgataccagagaggagtagcttgaatgtgtggacttgccttcgctataataaaacatagcctctatccccattataaaatggggaaagaagttagaaaaccaacctgattttaagatgatgaggtgaagaaaaagcagctgcttagaagttgctgtatgtatcatttagttgtttggtgttggttagaagaatcactcttattttaatatctaatgaactgaaaagtgagagtgaggtattttccttccctttttatttatttgtaatttgattcccagggaaattaagacttgtgacaagcccaaatgaagatattttggaatttgacaggagagttttttaacttatgcctaagcttcaaattatattaggcaataaattattgatagtttttaatcagatactggaatatggaattttcaaaatcacaactcagaaaaatgaccgctcacaggccttctgttttatatttattcttcctttttagtattctccaaaattaatcatcatcgtacatgtgtacatttattcttattattaccacaagagccttctgatgatcgagaggagagagaccctcagttcacctctggaagggaagttgttgtacatgagcacagggaggaatcagtctcaagagccagacctcctgaaaacctgcagcgttgctgagagaatcagcagctttactggctgaacagcagctcgggttagcccatcccgtggccaggtcatttgctggctcctccgcagccagcttccattgttgtctaggctgacagctccgccctactcatgacgtgactctctctatgggattgtttctctccttttttttttttacattcagttttcagaagacagaatggaatacttctcattcattcctccagcaaagtgcccctggtgggcagagctctctctcccaggccttaactggcctaaataaagtgggtggcagctgccttccagacagatgccagcctggtactagggtagtatgattgtgtgatacaaagctgccaatgtatgcatgtctgaccattttttcagatgggattgtagctaggcaggtacagcatagccttttcatgtccagcatagggtcttaaaatataaaaccacatgcaataaaataacaaggtataaagggaaagtcagggccaaaaaacaagataattccaagttttcaaatatcagcctaaataaacttattgtcgttgaggtgaaatttggttctaagattcctaataggcagggcaaacagggaaacatgataaattggagtatatagttctcacaatcaaaaaggaagaaatactccagggaaagtcaagatatttcctagtattggttctaaaggaagtattttacatactttatatacaagacacctaataaagtagtagtcaactgctaatgaactattaaaaaatagtcaatagtagcttctcagtcaacaggccaatagagtgctgtgtttcatatgcctactccttggcatgaactgtgcaaagataaaatattatagtacacgtcaatgaagacagttttgtgaggggacaaaaggaatatagtctaagtttccttgtggtcttcgtaatccaagggtaagataatggttatttagaggattgggtgaattgcatgtgtcttaggcaatcctaaatataacttctctcaattgattgcttgataagaactagttgtgctcttaggcaaggatccagatacctggtcttttatcttactgtttgaagatgcgtctattaatatatgcttgggaaagcaggtggcagaggtaacatcttctgaaagctttggcagctaagcagtattctcgctctatcatgtggcatgttgattgtctgctccctgactcccatacacagtttcctctgcctaggcaccatctccccacttttgctccctccctccccaatatgcctattcctgtttgtcctcaaccacttttctcctgtccagccctaccctatgttaatctgatttagatgcttttgactctgctctttagaactctgtaattacctctatcatggcttttacaatactctaggatctttatggttacttaactgctccctctactaagcttgaaatttcctggaatgcgaggatcaggtccaagtggactctaaaactctagggtctagcatagtgcccagcctgtagtaggggcttaagaaatcccaattcagaaaagaaaacaaaaaataataaggtgacaaataaataaccaaaaataaaaaagaaattctgattgaatagatgaatgagtaaattttcatatttctgcctttttttattcttctactgacatttggaatacctgcctacatatgcaaattcttcctattcttaggccaagctcagtggctcacacctgtaatcccagtactttgggaggccgaggtgggcagatcactggaggccaggagttcaagaccagcgtggccaacataacgaaaccctgtctctattaaaaatacaaaaattagctgggcgtggtggcacacgtctttagcaccagctactcgggtggctgaggcagaagaattgcttcagtccagggaggcagaggttgcagtgagccaagattgtaccactgcgctccagcctaggcgacagaggaagactgtttaaaaggaaaaaaaaaaaaaaaaatatatatatatatatatatattttatcccctaagggcccagttaagttttttgttttgttttgtttttgtttttatttgtgttttgagatgagtcccgctctgtcactcatttatcttgtcgtttaaaaaattcctagagacctacaatttatatcacaaagtttaacacttcttcagattttgtcatcttttatcactgcttactttttgggtgaattgtctcttcaataagaccataaactttttgagggcagaattatatctgtatgtttcttcaatccctagtaatacccaaaatgtttcattactttgtattgtagaccctaaagaaaagaacacatacatacataaaacttttctgaaaaatagtccatttcctctgttctcctggatttaagtcaaatgcctaacctcagaagataaaatcttctaatgaagatttcataaaaaatgcattttattattaaacagtcttcaaaatcagaataaccttccttataaattacctggtatttctatcccatttcttgcaacattgtaaaactacttcctgtaaaataatgaatgattgatcactactcttgttttttttttttttttttttttgagacggagtcttgctctgtcgcccaggctggaatgcaatggcccaatctcggctcactgcaagctccgcctcccaggttcacgccattctcctgcctcagcctcctgagtagctgggactacaggagcctgccaccatgcctggctaattttttgtattttcagtagagacggagcttcactgtgttagccaggatggtctcgatctcctgacctcgtgatccgcccaccttggcctcccaaagtgctgggattacaggcatgagccactgtgcccggccgatcgctactctttagataacaacatctgctacacattcccaaccttactataacttgttacatggtagatttcagtatgaagatgttccattttagaccacattcaagaatctcattataagggaacaaagttaaaatgagattgaatttatttggaaaacattcgctttcagctttttttttctcccctctacatcacctaactaactggaattgtttattgcacagatcagatttctcttttgaacactgaactgtctttcttatcttctgaactcaccatgaattctttaggttcctcttaagttgtgtaatacctgaaactgaacaccacactctaatctgacaggtgttgagtattgtgtaaaatttatcatcatggttccggagtcatatgttacactttaaatgtgcacagtattcccagaaacaaaaccaaagttctctcaacccttacttgttaccttccttacttctttttgcttcacagggccatgcagcattaccactgctgttgtcagtaacaatacctaagttttgtaagaattccagaatgcagggtggaaagatcataactgtgaagttagactgacctgtgtgggccctgtcactgtccagttggcaactttaggctaatcacttaacctctttcagcctcagtttcctcatctatacaataagcataaaaatatcaatcttgcaggattgggatatgaagatgatagattgcctcaatagcaacagcaaaaattcctgtataaaaatgggttagaatagacattcaaagaagatatgcaaataactaataggcacatgaaaagatgctcaacattgctaatcataagagaaatgcaaatcagaacccatggtgagataccacctcacacctttaggatggctactattaaaaaagcaaaaaataagtcggacatggtggctcctgcctgtaatcctagcactttgggaggccaaggcaagaggatcactggaggccagaagttcaagaccaacctgggcaacacagtgaaacaccgtctctacagacaataaaaacaattagacaggcatggttgcacacacctgtagtcccagcttcttgggagacagaggcaggattgcttaagcccagaaattcaaggctgcagtgagatatgatcgggctgctgtactccagcctgggtgacagagcaagactgtcacaagaaacagagagatagagagggatgaggggaggagagggaggggaaagggaagaaggaaagaagggaaggaagggagggagggagggaagaagggaagggaggactaaaaactaacaagtactggggaagatgtggagaaattggaaccccggtgtactgttgggaatggaagatggtgcagctactatgaaaaacactatggtggttcctcaaacaattaaacatagaattactggccaggtgcagtggctcacacctgtaatcccagcactttgggaggctgaggcaggaagactacttgaggccaggagttcaagaccagcctgggcaacataaggaaaccctggttctacgaaaaataaagtagccaggcacagtggcacatgcctatagttctaactacttgggagactgaggtgggaggatcacttgagctgggaggtcgaggctgccatgatccatgatcacaccagggcactccagcctcggtgacagagcgagactctgtctcaaaaaaacaaaaaaattgaattaccatatgatccagcaatttcattctgtgtgcgtatgcccaaaagaattgaaagcagagacagaaacagatatttgtatcctcctaacagcattattcacagtaatcaaaagacagaagcatcccaagtgtccgtcggcagatgaatgagtcaacaaaatgtggtctatgtattcagtgaaatactattcagccttcaaaataaaggaaattctgcaataagctacagcatggaactttcaggacgttatgctaagtgaaatgagccaatcacaaaaagacaagtactatatgattccacttatacaaggtacctaaagtagtcagaatcggaaaggtagaaagtagaatggtggtcagcagggggtggggagagaggggaataggatgtttttgtttaatgggcacagagttgcagttttgcaggatgcagagttctggagctgaatgatgggatggtcgtgcagcgtgaatgcacttaatgccactgaactgtacacttgaaattgttaggatggtaaagtttatgttacatgtattttgccacaatttttaaagaaagattatagattgtgtatgtattataccccagattaggtgtttttgttttctcgattttgcatttgaggaaactaaggctgagagaagttaagtagcttgtccaagccacacggtcaatgatggagctgaaattcacacccaagcagtttttttctagaagctgctgaactgcttcttcatctgaaaactcggcccgtcaaggtgatttcattttatcagcttcctttcctaatggagctaagcggctggtgatcaggccctgtggcctccgcctccctgcagtgtctggttgttatctcaaatggctcattagggggatgcctggcagtaggggggcatgtgtagtttaggctggctgtctctttatccagccatttaactttctcttatttagatggagccagacctggagagggaggataaggagcaaggtgggccttctgcctctactcccctgggtgggggtgatctgggatctttcccacatgcccgaaccgccttcgaagggacagcagttctggttggcagaggaaacatggatgtagatgaagctctgcagcagagggtggagctgaagtgaggaggtaggaggtgggggaaaagccgagagggcttgggaatcacccctggattagttaagagagcattccctgcaggtaacagaaactccgagaaatcagtggcagggtaagtaagggatttatttttctcacatgtcaaaaagtctggagacaggaggtccagggctagtgctgctcttcagagacataactgaggagccaggctgctctctttctgctctactaactctaatgcattggctttcattttgctggtcataagatggtttctgttcctaccggcattgtgtccatgtttcagtgagaagagggggaagggcaaaagacagatgccaggtcaatctgtccccctttcaaaaacactttcttggaagcccagcagttctaactaccatatcattggccaacactggctcccttgcctacttctccttagcaacagaggtgtctagagaggtggtcttttagctgggcacattgccttcccagtcagatctgggctcttttattgaggaagaaggggggatggctaatgatatacatctactggtttcaatcacagcacattttctttccagagactccacccctgctggaggaacttcatcacacttctgcagcccctctaccaccagcttcttgactgctataaatagatacgttgttccttgacccaaatttgccccagtcctgtctactagtacatggagttgggggtccctattacctttcagttacagtaacacatgagagccctcatgtttctggaagtgtttaaaaggtcaccgtaaatgaggaagatggaaaaaatgagccatagagaaaaaaagtaccctataaatatacttatcaaaattataaatttgctctgagtacaatataaaattatgatatatcacattcattcacataaattatttactatttgattatccttcagctgaataatgactatgtatactcttaaattatggagattaatattgttataactttaattttattatgatagtaaattctgttcacgaatgttgtcttcctaagatttgctcacagtatagctgctttaaacactgagacaagttattaatgattcctgtttcatttaaagaaaagcttctggccagtcgcagtggctcacacctgtaatcccagcactttgggaggctgaggcaggtggatcacgaggtcaggagttcgagaccatcctagccaacatggtgaaaccctgtctctactaaaaatacaaaaattagctgggcatggtggcacgtgcctgtaatcccagctactcgggaggctgaggcaggagaattgcttcaaccagggagtcagaggttgcagtgagctgagatcacgccactgcactccagcctggctccagagcaagaccgtctcaaaaaaaaaaaaaaaaaaaaaaaaggaaaaagaaaaagaaaagaaaagcttccttgtgctcaggtctttgctgagattctccaaaaagaataggacagggaggggcctggtaacttgaaaaatccaaaacagaagttcactcagcagtatggagtcataattttaaaaaaggattttaatctaatagtgaatataaagctacagtaaccaaaacagtatggatgggatagaattaaatgtccagaaataaacttatatatcaaatagccaattgattattcagtggactagtctcttcaacaactattcagtggtaccaagactattcagcggaatagtctcttcaacaactggcatttgaacagttggttatccacatgcaaaacagtgaagttggacccctgtttcacatctacacaaatattaaccaaaaattgataaaatacctacatgaaagggctaaaactataaaattcctagaagaatacataggaataaatcttcatgtcgttggattaggccacagtttcttagctgtgataccaaaaagtacaagcaacaacaaaattagacaagttggacttcatcagaattttaaaattatgtgcttcaacggataccaccaagaaatgtgaaggacaaaccgggtgcagtggctcacacctgtagtcccagcattttgggaggccaaggcaggcagatcacttgagctcaggagtttgagaccagcctgggcaacatggcaaaatcccatctctactaaaaatacaaaaattagccaggcatagtgcctcacgcctgtaagttccagctactggggaggctgaggtgggaggaatgcttgagcccaggaagtggaggttgcagtgagctgagattgcaccactgcactccagcctgggtgagagtgagatcctgtctcaaaagcaacaacaacaacaacaacaacaaaatgaaatgtaaaagacagcccacagagtggcagaaattatttgcaaatcatttatatggcaagggacttgtatccagaatatatacagacctcttgtagcccaacaataaaaagataacccaatttttttttaaatttaagttctagggtacaagtgcacaacgtgtaggtttgatacataggtatacatgtgccatgttggtttgctgcacccatcatatttctcctaatgctattcctcccccagttccccacccctcgacaggccctggtgtgtgatgttcccctcgacccctgtgtccaagtgttctcattgttcagttcccacctgtgaatgagaacatgcggtgtttggttttctgctttgtgatagtttgctgagaatgatgatttctagcttcatccatgtccctgcaaaggacatgaactcatccttttttatggctgcatagtattccacggtgtaaatgtgctgcattttcttaatccagttctgtcactgatggacatttgggttggtccaagtctttgctgttgtgaatagtgctgcagtaaacatacaagtgcatgtgtctttatagtagcatgatttataatcctttgggtatatacccagtaatgggatcgctggatcaaatggtaattctagttctagatccttgaatggttgaactaatttacactcctaacaacagtgtaaaagcgttcctatttctccacatcctctccagcatctgttgtttcttgactttttaatgattgccattctaattgacatgagatggtatctcgttgtggttttggtttgcatttctctgatgaccagtgatgatgagcattttttcatgtgtgtgttggctacataaatgtcttcttttgagaagtgtctgttcatatcctttgcccactttttgatggggttgtttgtttgttccttgtaaatttgtttgtgttctttgtagattctggatattagccctttgtcagttgggtagattgcaaaaattttctcccattctgtaggttgcctgttcactctgatgatagtttcttttgacatgcagaagctctttagtttaattagatcccatttgtcttttttggcttttgttgccattgcttttggtgttttagtcatgaagtccttgctcatgcctatgtcctgaatggtattgcctaggttttattctagggttttatggttttaggtctaacatttaagtctttaatccatcttgaattaatttttgtataagatgtaaggaagggatccaatttcagctttcttcatatggctagccagttttcccagcaccatttattaaaaagggaatcctttccccattgcttgtttttgtcaggtttgtcaaagatcagattgttgtagatgtgttctgttatttctgaggcctccgttctgttccattggtctatatatctgttttggtaccagtaccatgctgttttggttactgtaaccttgtagtatagtttgaagtcaggtagtgcgatgcctcctaagctttgctctttttgcttaggattgtcttggcaatgtgggctcttttttggttccatatgaactttaaagtagttttttccaattctgtgaagaaagtcattggtagcttgatggggatggcattgaatctataaattaccttgggcaatatggccattttcactatattgattcttcctatccatgagcatggaatgttcttcatttgtttgagtcctcttttattttgttgagcagtagtttgtagttctcctcgaagaggtccttcacattccttgtgagttacattcctaggtattttattctctttgtagcaattgtgaatgggagttcgctcatgatttggctctttgtttgtttgtttgtttgttactggtgtataggaatgcttgtgatttttgcacgttgattttgtatcctgagacttggtgaagttgcttatcagcttaaggagattttgggctgagacgatggggttttctaaatatacaatcatgtcatctgcaaacggacaatttgacttcctcttttcctaattgaataccctttatttctttctcttgcctgattgccctggccagaacttccaacactatgttgaataggagtggtgagagagggcatccttgtcttgtgccggttttcaaagggaatgcttccagtttttgcccattcagtatgatattggctgtgggtttgtcataaatagctcttattattttgagatacattccatcaatacctagcttattgagtgtttttagcatgaagggctgttgaattttgtcaaaggccttttctgcatctattgagataatcatgtggtttttgtctctggttctgtttatgtgatggattacgtttgttgatttgcgtatgttgaaccagccttgcatcccagggatgaacacttgatcatggtggataagctttttgatgtgctgctggattcagtttgccagtattttattgaggattttcgcatagatgttcatcagggatatttatctaaaattctctttttttgttgtgtctctgcggggctttggtatcaggatgatgctggcgtcataaaatgagttagggaggtttccctgtttttctattgactggaatagtttcagaaggaatggcaccatctcccctttgtacctctggtagaattcggctgtgagtccgacaggtcctggactttttttggttggtaggctattaattattgcctcaatttcagagcctgttattggtctattcagagattcaacttcttcctggtttagtcttgggagggtgtatgtgtccaggaatttatccatttcttctagattttctagtttatttgtctgatggtagtttgtatttctgtgggatcagtggtgatattccctttatcattttttattgcgtctatttgagtcttctctgttttattctttattagtcttgctagcagtctgtcaattttgttgatcttctcaaaaaaccagctcctggattcattgggtttttttgaagagttttttgtgtctctatctctttcagttctgctctgatgttagttatttcttgccttctactagcttttgcatttgtttgcttttgcttctctagttctttccattgtgatgttagggtgttgattttagatctttcctgctttctcttgtgggcatttagtgctataaatttccctctacacactgctttaaatgtgtcccagagattctggtacgttgtgtctttgttctcgttggtttcaaagaacatctttatttctgccttcattttgttatttacccagtagtcattcaggagcaggttgttcagtttccatgtagttgtgtggttttgagtgagtttcttcatcttgagttctaatttgattgcactgtgatccgagagacagtttgttgtgatttctgttcttttacatttgctgaggagtgctttacttccaattatgtggtcaattttagaataagtgtgatgtggtgctaagaagaatgtatattctgttgatatgggatggagagtactatagatgtctattaggtctgcttggtgcagagctgagttcaagtcctagatgtccttgttaattttctgtcttgttgatctaatattgacagtggggtgttaaagtcttccactattattgtgtgggagtctaagtctctttgtaggtctctaagaacttgctttatgaatctgggtcctcctatattgggtgcatatatatttaggatagttagctcttcttgttgaattgatccctttaccattatgtaatggccttctttgtctcttttgatctttattggtttaaagtctattttgtctatgtattttaaagactaggattgcaaccccagctttttttttttttgctttccatttgcctggtagatcttcgtccatccctttgttttgagcctatgtgtgtctctgcacgtgagatgggtctccttaatacagcacactgatgggtcttgactctttatccaatttgccagttcgtgtctttcaattggggcatttagcccatttacatttaacgttaatattgttatgtgtgaatttgatcctgtcattatgatgttagctggttattttgcctgtttttttttttttattgatcattcttgggtgtttctcgcagagggggagttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgattcttaatgagcatgctgccttcaagcatctgtttaacaaagcacatcttgcaccacccttaatccatttaaccctgagtggacacagcacatgtttcagagagcacagggttgggggtaaggtcaccgatcaacaggatcccaaggcagaagaattttttttggtacagaacaaaatgaaaagtctcccatgactacttccctctacacagacacggcaaccatccgacctctcaatcttttccccatccttcccccctttctattccacaaaaccgccattgtcatcccggcccgctctcaatgagctgctgggtacacctcccagaccgggtggtggccgggcagaggagctccccacatcccagtaggggcggccgggcagaggcgcccctcacctcccggatggggcggctggtcgggcggggggctgacccccccacctccctcctggacggggcggctggccaggcggagggccgacccccccacctcactcccggacggggcggcaggccgggcagaggggctcctcacttcccagtaggggcggccgggcagaggcgcccctcacctccaggatggggcggctggtcgggcggggggctgaccccccaacctccctcccggacggggcggctggccgggcgggtggctgacccccccacctccctcccggacggggcggctggcctggcgggggctgacccccccacctccctcccggacggggcggctggcctggcgggggctgacccccacctccctcccggacggggtggctgccgggcggaggggctcctcacttctcagacggggcggttgccaggtggagggtctcctcacttctcagatggggcggcctggcagagacgctcctcacctccgagacggggtcgcgaccgggcagaggcgctcctcacatcccagacggggcggcggggcagaggcgctcctcacatcccagacggggcggcggggcagaggcgctccccacatctcaggcgatgggcggccgggcagagacgctcctcacttcctagatgggatggcggctgggcagagacgctcctcactttccagactgggcagccaggcagagggtctcctcacgtcccagacgatgggcggccaggcagagacgctcctcacttcccagacgggctgggggcccggcagaggctgcaatctcggcactttgggaggccaaggcaggcggctcggaggtggaggttgtagcaagccgagatcacgccactgcactccagcctgggcaccattgagcactgagtgaaccagactccgtctgcaatcccggcacctcgggaggccgaggctggcggatcactcgcggttaggagctggagaccagcccggccaacacagcgaaacccgtctccaccaaaaaagtacgaaaaccagtcaggcgtggcggcgcgcacctgtaatcgcaggcacttggcaggctgaggcaggagaatcaggcagggaggttgcagtgagccgagatggcggcagtatagtccagcttcgccttggcatcagagggagaccggggaaagagagggagagggagaccgtgggccgtgggccgtgggccgtggggagagggagagggagagggagagggagaacttgtctatgtattttaaagactaggattgcaaccccagcttttttttttttttttttttttttttttgctttccatttgcctggtagatcttcgtccatccctttgttttgagcctatgtgtgtctctgcacgtgagatgggtctccttaatacagcacactgatgggtcttgactctttatccaatttgccagttcgtgtcttttaattggggcatttagcccatttacatttaaggttaatattgttacgtgtgaatttgatcctgtcattatgatgttagctggttattttgcctcttaattgatgcagtttcttcatagcatcaatggtctttacaatttggcatgtttttgcagtggctggtaccaacaacccaattttttaaacaggcaaaggatttgaatagacatttctccaaaaaagatatacaaatgaccaatgaaaagatgcatcattagtcattagagaaatacagatcaaaaccacagtaaatgccacatcacaccactaggatgactgtaatcaaaagacaggtaataacaagtggagatgaggatgtggagaaattggaatccttatacactgctggtggaaatgtaaaatggcgcagctggtttagaaaacagtttggcagttcctgaaacagttaaacatagagttaccatatgaccttacagttccactcctaaatatacatttaggagaaatgaaaacatatgtccacataaatgtttgtatacgagggttcatagcaacattattcataatagccaaaaatgtggaaacaacctaaatgttagccagaaaatgaagtgataaacaaaatgcagtgtatatatacagattgcctaggaactggggctggcgggggccgagaaatggggagtgactgctaatggcattgggtttctttttggagtaatgaaaatgttctaaaatgagattgtggtaatggttaccccattttgtgtttgtgtttttgtttttgttttaatttttgtgggtacatagtaggtgtatgtgtttatggggtacatgagatgctttgatacaggcatgcaatgtgaaataagcacatcatggagaatggggtagccatcttctcaagcatttattctttgagttacaaaacaatccaattatactattttataacatacaattaagttattgttaactataaccaccctattgtgctatcaaatagtaggtcttattctatttattttttacccattaaccatccccccgttttgtgtatacaataaaaaccaccgaactgtatactttaaatgagtgaattttattaatatgtgaaatatatcacaataaatctgaaagaatcaatagttaatatttagaaagtaagaggaaaaaaaagcccttcaacataagcaaattgtcttcacatcttagatggacaaattgttgatcaatacgtatttagtgtgtcctgttcattcgtccaacaaataatttgactgcctcccgtgtgtgaagtgtgttctaaggtcttaggcagaaagatgtctgggctctgctctgcccctgctgttttatcctcccaggaaaggtggtgtgcctaggggacagcagctgtccctgggcctggcctcactctctttttccctgtttggaaaggtgtcaggctcccgagtatttctgttgctttcgtcagcacagagcaaggaggaccttgactatagtttcacagccttaagcttcacctcatgcttcaaatccacgaaagagcagctgagaatggggctagctgtgccaccaattgcttctctcccattgttaatccctttaattctgctgttcctaggcacccctccctgacaccatcctgttgcccacttgtgatgtgattgaacaagtggtttggcctttgaaaggtgattcttagagatacctcaagtgacccagcccctggtttgctgggatgctcttggtgttcgtttccatggagcaccagagattgtctgtaggcgaaaccctttccaaccaaacccaactcaaaaaggaggtaactgccactgacctcctctgagatcctggcctagccgccagggtcattagggaaagcagcatttcattgcttagcaaagatagtgagaaagctccagttctttttggctcaaacagaagagtttatgtcctgacacctgagttattaaattatggcacagctagctctgtgatgaatgaatgacaaaaacatatatatatatatatatatatatatcactgtatttctgctttactctatcatttcctgggcaaaatgttattttatttataaaattcatccatctctttcacaaacctcagcttttatggcaaaacacacagacacgcactgagccacttttcagcctatatgtactcttttcagagagcattagaattaaactaattagaattcctccctccctcccctgagattgatgtatttctcagcattctacgatgcttattacactaaaaaaaagacaacttcctaatggcgtgaggacagagaaagtggcatgtgtgttgggggtaaaagggaatattcgagcattaacctgcctggtgatcgcagggcacaaggaaagcctcttctgtcctgggctgtccccttagttgtgataggaaggggagtagcaggaaatggaatctgccctggtcatgggattttttgaaagaaacaaagcatgatctgatgaagagcaggttaatcctgctatttcatttcccttgcagaaagggtgggggcaggattgtgatatgaagtatttagtttcacatctgttccaggaattatcctcggcataaatccatttttcttttaagcatcgtaaagcatcccagggagctcctcctcctgcccaccctccccacccccacagtttatttcgtggccacggagcagctgacatacttccagagagatcatcttgtcattgtacacaaggagggaatctctgagtcttagaagtcagaatttctgtggatcagtggtatcaattttgtgtactgctttccatgaagtgtttagaataaaactaattagcatagcagcagcgtagtataatgaaaagagctctcaatttaaaattagaactgattctcatctcagctttgctaccatttgtgtgaatttgggcaagtcaccaaacctctttggtctcagggtcctcatggtttcccaaaatgtgttcacaaaatacaagtcttcacagtcaaataagtttgacaaatgctatttaccctatgccacttcttagagttgtaatatattaacatattaaagactctgaaaagtctttcaataaagataccttttttttttttttttttggtggggatggagtctcgctctgtcgcccaggctggagtacagtggcacgatcttggctcactgcaacctccgcttccgggtttcaagcaattctctctgcctcagccgcccaagtagctgggattacaggtgcccactaccacacctggctaatttttgtatttttagtagagacagggtttcgccatgttggccaggctggtcttgaactcctgatctcaggtgatctacccacctcggcctcccaaagtgctgggattacaggagtgagccactacgcccggccaaagatacctatttttcactcagcatttcttaagtttatctgacctggaaccatttttcctataatgctgattagtatctcgtcactttgagaaaggaggttcaagtccaaattgctggtaatctatataatctgtcacacgtcatggttaccaaactcagtttaaagtaacttttcaaacttcaaatctcattatttggaaaaataaaaataattttatatatggcaaggggacttctaatttaaaaaactgaacgtaagcaccaaagcaattaagcagaccagtacagacttgtaactagagttgcgacaaagtttctttgacttctgttttctattcccacctttcagatgtttggtgttctcctgtggccttgcttgtatggtctattaattattctttgaataactaattatgctcagcacaatactaggtgcatgtaaagaataacaaatccaaagatcctaacctataatgtagagaatgaacacatacaaggtaaaacagaatttcaaattgtagagtaaggcaaaagaatgattacaaattcatatgttgacagatactagcacaggttgagtatacctaatctacaaatgcaaaatctgaaatactcaaaaatccaaaactgtttgagtgctaacgtgacactcaaaggaaatgcacattggagcattttggattttggattttcagattagggatgttcaaccagtaagtataatgcaaatattctaaaatctgaaaaaaatcaaaatctaaaacacttctagtcacaagcattttgaataaaggataatcagcctgtatatattattaattaaatatctactgacgtttcttgcagagaacaagaaattcacggaacaagtggatcagaggtcaagtgggagataagtgacggggggaaatgcaaaaataggattaggcaaagaaagcacttttatggttctgagagaaagaagcgatttcacctggtataaatattgaggctaagattaagttctaagatcaaccttagccggacaatcctaacatcatttaaaagtctggctatgataaatcttttgagaaatcagtaagggcagtttatttaatcactcagcttagagaaatatcatccatatatttagagtgttggtctttaacaacactgagtttttgggaatgttggctttccctttctaccgctctagctgttccttcttcctgataaagctccccatccttgcttgcttgttaattttcatattattctctaagatcctgtccttgatctgctcccgtagtttcagctgacctccatctaggacaattccaaacctgttcctccagccaagactgtcacatatggcttcaaagatttgttgtgcccagcacaattctggggcaccatacacaccaaacatgaacataagtagtacttctcctgctcacacgtctctttggatccatgttccccagccacctctagacgtgtctcctgaagggatcactggcatctcaggtgtaacacatccagaactgaccttatcatcctctcaagacacacccctcctctggtccctcctgttcaccttcattagaggtaaagccagaaactgagaggcatgtgagctcctcccctcagtccgcatatttgattatcattattatacttttccctttaaatatccctcagttaacaacttaacaagtccaatttcattcatatccactgccttaattcaaacacataacactttctgtttgaattactacagtgttttccagacggatctcttcatcctaagttgtatcctgcctttatcctccacactgctctaaaagtggtcttttagaaacaattatgactatgatgcttccccactaaaaagtcttcagaagctccctttaaagtgcaaactctgtaagtggattgccaaagccagtcatggtttgctcattaaagaccactccccagccactccctcaacacataggtttaaattccagtcattctaaagtacttgccatgctatcccaaacttcttcaccattgcacaagatgtttcctcttcctagaaatcccatcccttactatcaactcctgtagcaccctttgccttccattgtaacagaatttgctacaatgttttattttattttacttattgccctctaccactagattattaagtcccaaaaggattggggattatgtcattcacctctgtatcaccagtgcttttcatagtactgggcatatagtaggtattcaatacataaatatgggataaaaggtaaatttctattgctattgtaaggtttagcattcactgaataagtggctgtacagtggtaagatcagctatgcaatattcatatcttgtaaattatgggtattttaacaactacttctgtacttcttgtgtcctttggacttctgagaggaaacagaaactccatgcatctttgtaatcaactttttttctgatattcggaggctattctacttcattcatccagaactttggggttgggaggaaccaaaaaacaggcctagagtggagtacctatctttaataagctaaagatattaacttcactatatactgatgttaaaaagataaggagattttatacaaatcatttagaattgactcagtagcaaactagggtgtatatgtccatacttatgaattcaccattttcacgatggagttttttgctgtttgcctctacttctcattcatcccaacacagcctgtatggggaaataaaaagtaaaatagaatgttaacaggccattttatttttttttactgttttaacccatgacttcaaggaagaaagatgcaaacaaatacacaaggtgaactgctgtggtagaaaaactccagacttagtagcttctattctcattcctggcacttagtagctgtgcactctgaagcgatttagttaacctctccagactgttttgtcactgtgaaatggaaatacgttcatttagaaatatttttaatgcctgtgtgtgtgtgtgtcaggtgctttgctatgcactcaaaatagttgccatgtcttcttcatgaggttgatgtgaaagctggatgagatactgcctgtgagagcgttgttggtgttgttttttgtttattactatcaagtgacacctagaacgatctcagtcttcagtcagcgaagactccgttactttgacagaaaagtacactgattcatttgtagcaaagtttgaagcaaagaaatatttgactttagccccaattcagagaaaagtttaagtagccccaatcttctttgcccaagcattctagttaatacagttttttattgataggtgaagttgttattgtattattgtctactgccacataacaaattttacctgaaaacttaacggcttaaaacaataaatatttggctcggcacagtggctcacgcttataatcccagcacttgggaggccaagacgggaagattatttgagcccaggagttccagaccagcctggacaagagtgagacctcatctctacaaaaaaaaattaaaaaattagccaggccgggtgtggttgcatgtgcctgtagtcccagctactggagaggctgaggcaggaggattgcttgaaccctggaggtcaaggccgcagtcagccggatcatgctactgcagtccatcctggccgacagattgagactctatctcaaaaaataaacacacagttattatctcacagttcccatggatcagacttcttaggttaactgagtgtctctggctcaaggtctctcatgaagttacagtcaggctgtcagctgggagcagtggtctcattggaaggataaactggtgggatctgcctccaagttgtggttgttggcaagcttctttccacttaagcttctctaaaggctgctgttatggactgaattgtgtccacctcaaaattcatatgttgaagccctaacccccaatacctcagaatatgactgtatgtagagatagctcttttaaagaggtgataaagttaaaatgaggccatgcggcagggccctgctccagtgtgacttcttacaagaggaggaaatatggacacacaaggagacaccaggtatttgcacacatagaggaaagaccatgcaaggacacagcaagactgtggccatctgcaagccaaggaaggaaccaaaccagccagcacctccatcttgggctttgagcctccacaactgtgagaaaatgagttcctgttatttcagccacttagtatgtgacattttgttatggcagccctatcaagcgaatacagctggcttatcccatagtggctggcctcccctgagccagaaagccatgagagcctgagaaagctcccacagcaggagccacaatctttttataacttaatcttggaagtaacatcccatactttctgcagtattctctttgttagaagtgattccagtgcacacccaaggggaggcaattacataagggtatgccttccaggaggaggagtcacagaggtcattaaaaggctgcctgccatactagtttggggttgcttttaaataagttaaagtaaagcatttagaggtggacagattggcaacttttacgtgatactgtagattcaacctcaccaaatacatgagcactctgactaacttaatctataagctatactctcattctgtgaacctaagattgttatgatctgtaagataaaaacttttgacatttaagacaaggttttctgggggacgaagaacattttaatggactagattgaagagaaaaggtattatcaataaatgcttaagtctaggttgaatatggtgcttctcatccagggctgcataccaagaggaggtggggggaaggaaggagggataaagtttatcattagtaaaaaagcacagtcaaactataatgtaatcttatgtatggaaagtgaaaaaaaattatagctttcataaactgcagaaggtaaaactgaagacaatcttggctgatggagaataggtcataaaaagctgagaaaatgctctaaccattctctcattgttaatggacaaaaagggagtaaatgagactgggttccgggtgagcatgcagtgcaccataatacccaaagagcttttaagaacatccggtgaagagtaagaaaacagttaaggggctgcatggattaatttgggagataaatataaagcagcagtcatattctggagcctttaagaactaataggaagaactttacaagagaaggattggggactgttgaacccaagctttagttcaaaggatccagaggacatctgctttgtggtgatagtgagctgacatctgattcctcagtaagtacactgagttcccagtagctttagcctctaaaattagtagcattgtcagcttgattgtcttgtgtttgtctaacaatcagagtctatgtggcaaagctgtcattattcccaaccaaggtcaaacttcttttcaccaacagccctcgttggtttcttgagtgatgctaatatgaggggagattctccctttgcctttcagagagctctaaggagctgtcaatagtaataacatctccacgtattcagctgcaataatttagctcctgcttcattggaactctctcttgggtgagcctttaagagaggaagaagctgtttcctgttatctccaggctgcatgacaacaagatgataggctgattctagggcccatttcagttttccatacaacaagttgtgaaactagagagtgagatggatggtgggaggatcccacaagacccacactaaaaagatgtgttgggatttggatatttctatggattacctaaagagttctcttgaaagtagatgtttatgttgttgtggaacaatttctgagagatattgttaagtaaaagatgccccaaaaaaacccaacccactgtagattatgctccccttcatataaaaaggggaggaggaatatatgtttgtatgtgcatagacagtcctgagaagggtgagccacacacctatgcaaaccagtaataggcagctgcctgcctctgagatggagacccaagagtctagggtagaagaaatacttttaactccataatcttttgtattttttttttaatcatgcctagatgacttttaaaccacacaaataggaacagtttttaaaagagaaaacccttgaagaaatgacacttaagttatggcatatagcccttaaattcatgctctattctcttaaatagtaatttgagttttctggttctctctcctttttgtcattagagtttgaaaaatcatggtaggaatagcagttatttattgagcacctgctgtatcccaggtgctgtaatttttacatagttttttttttcacttaatcatcacaacaatcatatgagaaatacttcttaaactgccatgtttttacagtggagacttatattccttctttgggttttctttagaaaatagagagttccaagattaattttctacgaaatgtctgttactttgctccagcaaagattagaatggcccttgtcctgaggggtgcatcggatcagttctaccttcaagtttttctcctctttctctggcttgtcttaaagtgtagtcagatctttcttgctctccctccctctctgcttcacgtctttccatccgtctctcttcctcgctttgtatttctcatcacagcttcattgacctccctatttcttgcatcatatggcttcttccatgtggcaagatcagatggaagggtgtggtttgagcatcttccatcttattctttccagcagtgaccacagagtgagggaagcatctctctttctactttaatatatatataactccctaagaaggactgggatcggcttggcctgggtaataagaccacctcttgaagtaattgctgtggccaaggggattcaggttttggccaggcctgggatcatttttgcatcaacttttgtgatcaagaggatgtggaattaacatttgtagcctggcagtaatagcttggttggaatagaagaagtggggagcaatttcccaaaggaagagaaaggggctgaaaccctaagcagatgggaagtgtcactaggcagacaaaaatagtaaatttccctgctttccacccttagcttcttatacaaatgcagagttaaattataaaacaattcatgcaataagcactttatataacactggagcagaataagtgatagatcaatatccataattatttaacatctttaaaattgtggtgaaatatatgtaacataaaatgtgctgtttcaaccatttttaagtgtatggcattaagtacatttacatttttttttttttaagtcagagtcttgctctgtcaccaggctggagtgcagtggcacgatctcagctcactgcaactgccaactccctggttcaagcgattctcctgcctcagcctccctagtagctgggtttacaggcatgcaccaccacgtccagctaattttttttttttttttgtatttttagtagagacggggtttcatcatgttggcgaggatggtcttgaactcctgaccttgtgatctacccactcagcctcccaaagtgctgggattacaggcatgagccaccatgcctggtccatttacattcttatgtaatcatcaccaccgttcacctccagaatttttttcttcttgcagaactttagctctgtacccattaaacaataactcctcattcccttttgcccccagcccctggcaaccaccattctactttctgtctctatgaatttgactactctaggtacctcatataagtggaatcatacggtatttgtcattttgtgactggcttatttcacttagcatagtgttctccaggttcatctgcgttgtaacaagcagaattcccttttttaaggttgattcataatttaatgtatgtatacaccacattatccattcagcaatcaatggacacttgagttgcttccacctttaaatattgtgaataatgctgctgtgaacatgggtgtgcaaatatatgtttgtgtccctgctttcatttcttttgggtacatacacagaagtggaattgctggattgtatggtaattctgtttttaattttttgaggaaccaccatcctgctttctgtagtagctgtaccattttacacccccaccagccgcacacaagggtttctgtttctccacattctcactaacacttgttattttatggttattttaaatgtttatgttttgatagtagccatcctaatgggtgtgatgtggttttaaattaaacattggtaactgagataatactagtgccatttataaaattagcatcatggatgagtgggacagacaatactgttagaattttcaaagtcaagtttcgatgatgactgaatgttaaactcagctaggtttttctcaaaagagaaggagaagtcggagccagaggtagaattgagcaatcatctgtatggagatacttgttaaaactgtgagtggatgcattctccaaggaaacgagtttaaggattagcagcaaggttcaaaggatggaggaaaaggagccagtgggggagcccatggaggcagccttgagagacacctggatatttcagaaactcggagtcccaggatgggaatgatcagtgagctcagatgccaagacagatgactttatgtaaattgcctgtgaataaaattttgttaaattgaatcattttacatgaataataacctgtagtgccctttataattttcagaatgctttcatatggatttccttatttggcccttgtagcaatccagtgaggtacacacgtttttattctcatattacagaggaagaaactgaagcacagagagattgcaattttcctaaggttactgctcgtaaatctcagtttcccaagatgatcagttttggggaggctgaaggcacagtagttcagagatgcttacagcagagtaggcatgagtgtcttcccataatgccccagaggcttgtcatccctagcacatgagatctctttcagtacctcctggaaacaatatacactggccactctcggcttcctgtgaactagtaaagagcttgattgcctatactctagagcagtgattgttaaactgtgagtcgtgacctagcagtgggtcatccaatcagtttaacgggtcgcaaccaggctcacaagagctggtggaaggtgtcccttcccaactctgccttcagtaactttgcgttggttatttgaactcaattgtggtggaaattggccaacaacacaaagttggggctttcatttgttttaccgtagagagcctgttaaacattttctagcacaccactggtcacaatcatcattcccctgcctccccaccccagtgcagcagaatgaaatagaagaataccagggtctatctacagtaaaagtaagtgtaagtattatgggaattttatttaagtcataaagatggttgtgcattcagtggcaatgtgagatgtactttttactatgcattgcaatcagaaaaaaagtttgaaagtcactgttagtcactggtctagagtcccttcatttcatttcattttatttgtttagacagctttactctgtcattcaggctggagtgcagtggcatgatgacagctcactgcagcctcatacttctgggctcaagcaatcttcctgcctcagcccctgagtggctggaaccacaggtgtgcaacaccacgtccagctaattattttattttatttttagtagagatgagtttctctatgttgcccaggctggtctcaaattcctgggttcaagcgatcctcctgcctcagcctcccaaagtgctgggattataggcatgagccaccatgcccagctggaccatttacttctcaccttctttaggtaactgaaagtgctattctcctaatcttcagatagagaactggtatccagcaccctctttgactcattaatgctgcatctgctacaggaggaatgaggctgaatttttatcagactagaagctattctagaagaggcaaaatccacccccaccatcaatctgtcttttgaactcaaagctatataaaaatccattctaatgccccaccaaagattttctccagtgagcagaaaacaaaaatcattatccttaaatcccagaggtttgaggcttgtgaatagcataaatcaatttatagctcgtagcattgttttactctaccactcttcattaccagagctccctataaagaaattaaatcttttttttttttttttttttttgagatggagtctcactcttgcccaggctggagtgcagtggcgcgatctcagctcactgcaagctccgcctcccaggttcacaccataggctgtctcagcctcccgagtagctgggactacaggcacccgctaccaagcctggctaatttttttgtatttttagtagagacggggtttcaccatgttagccaggatggtctcaatctcctgacctcatgatccacccgcctcggcctcccaaagtgctgggattacaggcatgagccaccgcgcccggccgaaattaaatctttttaagaaagtgaagaaactcttcataaaagaaactctccttttaataattcagccatttattttataaatctaggttttacatgtttatataaaaatacaccagatatactcaagtaggttatgcttcgaaactagcatggtagatacatcatagaattagatcccaagaacattgattttagtcagccttaaaatttttaaattttcataacagggtggttattaagtattcttatgccaaaaaacctctgtcaaacatgttaatcagtcttccattaggatacttactatctaaatgtagttacaaaaagaaacacttttcactgaatgacatttgaaagtctttcagagatttatatctctctattccgtgataaaatgttatcatgcccatctgatgggtttattataataaaataatccagaatagggggaacatggttttttacaggtttgtgagacttaagtatatcttcagaaatgagttatgtgcatttttcttagaagaattaggcttgttgtattaatgactataattctttatagtagaattccttaaaatagcattgtattaaaattattcaacactcatttgcgagtagaaaggaaatcttcccccatagatggacacttgagctcttgttggttttagcatctgaactgaaccagatgcctgcattactcatgagaaattaaaaaggatttctgggaggccatgagggcttggtggtgctgctgtagtcagcggctcccatgtcccatgtggctgcattgcagagttccttgggctgtctttgctctgaacaaaccccttgcagctgtgcccggcgcctttgtgacaacccaggcaaggtttcatgaaatggatctgatgttcttgtgcctgtgttattcattccaacatactggagctatgcccaggaaggtgaggggcagcaggttggcccacacaccccagctgtccgtttctactaatgtcactcaggatataaataaattgattcattcacttcctttcttatcaaaccagaatgttgccagaagatactaccagggctgcccagatcagttggaaaggccttagggacaaatctttaagaggtaaacgtctttgcatttaggtaatattttaaattaagtttttaattttatttttcttattcacttcagaccttggagggagaaaaataactttggttatatgttcataacatttgaggtttgagccttctttatttgtcccattttccagataggaattttttctttttactgtattctttttttctgagacaggttcttgctgtgttgcccaggctggtcttgaatcctgaactcttgagctcaagtgattctccctcctcagcctcctaagctgggattataggtatgtatcaccacacctgcctggcttagggccttctttattggcagaaaattcatgatgaacttttttttttttttttttttttttctgaactggaaaagctatgagtcataggatttcataaaaatgcggtggctcacacctgtaatcccagcactttgggagccgaggcaggcggatcacgaggtcaggagatcaagaccatcctggctaacatggtgaaacccatctctactaaaaatacaaaaaaactagccaggtgtgtggtggctggtgcctgtagtcccagctacttgggaggctgaggcaggagaatggcttgaaccagggaggcggagcttgcagtgagctgagatcatgccactgcactccatcctgggctacagagcaagactctgtctcaaaaaaaaaaaaaaaatgtgtatcccttaaccttcagacagctgatgagtggtagaagcactggcctggaagtacagattgccgcttaccacatcaggccttttgttgtttgtagaagcctagtttgtattgttagttggaagtcttttgccacccatagggtaacagcgctattgatcatcagtcaatcaactatttaccaagcagctctcatgtaaatatttataaggcaaaatgctgggtgccctgggtcatgtgaaaatttgtaagatgcgatctcagcacttaagagtgtagcagtgaaaataagcagtatatgcaagacaaagtccctccccatgtgcctccaaatgataaaagaaacaatgatttagatcgtttaggagggtctctccaccattcctctcaggtaacttatgcttccaaatgagcacgacatgtgaatctgctcttggcttcaatggttcttcattcctaggtgattctcatagtgcagtttaccttggcaaatgttgatcacaatgtctaaaaatacttgcattctctatggcctaaacacaagccagtcatgttagttgggtgctaacgaaagaacagaaggatggaagtataagtgtgtttgttggactccctgatagttgccgaactggcatgatgtattttacaggtgctttaagactttttagggtagttctgaatatattttatgtttgtgttgcttgttgactttaggactaacataataagacataacttcatttatttcataaatgccaagtgagtgtataaagacagtattatctgtagacatttggccaaaaaaagacagaatttccaggccaagccattaaagcaaaaataaagatgggttagctacagtggctggtatttcaaagtcccacaaaaaaaaggcggtgtcggggaagagctgggctgtagtcgtggtcatagaggcagtgagggaaaaatgcagtaacatcgttgttctgtatacctctcctgctcttatgaccccgtcactggatcaccaggcaggagttaggattgaagtgactctgtacccgaattatggcaggatgtaagggacaataggcaaatcttaaggtgaagagtctagaggagacccttctagactgggaccccagagtgccagctatagtctccatatgtaagtcaactagaaataagccctccctctcgtccacccttcagtccctcaggcattgaaagataactggctatctggaaacttggtgctaaatggagtggagaaggggaatctcccctggtaatttataaccacaagctggaccccttgtaagcttgggcatgaattcacattctggaggtagcctgaaaaacttcagactgagagtttaaggtggtcctaaggcacctagcagaatcaaatgcatgttttatctggaggaatcctcctccaacccaaacctcaaataattcccacaggtaaagttttgtgagatcagagtttaaaatcacaaaacaaataaagaaacatggcaccatgagcaaagccagcaaaataatagataacagtgttagactaagataattgaaattgccaaatagtgcaaaataacttttctcatatgtttagagaaattaaaagagagagtaaaccaagagattaaaattatgaccaagcagatttgaaatagaactaagtaactcttttggaattggaaaataataataattaaagtttaaaaatccatggatgggcctacctgcagatttgacccagttcattgaagagagctttaatgaactcaaagatggatttaaagaaatgatctgggcacttgtctttcgagtcgcctgcttagccctcttctaagtgtgctttccttcctgctctgaagctttttgataaactttccctcctgctctaaaacttgccttggtctcttcttctgccttatgcccctcagtcaaattctttcttctgaggaggcaataattgaggctgcggcagacctgtacagatacagattcactgccgctaacatattttggtgccatgtgacttggataccttccgccggtaacatactttgctgtgtgactcgaatacattccctacttgccatcaagcttcagatgatcctcagtgagggacaccatcctctcaatattcaagagtcacccttctacaaaggacccctagactgcccatcagtggaacaaacagaggcacaatcttgcccctgtctcccttgggcctggctggatcccactttcaccaacccacggagcctccctgccctgacagctagcaacaggccaaaacccacagaacagccaactaccacctgtcagtggaaagcagttacagaagactgaccttcatccattttccccaaagaattgggatcttggactcttgagtcaggaaaggttacagtaggtagtcagacatgagcagggcaagagagggctcctgccctaccccttcccaccacaaccaggaatgtcaggtgaccatcaggtgatgatcaggcagttgttgaaactgtctctctaaaataataatcagttgcagccagcaccagggaaaggcagtctccttatagataggaaaaacctgaaactagtgattagtagcttcctgataagatctcaggagttgggggagtgggcttgagcatgtgcactaagaggcaaaatggcggcctttaactggcatatgacctcctagggacatttggctggtaagggaaaaacgcttcaagtgagcatgcgtacaactccagtaaacacactgtgcatgctcatctcccaagtgctagcagaccactgcatctgcatatgtggacagcccactccaagggaaaaaccaggggagaagagatgcaagacgccagaagtatgccagcatataaaaccccaagtcagaaggtcaaacctcatacttgatctctcaagccacctgcttggccctcttccaagtgtactttccttccttttgttcctgctctaaagcttttatagatatataatatatattacatatattattttataatatgtattttttataatatatattatatataaaaaaaaattttttttgagacggagtcttgctctgtccccaggctggagtacagtggcacgatcttggctcgctgcaacctccacccactaggctcaagtgattctcctgcctcagcctcctgagtagctgggactacaggtgcgtgccaccatgctcggctgatttttatatttttagtagagacggggtgtcaccatgttggtcaggatgatctcgatctcttgacctcatgatctgcccgcctcagcctcccaaagtgctgggattacagacataagccactgcacttggccttctaaagttttttaataaacattcccttctgcccaaaaaataataataaattgaaaaataaatgattgggaatgcagcacagaaagaaaaagaggtggaaagccatttgagaaggcctaataaatatctaattggagctctggaaagaaaaaatgggacaacatttgaagagataatggctaaaaattttccacaactagtgaaagatacacatattgcagtgaatcacaagaaatccacacctagacacatcatactttagagcactaaggtcaaaagatgttaaagcagctggagggagtggaaggattaccagagcaattccagtctgattgacagctaacttctcagcagcaaagatggaaacaaaaatacagtgtaatgttgccattgaggaaaggaaataattaccaaaccataaatgtattctaagcaaaaatatctttcatgaatgaggatgaaacacattttccaacacataacacgcaaaagagtttgtcactagtagacctttgccaaggagtctaaagaatgtatttcagacagaggaaggtattataataccagaagaaaggtctgaaatgcaggaggaattgggggcaacataatgagcaacaaaatgatgataatgttcttgtgaggttaaaaagaaaatgaaaatgtccaaaccatcatatcatgtaactcaaggagagcagatgttcaaaattaaagtcatttaagttcatactgtacagtgaaaaggtaaagttattgatgaattttacctttatatagttaacatatacaattgttaaatgaataaagtatttaaaaaaatagaaaacttccaaagtagcagagagaaagtggaatgagatagagaataaatccacaaggaggaaaaggaaacatggaagaggtagaacaaatagaaagcacagcttaaaacagtacgaacaaataaaagtattggccctttccaaaatgtgagttgactcaatgttccagtgaaggtcaaagactgattgattcatgaatgcaacaaatatggaccaagcatcttctgtgtgttcagcactattctaggcactaggcacaagccgtggagcagtgagcaaaacagccaaaaatccccaataggagagacaaacaacagaccaaataagtaacacaaaccgtacatgagaatgtgggaaatgttctagagagaaaaaaaaaaacaacaacacagtgaaagaaggtagagaatggggaggttcgctattctaaataaagtagagaaagtggcctttgcggtgagaactgaagaagggggaataagctggcagatatggatggaagggaactccaggtggagggaacagcgggagctcatgcctggagggagggatgtggctgctgtgattgggaaattcaagtggagctgtcatgttgcacgagagagcagaggagagtgagaacagatgaggctgagagatgacaaggggccagatcatgcaggccctgggggccaaggagaggacttggcgcttgtcttctgagtgtagtggtagccatcaaggaattctgagcagaggatttcacaggatggctgtggctgctatatcaggcagggacaaggtgggaacagtggagggaagagaaaatggccaaccagaaatagttatattgtcagcctggatttttaaaaaatagacttttaggctattaaaacaagaaaatcttacataggcatatataaaggatcaaagaaaaaggttggaaaaagatatattggggaaataccaaccaaacgaaagctgatgtagctatatttatcagacaaaatagattttcaggcaaaaaagcataacaagaaataaagagggtcactacattatggctaaaggttcaccaagaaagtgctcaaccttttctcgtcaacttactttaactagtatatttaatgtttttttcatttaataaatacatatttatgaaaagtacattgggcaaaaaattaacagaaccataagaaaaatagataaatctagctttatattggaaggttttaatgtaactcagtaattgctagattgagcagtctgataataagtaatgtttctgataataagaacatttaagaggctgtgcatagtggttcacacccataaacccagcactttgggaggctaaggcaggagtatcactctagcccaggagtttgagaccagtctgggcaacaaagtgagaccgtctctccaaaaaaatcgaaaaattagctgggcgtggtgtgtgcctgtggttccagccacatgggaggctggcgcatccccatgcttgagcccaggaggtttaggctgcagtgagctgtgttcatgccactgcactccagcctgggcaacagagcaagaccctgtctcaaaaaaaaaaaaaaatcgaaattttaactacatcattaacaggcttgatctcataggcgtgtatacaacatcacactaaataactgcataatgcacattctttgcaatcttctatgggggagttgcagaaactacgtagtaggccttaaatcacatttcaaacactacattccttgaccataacgcaataacaaaaagatactggaaaagtcctcatatttttggaaattaagaaagagttaactaatttaaaaatcataattggcggggcacagtggttcacacctgtaacccctgcgctttgggaggccaagacgggtggatcacctgaggtcaggagttcgagaccagcctggccaacatgctgaaaccctgtctctactaaaaatacaaaaattagccgggtgtggtagtgggcacctgtaagcctagctactcgggaggctgaggcaggagaatggcttgaaactgagaggtggaggttgcagtgagccaagaccgcgccattgcactgcagcctgggtgacaagagtgaaaccctatcttaaaaaaaaaaatcataattttaaaatgttgtttaatattaaaaacttgacaaatgtaggtaaagtaatacctaaaggaaaatttatgcttacagtgagggaagaggaggggctgaaagttaatgtgccaagtatctggtttaagaagttaaaaaaagaaaaacaaaataagtcaaaagaaagtaaaaaccaaaaataataatagcaataataaagatatagaggaaaataaacatacagttgagaggaatgagttagggacattattatacatgcttcggagattaaacagattgtaggaagatactgtgaataactttatgatgacatgctgatatatttttaaaactttagtgggatgagtacaattttaatatttaacttacaaatatttactcaagaagaaatacaaaatccaaatattcctttaattattatggaaactgaatcaagaacaaaaatcttcccacaagttaattaccaggcttttgtgttttactggtgagtcctaccaaacattcaaggaacaaatatttcaatctacaaactattccagagtataagaaaattatataggatcagaagggaggaggcagatctgtcattattctcagataacatatttgattgtaaacccaaaaagaacgttcaaatagactattggctttatcagagaattttccaaaatcaattacatttctatatttctgcacaaacaggtagaacatgtgattactgaaaagatatgctttacagagcattaaagcacatgcctaggaataaatctaacaaaagatacgtaagacctgtgataaaatatgtatatatacacatatatataaccttaccaagagacgctttaagaatatatatatgtattctttatataaggttatatatatataggatatagaatatatatatggttttatagagtatatatatattctatatatatatattctatatcctatatatatataaccttatataaagaatatatatatataaaaccttaccaagagatgctttaagaaattaatggagagacctacatgttcgtggattaaaagttacagtttgtagcctggcctggtggttcacgcctgtaatcctagcactttgggagaccaagggggattgcccaagctcctaggagttcaagaccagcctgggcaacatggcaaacccccgtctctactaaaaatgcaaaaaattagctgggcgtggggtgcatgcctatagtcccagcttagtcgggagactgaggcacgagaatcgcttgaacccaggagatggaagctgcagtgagctgagatcacaccgctgcactccagcctggacaatagagcgagactctgtctccaaaaaaaaagaaaaaaaaaaaagttacagttttgtaaagataccagttctccctaaaattgatttgtatatttgagagggtattagttgtttatttttattttttgaaatttatatgaaagagagaagaacccttatactcctataaagaatggggatgtcagtagggggctgtgtgtgacttgtcttaaccagataacaaaaattaccatcaagctaacatgcttaagagaatgtgatattgacacaaaatagagaaacctaaaactggtctatatataggaaataacttacgaccaagacacattgcggttagaagaggaagggatagatttcaataataacgttaggacaatcagtttttgtgtaggaaaaaatggaattagatctgtgcttcgaactgtacacaacttcaggtcagattagagacttaaatatgaaaagcaaaagtgtaaatctttaagaatacattagaggaccagatcattatagtcacggtaaaaggaaagggcttgtaaaatccaatccagaaagtgcaaaccataaaggtaaaaactgataaatttgacctggttaaaattaagaacttctaagatgccatgaagatattgtgggagtttttttccctttgtttcttattcatcagagatagattctgaagataatgttatcctgagtttgctttgaaaatactccaggaaacaaatgtgaagagatgaaacaaatggtacgatgccgatcattatcaaagctagatgatgagaacatggaagtgtattatactgttttattttttatgtatgtttgaaattttttattttaaaaacctttgtcagggctgggtgcattggctcacacctgtaatcccagcactttgggtggccaaggagggaggatcatttgagtccaggagttccagagcagcctggacaacatagggaaaccttgtctctataaaaattttaaaaattatccaaacctggtggcacacgcctgtggtcccagctactcaggagactgaggtgagaggatcacttgagctcaggaggtcggggcttcagtaagctatgattatgccactgcactccagcctgggcaacagagttaagaccctgtctcaaaaaaaaaacaaatgtgttttttgtttttaatccatcctgtttttatggtgactgtcctggattttctaatattttttaaaaaccttatctgggccaggtgtggtggcttgtgcccataaacccagcactttggcaggctgaggcaggaggctcacttgagcccaggagttttagaccaggctgggcaatatagggagattccatctctgcaaaaaaatagagaaaaaattagctaggcatggtggcacatgcttgtggtcccaggtacttaggaggctgaggcaggaggatcgtttgagcccaggaggttggggctgcaagtaagccatgatcatgccactgcactccagcttgggtgacagagcaagacagtctcgaaaataaataaatacataaccttttctgtaaagatcacttgttaagtacatgtctaaatacaatctaatttttatcctgaatagcacttatcttaataaattacaaaacaatctctttaaaaaaataccaggcagggcgcagtggctaacacctgtaaagtcaacactttgggaggccagcgtgggaggatttcttgagcccaggagttcgagaccagcctgggcaacatggcaaaactctgtctctacaaaaaaatttaaaaactagcccaggcatggtggtacatgcctgtggtcccagctactcaggaggctgaggtgggaggattgcctgagcccctgaggttgaggctgtggtgagccatgattctgcctctgcacaatacagcctcggcgacagagcgaaaccctgtctcaaaaaaccatagaatgaagagacaagtcacaaactgggtgaagatgtttgtaatacataaaaaccaaaaagttagtatccagatatttaagcaaagaacttctaaaattcaataagcagtttcttagatatgacatcaaaagcataagcaacaaaagaagaaaatagacaaactgggcatcctcaaaaatttaaaatttcctgcttcaaaggacactatcaaggaagtaaaacaacaatccatgaaattgagaaaatatttacaaatcatgtatatgacaagggacttgtatctaaaatacatacagagcgcttacaattcaataataaaaaagacgactcaggtttaaagatgagcaaaggaactgagcagatgttttgccaatgaagatataccatgccaagaagcatataaaacgatcctcaatatcattagccactggggaaataaatcaaaaccacagtggtcagcagccaccagcttggaggatcacttgagccgaagagtttgagaccagcctgggcaacacaacgagaccccatctgcaccaaaaaaaagaaaaaggaaaaacacagcagtgtatcacttcatgcccaccagaatggctgtaatggaaaagagacattggaaccttcatgcactgttgggagggatgtaaaatggcgtgactgcttttggaaacagtttgacagttccttaaacagtttacgtgaagagttgccatatgacccagcaattaattccacttccgtatctatacccaagagaaatgaaaacatagttcaaatatttttacatcattgtttatagaagcattattaatagccaagaggtagaaacaacccaaatgtccacaactgatgaatggataaatgaaatgtggtctatacacacaatggaatattattcagccataaaaaaggagtagagtagtgatgcatgctacagcatagatgaccctttaaaacattatgttaagtgaaagaagccagtcccgaaggatcattgcatgattccatttatatgaaatgtccagaataggcaaatctatagagacagaaggtaaactagactaatagttgcctatagctgagggatgagagatgtagggggtggtggcgaagaagtatggggtttatttttggggtcatcaaaatgttctaaaattgactatgatgacggatgcacaactctgaatataatatactaaaagctattgagttgtacatgctaaaggaatgaattgtacaatatgtgaattacatctcaaaaaagctgttttttaaaaaatcaataacaattcaataggaaaataagcaaaaggcatatccacacatttcatataagaagaaacacttatgcacaatagatacttgaaaagatgctcaacctcatttctaatcaggaaagtgctaattaagccacagtggaataccattgaatactcatgtgattcacagaaattgtaaactgaggcaatactgctccacatgtagaggtgtggagaagtgaggatgctcatacatttccagagggagtgtaaattgtataatcactttggaaaataagatggcattagagagttgaagatccaagtgtttatggcccagcaattcccctcctaagtgtatacccaaagaaattctaccagtagtatactgagattgcatgtgtaatcacaggagcactacaaaattcaaagccacataaaattcaacagtatattatataggggcataaagatcataaacctgtttttttaaaagcaaacaagggaaggataaacacaaaattcaggatggtgagaatgggaaagaattgggagggtctagcagggatgcagggtaatggtaaagttccttttcttaaactagatggtgagcatataggtgtatattgttgggattgaggggttgaggagaaggcaaagtattatctgacactctgacattgagggaaaatttagaaaaactcaaaagcatacatggaagaattttttcatgcactttaaaaatgctgataatacactgtgtttctagaaaagatggacatatttagcattttttaatttgaaaagggaaagataaagtgtttttgtccaagaaaaaaaaggaaagagaacaacacagaaaagaaacagcagtagaattgggagtattttaggaaggtttccaacaaaagtggttaaaattaagagctttgtggccaggcgcagtggctcacacctgtaatcccagcactttgggaggccgaggtgggcagatcacgaggtcaggagatggagaccatcctggctaacacggtgaaaccccatctccactaaaaatacaaaaaaattagccgggtatggtgggtggtgggcacctgtagtcccagctactcgggaggctgaggcaggagaatggtgtgaacccgggaggcggagcttgcagtgagccgagatcgcgccactgcactccagcctgggcgacagagtgagactccatctcaaaaaaaaaaaaaaaaaaaaaaagagctttccacttagaggtgaacttcatttatttgggccaccacttctttattcttcagtgatgttagataaaccagacattgctgcctgtaagtaaaaccccatgctgtcatttcattcatttcatggttgcctttctctttttcagatcctgctcacactaaaatatgaaccacaaacacacagagaaacaacctgttcaccactcctgggtgcatgattgagggtgaagcatccaccagcacttcaaggggtccatagtatttttttttttgctgcctcaaagtccccaaagccttcgagcagaagtggcagtagatggttgccaatcagccaatgcagactttcactgggacaacaagaaagcagatcttctgggttttgatggaacttggcagtggggacattcagctgatgcattatataccccgtcagagcacacttgtatcttttaccttccctttgccccatgcccccaaactgcttaggtcttctctgtccctttactgctgctgcacagagatgatataaaagaggctctttggctatttgcattttgcttcctcttcttttccagattacagtatgaagctttattttctttgtacaagcttaaaatttcaacatcatcatccgccaaagttgttcctcccttttcggaggatctagggggaaagaggagcattcatcacaagtttcctagagagaggagacaaatcggtgtgccattgacaacatgagccagggtaaaggcaccctttggaattactgatttcaaagattaataaagtaattctattttta

SEQ ID NO: 28 - DNA, 19984 bp, Homo sapiens
cgtgcgacagcgacccagccacccccggagcgcagtccccgaaggtgaggaagcggccggtgcgacccgaccctgaccccgtcccgggcctgggtgccggggcgtgggcccagtcccaccggcggccgcccagcgtctcgggggcgtgggcccaggccgggcgccgcgcctgagaccgggggtggtcggcgaggcggggccccgaggtgagcccgcggcctctagcgagcaacaagtgcgggcgggcgggggacgcggcgcggcttccccgaagttggcagccggccctgcttgacaagcttgtccccaaaacgcctcctcctaggccagccgtgggacggaacgcgcccggggccgagagagttggcctcggaggggcctgcagaagcgcgcgttcgctcagcgttcattccgcgcatagtttgccgaagtgtttgaacgcttactgcaaaaaccgagtggcgaacgatatggaaaatcaacacactcagtgaacttactgtaataactaagttaatacgcaagcgtccggatgttttcagcggaagtctgttaaaactttttactgcttgaggaggtgaaaagaaattggtgcttgtggagaaaatggagatgagcagtagtgtcacgcatcaaaacgttttggttctaaagttaggctagcagtttgtgacagaaagttggaagggaggaatgatgttttaaaagcctggaagcttgaaattggattgaaattagaaggcggtgggaactggaatgctgcagagccagccagccttcgtgcggtgcgcggtgtgccgtgtgcgcgttggcaggggaagccgtcctgtagcagcctagccgggctgcgcctgcttgggagcttttcccgttgcgcacgtccaccgtgctgtgagactcattttgaaggttcctcaaaggctgtcgtcaatggaagtaactagattgtaagactctgaatgcacatccttgcacttccagcatttgacgtctggcccggcacctggagggcactgagccagtgccccctgagtgcattcttgacccctgagccctaggaaggatgtgatgcatagaaattcatctgatctgtagttggaaaccacctgtaactctggaaggcacatctctgatttagtatgtttgggagtctttgaaaacatgggcctctgtatcagtattgcggttacacggaaattcttaccttattccgtcatgtattgggaacaatattgctgttactacctccctcaagaaaaaggcccgctgcccagatgctcactttatataataatgcctttgcctagaatttgtagtagtaatttaaaacacttgatgaaattgtagtctcagcttttttgagcactttgcatttttaactttatttttgtatatttttgagtgtctcaactttttagctaaaggaaaatgtttttaagtttaaggatataaaaatccttaaaatgctcaccagtaaaatagaaaaaatactggaatgtttaaaatgagttatgttgaaagtattgaatatgcagtgttgcagttgtatgcagatacttatgcaaattttcagagagtagatttagactatgcaaagctctttaatgaaatgcttattttataaggactgaaaaagaatatatattttactatttggaaaagaaccagttaattcctaggagctagagacatttgagactttattatcatcataatcatcattttaactaatatttatcagataactcgccagtccttgttctaagtacttttaatatagtagctcgtttaatcattgaattagccatgtaatggggcactattatagtctcaaattttcggataaggagatgctcacagagaataacctactcagctagtgagggacagtgcccagtgagaacccaggccgtccagctctggcatgcctggccactataccatattgcctctttatattcttttgcaggattgctttcattttaatatgtagcaagaggactatagtatttagcaaaattggattagcgttgaaagctatattacattaaaaaattatgatttttagactttaagccttggctaataagtaaataaatcaatttcctaacatctgatactttttctgaatgaaatggttgaatttataaccttgatgttcttgccacataatggattacattaaaaatatataatcttctttaaaaaaaaaattcccctccccctctcaagcttctttttttggtgtgtgtgctgctatattatagattgatgacccttattagggtatatttttgctaaattttagcagtgtaagaggaagagtgaatagttagaattgttttcggtctcatatgtccccttttcacagggacataaatgcctaaagtagtcaattaaaatagtcctatgaaccggcttcaagttgaattgagaactgtaaatgatccatacatttttttccccctgagcttgggtaggagagtttgctttaatcctagagtgatgcagcagtttgatatgtttatgaagagcagaaaccaaagcagatttgcatttacgggttcattgaaaatgttcttatttggattggattgaagatcagttttaaattttattccaggtcttgctcatgccaaactcttggacccttttaattataatatgaagttaatacttgtatgactagttgtccttagacagtctttcatttattgagacttactgttcttttattctttctctaattattatttttgaatcttttaaatgtataggatgataatgaagataattcaaatgatgggacccagccatccaaaaggaggcgaatgggctcaggagatagttctaggagttgtgaaacttcaagtcaagatcttgggtactgtcattttatcggttattaatattttttgtgatgttcctctttgccttaacatcctcttccctttcccccagctctggcaaaggcaattattaaaaattgtagaatattttcttcctgttctataatgtgccatcaaagttggtcttgctactgagtgtaattaaaaagcaattttatgatagtaaaatacatacatacataaaattaatcattttaacaatttttaagtgtgaaattcattggcatcagttacattcacagtgttgtgcagccattaccaccatccatttccaaaactttcactaccccaaactttataaccattaagcaataacctccctttctccctctatttagcgccttgcaaccatcattctactttctatttccgtgaatacgactacttagttacttcatataagtggaaccataaaatatttgtccttttgtggctggcttatttctcttagaactttgaatatcttcaaggttcatctttgtagcatatgtcagactttttttctgtttttaaggctgaataatactccattttatgtatatactgattttgtttatccattcagatgttgatgggcatttgggtttccaccttctggccaaggtgaataatgctgcagtgagcattggtgttcagagtttgtgttttcagtttttttggatgtttatctaggagtggagtagctggattatatggtaatcctatgtttaattttttgagaagctgccaaactgttttccataggggctgcacaccaatttacattcctaccagcaattcacagtttccagtttcttcatatttctcaccaatttgttatttttcattttttaaaataatagttaccctaaaaggtgtggagtgatattttattgtgattttgatttgcattttcataatgcctactgatattgaacatcttttcatctgcttggccatttgtatagcttctttggagacatgtctattcaagttctttgtccattttttatttggggttttttttgttgtaggagctttttaaatatattttatatattaatacttcatcaaaaatatgatttacacatattttctcctgttctgtgggttgtcttttcactgtcttgatagtgtccctgtacaaaatttttaattttgatgaagcccaaatttttcatctattttttcttttgttgcttgtgcttttggtgtcatatgtaagaatctaccttcaaatccaaggttgtgaaagatttctatgttttcttctaagagttttctagttagctcttatatttaggttgttgatccattttgagttgtgatatgaggtaaaggtccaattttatacttttgcatgtggatacccagtttcccagcaccatttttgagaacactgttctttttgaaggttactttttaaatagatggatgcataacatagtgtcactttcccatgtccaatatagaggttgaattggcccatatcctgaaatctgtactctgttactcaggatggagatcgactgtgataccctggcaccttcaaactaggtccattctttgcttctgggtttgtggagtatctgagaacaaacagttacggtttatgatatgatgcactgagataataggtttttaagagttctgttttctcagctatttatgactcactgaacagtagacaagagacagaagttgattattctttgggtggatgaaatactggctatgcattttaagcccaagagaaagaagtcagagctgataccatcatcaccttgctttgccctcataggtcctttaaactaaaaatgccttcgttcttagcaattgtgattctacgttcttcccagtgtataaaagatgttattttcacatacctttttgacttggtagaccagataattatttctattccttgtacctgttttgtaattttctttgatacacaggaagtcaagtcataggaggcaaataatttaaatacttaaaatagttttcaaaatatcctcaataaaagtgattaaaaattaatgaaagctacatttaatgcataatatgtatttctgtacttagttttagttactatccagcagaaaacttgatagagtacaaatggccacctgatgaaacaggagaatactatatgcttcaagaacaagtcagtgaatatttgggtgtgacctcctttaaaaggaaatatccaggtactagtttatataatagattaatttataattgatagtaattctttatgatacactgtcaacttctgaatttttctgtagattatattttatattcttgtgcttgctgtttttttttaagactaagggtctcattctgtaacccaggctagagcgcactggtgcgattatagctcactgcagccttgcactcctgggctagctgtctccctgcctcagccttctaagtatctgggactacaggtgtgcaccacgacgcgtggcagatttttttaatttttatttttttagagatgtgaagtcttgctatgttgcccagcgtggtctcaaactcatggcttcaagctatcctgctgcctcagcctcctgaattgctaggattacaggtgtgagccaccacgcctggctgtgtttcatttactgctatcattcagcatcactcttcattattgatattttctatggctcataaactgatttaaaagcaaaatgggaaaggtgaatttcctgaggaaaattttagaaaaaatcattttatagtcaagtttgggatttttaccattgtttcttgatctaaggaatagagttagctatatgagccgtatctgaatttgagaaaggctattcctcatgaactagtttagtatagttatttatatgaccttcttgctttggattattctatttcctattttattctaacttttgtatcttgctgagttttatttcttgaatttataaatttttttgtagcccctttaataatatttggaatatgtaatatgaatactttaaaaagtcaaggtttttaagcttttaaaagttttacaagtgcataaggttttgctgtttttaatagtcttttgatcttttttttggagatttagagcgacgagatttgtctcacaaggagaaactctacctgagagagctaaatgtcattactgaaactcagtgcactctaggtaagaatagctttttaatgtgaatttttcaagctgaacatttatgagataatactagataagtatcttatttcctaaaatattttacaaaattaataaaataaattgaactatttaaatgctacattatttacttcatttttgattattgttaaaatacacaggagaatgaagcttgaacacacatgtggttcctgacttatgatggttcagcttcatgatggtgtgaaagcaatgcatattcagtagaaaccatacttcaagtgtctatacaaccattattcttttcacttgcagtataatatgtaacaagtcacatgacatattcaacactttatattaaaatttgtgttagctgattttgcccagctgtaggctaatgtaagttttctgagcatgtttaagttaggctagggtaagcaaagatgtttggtaggctagatgtattaaatgcttttactttttaggatagtttcaacttaggatgggtttatcatatgtaaccccattgcaagtcaaggatcaacctctattctataacagagtataattgtctaatttttctcttttttttaacacagagtctctctctgttgtccaggctggcatgcagtggcgcgatcttagctcactgcaacctccatctcccgggttcaaggaattctccctcagcctaccgagtagctggtactacaggcgcatgtcatcacagccatctaatttttgtatttttattagagacggggttttaccatgttggccaggctggtctccaacttctgaccttgtgatccacccaccttggtctcccaaagtgctgggattacaggcatgagccaccatgcccagcccttgtctaataatttttacagagttttcagagtgtttgtattttttgtacaaagcttgtacaatatatttttttaagttgcaggttctttgctaagtgcatggtgtgtgcgtgtggtcccagctacttgggaggctgagggaggaggatcactggaacacaggactttggggttgtagtgtgctgtgatcatgtctgtgaatagccactgcactccagcctgggcaagatggcgagaccacatctctaaaatgcaaaaaggcaaattttcttcaatttttagttctgtataattatgtccgtgctttatttgtaatctttttttcacaaacattttaatgcaacatggctactttttatataaattcttgggaatgcattttagcaattggtgaaatctgatactgtgagttttgaaaattgtctccatggtgtgtgtgtgtgtgctgatgtttttggtgaaattttaattgattgtaatatttcttgtgtatggaatttgaagactgggaactataatatgttgaatttttttttattcatctagtattctgtagtacttgttagtagttagtgcatttcattatttaacagttgtttccaactaaagggatatatgttcaaagcacatagaatcttaaaaataaacttgtttggttgaaaaattgatatatttgccttttgcaagataatcttttgattgctcgagtttatattgtgaatattaagtttaattattttcaaatgtactaagatattttgctttggctattggaaaaccattacaacgtggagcggtttgaagaattaaattttgaagagtgcttttgttcacttatccttaaaagagcttctttatttttttattttttggtctaaaataggcttaacagcattgcgcagtgatgaagtgattgatttaatgataaaagaatatccagccaaacatgctgagtattctgttattctacaagaaaaagaacgtcaacgaattacagaccattataaagagtattccgtaagtaattgaggtgactggcattttttatttgggttggggaaaatgacattttagaaagttatatgtgacttccaactgtattttttttttccagcaaatgcaacaacagaatactcagaaagttgaagccagtaaagtgcctgagtatattaagaaagctgccaaaaaagcagcagaatttaatagcaacttaaaccgggaacgcatggaagaaagaagagcttattttgacttgcagacacatgtaggataacttaaatttagtaccccctgaacttagtttattacttgttattgcagagtgcccatcaccccctttatcgttattttttgtaccacctatgtgtgtgtgttttttttgtttgtttgtttgttttgttttgttttttgtggcagagtctgtgtagcccaggatggagtgcagtggcatgatctcggctcactgcaacctccgcctcccgggttcaggcgatgcttctgcctcagcctccccattagctgggattacaggcgcctgccaccacacccagctaattttttgtatttttagtagagatggtgttttaccatgttggccatgctgacacctgcgtgttctttttttcctcagaagttgagatgttatttttaatggtgtgcttaataatactcaatttacatttttttgtgagatgtcttttgctttacggttaataattctaaatgagactaataatagctacatatcatacttgctgtgcgtcccaagagtttttaagagatttgcatgttaattctcatagtaaccatgtgaggttggaactaggattacttccatttcataaagaaattgagctacagagaggtcgtataagctacccagatcactctgctgttaagtagtgagcaagagatccactgccattcctcaggagaataggcctttaaaacaataatatatagaactgaaagcaccaactgtcctcttaggttatagctcctgatatctcctaaaattttagcttttcgagggggaagtgggcgtgcagtggtgagcacgtggggactcttcctaaagccttgattcttagcatggaatcagttttgtgtttctctttatgttaacgtaggttatccaggtacctcaagggaagtacaaagttttgccaacagagcgaacaaaggtcagttcttacccagtggctctcatccccggacagttccaggaatattataagaggtatttagtagttttagttacagttggtatcggctattggtaaggggtttcagagccttttgtacttgcctcctaacaattttggggtctatagatatcaccgtaagatatcgtataggatttgtgttgctattcttctctggttctgtggtaaacaataccctgtagtcagaatttgaatatatgctggtgaagtctagatgcctctgtctctgcccattctgtttgggtttgttagagacagatgctgggggttctgtagcacctcactgctcagggtatgttccgtggtccaaagcactgttattgctcagaagcttgttggaaatgcagaatctcaggcccaactctagacctatgactcagagtctgcattttaacagatgtctgtgtgattcatgtgcaggttagagtttgagaaacactgacttttactgcagagaagatgagagaaggagcggagaggggcaggcatgggcaactgggtgccccagccacattgctgacctggcctggctgctgctccaatatggaccctaaatgttacttatctcctattcccaaattaaatgtaactgaaaaaaacagggctaacagattcttttttttttttttgagacagtcttgctctgtacccaggatggagtgtggtagtgtgatttcggctcactgcaacctctgcctcctgtgttcaagtgattctcctgcctcagcctcccaaatagcgggactgcaggcacatgccaccacgcccagctaattatttgtatttttggtagaggtgggttttaccatgttggccaggatgctcttgatctcttgacctagtgatccgcccaccttggcctcccaaagtactcggattaaaggtgtgagccactgtgcccagcccattttgttttaaagtctcagcttttacttcaaccttaagccttactctggaaccgtatgtttttcataatatactattttttagagaatagaatttaaaatatagtatcataactcacaccatttgaaagtcaaatcttgggcagaaattttttaaataaaaaaagattttttaaattcaaatttaaatcatgagcagcaattttttaaaagtttttcttcaaattttttttttttttttttgagatggagtctcacgctgtcgcccaggctggagtgcagtggcgcgatctcggctcactgcaacctctgcctcctggttcaagtgattctcctgcttcagcttcccgagtagctgggattacaggtgcccgccaccttgcccagctaattttctgtatatttagtagagacggggtttcaccatgttggccaggctggtctcgaactcctgacctcaggtgatctgcccaccttggcctcccgaaatgctgggattataggcgtgagccactgcacccggcctttaatttttaaaaattttattttggcatcagcaaattattaaaagtcatatgcaagtatattaacccctttgctttttggtgtgttgtcttagttggagaagtcttcatctagggttgcctcctgaatgggggctactgagggtgagaatggaggtggcacgaagcagtgctgtctgacctaggggaagagattgccaatatagtttcagacaaaatagatgattaaatttgttagaatacatgcttcccaaatttgtttacaataattggttactaaaaattttgctttctatgttattattttaagtaatatcatgtaccatgcactggtgtgatatgtatgcattaaataagttaatgcatatatatcaactgtatgcggtagatgctattattaggtctgttttacaaatggagtgacagcacagagaagtagcaaagacctgggacagtggtcgaggtggatgtgagctggcagccagacttggggctgctgacattttatttacttttttctttttttgggttgagggcaaagaggggaggcacattatctcttagtaagaatcaaatgcatattttacataagtctagtgaaaagatgttcaggctttttattaaccctacttgatgacaaaaatgaaaaattagtactctagttttcaaaagtcttcggggttactcaagaagtttaaggctatcttcataggtcaaagatgagtctgtttatatttaataataaagggaaaccaaaaataaactctctgaacttcaggtactcaccagatgagctgcggtatctgccattaaacacagccctgtatgagccccctctggatcctgagctccctgctctagacagtgatggtgattcagatgatggcgaagatggtcgaggtgatgagaaacggaaaaataaaggcacttcggtgagaacatttctctctagtaggaagcatttcctttctctttgaatttttgttacattgaatttctgtcatcaccctctccttgaaaaaggatggttgcatgtaatttccagaaagtattcatcaataaaagttacttatagtatgttttgataaaaacaagcagtgaatggcctttggtaagctttatgcttaaaatcgcccctttgtagttaccatgagcagtttaggcaagggtatggaaaattagcttacaatcatttattcaacttgctgtctctttagcttaaaatattgaacaaaacagaatttgatctcttgacacagaaatgtagttttcttagttgaggggagtgcatttgcttaatcttatgcttcctataggaaaatattatgtttagtaatatgttgtacaatttgttgggttttcctgtatgacttttttttttgtagcaaaatgcacctgcaagacagtgggcagttggtgtattctgtgcacctgaaggagaataaaatcccaatgatggtttggggctttgatcccagtgatgacatagggctttgaatttctttagcattgtgttttaagtaactggctatttcaaacttttcattgaagccaatgtaaatgtgagattgtgctaccattgaatggacattatttccttgtcaccaacagcttctaaaacatctttaataatacatattatgcaaaataagatactgttcaagtattaaagtggtgacacaacttttctcctgtcatgttgctaaaaggggagctatggcatgcaaagggtgatgaagctgacttcctttcatactgctaggaaaagtgtaaactaatccaacattatgggaaagcattttgacagtcttaccaatttaagttccatagtatttgacctagcaaatccactagtagaatttatcctaaggatttaatcagatgctgaaaaattttaattagaaaaaaaggtccatttgagtgttgacagtattttttatgctggaagttacaaataaattttaatgcccacagtgggtaatattatattacatttataggatagaaatgcagttcaaagaatatttaatgattgtgagaaaatgcacataatgcttttaaaaaataccaaaatacacatatgcatacacacacagtgtaatccagttttgtattttaaaaaatgagggcacaatgaggtagggggtaatgtgtgagtctcggtatctttatgtatataagtggacacccagaaaaaagataaagtagatacattcatgtttctagtcagtgtgtgtttatcagggaggctctagataacctaattttttaatttataatttttgtaatttatatgaaagttctaattagaacattttaaattataaaatgaagaattaaatgatcagatactgaggtcttaaaccttgaatatataaaatatttcagatcctgttgtagatagttgagggattggctctgcatagtttaacattgtgaaaacacaaatgtgtacttgaaggacttttttttttttttcctaactgcagcgcttcatttttcctgaaggaccttcttaatgacttttagtactcagtgaaaatacccacacttatttgtaacaatatatttttgtatgaaacaaatatgttcccttgtgacggaaaatgatgttgaagctgtgtgccgtaatagtagctgaagcggataattgtgtttttgtgacttatgtcagaaaacaaagttgatgaaggcactgatatggaatcagttttatataatatacttagaagaaggaggaatgatttttaacataacttactttagtctccactggaaaaagctttcttacatttagaatgatctttttatttttaaaatgataaagctttaaaactttctttgaatattttccatagttttcaaaatccagactcaaatttgtcttaattccaaagaatctttgtttttgccttttaaactccaggacagctcctctggcaatgtatctgaaggggaaagccctcctgacagccaggaggactctttccagggaagacagaaatcaaaagacaaagctgccactccaagaaaagatggtcccaaacgttctgtactgtccaagtcagttcctgggtacaaggtagaagaaaaaagcccctgactcagcttctttactgaccagcctctccctgaaatattttaacttgactttcacgattgtggagcttctgcctgctgtacctcactagctgttcttctatggtgtgccctttgtccgctgctttcttttttgctttatttccttggtggcttttctgtcacttttggctatggtttaccttctgttttctgtatatgtacaatttataagtctttttttttctttgaaagaataaccaggcaagtatgggtttttaaaacattatttcataggcagaagtttatattttctttccttggagtaaagatcataattatttggcattttaaatgccccagcatttagtgtagctaaagctgctgagctataaagtatgagtggatatactgttagactaagttgcattttttttagtgcctttcattaagaaagatctgggtttaatctaaggattatttgatccatatgctaaatttagctaactctgggatagaaaataataaaacctgttacttacattgtagtgatttttagcataaccttggtaaagagcctatatgattctatggcaagaattaaaacatacttgttaacttgttgatctgattatcctcagagtaaaggagtaggttgtcagcaactattattatattttgaacttttcctccctctgtctgcccctcccttttcttctgaagaaaaggtgaggtgagagatgagtagccttatttgcatatagggatttaagaatatcataaaaggaagaattagctgtacagtttcatatttgggatggtggtagtaaaatagactaccttttgattcttttggtctgaaatgtattagaacatgcttttattgcacttatgaaggtgtattgaaggaaaattttagagtaagctgatgagaaagttttgccaagtgaaattgttaaacaccttgtatgtcagaactgtgattgtggtaaataattcacaagaacaggctgaagtaagtcacctttccctcaaactaactagaacacgttctaacatgttcatttacctttcttcaagtaaaaaaagcgacattaagttagtgtatttcatattttattaggaaatgcttttatgtaattaacttaaaaattcttttttttttttgtagcctatagcaagcaaattttaagcttaattcagcaagggttggcttccaagggtggctgcaataggctgcagctatgtgatttttgtacttgtttttacatatatagcttatgtaatttctttatataaattaatgcttaataactgaaagcaagtgagctccaaagatgaaatttcagaagcagtatacatgaatgagtgtgttctactggtctgctaagagctttaaatggaagtggccgctcaaagcacagtgtcctgttaactcttgagtgctaagtagatctttgcaacagtaagcttgattgatcatgggttaaaaagagagaatattgaaatagatgttttaatacaggctggaaatcagctattcaacactatcattgatttagtatacaagaaatcatatggattaactgaacttaatagtactcaagtaggatatgcaaaatttatattttacataatctgtgaacatttttagtacctaaaaatgtttcaggtatttcaaagatgggaacaaccagtatctagtcatcatacattaatgtgaacatgcttattaaaagttaacctctttataaaaagtattaataaaccaagatgtgcctaaatattagggtacttcaagctaaaggtcatagtttatatataaaaagtacgagattcaaggaagtaatgtatctgatgctttgcttaataagattcactagtgcttgcccttaattcatagaacagtattgtttaggttacattaacctgaaatttaaagcataattattaggattccggcctataaatacaataattaaaatctatactatattattgctaccatgaaagtcttatctttggctgtttttcaagtagaaaagtaagtgtactgtgagccttttatttgagatgctgagagctattaggatgagtatttcagttttcttgtcaatagtgatactctgatgatgttgcagttatttgaagtagaactgattgtctaaaccagacacacataggagtgtgctccattggtcttgtggagagtgctgcacattaacccctccctcaactgtgcaatccacttgagactggcttctctaagccacagttgttatctgctgtgtaaagtcctggatgccagcactgtggcttcttagagagggcagatgctttgtatatcgagctgcagcattcatcgtagaaaatgctacaaagctgtctctcttccccttctctcatgtttccctcttttcatcaagatgaaggctgttgggtaagaaaaactaagtgatttaacaaatcattatgatttaaacttagaaataaacctagaattttttggtgtcccttttatcataggtgtttaatgtatattttaatgattgtagaacttgaattgctctagaatgtgaatgactacccttgtgttttactccttttggcttttgttttgtaaagaatctcctgtgaggagttctgtttttagaatttaatattgtttggttacttccctgactttagtgaaagatattagagtatttactatgccagtatctaacttaaactattagtattaaataagtatatcttttacatttagtacaggtaccataaccaagagatttcttagttttgatggattaagagagagcattctgctgtatattatggcaggtacagatatgatcataactgaaccagaatttggattatagaagtgcacttcctagctgttttttatttaggtataggaacacacaatgagaaccttatgtttagaatgtagcagtaacaacagagggtaactacactgcaagacttaaatggtttgagcatgtgacactatccttttgttggggggagcagggtataaaaatatacatacaggagattagtttaatagtaaagttttatatgtatgtttaacttccatgatatttattattttgtagagacatttgtgattgtttagagttcttgtttttattctatttatgtataaggttgactttttttaaataaataagccaaaaattctttttgaatgcctctgtcatcttttgcaaagaaagataatttaaaaagtacaaaacttaagaacaaattgtttaggtctaacaggttatgaaggtggcagtgagacatttcaaagctggaatatatacaacgtttgagttttgtttaggttcctctttggttcagtaaattaggaaagggatgcatttggcagggtgggaataaagcagaaatgaaacaattctacttaaaataattattttcccagttcatctacgtgtgtgtgtgtgtgtgtgtgtgtgtgtgtgtgtgtgtgtgtgtgtgtgtgtatgtatgtatgtatgtccccttaccccatttcattcttggcccatgcttgctcttccttttttaccactgttatttacttatttctatagcatgagtgaacgtcattttgtaacagtcaagaccgtgacgttcggatgccctccctcccctggtaattttaagtgcagtgaaccctttttcctttgtcatttccatgtgtaaccaaatatgtctaaaattcagacaccttcactggaccatgcatgtttttaatctgaaagatcagtagtactcagagtgttcgtgtattttttaagtgactgcaatttttttttgcttgtctgaaaacttatttttcccttttataattttacattttatagtgaatctttctaagtatagattcttttattagacatgcaaagagaataatcacacaactaagttttccacaaacgtttatgtacacgccaatgtatgcatgagacatctttcaattaaaaatgtttaaactgatttttttttaaataccactataccaatgaggataagctgattttttaacttagattttatagctctagttttgcagttttggaaaatagcaggttttaaacaaaattaatatatgagctatttaaaatggtctttttagagtaagtcttacacataatggtcatttgctacttggattttcttgtccaattaatagtgacatttgacattgtatttagtctttccttccattcattaaacaaatcttactgtgcatgtagggagtatagaatgctacatttaatcttacgagatcatgctgtttaccaaattttatgatgaaattaatgctttcttcagtaggcagtcttacattgtaggcagactcctgtcaagttttgtctttcaaaatggtcctcattagcaagttaccaaaagtaaaaatagggcaataaagtaacagaattccttttaaacccatagtaagctcttctggcatgaatttatagccctcttctacccttccagccaaaggtcattccaaatgctatatgtggaatttgtctgaagggtaaggagtccaacaagaaaggaaaggctgaatcacttatacactgctcccaatgtgagaatagtggtaagtattgaaatgtctttttaaaattttaaccaccgtatttattggttcaaaaactagaatttatagtttcaggcagatttcaaccaaagagtcaccaaattaaatacacagggtagcttgtgaggcatagacacagcccatgtgttttcctctacattgtatattcatttctctttggcgatttgacattatagccattctctggaagtcctaaagcaaactagtattttatgtgccatattaagttaaaatttcttatgtgagataccactaatactggttttgatttaggccatccttcttgcctggatatgacaatggagcttgtttctatgattaagacctacccatggcagtgtatggaatgtaaaacatgcattatatgtggacaaccccaccatgaagaagaaatgatgttctgtgatatgtgtgacagaggttatcatactttttgtgtgggccttggtgctattccatcaggtaaagattaaaaaaagagcaaacattatctttgggtgatgagactctcccagcactccaaaaggctgcataaacgctatcatgacatgaagagcttgtggactcttatgtgcaaatatgaccaaagctgtgattatacaggtcatgtccaccagcttttcatccctagacaattccaactaaaggataagtgaaaggccagaatgcccctgctaagttttggaagtatagttctatagaatgagctggtgtttttctactgaaatactaaagtaacaaagcctttatttttatatgttatctatttagaaacaacaaaatgactgctacgtctttatacatttctatagaaatctattatagatttctgtaaattgaggcagcatgacaattccagataactttagaacagagttgaataaatcacagtaattggactaaaacattacacagataattgtgtaattttagaacttacttgcatagttaacactgtataatactcttataaaatatatgcctacaacgaagtttcctgggaatcattaagcaagcaacataattatttttctgtagtaattcagatcaagtatgtagtacaagttatcattgtgctgttaaagttttaaagtgctgtcagcagagtacaccaggacttgaaagaatgctgttaagacacacagctgccagtgagcaggagagaaaaagtcttaaaaaagccaaattccggaatgggttttgaccttttgaagtatgatagtgtttgaatttcaggaaagattgtactttcttaaaggtccgtatcaccgtatggcattgcatctctcccatcccccttgacttgcaatgaattttgcatggcattgattacattgattaagtttacattttttccttaaattaaggaactcatagtgcccttctcaccacaaaatccagagaggaatatcattagtgatagctaaggcagaagagtttagatgggcttaaaattcagtcctgtaaagataatttttcattctatattaacaatttttttcctaggtcgctggatttgtgactgttgtcagcgggcccccccaacacccaggaaagtgggcagaagggggaaaaacagcaaagagggataaaatagtttttgactctaatactgtatatgcatttaagtggaatatttggtgccatttacaacattattttcatgccaataaaagattttttttgcaaa

SEQ ID NO: 29 - DNA, 116210 bp, Homo sapiens
actcaatgtcggaacgttccgaagatgacgtcggagcgttctcgaatcccgtgtctctcggctgctgctgccgaaggaacagggaaaaagcaacaagaaggaagagcaatggcgacactggatcgcaaagtgcccagtccggaggcgtttctgggcaaaccctggtcctcctggatcgacgccgccaaattacactgctccgacagtaagaaccccaccacctcctcctccttttattatcctgtaacctttccattcacctagagccactgggaaaaagtgtgtgtgtgagagagagagtggcccccggtgtcctccatgcttctccctctctctctaaataaatacacacagagacagatcatcaatgcacagggagaggcccggctgccagggctgtctgtctgtctgtgcccggctccccgtggcagcccgcggggtgggctcgcagccccacggtgttgtccgtttaaaaggctactttgttgctgcttgcatagttttttgggtacctatctgggccaggtagatggaaacccagacttgggagaaaatgttgcattgtcaatttttgaaagaatttcatatacagtatttatatcgatctgtttgcaaataaacactctccctccccccttgactttggcttttttccccccttttttccttattttctgttttccttttctttttcatctgcagatgtagatttagaagaggctggaaaagagggtggaaaaagcagggaggttatgaggcttaataaagaaggtaagtggagctactggcattttagtgttagcatgtgtggcagaatcttcacaggatttcgaatataatgtgaattgttctgctgggtacagagtgactaaggcttgtcaaaaattgagcacgcccaggtgactactgcttcatgttaacttctttcaaagtataaatacaactggggggggggtaaaggggggtgagactgttgaaggcagaagtttactgcacttcagttggactccacgtttgaaccttctgatgcatatctgccattctccttgggagcatcattgccaaatggtggggcgttaaaatttctgaaatgaagagtggagttcccttcacaagcatcccagcctttctcgtgggtgaatgcacaacagcttaatgaaccccacatggtcagtcattccagcagctacttctccactcaccactgaaaaccattgtacatggcaaacctttgcagcaagttacatttggcccactttgcatttggtcacagattgttatgtggcaagcagggttaggagcatctgtatgtgcagcccctcagcagtcatcatctctcttttcccagcatggaaatacggtacctgaaatgggacacactgagtagataggtcatcccagaccaagatatgcaagagaagccacaacctgctgcaattgggcatcaaacacatatggtcgtcataaataaatcatatcctgttctcatttgcaagcctgccgtatgtaactctggcctatgggcttcaaatggagcaactccgggggccacttgctgctaagcaaataggtggattcatttgaattgtgattcactaactgatgtcttataaacataattggctgaaattgggggtgggaagatggcacaaggggacagaagaggttggtggtattgaaagagttcagacataagtaggccataggtgcattggtcatcccaaatgaatggagaaaaggccattagatgccaaagaatggtccccctcataaaaagggatgtcaccctggaaggcagctgaagcctgcgtggaaagatggaactcattttatgaatcaacacttcagatggttggttttctgtgcccaatcatttcctgaccatccactgagaggaaattttgtgcttcagaaaaaataacatgaaggttaaaatgcgtacatattcaaggacagttccctagcataatgtttctgctaattaagcactttgggaacaaaacattattctaaagatgtttgcttctaaatatcttagtgtgatcttgacaggtgtcttcaggatgcacgagggattgatgtcaagtggacttcttacaagtggcagcttatttgtgttaaatgttcatgtgtgttggcagtgggaagcatcactagagattatttttcttcacacacaaactcttgagatctctaagtgcttgcaagacccagttatcaggctactggcaacgtgtccataaaagatgatgaggctgtggaaatctttaaattaaagttgagtaaaggtcatggtatagcacaggattgtcacctctcaggtctgggtgatgcgttatgactatcacacacaaaactcacatcctttccccccagtccctgtttctatttcagaagactgttgttctcagattctctttgcctcatgagaaacagattttttttttttttttttttttgatacggattctcactctgtcgccaggctggagtacagtggtacgatcttggctcactgcaacctccgcctcccgggttcaagcgattctcctgcctcagcctcctgcatagctggaactacaggcacgtgccaccacacccagttaatttttgtatttttagtagagacggggtttcaccatgttggccaggatggtcttgatctcttgacctcgtgatctgcccacttggcctcccgaagtgctggaattacaggcatgagccaccgtgcctggctgagaaacggattcttttaagaaaaaatgaaaagctctcctttcctcagaagtcacaggtggtacatcccgcttattaggtcctttgtcctataaaggtacgaagatttagctcctaattatacatatttgcattaaggacacccactgttcagtgtaacttgaaattgctaacttcaccaaaatagccatatatgggctgaaatctctttgttcacaggcctggtggaacagacttgggtgagcaattcctgatggtctttctggtatatatgcatgcagttttctttatagataaaatatctatatactgaatacgtattcccccatggtgagaaattgaagggttgagctgagacagggtgtttatttggttacctggatctccagtaatgcttgccatgggccctctttttggagtgatcaacaaagtcctgggacggatacatgtttgtggatgggtcactgcaggacacaaagtagcctgtgtgtggctgtgtacctgtgcttatgaatgtatgtagattgtccatgacactgttggctttaagcaggtcttgagaagaaattcggctttaatgggaatgaatgaacaaaatacagtttagaaattccaactgggaattgaagggaagtggttccgatttttgttgttgttgttgttttgttttgttttgttttgttttgtttttttgagacggagtcttgctctgccgcccaggctggagtgcagtggcgcaatctcagctcactgcaagctccgcctcccgggttcacacccttctcctgcctcaacctcccaagtagctgggattacaggcgcccgccaccaagcccggctgattttttgaatttttagtagagatggggtttcaccgtgttagccaggatggtctcgatctcctgacctcgtgatccacccgcctcggcctcccaaagtgctgggattacaggcatgagccaccgtgcccggcgggtggttccgattttgatgtttttttttttttgtggtaaaatatacatagcataaaatttatcattttaaccattttgagtatacaattcagtggcactaagtactttcataatattacacaactatcatcactttccatttcccaaattttccatcatcccagtcagaaactctgtacccattatgcaatcactccccattccccattcctctcagccctggtaaccactgttctactttctgtctctatgaagttgcctattctgatacctcatataagtggagtcatacaatctgtatccttttgtatctggtttatttcacttcgcatctcttcatagctcatccatgttgtagcatggatcagtacttcattcctttttaaggctgaataatatttcattgtgtatatatactacgttttgttatccacttatctgttggtggacatttgggttgtttccatattttggccattttgagtaatgccactatgaacattggtgtcatatatttttaatagactaaactcaggaagagaagttaggctggaaatgtgaaataagaattattttggtttggccaggcatggtggctcacgcctgtaatcccaacactttgggaggctggggtgggtggatcaggaggtcaggagatcgagaccatcctggctaacatggtgaaaccccatctctactaaaaatacaaaaaattagccgggcgtggtggcacgcacctgtagtcccagctacttgggaggctgaggcaggagaatggcgtgaacccgggaggcggagcttgcagtgagccaagatcgcaccactgcactccagcctgggcgaaagagcgagactccagctcaaaaaaaaaaaaaaattattttggtttctacctctatctggccacaacttcagaagacacagcaaggacttgcagactttttgaataacttgattactgtaatacagttccccattcctcacccctttaaactttctttcaattctttccatttctttcagttctccacctataaagtatgaaatgttaactggatgctttgaaatgtctgtaataaagttttcatgtcattgttattatttcatctaaaattagctaaattatagctaagaggaatttgccaattttttttttttttttgagacagaatctcgctcttgttgcccaggctggagtgcaatggcatgatcttggctcactgcaacctccacctcgtgggttcaagcgattctcctttctcagcctcccaagtagctgggagtccaggcatgcgccaccacgcccggctaattttgtatatttagtagagatgggtttcaccatgttagccaggctggtctcgaactccagacctcaggtgatctgcctgcctcagcatcccaaagtgctgggattacaggcatgagccactgcacctggccccaaatacttttgaatgttgtcatcacctgggttcagaaggcgttgctagatccatgggtggatatgcttagatgggcttatatccaggacaacctgggtactggaaggagcaggatagcactttgagtcagcttcctacattttgatctatgccctttggaagtcgtttcacttctcttggcctatttgcccatatttaaagaaaggggggtggaactgaatgtcctctaaggtccctttgagacctctgaacccaagcttctctattgaatgtaccttcctttgagatgcagttatagcaggcaaactgtttctaaagaaacttaaaaaaaaaaaaaaaaaaacccaagccctcacattaaaaatatcttaaactacttcaaaaataactgggtttattttctcaatttataacttcttggtggcaaaaatcactgcatctcatacacaagcaatattctgctgcaaatcatttgtgaatggtatttggccttcagcattccgagaaaagtggggttctgagtccaaaacccaatgtgttcccctagtgaggaatgatttgaccccagtcagcttggatcagtcaggcattcagatttcctgagaggaggactcccagaaaccttattagcctaatctgtgaaaggtgtttatgagagaaaattccaaggacggccattcttctgtgctaaccttttcaaataatttcctcctcagctttttcaagctaattagggaaaagctctcagtgatttagaaagatgttccccttgcctcacctgaatttttttttaaagaataccaattcatagataaggaatagggttcctgtgcctcataagtgtccctaactataagacagaaaagaataaggttgttgtgatgattaaatgagataatacaaaagggcttagcacatagtaagtgcttaatgaatgttggcttttactattattatcattattaatgaagctagctctagaaaactttattctaattaggattttaaactaatctgtgatgaaaagaaaagatacgtagcagaaactttatttttagagtaaaccattttgttgtaattttatgacactaatgattttttaaagaaacaatttctatggatatcaaattttttttttttttttttgaaatggagtctccctctgtcacccaggctggagtgcagtggtgcgatctcagctcactgcgacctccacctcccaggttgaagtgattctcctgcctcaggctcccgagtagctgggactacaggtacccaccaccacacctggctaatttttttgtatttttagtagaggctgggtttcaccgtgttaaccagtatggtctcgatctcctaactttgtgatccgcccgcctcggcctcccaaagtgctgggattacaggcatgagccaccgcacccggccagatatcaatgtttttaatagagtgcagttaagtgatcattgataagttttatcaatagctgtcgaataatacttaggctgtatatggcctatggctaagaagagtttatacaaagttctttctagggactgggagatctaaaaaacttttttcaatgatcgataagttgttttattttatcactgagaaaaaaaaaagtcctgaatagattcctgtttgggtctcttggaagcctacacttgtcactttgaaaacttgcctgtgttttaacgttcccacatgttttgatgtgatgtagataaactggtggaaagtttccaatttgaaaattgtgctggggccagtaagatattgctgtgactataagagtttgctgttcttctgagatgctggtggaattgggctggaatataggagggtgcagagaacataggagcatgttcagctcaggcttaggagtcttgcagttgtggctggatgggagcaaattggagaaggtggcaactgacctggttaagaatgaagttttcttagaatccaagccagagaagccagcagcaggccatggagatttatgggaaactgcgaacagcttccctttatcattatagacaactctgttatctatgttaataggagatgggaagacacaaagtccacagattacacagataaacctcatttttaccattaatttcaacttcattccccattaagcctaccttcctccccttttgctaacaagcagtaacatttgttcactttggcgttacattatcatctctcttatctggcccagcttttgggatggaaggatgggagagatggagcggcttaaaggtggtagggaggaaagatgagacggagaagggaagggcttggagacctataagctctacaggtgcagcccactgatggagcaggggcatgccacaaccaacacaacacagatgagaaaggacatcctgatcatctagtttggaaaatacaaagcttccaaaatgagtatttctttatacatacaattatttccttgtgcctgggttcccgtgtggaagaaatgtggctctgtctacttccacaacaggaagctagaatggacacacggaaacactgtatatgataatttgccttctaagttgccctgtaccagggtctcatcctgtatcattctatgagaataatgtttttactgctagaagatgtagaccattacacacacatacacattcattttaaaactacttattttttttaataatgttcatgttacaaaattcaaaaggctatccaagtggaaagtaagtctccctcccaccccatccccagttgcttgtgtattcttccaaagatattctgtgtgcattcaagtagatacatatataattttgtcttcttgttctcacgtgaatgatagaaacctatagtattagctgatatcttgccatttccatttatcttagagagctgtccatgtcagttcatgagaagtcgccatgttctcttttggtgcctgcatagtagggtaacaatttaagcctctgggtgtcttgccaagtttttaatacgctcaactgtttctcagcctcccttatgtgtttgacctggagggagctctcctgacgtgccagaactgggctagacaccagggacacagcagtgaaaaaccacaacccctgcctgccctcagggtgcttccagcctggtggcgaaagtacaggtagaccgcgatgagtgctctgatagggaaactcaggtgctgctggaggtcatggtgggggggcctcactgaggtaggggctcagtgccggcctcccagaggaaattttatgtaagctaaaacctggaggatacaggaagttacccatgtgtagagctgggcaggacagagttagaggaaacgacagggataaaggcccaagtgccagagaatatagactgttctgaacctaaaaagtcctcttgctggagtaaagatagcaaagcacacagtagtataatatttctcaccagtggcaccactgatggtttgagccagatgcttctttttgggggcgctgtcctgtgtatggcaggatgctgagccgcatcttgcgcctccacttgctagatgccagcagtgtctccctcccctcccccaagtttagacaaccaaaaatatctccgtacattgccaaatgtcccagggggacaaatcgctctgatagagaatcactggctggtgaggctggagaggtaagaacacaagaaaaatagactaagatacagaaatattctgccaatatctgtccatgtgttaggccttcagcccatgtaagtcagccttgtcgattactcagcagatatacctgtactgtgactatcccctggcgctgagctacatttgggaggatctaaagagagagaagcctcggtcccccagggaaccctcctcccaaagttcccaagatgactcttccaaaccttggagtccagtctgcagtcactggtgacaatagtgagttgcaggttctaattctgggtggcccaaccctccttcactgtgggtggaggagacccaaagcatcaattctggtaatgatggcatttattatacagtggcccccgatgtcaaaagtaccacatcgcattggtgaagcagtaaggatttcagtttatatttaaagtcaggctgaaaatacaactggcgttctctgcagtttgattacccacgggatatgtctgaaatggggatgcacatgacggaaagcaaagtggctgctttcatgatttccatgttaagcctgggaaggtacaaagggcaggggagggtctgattcctgaggccttctgacctgtgtgccaggtggtctgcagcatcagttaagactgtgaggccatgttgatgctttcagccggcggttcccaggggcctgccgtctctgctgcagaattgatttagaaaagttaggcagatttgtttctgtatggttttccgggttggttgcatttatatccttcaggttaacgtttcgtttatgacattttgtttcattcatgacatatttcagaagtaggcataagatggtagtactcaatgcagtgagaccttgtcctggtcaaatccctcttctctaaggaccccacacactgaggtggcccactattcacatctggagacagtggtcactgagtgattgcaataatcaaacatagccgtaatggagagggagagctttagccagtgggttctactttttcagaatattgtaggaatggcaaggactgacttctgtgtgtgactgtctcctaaatctcccggtccagtgttctgctgattacgtgctcccagctgatgccgtttggctggcattctcttactctctcctgtggtagagctcagactgccaaatggacctggatttggaccctgaggcgcttgaactaatgatgaaacctcaggaaatcccttcttgcaagtgggctgaggctacagcggagcatccttaatattcaggggctagacctggctgccctagtcgtctataagtgaagctggaattctgctgtggggaaagcaatgtttttatggagacactttatccttgtacctgtggtttctcaacacaattctgcttgccaattttaagggatcaagtgcttacagaagaaatggaaaccaaataaatactctccagggcaggacgaagtggcaccaggtcaccataatggggaagataaaagtgagtcgatgacaggctctttgaacacagaagcacttaccggtgtacctgattctgtgatgctaattgtaaatctgtgaacattaatggtgtaaggatacccttaactgtagggggagtgtgagttacgtgaccttacctcaaggcattgacaggccacagagtcctggggtggggtggggacacaggacacccagtccgatgatattaaccacaggtgagttcagcattccaggggtatggaagatgctggagacatggtcccagtttggttatatcagaccaaggtgatagtccagttctcaaaaagtatatgagtcacaaaaggacaaatactctgtgattccatgtataatgaagttcctagagtagtcagattcatacagacagcgagtagaatggtgggtattcaggggctgggggaggggaaacggagagttagtgttgccatgatacagagtttcagttggggaagatgcaaaagttctggagatggactgtggtgatggttgtacaacattgtgaatatacttaatgtcacagaactaaccgtacacataaaaaatggtgaaaatggcccgggtgcagtggctcacgcctgtaatcccagcactttgggaggccaaggtgggcagatcacgaggtcaggagatcgataccatcctggctaacacggtgaaaccccatctctactcaaaatacaaaaaattagctgggtatggtggcacgtgcctgtagtcccagctgctcaggaggctgaggcaggagaatcacttgaacccgggaggcggaggttgcagtgagctgagatcgcgccactgcaccccagcctgggcaacacagcgagactctgtctcaaaaaaaaaaaaaaagttaaaatggtaaattttatgttatgtgtattttaccacacacaaaaaggttcattggcattgcaggcttgggagtttaatggagcattatttaaatcttgaccatttattggctgtgtattaaattaagcctcaatttctacttttcttttccagagtaggaataatagtacctatcagaattgttgtggaaataaatgagatgctatctggtataaagtaggtactcagtaatggaagcctttgttgtgatgatcgttgtttttaccgggcacttgggtcttcgcctttgtcttaagagctgccacttccaggggacagactgcgttcttactgctccgggggatgcccggggctcaccaggcatcttttgtcaacttgtatgtctccagttctttaaggatgccccgaataaagacaaagggattggactggtgtccctgtactgttagtttcaagagtgaatctggggctgggcactgtggctcatgcctgtaatcccagcactttgggaggcccaggcgggtggatcatgaggtcaggagttcgagaccagcctggccaatgtggtgaaaccccatctctactaaaaaaaatacaaaaattagccaggtatggtggcatgtgcttgtagtcctagctgcttgggaggctgaggcagaagaattgcttgaattcgggaggcggaggttgcagtgagccgagattgcaccactgcactccagcctgggggacagagtgacactccgtctcaaaaaaaagaaaaaaaaaaaacgaatgaatctgtttcaatgttttgcaaagtgtgttcattctggagaccctgctgtgttgtcctgtagggtacttcgtgcccccggccccaggctggtcatactaaaacgaaacaaccgggagtgaagcacaggaaccaggaatgtccttttttttttttttttttttttttttgagacagggcctctctctgccacccaggctggagtgcagtggcatgatcaagctcactgcagcgtcgatctccagggctcaagcgatccttctacctcagactcctaggtagctaggactacaggcgtgtgctgccatgcctgcctaattttttttgacttttagtagagacaaggtcttgctatattccccaggctggtctcaaactcctgagcccaggtgatcctcccacctcggcctctcaaagttctgggattacaggtgtgagccaccacacctgaccaggaacgtgcattttaaacaggctcctcaggtggctctgttgtttcctgaactttgagaactactgtttattggttgagagaagtggttctcaaccctgcctaccttgaaaattccttgggaagctttttaaaagcaaatatgccaggaccacccacagagattctgattctatagatccaggttcaggggttctagggagctgcttatgtatttccttttggagttttttgtttgtgttttaaatttatttttctggtaccttttgggctaaacacagcccaacttatgtgtttttttgtttgttttgttttgtttttaagtaacaatcctagctgtcttttattgggcattaactaggtgccaggcacagggctaaatgtgcatgttcgcatttaatcctcatgaccaccctgtgaggcaaatcctgttatcaaccctatttcagagattgggaagctgaggctcagagaggtcaagtgatttacccaaggtaacatagctggggaatagtagagctgccctgaaccccaaggcaggctgattccagagactgtgctctaagcactgtgtcctgatgtctgtcatcctaggagcagggttaggactaaggggaagcaagcaggcacccaggacacctgtttaaggaggggctcacgtgggcttctgcaagtgcggagtgagtgccccttaagtgttgcacctgggcacctgacttcactcatcctctcaccatccttggccaagagagcttgttctttaagcaaaatggcaaggctgaactacctttcattcccccttgactgtgtaagccagtggcctcctgatagggccctgggtctccccatcagggaaacgctctctcattccaaggccccagctttggggcctctgtggccagagtcctggcctcagggaaatcacaggagctaatgcaaactgtgttcctttttgggagaaggtgttagcaaagatggttgccaagcaactccaggggcgtctatctagagtgatgatttctctctttttcctccttttgaacatcttctaggccgctgttcagtttccctcatggcattgggattgttagtaatttcatgaagggtgtgctctctaggatgatggagcggagatcactcttcaatactgccacattagaggtgtccttttgatggtgatatgcctgctaagtgggtgtgaaagtcctttaccttcttcagccacagagatgccctagttgtcactgtctctgagagggcagtgacaaagaggatcctttggattggagtggctgggaaaggcacagaatgcatctcccacatgaggacagggcgatgtggcaacatttacttcccgtgactttggatttcacccattctccattaactgggacatttaagcattttatagtgattgccctgctggtcccagaggagctggtgtcacccccctgtctctctctcagtggtttcacagaccagaagagtccttgacagtcctttcctcctcagtgctgtcccctctcctaattaatcacctcctctgtgtggggtttcaggtgaccttcgatgggccccagaccccattgtctaccagctggtggtttgattcttctgataaggacctggagcttgtgggttcaagcaccttttacacttaatgggacagaatcccagccagactgtcaagaagagggtgatccactggaaaagaggaactggtcacatttttgggtgggaaggggcagtagctcggtcgcccaggctggagtgcagtagtacaatcatagttcactgcagccttgacctcccgggctcaagtgatcctcccacctcagcctccctcccaagtagctgggccacaggtgcacgcccccatgcctggctaattttttctattatttttagagacggggtctccctatgttgcctaggctggtctcgaactcctgggctcaagcgattctcccactgcagcctcccacagttctgggattacaggagtcagccaccacgcccaccagaactggttacatttgcttaaggttgaatccatttggccaacccatgtacaacagccctgttagccaagtccccagactccaggcttctgttcccttgagttactccttccatcattgtgcccttcctcatcatcttttgcagaagcggggcaggacccagagagaattagggactcagatgagtcctgccactttcagtggctgagacaaaagacttaatggcagaacacaaacccggtacacaagccaggtttaaacagagtaggggcttatttgctttccaaatggagttactgggcatttctttaaacagtagacaaccctacagctttttgaaaatcatatttgcttcacagaagttttcatggcacccgcttttgtgccctttctgccagctcctcccttggagcgtgaggctttgccctcggtttgctctgcatttgctccggaccctggctcctgttcacaccccaggtggtccctgtgtgtggcgattctgacatgcctgcagctttcctgacctctcctccacagagtgctcatcccacccccgggtgccgcaccagacagcccctcacagatgtcattgtgcatctcagactccactagacccaagagcaagccgagcctgtgcgttttccccatcactatctttagaaagaccccctcctcctctcctccctccctcccatcttagcaattccctgcacctctccatctctctccactcccccacccccatcccagctagcctgcctcatagcctacctagatttttataatagctatttaattggtcttcctgtctgtatcttccctgcacaccacttcaaaaattaatcttctgaaaattcacatgtatcagtttgttcctcaagtgaaaacctctcagcactccctcatcgaccagttaacacagcattcaaagtcctcagtcccttcctatccggacaggtggcctgccctttgcagcagcactttggacaagtggagtcctttccctgcccccttctctgcctctgcctgccctctgcatctagtgtcttccccttctccccttccccttgcccctcatcctccttccccagggccagccatactttctaaggaagccaccctgccgctcgggccaccccgcctggaccttctccgcaccctgtgcatgctagccatgcccagcgtgtactttgcccccaaatctcgcacctccttgcactgctgcagactcttcccatggtccacatgtgtcttgtcatcatagctgcattagaatcttctggaggcaaggtggaggaaaagcgatcatatcatccccttttctttcctaagttatctttcaaccagcagtgttatagttcgactaagcatcttgtttttgaaatacctgtattgtctttttctttttttaagaaaattgtggtaaaatactataccatcttaaccattttcaagtgtaaagttcagtagtgtcaaggacattcacatgattgtgtagccaatcttcataactcttttcaccttacaaaattgaaacttcatacccatgaaacaacagttcccatttgtattttcatttttaaaaagtcagtctggagatggcctatgaggttttttgattcaccatctgatattttgaagttgtcaagattctaagaactggaaggactcctaaagtttctgttcaagtggatagctggagctacaatgcaaaacacagctcaccttaggacattagctccagcatcctaggtcagcagagaaaattccatgaaaaaatgctaccgctggggtgcagagtcacagacatctttgagcacctaaagtttttcatttaatattcagtagtaacccccactctgcaccattctcttttttgcccttgcagctcagtgttaaaatttttcacatgtataaaaaggttgaaataacggtaccatgatcacctatagaattaaacattagttcacattttgtcttgttttcatatatatatatatatatatgtatatatatatatatatatttacatataaagatctatctgtatatatgtcttataaagaaatatacaggccaggcatcgtgactcatgcctgtaatcccagcctttggaggccaaggcgggtggattacccggagtcaggagttcgagaccagcctggccaacatggtgaaaccccatctctactaaaaatacaaaaattagccaggcatggtcacacacacctgtaaccccagctacttgggaggccgaggtgggagaaatgcttgagcccaggaggcagaggttggagtgagctgagatcgtgccactgcactctagcctggccaacagagcgagactctgtctcaaaaaaaaaaaaaaaaaagaaagaaagaaaaagaaatatacagtcatgcattccttaatgatggggatatgttctgagagttatgtcattaggtgattttgtaggtgtgcaataggctatgccatctaggtttgtgtaagttcactctatgatattcccattggtataacctattgctcctaggctacaaacctgtacagcatgttgctgtactgaatactgtaggtaattgttgtaacacaatggtaagcatttgtgtctctaaacagattgaaacatagaaaaggtacagtaaaaaatatggtattatatactcttatgagaccactgagtatgggcctgttgttgaccaaagtgtcattatgcgactgtgtgtgtgtatatgtatatgtatgtgtatatatatatatttatatttctgtagcatttgaaaataagttatagacatcacgacacttcacctttaaatatttatcatttttccacatcttgattgtgctaccttgagctgttcacttaaattctcagagcctcatcatacataaatatgtatgtatgtttttgctgaactatttggtaagtcacagacagcatgacacccctaaatacttcagcatgcatctcctaaaattagaggcattctctggcctaatcataataccagtatcacacttagaaaactaatggtaattccatactcatatctgatacccagttctcgttcaaaattcacctgtcatgcccccacccccaaaagcttatagctgcatttttcaaactagatcctgttatggttcatgtactgcatttggttgttatatctcttcagtagcttttaatctagaacagtgtccctcccccacatgtgtgtgaatatatgtataatacatatttctatatatatgtatacatatttttatatataaatatataaaacattgccatttaaaatgcttcctgttctggtctgtcttgtcacttccttgtggtgtcttaccttgtttttgctattccctgtttttctcctgttctggaagtttgagcttaagtatcattggattcagactcaacattttggtgcaaatgtgtcccaggtgattctgagtgcttcattaagcatcccatccaggggttacaagatatcagggtgccctattattagatatggatgacttcgtaaggtggtgaccactgctgcccattgcaaacgttgtattttccttctgcaattagcatgtcattctgtgggtaatgctttgacacccagtgaatatcctgtcccccaaaaggaaattttgtggaatcctctgggcattcattgatgacccttgcctggatcagttatttctttggggattgtaggatggtcattttcaaattctgtcattctgatctgcttttattggttgacattcttcaatatagaagacatctttcccatcaacaggggatgaactattaaattcctcctaaaagggcagagttaagtttttctctttaattatcagtgctcatagtaagtagttgaacactgatgattcttttattttatttcattttcattttttgagagacagagtctcattctgttgcccaggctgaagtgcagtggcatgatcatagctcactgcagccttgacctccttgattcaagcgatgctcccacctcagccttccgagtaactggggctacaggcacatactaccacaccacaccaactttttattttttgtagagacaggatcttgctatgttgcccaggctggtctccaactcctgggcctaagcaatcctcctgcctcagcctcccaaagtgctgggattacaggcatgaacactgcaccagcctatgattcttttttttttccccctgtagcctaatcttgaaggtgaaggtgatggcctgtgattcttaagctaaggaggaacaaggtttaggactgggtacactagaatttcaagaagatgcttgtatagtgtgaaaaccacaatcagtgggaagtcttagagagaaagtgagctttgtagtacaaacctcaggaagtaaagtgtgatccaatcttggtagagcatgagtttaaaaacattgagaaatattatcccacacagtcaagtgaccctctactttaacctggggaaggaagaagataattatacttaaaataatccttctcccacctttcagagggagcacagtatttagcctgggtctggtgaaccactgaagttaaatgggaagtcatgatgagtgatgctctgcaagtcagaagccagagctgtgcttcctgcattgctgactgcgtagaaagtgaccagttgtccaggaggtggaaggccctgggctgggctctgtgtggaatgtgaaggtggaacagtggccctgccctctaggaactcacttgcagcacctgggaactctgatgttgcttagaaaatgaaatgtgattagaatgccttagagcccagggaaggaagatatctcagtctatggtcagccagacctttaacctgggtctcagacctttgacttaaaggtagaggctgtttggtttgtggttttacatgggccacagtaaaggatagttagtaggagtcaagttaatgtttgaaaaatgaatgaaagaatgaatgaatggacacctcgtgcagaggcaacacagcagctaggatttggacattcagggcattgtacagggaaggaagagcttaagcaaaggctttgagggctatgagttcctcaagaggttgcttttagaaaaagaaattatggtgaaactccattaataccaaagagaaacagttcataatttattccagttgtagacacactcagtgcctaactccatgccgtctttttttgaagtagagttttcagaaaacagccttctgttttctttggtagtgttagtgtttgttttgctttctccattcagggtgctggagggagagttattttctctctctctctctctgtctcacacacacacacacacacatacacacacactttttgggtgctgctgaccaattaatttgtaagttcttttctattagaatcagtgttgtgctagtaaatgtttaacaatctgctatctaaaaaagttagtgcatatggaaatatatgtttattatacattttactgatttaaaaaagctgtttagcatatgctttataaagaataaaatatttaaattctttttttttttttttttgagactgagtctcactcttgttgcccaggctggagtgcaatggcactatctcggctcactgcagtctccacctcccaagttccagcgattctcctgcctcagcctcccgagtatctggaattacaggctcctgccaccatgccccgctaatttttgtatttttaatagaaacagggtttcaccatgttggccaggctggtcttgaactcctgacctcaggtgatcgacccgcctcagcctcccaaagtgctgggattacaggcctgagccactatgcccagcctaaattcttttttgtagatttcatatagtctatagattcttaccaaatgctttggttgacttctgccaaattcttatatccccaaccttcctaaggtttaaattgacaaacaggtgtaaaccccacataagtattggttgatattttcatttaagtcagtgagtaagttgaaagggaaagaacaaagataaatgttaaaacttcacttgattgttagtgacgtgactttcttgctgaactgaataatggttttcaagtactaaaagaatatgtcctcattgttttgtagtattcacaataaagctagagacatgatatacagctgtcccttgatatcgaaggattggttctgagaccccaaatccttggattcttatcccttatatgaaatggtgtagtatttacatataacttatacagttttttcatagactttaaataatctctagattacttataatacctaatacaatgtaaatgctgtgtaaatagttgtcattctgaattgtttaggggataatgacaagaggaaaaggtctgtacatgttcagtatagactcaggcatcttttctttttcttccacatatttttgatctgcaattaagttgaaactgcagatgtggaactcacagattcagagggttgactattcttttaatttaacttacatcattaaaattttctccatcactttcttaaattttgataatcaaaaaaataataaatcatgccctgatttgtagtatgtgatgatttccatggtgtaaactctcctaccactgcatttcaagctgtcaatgtgatatcacagaactcagagttgggaagagatatgcatcagcacactgttacgtaggatatcctccatacagatacattagatggtaaatgactttgagagcaggattaagcaacgtgtggcccatgggctgcctgtttttaataaagttttattggaacatagccacactcattttttaatgtattgtctgtgctagcttttgcactacaatgcctgcatggagtagttgagacaaagcctaaaatttttactacccacagtggctcacgcctgtgatcccagcactttgggaggccgaggcggacggatcacgaggccaagagatcaagaccatcctggccaacagggtgaaaccccatctgtactaaaaatacaaaaattagctgggcgtggtggcgcacacctgtagttccagctacttgggaggctgaggcaggagaatcacctgaacctgggaggtggaggttgcagtgagccaagatcacaccactgcactccagcctggtgacagggtgagactccatctcaaaaaaaaaaaaaaagaagaagaagaaaagagaaagttcccaacccatactcaaagcatagataataagtgaaatgtagcaagataaattggaaatgatgagttttatattcaattgtaagcttatgtcatataacttttaataatttaataattggctcaccacattcctgagaatttaacaatcagctcttgtgagcctttacaagctggccccagcttacaactgcaaagctttgagggcttcagcttttagtgccaaaaatgaagctgtcactattaagcagcagcagctgacaataccagattggagggggagcctcactaagaaggatttgaactgcttgaaattatggtctaattgtccatagaaatcagaagaaagcaattttgaggttagttttcatatgatggggtttttgtgttttgtgtttttttttttttcctctataagggtctggggtttgttttggtttttcaaatgcttttttttttttttttttcagagctaattttcaaacccaatacagcatgcttttcttaccaaattttgtgagcatctgtctcgagccgttcagcccctgacagacgctcagcagcctccagaactcccacagatgttgtgtgtcccaagaaaggcccacttcctgtttctggccactagcgggaggagaggtggtcccaccagttgcattttgcaggggttttccttgccgccatttcctgccggttgcctttgaatggattacagatggtcagaaaaagacttcttggcacagtgagaggaccagtctccagtgctttgtgggaaaggatttatagcaggatggcagtttacgcctaccaagaatgggcctggctgccgcggccttatagggaaaactgcctgcctgcagagatgggctctgggggtggagggaacggccaggatgaaggggatgtttaaatcgatgtggcacctttcagccagtcggtgcttagaccgccgcgtgtccacagatgttaggcccctgtggaggtgtcgggccccgggaaatgaggtgctgctcctggtgcatcaagcgcttgtgggaagtattatgaatcctcatcttttcagagagaggtacagccaggtgctgttgttccctaccgcccgccctttttgttaaagccacaatatagagcacatttaatttgtttttgttttgttttgttttgttttgttttttgagacagagtctcgctctgttgcccaggctggagtgcagtggtgcaatctctgctcgctgcaacctccgcctcccaggttcaaggaattctcctgcctcagcctcccgagtaactgggattacaggcgcccaccaccacgcccagctcatttttgtggggctttttttgttttttttgtttgtttgttgttttttgtttgtttgttttttgagaccgagtcttgctctgtcacccaggctggagtgtaatggtgcgatctctgctcactgcaacctccgcctcccgggttcaagtgattctcctgcctcagcctccgaagtagctgggattataggcacctgccaccacgcccagcctaatggttgtatttttagtagagatggggtttcaccatgttggccaggctggtctcaagctcctgacctcagtcaggtgatctacacgcctcggcctcccagagtgctgggattacaggcgtgagtcactgcatgtagcctacatttaatttttaaacttttaaaaatatatgtaacttaaaattttaatactttaaccagtttagagtgtataattcagcgttactaaggacattcacagtgttgtgcaaccattgccactatgcatttccagaacttttctatcatcccaaacagaaactctaaacccattaaacaataattccccattcctgcctcccctcagccttggtacctgttctacgttctctattctactttctgttcctatgaagtcacctattctaatcatctattcccctcatataaggggattcatgcagtgtgtgtccttttgcgactcgtttctttcactgagcgtaatgtttccaaggttaatcgatgttgtagcatgtaccagaatttccttcctttcaaaggttaaataatatctcatcgtatgtatatttgacattttatttatccaatcatttgggcattgtgaataatgctgctgtgaatgcgggtatacctgtttccatctgtgagtgggtcaaatgtatacctgtttctatctgtgagcgggtcaaacagagacctggagagaactgatgtgactgggatgatgcttcagtccttccgagataagccagccgaggtgcacctctccatcagagctgacaggaatgtgtgtgcggaagggccctgtgcaggattgctggccgaggggtcagatcaagctggcactctgcttgccaaactgtgcgccccctgtgctgcatctgaccagagagggtgcctttttctagcttgcacaaaggtccttgcttcatggtctggaagagtcctgccagagctgaaaatctgagaggccaggatcacacaaggccactagtgcttttgctttccagggaggaggcagcagattgctgggcagaggttgtatagggagggttaggaaggctgaactaactgggtcaagattcctgggattgggtctccctctgtcagaaaacagggcaaccttgtgcaattacagagcaagtcctggtgatctccatctgtgagatgaggggaggactgtaaggtccctgccagtagtatagggctgcctgtcaataaagaactggcaaaattcatgggggactagagagaggcaggggcaagcctctgggaacagggtatggacgacatagaacaggaaggtgatggaacttcacagagggaggatggtacagagaacttagaaatctgagagccagggaagcgcctcatagaaagtgtgataaagtaaacagctacattctttctgaccaaagatggtggtggaaggaggaggagagagaagtagtggcattgatccttcataaaattattcagcacttactgtgtacagacacagaatagagggtgcaagagggaaacagaatcgtgattcttcacttgtgccctgtgaagctctcctgttgcatgaagaattgcagaggtgtgagggcgtgttttgtgtgtgcacatttctcctggggatggttctgtggtttttccttttcctttcctgtggacttcttcgccctttcaacaacaacaacaacaacaaaatgtttaaagaaatttacagcttgtgggggagacacacctgtgcccagaaataacaagggggtgagccacatgggagggggatggaaacacgtgaggaataagcttgctgctttaaaagttgcattttggtgttagggtttgtgatacatgcaaatctcctgaggaagagtcctccctgtttggggtaaagggctggggacagccacttgcaaatctagccctattgacatgattggtgtttggatttttactgggagatagactgacagagatacagagaaagactggtaatatgtatgctagctggagaagccacctttcagtcccatctctgcgtatagttgatcgtcgaggaactcgatggtgcagggggaaaggcgtagctttgcagtcagaccttagctaacttcttggccctgctgcttgcttgctgtgtgactttaggctagctaccttgcctctctgttcctctgcttgctcatttggacaacaggaccagacctaggaagattagggataagtcaccagctgccatcctatagatggtcagaaaaatggtagctggtattattgcctggaggagagggcaggtctgagaaatccagtggtttccctgggttagtttcagggttgtaaatcattgtgggatacacataaaaaacgagccagaatttgagagcaaggggagggaggtgttgtgggaagttgagtttggaagtgtctaggtgaagaggtaagttataaggaagcggggcagcaggaaggaataagaactgaagtgacatatcctgggggcagagatggctttctgccccttttgatattgactttcattatctctgagatctgtctgtatcttgtcctccagctcagcctacacaccagggcccccactgagggcatttgcagagtctggggagatgggaaaccgggagctcctgagagggactctcttgcaggcaagtgaggatcactttccaaacaggcaggccatatggagcatgggtaccccttctgtgcagaaggagacaccacagtgtcttgcagcagaagcccatgctcgctctgtgctcgttcttcaggaggcacagggatcagtgctaggcctcttaagtcagagagatctgggttcagcacagaggaaagtcctataacctctcacagccttatttttcccatctgcttaatgggatatcacaggtagctcatagggttgttggcaaagttgaaggaagtgaacacacagcatttagctcaatgcatggcccatgggaaatgcgcagtgaacatttcctttggttgccattgagtagcccctggaacagaggactagggggtgtccttcaggatgagcttcctcatggtcctctcctgtgggaacagtgtgctggtgaaggctgtattcccgatgccatggggcatgacaggcatgaggaaatgacatctggaaatggtccttaaaccagggccctaggcagggagccaggagtgtgcaaacgtggtggcacatctttcagaatgtcagttcaactctaattctacaggaaagtatttttttatcattatatttcatcaactctaagatgccatttatcagaaaatacattgttattttatgtaacactgagaaaaagcactgccaattaaactacagccactgtggattctaagacatcctgattttaaagatgttacaatggaagtgggggtgagtgcagcttagaattaataaaatacagtagggcaaaaatagagtatcaaggaaaatttgcattaatttttaagataaagcatgaaatttgaagagtcacagaaagctcttgtggtagcctcagaaggtgcaggtatgtgtgaacttgccagcccatcagggcaactctgtttaaagagctgagagcagctggggcttaatctgcctctaagttcagatgggaagcaggagggaaggaagtggcccagacttcagagcacccattgtcattcaggggcctgaacatcctcagggagccccagtgacctcagggcccctggtgaatcatttgtgttcacttcacttagaaggaaaatcaacatacagcactttcaggaggagaagaggtgtcatgaaaccaagcaaacaatggctacacctccaagagggtgggaaaccacaggacggcaccaccctgtaagagaggcagcttcctgtgacttgttgtctttcagtacagcctgcatgacccatgagcagcacatcttctagcgggggcccagccctggtgttttggtgtttgggtggagattcagggagaaaaccaggcttgaccctcttgcccttaagaattcctgcgcatctcaggtctgtcagaagggatctggttacactaacttcttgccagagccctccccacctgcatatcactacgtagggacggactctgggcagttgtggtgttgtcaaggagtgacgccctggtgtggtgaccagccttctgccacctccttggcagggaagtgaaatcacacctccaagccctgttgagattgtccatctcctctcaggccagtggtgatggcctgtcccctctgatggactaataatagggtggtgataatggtgcaataatggtcaaattcagtggagcagttttattttcagactgctgtgtcgtggggttaggagtggaggataagccttaggtcatgggacttgcaggtggaggaatggaggtgaggagaccaagtgatccactggggtgatagctagtggcagacctgagtctagagccatgcagtgcagggagagggcccagagaggagcagaaagcagtgacccagccctgagaacacactctgggctggcaggctgagggaactggaggctagaagaatagtcactgggccgaggagcagcatgctctaggctgggtgcacggagctgcaatcatggagggcctggacctccatgagtagatttatttaatgatgctttttcttcatgcaaaagtgatatgtgatcactgtagaagatgcacatcaacaaaagaagaaaaaagctagcctatacccctgtcatctggaattaaccagtgctgaccttttgtttgtttcctgtaacttacaaaaatgggataattttgtattatgttgattatggtgagtacctttcctagttattaagtattccattgtaaatgtatttcataatttatttaactaattccctgtcattggatatattggttgttttcaggttctcattattaaaaataatattgcaatcaaatgaatatccttgtagctaaatttttgcacacattcatgattatttctaaagcataaattcttagaagtggaatgctgagtctaagagtgtgctgtttttgaggcttttgatactcattgctaaattgccctctagaaatattgttccaattaatactcccatcaggagtgtatgagagtggctgttttcccaactctggccaatatctcaccaaagattgtcagatatttgatgatttaataagttcaaatgttatcttattttagttttcattcttatgattactaataaggttgaacatttcgttagctttgtgtatgttcttatatgagttgctttttcatggtttttgcttaattttccattggcctattaatcttttttcccattgttttctaagagccctctatagattaaggctaacttacccatgtctgtcatatttggatcacatgagttttaggaaatcttaatgctcaaacattttctatccaatcttgcctataggaccaaagtagctaggaaaatagaaatttccagataattctcaaaccacatggcaggtgttactgaatgctggcaggggccatttcgtatgaatagttatgctgacaagacagtactaataataaaaactaccatttactgaacaactattatatgccaggcacttttcatatatattagcctttcagtcttatcaccctgcaaagagccgagtaaactggggcagagaaaaattaagaagctcttttaagatcacacagctaataagtggcagagccaggatttgaacctggatctgttcatctctaccacccatgtactttctactgtcctgagctcttgttcttggggtaaacaatagttttacagtttaggtcttccttagcaccatccacatctggacctgttggttggctctagaagagtcaaccctgccctgattttacctgcccttgctgctgtacattatttctcagctggacctgttctctaggcttccagcctgcatgctttctccttgttgctagaggtcctgtctgactgttttgctactgataaagaagcccaaaagataccaggatatgatttctctctcaaatttcaggatcaaaagttaaaactagatccatccagtccttaatctagtggccaactcccaatgttctcacccatcaagccaagaagtgagttggagtgcacatggtaactggtcttcagaggtgccttttcagggaacacgcctcccatgtagtctcttctctgtgacgcttggctcaccctgtgacacactttatgtatgtgttttaataattgccattaagatataattcatatgccacaaaattcactcctttaaagttgtttttggtattaatatattcacaagtggtacaaccaacaccactatctcattccagaacatatctgttagtcccgaaagaaaccttgtacccattagcagttgctgaccattccctcctcccctcagtccctggcaactacgaatcaactttctgtctctatggattgcccagttctgaacatttcgtataaatggaattatataatatgtggccttttatgtgtggcttctttcacttagcataatgtttcagggttcattcatgtggtagcaggtatcaatacctcattcctttttgtagctgaacagtattccactgtaggatatgctacattctgtctattcatttaccagttgatggacatttggattatttttaccttctggctattttgaattgtgctgctgtgagcatgtgtataagtttttgtggacatatgttttctcttgggtatatacctaggagtgaaattgctgaatcatatggtaactccatgcttaattttttgaagaactgtgaaactgttttctaaagcagccgcaccattttaaattcccaccaacaatgtatgagggttctaatttctctatatccttaccaacatttgttattatcagtcttttttatcatggccatcttagtgggttttaagtggtatttcattgtggttttgatttgcattttcctgatgactacatgatgttgaccatcttttaatgtgcttgatggcacctattggccatttttacaaattttatttcttttagagacagggtctcgctgtgttgccgacggtggcttcaatctcctaggctcaagcgatcctcccaccttagcatccctaatagctattagattatttctctttaagttttaagaattctttatttattctggatatgtataagaaattatatatttcttatcagatataatttgcaaatatttttcccttctgtgggttgtcttttttgctttcttgatgatgtcctttgaagcacaaaagcttttaattttgatgatgtcctgtttatcaaatatttcttttattgcttacacttttggtgttatatctaagaaaccattgtctaatttcaggtcacaagatttgctcctatgttttcttctaggagttttgtagttttagctcctacattagatctatggtgtctttcgaggtatgtttttgtacatggtgtgaagtaggggccaaaattctttttcatgtggctatccagttgtctcagcatcattttttgaaagagactattctttgttccattgaattgtcttggaactcttgatgaagatcagttgaccataaatatgagtttatttctagactctcagttctgttccattgatctatatatcctaatgccagtaacacactatcttggatactgtggcttcatagaaagttttgaaactggaaagtatgagtcttccaactttgttctttttcaaaattgttttggctttaaacaataggaacttcttgaatttccatatgaattttaggattactttgtcaatttcttcaaaaaaaaaaaaaaaagactgggtacttacaaagattacgttgaatctgtagatcagtttagagaatgcaaaccatcttagcaacattaggtcttccaacgcatgaacatgggaaggctttgtatttacttagatcttaatttctgtcaactgtatttatagtttccatgtacaagtcttacatctctttggctaaacttattggtaagtattttatttttgatattattgtaaatgaaattgtcttcctaattttactgattgtccattgctagtgtgtagaaatacaactgaactgattttttttttttttttttttttttttttgagacagagttttgctctgtcacacaggctggaatgcactggtgcaatcttggctcactgcaacctccgcctcccaggttcaagcaatcctcctgcctcagcctcctgagtagctgggattacaggcacccgccacgatgcccggctaatttttgtatttttggtagagacagggtttcaccatgttggccaggctggtctcaaacttctgacctcaggtgatcctcccacctcagcctcccaaagtgctgggattaaaggcataagtcaccttgcccagcccacaactgattcttatgtatgttcttttattccgcaaccgtgttaaacttgtttgttaactctcatagttttctttgtgtgtatttattccttagggctttctgtatataaggtcatgtcatctgcaaatagagatggttttaccttttcctttccaatctgaatgcattttatttatttttcttgcctaattgctctggctagaatattcagtataatattgagtactgatggtgagagtggacattcttgtcttattcctgatcttggggagaaagcattaaatctcttactattaagtatgatattaactgtgggcttttcataaatacactttatcaagttgaaaaagtttccttccattcttgttggttgagtgtttttattaagaaggggattggatttgtcaaatgcattttctgtgtccgttgagatgatagtgtagttttgccctttattatgttaatatggtatattacatggattgattttcatatgttgaaccactcttgcattgctgggataaattccacttgttcatggtacataatcctttttatatattgctgaatttggtttgctagtatcttgttggagatttttatgtctatgttcagaagggatttagttttcttatgatgtctttgtctggtaaggtgatactagcctcaaagagttggagagtgttccttgtgactcagtcttgaccaatagaatatggcagaagtgacacagagcctgggtcacaagggtcttgcaacttctgcctgagtttctttgaaaactcactgtcaggatgcaccttcttggatccagctaccaagctataagaagtgcaggccatttggggtggaggccctccagtcaacatccctcgctgacaccaagcatcagatgccagccatgtgaatgggccatcttggacatccagctcagtagatctacagatactgctgtagcttcagttgacatctgattgtaagggaaaactgcccagttgagtttagtcaatccattgaactgtgagagataataacaaattgtggttttaaaccagagttttggggtagctttttacacagtaatggagcaggaatccattggctccagccatccctgggccatagctttctacaagaattgtggaaacatgcaatggtgttttcttatctcctgtctcttgagaaggccctgagaaatgaaatggccagaaggcagcattgaaaagaagagggaacctgggtcctggaacacccatgcctagggtaaccacccctcacagtggtggccagtggcccgttttccaaaaggtgcttgcctagctgtactctgcctctgcccttggcagagtgagtcaaaggctcacagggctcacacatcagtcagccttcagccactttgctgcccctgtaccacaggagggttttgcttctgtgagtgcccagacctgccattggctggcatttggggccatccgctcacttagcttcctagatggatctgtcatgtggcatttatccttaatgccccggcttttctgaggcccgcaattggtctgcaagctgagcatctcagaccatcttgctaatcccaccttcaagcctgtggacaaagttggactgccattctaaagacagataggacctaataaccagagaaacagaaccagggtgggccccagctagatgtggaagcttttgtgagctggtgcagccttcccaaatcccaccctaaccttggggccaccatttgcttgctgaacataggaaatgaccaaaggaccctgtctgttgggtattcggtttccctgctgcagtctctaggtggatcagcttgctctgcctgcaccaagctcacgccttcattttaagaaaaaaagctgaagatttcgtatcttttatttcaacttccataatatcaagaacctaaagatgtactgtacatgaaaagatgctcaacatcattagtcattagggaaatgcaaatcaaaaccccaagagacaccactctccatccagtaggatggctataatactatatatattttaaaatagaaaggaaaattacaagtgttggcgaggattgtggagaaattgaaacccttacacattgctgttgggaatgtaaaatggcacagccactgtggaaagcagttcggcagttcctcaaaaggttaggcatacagttatggtatgatccagcaattccacttctagttatatacctaaggtcacacaaaaacttgtacaccagtattcagagcagcactattcacaatagcccaaaggtagaaatacccaaatgtgcatcaaatgataaatggataaatagaatgtagtatatcctacaatgagaattattcagccaaaaaaaggcgtgaaatatcaatacctgctataacatggatgaaccttgaaaacattatgttaagtgaaagaaagaagcaaaggaccatatattggatgattccatgcatatgaaacattcagaatagggcaatccgtagagaggaaatagattagtggttgccagaggctgagcaaaaaggggaattgggaagtacggggtttctctttggggtggtaaaaatattctcatattagatagtggtagtagctacacaccattgaggattacacattgaattgtacactttgcaatgtttaaaataattaattttgtgttatatgaattttacctcaataaaaattttcaaaaaaaaaaaacccttctactttaatggttattgctgtaagatgacaatatacattgtttgccatgtaaaggccctttcccaggcaggaagagggactggccagagaataggtgcttcccagagtggcttgacgtggcatgaagagtacggtctgggagccaaagaattctagttccccatctcacattccagccgggcaacttcaggcaagttcctcagcctggagcaccctgtttaagtcattctaaattgcagatctttctctaagaatgcttataaagtacccactatgtgctaggcattagtccagtagtcccccttatctacaagggatacagttccaagacccccagtggatgtctgaatccacagatagtactaaaccctgtgtctaccatttttgcctatgcatacgtacatactgtgatagtttaatttttaaatgaggcacagtaagagattaacaataataactagtaacaaaatggaacaattataacaatatgccagcatcactattcttgcgctttggggccattgttcaggaaagtaaggattacttgaatgcaagcaccgagatgccacagccttccatcagatgactgagacgctactaagtgactgataggcaggtggaatagacaatatggatctgctgggcaaagggatgattcatatcccaggtgggatggagtggacagcatgagatttcatcaagctgctcttaacagtgcacaatttaaaacctatgaattgtttacttctgggattttccacttaatatttttggaccatgattggctgcatgtaactaaaactggaaagtgaaaccgtggataagcaaggactgctgtattagttccacttttcagctggagaaaatgaggcacaaggaaacagagtacttgtccaaggtgaggcagccagtgagaggctgagcagtgctccaggacaggcatttcaactgcagaacctgcggtctcatgctctgctccatgtggccttctaggagtgcctgaccccccgacctcccatggtgttgtgggatccaatgccattagacaccgggaaactgtcttataaacaaaaacactgtgcagcacgcacaaagctcagtgttgctcctgtctcagatattagcaatgagatttatagaaaaaacacctggagctcatctgcccaagtgatctgtcctggccttacccaaaatgcattcctcctggagttcaccaaggacattaggattgtcttatgtccagatttctctggacacaggaaaatgtccctataagggttctgagaggaccctgagattgccatcactccatggggccagaacttgggggcaaaggtaaaccagatgaatactggaattcctgacaccagctggggcaggtaaacctggaagagtgtgctcaccgccggtaagttacttcttttttgtatttagaaggcggtctgtagacagaatcaagtgggaagtataccccatttctttcttggggcttctggccctggagccgttggagatgcaggggttggacagggaggctctctggcccagcatttgacagctgggttgtaagctctggggggcagtatgtgtgatctggagaagatacaacagagctgggagccggggtgttgctcagattctggcactggtgaatctgagaatcaggaaggttcagaaaatgtggcagaagagctggtgtgttggcagcctggactcagacacattcaaggcgccaggctttttggccccaggcaggcatcatttcctgctacctgcagccctgtggactccaccctgaagcacttctgctctggcccctcctcttcgccacagcagcaggctatccaagcccccgttctctaggaccttcatagtaacctcttgactgggctttctcctggttagtgcctggttagtgactctccaatccagctttactgtctccagcatgacttttccagaactcagatcggattgtcactctgctcctacactcatgccagtggctccctggggtctgctgggtgaagttggcatacagcccctcactgtggcccttgtgggccctcccaggcccagccactgcctgccggcagagtccctgtgctctccacagaccactcaccctctcctctgactcctctgatcctgactgctgccttggtccacctggcaacttcctactcatccatgaaggcccagttcaaatgaggtttccctgacaccaccctaaacctcagacccatgcagaattagccaagtcctcatctgtttacatagcacatttcaggtgtttctgttacagcatataataatattgtattatttcttatttcacctgtcctcctttctggtggactctgggtgcctttaacacagaccgtatgtctcatttatattcctctttcccatgcctggcacatagtaggtgctcagtaggtgtattttcccatgggtgttcatgggctctctgagtgcaacaaagtagatactcatcagtcctctctgccctgcatatgaggctggacctaaggctgtcatcccttgtggggtgtttaagttcttcctctcctctgggtatcatgagcagagatgcagggagaaaagggagaagactcatctcatctcaccttgtgctctaactgtaacagctgccattcagacaccccagatggaccattcagtgtaggctgaatggccaaacaggctcatatgtgctaatcaggtaccatcttgaacccagtccaaacggggaagctgccagcatttacacccatgtgcccagcaaactgggagtgaaggcagtaaagagtgcatcgggctgagacatggaaagcccagggttggatttggagtgtttaggccagggtgagatgccaaaccatcaggcaaccatcttccatgttcaagttttgattttcattttaagtgcacaaaatccacaagcttttttttttttcatgcagcagcaacagcttcctaaaaacgtctctcagctgagccattgcccataacagcatgctatttggcctttgtaaaaggaaaaacctctgtatttgtatctagaacacccacagctgaatgtgtcagatgctgctggctagtttgattggttgccttgcatgggtggcttcccgcaggggctggctttcctaaagttgagtgggcagtcccgagttcttcagagatttctgcctaacctgaggaatgcctggtttaagcagagatgatgcttcgtgaaggaatggattcctttgcttttctgttgggagtgactgaggttcctagagtctttctcgtgagtgaaaaggaagtagaggtgtgctccagccaactcttcagatgaggcaagtggattgataatggaacattcctagactcctagagacctggctggcagggtgcccggtgatccaggagttcgggtcatttccacgttgctctgggcccttgtttgggtgccagacgcgcagagtaattagaaaggagtggaacaatcagggaagatgatgtttgccagccacaggcctttttttattgtccctgtgggttggatactgggctgatccaggtgggacagagatcagtttattacccagtctctcagcccctgctcctggctggaatttcacagaatctaaccgatttctgcacaggccactcctcttatatcaaaaggctgaaatccctaggggtgtggcctatgcagcagctgtttctctcctggtttccaaggataatgtcaagtgcctccgagtgtgtgaaattctggctgaaagtgaatgattgaaatgctttttccattaaaccatctccctcctggtataggtattttcctaacaacgcttatgcaaatagctgtgaaaagtaggaaatggtaaaatgtcgagtgtcttcggctcctggcagcatgctcagccgaagccttctgattttccaccaaaaaaagaaagaacgacaggcagaccaccagcctttggtgtggcactgggcagacacagctgggaggcctgtgtcgttttcttgtctgcttcttggagggcaggattatgttagaacactgagccattatgggtctctaggatcacatattgcgctttattgtctacacagccaatgtaagttattgatttgcaaatgggaagcattcctttccaactcccttgaaggaggctggagggaagctattttccgagggagaagacttggttcattctttgcaaaacatttcctgtgcagcccgactcctgcttttaggacctgcgccatcgagagcgagcgcacatgtgtagtgttcattcacgagggaggcaggcatttggcaaacgtccccagaggtccagagtgccacttgtctcacggaggcctccgctgttggcatcgggctcgccatgtgagtggagaagggtggccagggacgtgttccatggctgagtccaccctccacagagacagtaaagcagatccccagggagtccttccgtccctgctgtcttttgctgctccctgttcatgcgttcacctccttctcagctcttccttcccccatcatatgtggattctggggatgatacatctatgccaagtgaatcttttcactggcaccctttcactggtgctgtggatgggaggcagtgtcatggtcccatgcaccccttctgaaaacagccagatagtagtatatccttccaacccttcatatttcactgattctaagatgcccacttttttttttttttcacattttaacttctccaaagcagggatccatcttaaatttcatgttgtgttatcattgggtagtttggtttcttgtttcttactagtagataaaataatggtgcatcttagggcattgtagattcaaagaagtaggaaggaatcagaaggccagtggatgactatgatatagtttggatatttgtccccacccagatctcatgttaaaaggtaatcctcagtgttggaggtggggcctggtgggaggtatttgtgtcatgggggtggacccctcatgaatggcttgagccatccctttggtgataagtgaactcacgctctgagttcacacaagatctgatctttgaaaagtgtgtggcacctccccccacccactcactctctcgcgcttcgtcttccaccatgagtaaaagctccctgaggcctccccagaagccgagcaatgtcagtaccatgcctccacctcctgggttcaagcgattctcctgcctcagcctcccgagtagctgggattacaggcacacaccaccacacccggctaatttttgtatttttagtagagatggggttttgccattttggccaggctggtctcaaactcctgacctcaggtgatctgtctcagcctcccaaaagtgctgggattacaagcgtgaaccaccacacccagcctaaacctattttcttataaattacccagcctcgggtatttctttatagcagtgcaagaacagcctaacagactgctttcaagatgatttcaaatcctgagatgtcctttgagactctgttcagggccaggtgctatggagtaggcagatgtgtggagggaaccacctgccctgatgtctcccagttctaacactttcttctggggatgcttatgccacctgatattgtttgccatctgtccctgataatttacttttccttccccgcttctctggaaacatcaccctcagctgggagtttgttgccctaccatttaaatgctggcatcccattttctccctaatcactctctcctgggctttttaacacattcgtctcatttgttcggttgtttttctgatctttgggtcattttggttgtttgggtgaccctgaagctcttgtgtgattcagaggcttaaattctcaagggtccaggtataagagtactttcggctaaatattttctcttgaacatgatagaaacctccatgttctgtgcagtaggcatattcccttcactgcaagagtttggggttcctgtgggtttcatctctggtcccccatagcccagtgccatcccatgccccttctcccccagccctcctggtttggggcactgcctctcttggctgtcaccgttctacttttaatttactctggggatgcagcgcgtgccagctgcttcttccctggataaattggacatttcacctcagagcaagcttgttctcacagtttctgaagacttctttaccctctcacattttatcccttagctggtttcctcagaaagttctgagggtttttttcccttggtattcttcctcttgaaaaaaagagagagagagagaagggtgccactagccaaacttcccaagaaagtttcttttttagaaaaatttctgcctctgtcaccagtgttgtgaaagtcccttcagtatttctgttaatagggtttttctatcctttaagaaaatgggatttattttggttttatgaagggtcagaaaagctcttgttggccagaagagaaactgtctccattgtatagggaaatatgttccaagctccaaaccacaacttacaaatgaacttttggactaagaccagtgtgtgaagtgaggagtccgtctccgctgagctctgaaatggaaatgctggtctactggagttcaggctgaaagactcacatgctgatttcaagtgcgtggtctgaaagagtcaacccaccaacttgggccccttacctccggaaactttttttttttttaattatacaattaaggctggacactggctcacgcctgtaatcccaacactttgggaggctgaggtgggcaggtcccttgagcccaggagttcaagaccagcctgggcaacatggctagaatccatctctacaaaaaatacaaaaatgagcctatcatggtggcatgcgcctgtagtcccagcttctcaggaggctgaggtgggaggatcacctgagcccgggatgcagaggttacagtgagccatgattgcaccactgcactttagcccaggtgacagagtgagaccctttctcaaaaaaaaaaaaaaaaaaaaaaaccacacacttataaattattaaaaaaaaaaaacagcttccacaggggcatggagcacagaaagtgaagcccctcctgcaccctgcctctcccccagcattcatgcagcttgacctcattctgtttaagggtcaagaggattccattgttttggttcaaccaaaacccattcagtgagtcccagagaccacttttagccctgggaaaaactggccctggattcccagtaggcatctgaaagaccctggttttggctgctagattgcgtttcgtctgcagccctctcccctccactccatcacaaaaaggcagcctcaaatttcctgtaaagaagagtacctctccccgttctcagcagtgtggcaggattcgttctagtcatgttctctgaacgttattgaagttgtttttctgcaagcctacagtgtgtgtggcagtacgctcagcccagtgagggaggcagagcaaagcagttgctctctctcaagaaacttacagactcatcagaaaataagaatatacccatcagaatagcacccttcagcaaggtaggtgtgcgtatcaggatcctaaaatgttatgacgtttgaccttagtattgcatttctgggcacataaactgagtaggcaaacattaggcacacagatttatatacaaggattttcattactctgttgttgataaaagtgtaaaattgaaggtggcccatagttccaaagataggagactggttaagtaatttgtgatatatccattcagtggcatactatacagctgggtgaagccaagctttcaaagtcaatgatgaggccaggcgtggtggctcacgtatgtaatcccagcactttgggaggccaaggcaggtggatcacctgaggtcaggagttcaagaccagcctgggcaacatggtgaaactctgtctctactaaaaatacaaaattagccaggcgtggtggcacatgcctgtgatcccagctacttgggaggctgaggcaggagaattgcttgaacctaggaggcagagtttgcggtgagctgagatcataccactgcactccagcctgggcaatagagtgagactttgtctcaaaaataaataaataataaacaaaacaaagacaatgatgacatgggaaaataccataaaatattcagtaaaccatgttgaatactgactgtaatcaatatccgaattaatttttcccaacattttattataaaaatattcaacacatagcatagttgaaagaattttgcagtgaaatcttccttataactaccactggctgtatcattaccattttattatatttgttttatcatctataccccctcttcttcatccaataatgcatctgatttttaaatgcattttaaagtaaatttcaggcatcagcatgctttccccttgatactccagcatgcatatcattaactagtgttaactatttggttttttgttttgaggaaaaaactacatacagtgaaatgtacaaatgttaactatactttctctgagttttgacaaatggatactctcatgaaaccaaaatccctattaagatatagaacattaccaattatttttactactaagcacacatatttatttgtatatgtctatatctgtgcaatggattccaaggctgattttattttcttcgctgtattctttacgttctaaatggtgtgagtacatctatttgctcttttatttaatgggtattcatttatcatgtagcgtgtgccaggctctgccctaaatacaggggctccaggggttaacaggactgcagaattccctgcctttacggcacctacgatctagtaggggcaagatgagtgaacaaaagataatgcagcagggagatagtgagtgaggggctgtgggtggtcaagggagactgaatgatctgaggaaacagccagtgagggtcaggagagtctaggggacctggggaccagcagatccaaggaccctgaggcaggaaggggaacatgatagggtgggaggtcagagggggaggcagaagccaagccatacagggctttgcaggtgatgtgaggagtaaggactttatcctggtgtggtgagaagccattagagggttttaatcaggagagacatggtctgatttctgtttttaaaagctctgctctgtggagaatctgctcttctggggtaaaggtagaagcacggaagtcagaaagggaggcttgtgctgggatagtaatggatgtggttagcagctgtgaaggtagagctggctctacttcctgaaggattaaaggtgggatgtgggcaagagaggcgtcaaggaagattcttagattctttgtctaagcaactgggtgaatgatggtggtataactacgatgggcagacttgtgtaagaagcaggctctggggaggagagaaatcagtagttccgttctggacatgttgaatgcaaagtggaaacttcacctttcaaagctttccgtggagaagtcaggcaggcagtggctgggtgagcactggaggaagggaagaggccagaactactccaagttgttggtgcacagaaggtgcaggggcatctgcaatgcccttgggggcaggtgtgttttcgaattcagaattattcagactttggaaaagtaatcgatttacactcactgaggtctggggcgtcacctgtcatcaaacacataaggtatttctgtagcaaatcgtaatcttcacacttaaacagattaataaagactagaaatagcctcacattagttcaggtcaggtgttgttatgaaggcagtttagtcaccaaattaggtaaaacttggtttcagagctcttgagtttccgaattgcagaaaattagcaatcccctccctattctcaatttctactccccaaatgcaaatactttgaaaaaatttttcactgttcttttctgtttacttctataatgtcaagtaactgggttttcctgccatctcaagattcttaaaagctttatattatctactaacttgccaccatgaaaagtgagggcttatttcttcaataggccctccccactgcacaccccttttccatgcagccttccaatatagtcacatggccatttctcactaaatcagcattaggggcttatattattatgatcatgtgagtattactcacagctgaatgacctgccatactattattacatgtcctttcttaaacaactctgatttcttcagtcttttgcagagaagaagcaaaggataccagggtagaaggttatacagagttcccaccaagcttcccatgcctagcccaccccacatccctgttctcaagggtagcctttctgggctttgggggctaaaatcagcccatgtcaatgccccccacttcaccccacccactaactgtgttcagctaagtcatttaccatttatccaactgctctgcagcagcatccagaattttactggcatcttgggtctactctcatctcctatattgtaggactatcacattgttctggtagtttacgctttttaaaattaaatttactgtcattttttgtggggcttcaggagagagtagagatagacatagtttatcaacctgccatatttaacaaaaagcatcccagagcacttttcatagttcctcggccacgacctttttatagtgggtgtcagcagatgttccttatgtaatgattttgtccacctgttgcccagctcagcccacagagttggaaattggaaatttggaagcgctgttacaacaaattgctttctaggcattttaaatctcccagggttttcccagagcaatttaggagacctcctgaatgagcctaatgtgctttcagcctttctcgctacagtgaagagactacatggcatttgcatttatacagctattttgaagtagaattcttcatgtaaccagggtagcataaagggcatgcattggtcaggcagggtggagcttggtcaccaacaagtgtgtacactgcacaacttacttttgctctctaggccccagtcaccccatctacggtaaaggtggactggagcacctcattctttatccaaactttacacagagccctctgtataaaacgcaaaaagaggaactgttgtggttgaagaaggggcagatgcccccagaatgaactgagatacttccaaggtatcccaggctcctgtggacgtagattgagaagcactggacttgaagatgtctctaaagtctcaataggacagctctgtgaaccctgccttttcaaatgcttactgctctgcagaagtgaaacactctttgcagctggggtcccaggaagtgcagtcccaggaagtgcaggtcccatggaaggccactggacctgacatggcatagcaggcactgtcctaatctccctttcctggcacagaagtggaagcaggaatgttggttctagctgcctcttagagaagagagagatttgttgatttatgggttaagagccctgggatgggaatcctcccaacacaggctctgtaagaatacaggaatttgttttcccacatcatttgcttttgatttactgttttgatgtggggctgcttgatgactcagatgttatcttccactgccaaatcacacgttaggtatgtataacatttcctacacagtgacatcttatcctcttccacagtcatcaatggccataccccacacccgccatggggcagggctgggtgggagggggaattaaacaactcttctagtcacaggtatggggcagtggttttcaaaaccgttgtctttgttgttgatgttgttgtttgaaggatagaatcattttccaaagaaaatcttaaggcaaagccgagtcagtaaaacagataaacatggaacccctgctcaagttgaagagtgggatgaagtgaaataaagactccagcccctcttccagctctgccatagaggctccagttatagggacagacccccaggtcatttctggatctacctcctatacttgtcgtgacctagtaggataaataactgagcctcccagggccttcttgtcctcatctttaaaatggggctgtcgggggatggggtaacatctaccactattagctttgagtgagccacttcgtgtgtccccagtgacaaggaggcttcttattactgcctacttagaaggcttgcccccaaagggtaagctttgagccccacaacagctttcctgcagggaatgttttagaaaacctgatttgcacagtttgcaacaactactgttttcttttcaacctcttctttccagagaaggtccctgtaaggtcgtagtaacatccagttgttaagtgcttgtgattttgcttggaatgtaaacaatactctgtctttggccagtttgaaaaggaagttttatattttctcctctgtctttggaagtagccttactttagtaaatgcattttgataatgcatgctgaaatctatgattttggttacgttgaagatggggaccctggcagtagtgtggatcttctcaatgagtgtatatttgtgggtgttttgtagctgttaattacgttaagtaaatcaccataaaattgccccagtatttcccctccttcctccatgctggcccataggagctttctctctgagtgggaaatggctggttttttgttgttgttgttgtttgtttgttttttaagacaaagtctcactctgttacccaggctggagtgcaatgagtgcaatggcctgatctcggctcattgcaacctccacttcccaggttcaagtgattctcctgcctcagcctcccgcgtagctgggactacaggtgtacgccgccacgcccagctaatttttttgttttgttttgttttgtttgtatttttagtagagatggcgtttcaccatattggccaggctggtctcgaactcctgacctcaagtgatccacccgcctcagcctcccaaagtgctgggattacaggcgtgagccacagcgcctggcccagaaatggctgttttttcacttcactatttgaggactgagcaggcagcctgtcaaatgtattgattgccttctccaagttggagattgggagctacatatttgcttatcttccctagtgaaaaagcaaataagactgcttatctagtatttaaacttgcttttcatttaccctgtcaaaggcattatcccatgaagacataatttgagaagtatcttcatagaaaatagctctcattgcataagccatgaatacccttgccggtggagtccatgtattgcttctttagaaattgtcagtgctcacagctctcatctccctcagtgaattttctagcttccaaaccctgtactttttctcccaccagttctttcttccccttaagctctgcctccaacaaactgtggactgtgtgcatttagcttcagcctcttcttctataaaatgagaataataatggtttctccctcagaaactttttgcatggaaaaaacatgatattgcttacaaagtgcttagtacagtagttggcatagagtatgtgtttgataaagagtagtcattatttctctttgttgcctcctcagttcttacattcatattcacctgtctccctgaccatatttacctggtttatctgggactttgttgtattttcctcatcccatgggattaaaagcaagcacagcccctttccaagatgctgtgtgtgcctggagcctttctggttcaagatcttctatggacaactccacgccttgggcttcctccaggtcattctccctgtccttcagggatgggaagcattgatgtcacctggctgtcttccatatcagcaggactctgcttggttctgaataccatgttccttaactacttgtgcggtaaaaatgtaatttatgccctctaaaccccaatcctaaactgtgagccacatacaaggaagcaatatggcaagggcagttaagaacctaggtttggggccacactgcctgggtcaatccctgacccttggggcaagttatgtaatttttttttgtgccttggttttctcatctatcaaatagggataaaaattctgatctgtatttctgaagagtgcatttcaagcactctgaaaacaaagttgttttttttcccctaaatttgaggcacactcatttggcatcaaagtctgccctgaactgacatatgactatttattatgcactttatccaaattagtgtgattattcctatgtttcactgcagaaatattagtgtttctgattataggatgcagcccgactgctggggtgttatataatgtacaccatatgaccttactaaaacctgataaattcaatttgggaaaaccactaagcccaagagctttggataagggattgtggatctatagtagctacttcatagggttgttgaaaaaattaaacaagatacagtcatccttagtgtacacggagaattgcttccaggacccctgggtataccaaatccatgcttactcacatccctcagtcggccttgcggaacccgaatatatgaaaagtcagccttctgtgcaggcgagtttcatgtctcacaaatactgtattttcaacctcatttggttgaaaaactttggtatataagtgaacccacgcaattcaaacccatggtgttcaagggtcaactatattttgcataaagctcttagaatggtctctgaactgtgaatactcaataaacatttgctattattctcctaaagacataaaagagtactgtgtccatgagaatgagtggtttattttaccacagtaaaaatgtttgttctctttttaagtgaatggtttaaatgtttaatgaatgatataaaaatgaattttactgcctggatctaaaggaagtttgctgtttgttttggaaagaggctccaaatccaacaagagaagtcagtttcagcaaatatggatgccactttgactgtcagattttcttctgtattcttgacccagagcttgcttatgccagcaaagacagagtccccatcctttccttttcaacctcgccttccgttctgcatacattaaacacaggttggagtggaatccaaggtggccttactctgagatgttgtgcttcctggacacctgtagttcaggtggtccctgctgtcttgtgtctttttcatacctttgtcctcgatggcaaaccgtatcagctcttccttctatatcccaaaggtaaaatatttgtaagtctcttgtaaaatattacagctactatctttctcatcatttttcatccccagtctcaagcttttgccaaaatcatctaccattcagacttctctgttcacctgtataaaaaccatgggaaggtcctatttctccactgtccagcctccttctcatttagacctggtctgggtctaaccctccttgtctatttgattattattgctttgtttttttcttggtggccatgttgttttatcttctttgacgatcctgtgttttcttccatattgcattcttctgcaaaatagtcacaatttacattcctctgtgtctggcaaatcacaagactcccttattgcacatttttccaaatgtctccattttttaggtatatgtctatgtaataaaatgctattttcttagcacagtgctaaataatattacagtccagtaattcaagtttggatgataccaccaacattggcagagaacccaaatttgcacattagaaccatgcagtcatagaattggacagttgggaaggactccaactccttgttttatagatgaagcaactgagacctgagatcaaagtgtcttgctcaaccaaacacagttggctggtgacagacattgagccagaacccagttctccaggctagtgttcttattaaactttttatgtgcttttttcccccaaagtaatatatgtacagtttaaaagccaagttgtactaaaaacttaattcaatagcagtcccttgccctgtctctacccactgctagtcctgtctccctagaggcaaccacttttcactcttttagctgtttcttctagtatttactccatatctctataaagggtatatatatgagtacttcttcatttattggttttaggtatttaggatctcggaaccttccatcacataccggagggtttggctgtcacacatctccaccccctttccttcctccatcccttccctatggcttctccattctcagtgaaggtatgtggttacatcaagcttgtaaatatcaagtatctgaatctatccagtttctaagtcagataacaagctcagaaaatgagagacactgtacatccaaatttatttggtttctgggtttcagatgtgagtagtggaatttcaaatgatgaggaacagattccagaaaagtatccaaatctgttcccttctaaaagatgaaggctaagtgtttggatagtgagaggcatctatactgttcacttacagagccaaggagtatttatttccttgtgtcttaaaaacatgcttattgagtctgtctttgtctaccaatattaggcaatattggcaattccacttcctctcgtatgtaggtttttgcttgtcctaaaattattgcctcatggtttttacttgcattcttacctatatgtttatccttaattttggccactagattgggtatatcctgtcactatttttggcccagctggtcagacatactgaataaacccatcaattcccctgtattttctggagcccattagcccctcagcctactgtgctgctggtctgtgacaacagcttccctcttcattgtcttgggaagtccactgactggaagcctgtcttcgtcctgctcaatttactccctcttttgctaggactaatcttccaggggcatcctacatgaaaggtaaatttttcgagtcttcaaaatatggaaatgtcttggatctgtcctcagacttgattagtaatttggtggctacagaacattcaaagttggaagtaattttctctcgggattttaaagacattttcgtattgtcctctggctctagtgtcactcttaatatgagatgccagtcttgtgtgagaccactttcgttctctgaaagcttttaggatcttctctgtaacactgttgatctgaaattacttaataatatgccatggaggtttttttgttttttttatttttttgtttttttttttttgagacggaatctcactctgtcgcccaggctggagtgtagtggcgtgatctcagctctcagctcactgcaagccctgcctaccaggttcacacccatggaggtctttttttctttctttgggttgggcactccactggtgggcccttttaatttggaaatgcatattcttcaattctggaaaacgttcttttactggtggtggtttgttttgttttgtttaatttcttcctccccattcacttggttctctctttctagaattccttttgtcagatattggaccttatggattctaaaactctatcagtttctactttctgtttgcttttgttttcttttttgaaggctcttgtaagccttctagtaaaatttttatgtcacctatcatatttttaatttccaagagctcttgattgttttctgctttttttcttaccgttgcatcctggttttggtttctctctctgaggacattaataagtgtttttgaagttctcttctactcattgtggagcttctatattcctctattcctggttattgtgtctcagtctctttcaggtgggtgctgtctttaaatgtctggtgattcttggccattcatatttaagagtgaggcactacaagcggcttggaggttcagggtgttttagtggagctttttactggtggcccattgtaaagggggattacattgcgaactcatcatttctttggagaattttcagttgccagcatatggaggcattttcttagaagaattcctctctgttttttcagagatgaattatcccctttcctgcctggagggtgctctaagagcagatggaggcagaggcccaagggcatcacgccatgagagtggccaccctcagtccatccactctgtttagcctgcccatcaccccatcccttcaccatgcctcctgtcccctggtctggatcctcttctaacccatttctccagtaaacaaaccttcagactctcaagcagtctcccctcacattacccctgccatctgaagtacacagtgccttcagctcccaggcctcccaagggttatatcccaggcggatatactcactttgcatccaaacacctttctgtagacacatagatcactgtttcctccactctgcccagtcagcaatcactcctcacctgtcttccaaaaacatgtgcttgtttgctgatatctcccatttccattgtctttgcactctttttcacttctttaccatcattttaggggtgtcttggtcaagagaaaagataaaattgaggagtaaccattaatccaccattcattcagccaatcaacagatagtggaaccaagtgggttcaaggcactgctggggatggagaagtgaacaaatcagacaataattccttccttcttaaaacttccaatatagtgtttattggaagtaccatgctcttgaatgccacagagtagcaagtctagcaacataaacctgtaaagagaagcttgggcctgttacgattcaagaaccaatgtgcagacacctgtgaacccatatgcttacttgaacccttgctgtttgtaagtgatcacaaatgatactggaaatggggttgcctctgctgtatgagctgggagccatcaagtttgcaaagcaccggaatagccttttacaacaaaagatgattcatgtcagccttcgactttgtaggagatagaaaacaccttctgctactctagaaaatcaggattaccacttcacaaggttgtggtttaatctgaagaatacagaccaatcaaagttcctgaccaaaagtaactaataatataaaaaaaaaaaaagataaagggccagaggatgtattaatctccagtattactaagactcttactagcttagagctgtggctttcaagctattttaatcatgcacccttatcagtaaaaatttttggagctggaacccaagagtatgtgtatttaattataaattacatgcgcatactagtctaatacattagtgatactatgaaacaaaatttaaaagttaaaagggcaagctaaaaataactagaattagaagttttaatatgtttccccatcctaatagatcatcttgggcatataaagctcacttagaaacaactcactgggagaatggaaatgaggacttggtcataccatccaccattgcttagctatgagatactgggcaagctacttaattctaagcctcagtttcctcatttgtaaagtgataataaaaatactacaatttccctggctttctcatagggtggctttgaggatgaaatgagctctgtaggtgttttataaactgcaaggcgctcagcaacatgcaaactcaattgtgtgaccagttagccacctccatgccccagccaataacttctccctgagtttattccaccaccccagatatccttcctgcaggtcataagaagtaatgatatgaaggtggacaaatgaaacagtgaaagtctctcatccttacttaaaaagagagacaaaaccacaaagcaactcaagcccaaattctgcagctagtcagtaccatcctccccattcacaggagagcacctttctccctacagctccaagggtgttatgttttccacactatagatgttatggatttatttttggagacagggtcttgctgtgttgcctacgctgccttaaactcctggactcaagcaatcctcccacgtcagcctcccaagtagctggagctacagctgtgtgccactgtgcccagctgacattatggattttgagaaagtaaatctaatgttgagaagcagcaatgttgttcctaagacttgaagaatttcagtgtgtccagctgaagtatagggaagggctctatgacctcagcaagacaattatgtgagctgcctggtggcaagtcactaagccctacagcagtgtcactgaaaggtgtctggggcttacacacttggagtatgtgcaatgtcaccgtatagcaaaactgcatttctggcgtcaaccaaagtagaggattaattatgcaaagggaaaataagatgttccaagcaccagttaatggaagtgttgtgagcacaggagcaacaatcacagttaactgtactgcgcacttgctttatgcaagcctgtgcaaggtgtgccacgtgtgatcccatttaatcctcactgtttccatttccattttgcagttaaagaaactgaaagtgagagaggttaagtagcttgctcacaatcatggcggagccacaatcaaattcagattgctctgtctccaaaacctatacctgaaaccaccctactcttccacctatcaaatgagttctatattttcatctttgttagtgactcctctctctgatacccatacaatcaatcttctacgccattcaacaggacaaaactggaaggagactagcgatctcctttgctagccactctcctgaggttagaaacccagactcactgcacaggatcttaaagcagcagcagcaggtgtgtgttagtcagtttttttgcatgactataaaggaataactgagacttgataatttataaaaacagaggtttcagccaggcgtggtggctcacgcctgtaatcgcagcactttgggaggctgaggcaggtggatcacctgaggttgggagttcaagaccagcctgaccaacatggagaaaccccatctctactaaaaatacaaaattagccaggtgtggtggcacatgcctgtaatcccagctactcaggaggctgaggcaggagaatcgcttgaacccgggaggcagaggttgcattgaacagagatcacgccatcgcactccagcctgggcaacaagagcaaaactccgtctgaaaaaacaaacaacagcaacaaaaaaacagaggtttcattggcttacagttctgcaggctgtacaggaagcatggcaccaacacctgctcggcatctggtaaaagcctcaagaagattacaatcatggctgaagccaaagcaggaacaggcatgtcacatggtgagcgtgggagcaagggggtggagggtaggtcccagacttttaaacaaccagatctcacatgaactgagtgataactcacttatcaccaaggcgatggtgctaaaccattcatgagggatccacccccatgatctcatcacctcttaatagggcccaccttcaacattgggaatcacatttcaacatgagatttggaggggacacacatccaaaccatatcaaggtgatctgttggtttattataactgagtcttccaaggacatggagggaaatttgcaatttaaaaaaacccaaccctgcccttttactggaaactggagtgcaagtaagaaagcattagccccacagaaggcagctacatggccgagctttgttgtgctgagaaccacagctctctgtctagccaagctgcagcctcatcaagggactggtgagccttggaggtcttgctccaactttaataccttcaccccactgcccagcatgttcctcacctcatacccatcccacagtgctcactcttcactccttccaaaaagccttgcgctctagaaagtcactaagctatcagtcatctataccccagtatgaatattaagccaatatatgacttgctggtgataggtacactttgatgattttcttgaatattagtttgaaaggctttgcttctattgctgtgacctacaggcatcaggaacagatggggtgaaggacatctgaatgaggcccacgctttttttttttttttttttttttttttttgaggaataaacagtctttactgggctcagatcaggagtccatgggtcttgagagcttctgtgtatttgtcagttttcttctccacgttcttttcacccggtttccatagcctcatgagctgtttcttcttccgatagtggatcttggctttctccttcctcttctccttcagggtagatgccactgccaggtacttacagcaaacctcgtgagccaggcgccccacgtaggcaaagtttcttgtaggcttcagatgcatgaccttgagggcagcaggaaccaccatccgctttttcatgtcatagggcggtgggatgccgtcaaacaccttgaggcgctccagggcggcccggccttgctttgtcttgtggggcaacatgcctcgaggtcagccggaaggtgcggctagaggcccggaagtggtaggggcctcgggaagggttggtgttcatctgcttgcggaggaagaccaggtacttcaacttgtatctgtagaaatggccagaaatgatgatgccctcacagcgtacgacctccaccttccggcccagcagtacctacttagccacgatggccgccaggcggcccaggagatggcctcgaccatcaagcaccaggacctgcccctccgccatcttcagcagccccctgggaaaggacactctttttttttttttttttaaatcccaaatacaagttaatgcattttgctttgctctaattttaaattttttattgttaaatatccagcatatacagatttttttttaatagccaacccagatacagaaagcttcataaaacaaatgtacaaactcgtatgaggctatcactctttgaagggttaccaagatgccatttgtgaacccctcccagtgacttatcccctctgtgcaagattaactttgatcctgaaatttaaaaaccaaatttaaatccagtgggtaggaaaccatcattctcagcaaactatcacaaggacagaaaaccaaacaccgcaggttctcactcatagttgggaattgaacaatgagatcacttggacacagggtggggaacgtcacacaccggggtctctccgggggtggggggctgggggagggatagcattaggagaaatacctaatgtaaatgatgagttgacgggtgcatcaaaccaacatggcacatgtatacctatatcaaacctgtacattgtgcacatgtaccctagaacttaaaaaaaaaaaaaaatgcagtgggtagattagctgtccccatgtgtttaacaacaagggatagagtcataatcttttctagctgcagtgttttggggtcctgagtggttctggtaccccagtttttcggtaaaggatttcccctgggtacattatgcatttttatgcagctttatcctaatacatgccagcttcaatgtgtgctgcatctttggaggctgcagacttacccagtagtgcccaaacttttggggacttccttttctgaattatcttaatttggtaagtcagctagatggttcctttcttttaaacaaagctgtgttagggcagctgatcattcagccttgaatttgggccattacagagttaaaccctgaaagagtcgttttctttcactttgaacattctaagcctgttttactggttctaaatctatttcaaaagacaaggagctggacatgggggctcacatgctgtaatcccagcactttgggaggccgaggtgggaggatcccatgaggatccctggccagcatggcaaaaccccatccctacaaaaaatacaaaaattagctggggcgtggtggcacgtgcctgtagccccagccactcaggaggctgaggcaggaggattgcttaagcctgggaggcagaggttgcagtgatctgagatctctccactgcactccagcctgggcaacagaatgagaccccccatctcaaaaaaaaatttttttttaatttgaaaagacaaggattttagcccaggcagcttgttacattgagagtctggtatccagcactcaccagaatgcttttggaatgcttgtgaaacctcagtgattttcttacagcttcatttgattttatattatttttaactccttatttggaaataatttctaatttccaaaaacatcaaaaataagaatagcacaaagaacattctatagcctttacccaaattcaacatttatttattgaaacagggtcttgctctgttgcccaggctagaatgcaggggtgcagtgataactcaccgtaacctggaactcctggctcaagcaattcttccacctcagcctccggagtagctgaaactgcaagtgtgtaccactgcatcagctaattttttattttatttcttattttttagagatagcggtctcgctgtgttgcacaggctgatctcgaattcccagcctcaaatgttgctccagcctcagcctcccaaagtgctgggattataggtgtgagccattgcccctggcccaactgttgttaacattttgctccatttgctttgtccttctgtttcttgggggtagggaatgggagagagacagaccgatccagatatattttcaatagtcacacgtaatatttttctaaaccatttgagggcaagttacattcttcgtggtattttaccaattacttcagtgtatgtgtcctaagaataggaatattctcttacataacctcagtacagttttcaacttcagtaaatataacatgcaagcatttactttaatataatcagaagaaaaaaccaccaacagacagtggtttatttttttctacacactgagcagtaggcttccattttcatgtggtttgcatacagcaatcttcaagtctaattgtttcaatcttattgaaattgctttctcctgtatcaacaataggtagagggtgcatattgacatctctgttttcaatcaaatgtttgtttactttctgccctcattagggactctaaacacatcagagagataataaaaataaatatcccatcctgctcccaggccttggaaatgagagagtaaacaccagtataatttaacactttcctggtccgatgggaaaatgttgcttttttatgtctacggcccttgagaggaggagaagctctccgctaaataaaatatcctttgtatcctctttgctgagcttcctttccttgactgactttcaccatgaaccccacctgctggggtaaattactgataagtgacccatgcctgtttccccctgttttctaaattcagtggtcagtgtttgtgacagctgtcatcagctgcatctcaccgtgctccctgcactctgcagggttcttggcttagagaacttagcttagaactccttagagttcttggcttgtcctgcataggaacgaaccttccagagcattccagctcccagctggaggtgagacagcacacacatttcccactggggcctccacttgggccaggaacaggtatggtgaaggtggcagcgatgttgggaaacttcttggctgctgggccccttccctgagggctgtggggaaaggagcattgcaagagtgctgtgcttggaagttttcagcagcacgaaaatcacatttataggttctgaatctgaaccatttcacactaagaattttgtaatacttcctctttctcctcctccaccctaacctctcattttaagttgctctgtcaccccatttcgcctattaaaagctagtgtctataaaaatttcagtttcaaggcagtgcattcctcattaaattgttttctctcagagttttctaaaaccagtttaaaattcagctagtgcccttctcagactctccccagcccccagaccctctccccagaacaacctctttaaaatctttttgttattttttctggtattaacccctctaaattagatgcttagactgcgttcctgatttattggttttaaacactgcctactgacttcccgttagaagaatttggccctcttgtaccacccaccctcacttctcctccccatcctcccagtacagctatacaggtaggcaaaattcatggtcagtgtttacagtatgatggtgatttaaatattattcactagggagccaaccagtgtactgggattaggtttcctttcttacataactttttgtttttcttttaataattgcctttaaaagaccgctttgtctatgagatgcccattgcacattctcctaaatgcctaccagtggcatctgccaaacgctcacaagcatcctgtgaactctcggtccccagctcccgaatcttccacctcctgctccagcctagacttgtgattccctaggcaagctgccgagcatcatgcagggatttccttttgctgtgcctctgaggcttagatccctgtttttcttggacctatttcttcctactttttagtttgtccattttaggggagagtacatcctctgacagcttcctgagaaagagtgcctgggaggcaaagtttttgacgccatgtgggtctgaaagtgcctttgtccttccctcagtctgaataatggttagttgggtatagagttttcagctgaagataatttcccctccaacttttgaagctaacacttcactgccttccagcttccagtgttactaatgaaaagcccagtgccattctgagtccttgatgcaacctgtttttctctctggaagtttatgagatatcctctttatcattttttaaaaaagctaagtgatctcaatgtagaacagttaggggtttcaaaatcacacaactcttaataataaggtagaaagtcagcctgcagtgtacataccttttcctagagccaagcacaaaatgcaaatgtgagatttcaatgatttctgactctcagatggtcttgcacctggtacttctccccctcttcgctccataatacctggttcttcaggcacaagtaagcagttttcagaacgtctgagagagaggaaatgaacacctttatatacgtgtaagagtgatttcacatcttttccctgaagaggcaaaactgacatggggatagaggaataggagagcattgtgggcccccctttccagaaaggactagtcccatccactgccccccatcctgtcttagcagcagttccatttcttatatgtttctagtaaatgatcttttgtaacagtcctacgaactgattgttctagactggcaatttctgtgaaaccaagtaataaatacaaagccccaggaggaagccattcagaacattctcttcttatttaaagaatttatttgtacatgagattttctgtatcttttctgaatgtttagccatgaggagtgagagacaacttaaaatgttatcttttaaattctgcaagtattttgcaactctgtcaatcccctttctgactcttcttccttcctttctcatacatgattcttcctcacttgtattttaaaggatttctaagcattggagtcaacaagcctgtgtaatgaggaaggaattaagaagtagaagaaaaaaactaaaaacaaaaagcaactgcctgaaagtcaagtaatcataaagtacctatgaataacctaaaatatgtaaatataatccaatatttatgctaatgtatatgggcatcctagctttcatattcctcagacatacaacctggaaaaaaaaaaccctgctggaaaacactgaattgatagtttctctcccttctccccatccccttcttcaacatcttcatcatcatcatcaccatcatcattgccaccaaagcttcaagtggcaggaggcggggcaaagatcaagtttattgagtttttagaagctcactggagtgaggatagtgaattgccaagtcaatttcagggggccatcagcacagctgctggcattgcgatcacaattggaggccgagtaagagaaaacactggatggtccccaggtagagaggatacatcctgaagggcagggtctgagcacctgatagatgtgggaccctacagagaatggggactgctgcgaagctggttttattagactgatttcctgaggacgacgtctcctctggaaggacagcttttgtgtaaggtgaaatggaggaagagaggaagaaaggattgaggctagaggggcattaaaaagaaagatttgagacttggaagggtgggactcatactggtgggaggaaattggaatccaggatacatggagaaattatcagaaaacacccagctatctcaagttcagaattcaggttcagataatgacatcctaggatactgggggaaaaaaagagagagagagatagaattgcttttggtaagcttagcagagtcagagagaaaaggagagttcccagaaaacagaaagtggccaaatgattttctggtttccagaaaaggaaaaaaaacttaatttcagaatttacagataaaggaagagtctagtgtgcattattaaaattatagattgtgggccgagcacagtggctcatgcctgtaatcccagcactttgagaggccgaggcgggtggatcacctgaggtcgggagttcgagactagcctgaccaacatggagaaaccccgtctctactaaaaatacaaaattagctgggcgtggtggcacatgcctataatcccagctactagggaggctgaggcaggagaatcgcttgaacctgggaggcagaggttgcattgaactgagattgtgccattgcactccagcctgggcaacaagagcaaaactccgtctcaaaaaaaaaaaaaaaaaaattgtagattgtgaatactagaaaagaaggtagtgaacaccaggagccaacctgggtttactaagaactgtgtacaccagagaaatcccatctccttttctcctgggctgggaggccaggaaatattatagatacagtgtctctggttttaacaaagcatttggcaaaagtctgtcatgaaatgtatgtggaaaagatggaatccacatgaagtcatacaagtaggtaaattcataacagttgaaaggcggtatctgtggagaagtcagagcaaggatctttgttttggtggtggggttgtttggtttggtttggtttggttttgtcttgtttttgagacagggtctcactctgtcacccaggctggagtacaggggcgcaatcacagccaactgcagccttgacctcccaggcttagatattcctcccacctcagcctcccaagtagctaggaccacaggtgtgtgccaccatgcccagataaatttttgtgttttttctagagacagggtttcatcatgttgtccaggctggtcttgaacttctgggctcaagtgacccacccgtctcagcctcccagagtgctgggattacaggcgtgagccaccatgcccagctagatctttgtttatcactgatgaattcctgacacctagaacaatgccacagtgggtgcttagtaaatatctgtacagtgagtgggccgtaactgagccagagggacaactgcagggaaatgttacaggcttctttcctgcccctgtcctgctttgtttcgtattaaggactcgagtaaagacattgatgatatgctcagtaaagtttgtggagaacagaaagctaagcctgaaaactagtttagaaactgatagaatcaagacccaaatatcttgctagtctgagttagatctctcaagaactaaaagtttaacaggaatatatgtaaactactattcttgagacttggaaatcaactgaacaggtaggaaagatataacttaagaaaccttgcttttaaagttcatatgttttcgttgactccaaacttagtgttaatacggtagctgccagaagagtcccatttcagccatccatgtttggattcatcagtttcaacaaatgcttattgcaggcctgctctgtgccagggagctggttgtgtacagagacagacatccccatcaaccccgggataggagatgagcactaaggttgaggcaaggttagcatccaggggggcttgagaagggagcagggtgcctccctgtgcctggggtggtccaaagcattcacaaggcaggggagctcttaggctgagacccagaaaacagaagggaaaggggaagctggcagaggagacaatttgtctgaagacaaggtatgggggcagttgagagtggtctgttcagtgggctctctgggacttagcctgtgaggggaagaggagaggtggctgcaggtaggtcagcagggaggccttggcccaccaggagccatggggccagggaagaaatgcaggccccaggacttggcactcttggtttttcttctacctcctgggctgctccaactcagagtcctttgccagtttctgcttctcccagtctcagctttggagtgccccaggctcaatccttggccctcttcccttcccatgtatacttttattccttgctgccctcatccagccccatggctataaatgcattctatttgcagacatgtcccagactcctgtcagcagcctgggcttttctcctgaacttgggactcagacatcccaccacctgcttgacatctccagcatttaacatgtggaaaactgaattgttagcttaccccctgtaatagtttgctagggctgccgcaacaaagtaccacaaactagatggcttaaaataacagaaattcattctctctctgttctggagaccaaagtccaaagtcaaggtgctggcagggctgcgctctctctgaagcttccagggcagaatctgttgcatgcttccggtgtggctagccatccttggctttccatgtcttatagctgtgtcactcccggctctgcctcctttatcacatggtgttctccctgtccaccttcacatcatctccaggcctgtctgtgtctcttctcctcgtcgtataaggacgccagtcatattggattaaggcccaccctaatgacctcatcttaacttgatcacttctgcagagacgctgtttccaaataagaccacattcacaagtattggggataggacttcaccatatcttttcagggaccccgtaactttcttcatctgtggcctttctaggttagctgatagccacttcattcttccagttgctttggacagaactcttggtgtcatccttgactcccatctttttctcccatccacatctagtccactaggaaacaggttaggttcaaaaccaactgcttctcccacctccacttctgctgccctgatctgagccaccatcacctaaattactataaaagccaagtatcagttcatgtcactcctctgctcaaaagcctgcatagcttcccacaccactcagagtcactggcacagcctttccgccgcccccatgccatccccggcttcagtgcctctacgctggctcgcgttggctcctgcacacaggctggcttctttgctctccctcatacgtcctaggctctccccttctctggacctttgcactagctcttccctctgtgcggaacaccatcccctagatgtgctccagcctcacaatctaccttctcaccttcttctagtctgctcagatatcaccttctcagtggcaccctttttacaattccagccagccttcccagcaccagtgttttgtttgtttgtttttttataacactttaccctttctatagcagacattattgggaatacttattgtttgttgtttgtctcacctgctagcatgtgatgtctacaaggcaagggtcttgccagttttggtgactggtgtttcccaagggcctagagcaagggagagccaggactgggcccaggtctccctggctccaaggccatcctcttcctgctgtgaaagaccactctgaactatacaagggtagatctctccaacaccacatctcgtttatcctccctgccccatcttttgccatcttcctcagtgacttcagtatctctgtgagcctacttgctaaaatagaaattttaaactgtacagaaagaacatggtgttatgttcaagagaatggagtctgggctgggtgtggtggctcacacctgtagtctcaacactttgggaggccaaggctggaggatcatttgagtcctggaattcgaggccagcctgggcaacatagtgagacctcgtctctacaaaaaatttaaaaaattaggtggatgtggtggcatgtgcctttcgtcccagctacttgggaggctgagttgggaggatcacttgagcccaggaggtcaaagctacagtgagctatgatagcataactatgctctagcctgggcaacagagtgagaccctgtcttggaaaaaaaaaaaaaggagtctggagccacttacacagcaggtaagcataggcacctcacttcacctccctttgcctcagtttcctcatctatcaaaaggagataatcatgccaccttaccttgaagggtttctgtgagggctaaatacgttaatatatgtaaccacttaccatggaaacagtgagtaccatgtcagtatcattgtaaggatatatatttgaaccttgaggacactatgctaaatgaaataagccagtcataaaggaccaatactgcctgattccactgatatgaggtatctaaggcagttgactcgtagaagcagaacatagaatggttgagtgccaggggccggaggaaggaggaagtgaggttgctgctcagtgggcgtggagtttcagtagtgcaagctgagtcagttctagagatctgctttacaacagtgtgcttatggttaacaatactgtactatacactcacagatgtgttaagacagtagatctcatgttatatggggctttttaaaccacaacttgttttttaaaaaggatgtaatatattagtcactaaccctttgttttattgaattttctcaaggttaagggacttacccaagtgctcgcagcttataaaggaaagagggtgacaagaatgaagcctctgacttccagggctctttgtcctgctccaagtcaggcattagttctgtctgtcaaaatccagattatcaaaggaccatagtataaaagggctctgcaatatggggaggtgcatccacgcttctttgggagaaacgcctcacatgttggcttcataaaactcttctatgccccgtaggttggacaatgagaaataaataatccagacattggtgtttttgataggtggttagagcttccccaacagggggagtaaacaaaagaaccatcttaatttcaagcttagttagaactacggaagactaaaagtcatttttcaaaatggtgggtggtgccagggctctatccccacctggaaggggcacttgatctgtaaaagcagcaaaaataattgtgtcttttatgtcacttaggtagaagctcctgtcccaattaattcttatctcctcctccctttataaatatgcttgggcaaagtgacatcctagcagttttttgttttgttttctctcttcttaacaaggaattctctctgcttaggcattttaggtgctgatttttctcatgtcccagagatgcttctaattagttgatgcttccttcccataatagttcaccacagagagtggatttggactggaggagggagcaattttgtcatcttatcaaagtgccactgatcaggttggctttcctgagtgctcattcatttttccgcctctctggaaacagaagcagcaagctccttgctgagtggagctggaggtttttgggttttgctgtctccccagtgcttcccagcaccctttgatgaaatgctgcctcagagtctttgcagtagggctcactagagaaattatctttttcctttcacatcagtggaaaaacacttggctggggacaaatggcaaaagcatgccactgtcaccttgtccctaagtaacctggcacccaccagggctgcctgcaggccctgtgtgtcctggggagaaggtatataaaggcctcttccttttcctgctttctaggagcagagtgaccctccaggccaaggacagtgctgtattcttgggtggttctgacattgcagaaagagtctgtggacactagagatccaagaattatcctccagtgcttcagagctggaaggagatgctagctcaggcctctttaaggacttgtatcagttagctagcttttgctgtgcaacaaaccaccccaaaacttgatggcttaagacagtaaacattacttactatgattctgtgggtcttctgggtgtttcttctggtgcggatagcgcagcccaggctggatggtcaaagaggccctccctcacctgtctggtggttgggaggctgctcggtctggagaggtctgggcaggaacagctcacctgtgctccatgtgggtccgtccatgctactgcagcccagcccgggctttccacatgagggttccaaggagaacaagagagggcacacaaacccagtgcataagtattttataagtgtctgtcacagttgctaatggtctgttggccaaagtaagtcatgtgactgagcccagaatcaatgtgaaaagggggaacccaagggtgtgaagattggaaggtataaacaactggggggccattcctgcaacagcctacccaggagtgccgcgtcagaaggtgtgtcctgttctcgccctgcatgggtttgtgtcagtgtggggcagctctttcaaggaagaaatgaaaggctcttttgaggcagggaagtgcagtggagtttgacacacagtgttcaaattctgcacagcatttaccagcagtatgacatcaggcaggtgacttgacttttctaaagcctgggttcttcacctctaagctgggtctggtcaagtttccctcatgaggttcttcaggacactaactgatgtttgtggagcagggtgtgtggcatgtggtcagcacccaatgtagctggcattgtggtggggcagcagaaaggcagctatgctgggaagttggacagtgccaaatcctggggcaacaggtggtcatccatgcacaggaagcttggctggacacctggatggcagcgtgccctggcccaggaggccaggtgaagatggcaaaagggaaaagaaggctctgctggcttcttgcagactaaagccctgttcacatatttgttgtttaaaattgaaacaagtaagtcaccctttcttggttgtacatccccccacagcaactgccagttgacttccacaccctattttttccccagagctttcactccttgtcagaggtgttgaacactgcagtgcttcccacgtggcttctctgtgcctctgactctgttgctgggtcctcctgggcacttcctcatgactcacctcctccctctgcgagcgttcctctcagcttccttcactggccccttccctcctctcatcttcttgttatttattggtgttccccaaattctagccttaaccctgttgtcagacaacactgtttcacagggagactgtgcacaaccccagcttggcccccgcttgctcatgatgtccccactctgtctctctggccccagcttgcctcttggactgcagatcagtttctcacacttagtaggctgcaaaacaaagctctcctccccatatgtcctcagtctgctcgggctgctataagaaagtaccatagcctgggtggcttaaacaactgaggtttatttctcacaattttggaggctgacacccacgatcagggtgcccgcatggtgagtggacgggtgctcactgggcagagagggccctggtgtctcttcctttccttacaagggcactaatcccatcatggagctccacttttaggtccccatgtaaacctcatcattccccaaaggtcccatctccttataccacctcactgggtgctagggtctcagtacatgaatccagggggacgcagttcagtctctagcaccatgtaacctgcattcccatctgtcttcccctcttcctggtaggccaagccagaaagctctaagtcatttcccacagtggtcagttccaaataaatgtctcttgggtcctgcgtcctctctgtccctgcagccccagaccctgcagcagccctctcacctccagccttgttccagcaagctcagcattgcttccaaaacaaacacccgatcactgctctctgcattctctctctcatactcatgagcacatggtaaaactctgcctcgcacctctctggccttatctcctgcccttccccccagcatcctcattccctgctatattcacccacctgtggcaccctcaccaggccagcacatctcaccacactgcatttgctcttgctgttcccacgacccgggctgcccctccccctgcgactgcctggaagcttgtgctcatctttcaggaaccgactctggggtcatcctggtgaagctctccctgccctctgccgcagcatgagccacgcacacgtcctatttatcacttgccaagtgtactgtgggcttgtgagtctcgccctgtctcttttcatgatctgtgagctccttgagggcataaatcatcgcattcatttctctgtaccccagtgtctggcatataatcaatgacaataaataagtgttggataaatgagtgagtagatgagggcagtgggtgagaccaacaacctcctgtttcccacactgagtcaccccaggttccccactggcacaagtgccactagctgccagccccctgaacttcctgcatatccaacttaccaagtcctggagcagctggcgttctccttcccaccccacagcactaagggccctggcaagttctcgcctgcccccaggaaggccggttatagagaaagcccttggcaccttagccagagctcatggctccctcctctagcacactttgccctttctgcctgtttaatcatgtcactttatgccatcccattctctaactgtctggctcaggttagcccttcactacatcagctcactctactgtccggctcgttcgttgttttaagtgtgtatgttgtcatcctagctgatcctcattgtagacaggagcttctgttctttattggttcttggacatttggtaaatgctacgccacgggtgtttattcataactgacctcagagttcttgttacttccctgcctgcctgtctccctttctcccagctgccgtcctctttaaaaaggtacaacatcctaagagttaagatccagcagccttgagttcagattttggctccagcattcccaaactgtgagactgggagccaatagcttaacctctttgagcttctatttccttatctataaaatggagataatgtcacccctgcaggtctgctgtgaggattcaatgaaacaatcaatgaacagcacttagcacagtacctaacgtggagtaaatactcaataaatgccggctgctgtgattgatgttttttcaataatattattttatcaataaatcttctccttaagggtctatcatagtctagccccaggccagcacccaacacatagaataagtgtttgtagaactgtcaggcgagcatataaatttatttctagggctaccctgaaatgcttccccttccttgttagttggaatgagaggctaattttccctaagatgtttccactcatctccaacaagagcttccttcttgtgaacacagcccatgttctgaaccttaccttggggcagggtgggttatgctggctcttcacccatacatgcacatgtcggggacagccagtctcaggagtcccttcttaatcaggcctttttggaagcaagacagctagacccttcccctctattcatatcagagtttagggtttgctttcctggtttgatttggtctcagcatggctatcacctgtcttgaagggcttttctgggaagacaccctgagggacctgacagggcatccaggaagactctgctcaaaggccagaaaggaagctgggcaccccattctagcctctggagcttggccaggtggaggcatcctggctaagggatgcccatttctctccctctggccaaggctggtagaagtcctgcccactgagagtcagggaggggacagggacacaaaccctattgaacacagctctcagtcccttacctgtggagggttccttcctggaccacttagccgcctcagagaggggacagtattatagtcccatctctgatcactggagaggcaaatcaagcacatgattctcacccctgagccttccctgttccagttcataactgggtggaaataggtaaaatcatagactgttcctatgggaagttaccattagggaagtctaggccagtgccgggttgaacagctacatcaaagttacctggaaaactttgttccaaaatgcagattcttgcaatggaagcatatccagaatttccagttcagtcaggctggctggaacccagtcatctgtcccctaagagctcctgaaagattccaatgcacagttaggtatggacccattaacctgtcccgctgccttatctcagcagtaaaggtggaaggtgttctagggccccagagaggtctcatgccttgaaaagttagtgataaaggcccagagcaccgaggatactgctcaagtcctgccaccttctcacagcagccagggctggagccgtccctccactagataggatcctggacatcagggtggggccagcaggggagcactgactcatggggtcccagcaggccacgctcccaggggagctgagaaagagctagggcagagaagaagggcccttggccatttctttcagagccctgtggtgtggatgcatggatgccctctgcttcggcccactgccctccctggcctcccatggcaatgtaggggccactctacaacccaccactgctgggcaggtggagagtgaagcccgtgtgttgcattgagtcctgttaagagtctcagttgaagttggctggctgacggatttgacacaggggtagaaagtagatgtgggacaaagtctaagtttaccaatacagacaactccaagtcctgaatagattgaaggggttttgttttctcatgtgggcatttgacccttctagaaagatgggaccatccagagatacccagccctgaccccagcagtttacactacgaagctgctggaatcacagacacaaaccccatagagacaggtcatgcctctgaatcagaaacttcatttaaaccaggaaaaacaaaactgtgtgagccctgggcagcccagggaggggaaagccccacgctagagccaggctgctgtgcagggtgctggagtgagccttctgctgctgggaatcaagggcctggagctgcagttcctctggattctgtggctgggctggtggtgttacagaaaggtgggatctttgtttttcctggtaagcaagaagcagtttgatggcactatgaaaaaacttcctcaggcatgcagaccttaagtaaataaaagcacaaaaatagatttttcaaaccatgtccttccagagcatagtaggatttgctgggaaattggattgaattttccctgactcacctgactgctgaggggaggaatttaaaggaaaggtctgtgtttccccagtggtatctgctgaaacagggccaactgcagggcttacggctccttatgggtgaccttttaaaaggcagctgggggtgtctgaacagcaggctggggactgggggctgatgcttagctagaccaccttacctctgaacccagagatgagagattgattgtcggacctctgcgccgtccacatattatagatcggtttactgaggtatggaggccactgggcagccctcgggagaacaggttgcttttctaatggtgatgaaggattgaccctgaagcgtctatgccttgactcgttccacttgggtatcaagactgcagtttgctaggtggttggcccaaggctggggtttagaggatgaccacagagcacaagggaagttttctcttgagccaagctatgcagattaaaatgctagaacatcattagcatcttaggaaggttttcagacaccaggctttaagtgaccccaaaccttccccggacctaaatttaatgccgtgggccacattccgtcgagtttgggttcctgcacagaattttattatgaatgagaaccagtggtgtgccaatacactggctctctgaagaaatgtaaaagccttgatttgtagtgtttgccaattttcaaggtgtaactactcccactgtgccaatttcaaactaccaatgtgaagtctgtaaatatgaagttgggaaaagatgtgcacaattggctgtcatgagcagttccattcggctccagcacaccactgagctcatgggcctccaacgcatatatccaaagagctcacaagtagaggtgattcagaggggcaaactgaaccatgtgccaggtgtaccctcagtatccctacatgtacagaacactctttccccttagctaacagaatcttttaactagcaagaagttccatattaccacattaatactggaatatatcagcgggtgtctccactttagtagtgatcatgataggacaatgattggctaagtttaggagctatcagatcccttgaggagcttgcttaaaaagcattctgctcgactccataccccagagaatctgatttcctagatctgagatggggtctagtcatctgtgtttggcaagaaagttacaggtcgtattcatactttgagaagccctcatctactgtttgctcaccctgtggtttagaagcctggaagttcaaggtctggtgacttttaacagtgattttattcctcatactaactgttttgctccagtgaaacttcatactaactgttttgctctgtttttttaaatcccaccatgcaaaatctgattctaaatgatatgtattgacagcatcccaagtatcagacatcagacatgtgttatcccatcttattctgacaactaccctattattaccaccccattttgcagatgaggaaactgaggcccagagaaatttcccaagtaggtggtgctagaattcaagttcaggcgatctgactccagaacctgcattctaagcaaaacacggctgcctctgtaaaatagtgttcctttgagggtctttggctttttacttagcgaattcaggctaaaattcagctaaatttcttgagcatttaattgaatacctataagatgctatcactggcataagttatctcatttaatcctagcagcaaccttacaggggaggtaagacactgttttctggaagagggaagggagatccagagatgttctgtggcttgccctgtgttgcacagccaactggaggcagaacaggaatttgttgctcattccactaccccacagctgcccagctaagtttcctgtgtggttctttagtctaaggcagctttgattcattggtgcttttttaagcatttgagtacgtttctggcagtcttcacttttgactgataaatgtctgagtctgtatataaaacagtgtacaaatgggaaagacagccgtatccaccactatctttaaacaccagacagagtgggctaagtgcagcactaagatgcagaggagcgtgcaaatacagagaaagtgtttgttgtttctgcgggaattgaagaaggctccctgaaggaggctacaccaagctggaccttgaaggatacacaggattttggcaagtatggagggaagagtcggggatgggcagcagtgaaagaggatttggtggaaactgaagctgggaacccagggattggggcccaatcacagggcttcatgaatcttgccaacagtgtcccttttttctttggcccataactagtttcatgcttgacttgtgattaaggacattgtgatttttctcctctagctgatcgatcttattttccattaccttaaaacaactttctgtagctcttctatgggggagttttaattcctgtgcccttgtgctttaggccccagcaccttcaaagtggtcttccaggcacatacgactggcttgaggggcccagatgtgctgagatgccccagtgcttctttctgttcccttacagcaaaagtttatttctgtccctcggcagcattggtgcagtcggtagccagtccagctggagtggttctggttccctttataagcacccattcctgggagaatgccttgggatatctgtcagcagcttcctgtagtctggctgtcccagtggctggagtgctttgaacaccgattcccagggacattacacagttcctttccactgttttctggctctcccaagtggacactgacctcgaagtgagcacatttacctctgagctctggcagcatcgtttgggcgattattgtaatcttgaggggcttgtggggatccaatagccttgactaaaggcgttccatagggagaaaaaaaaatgtcgcaattgctttgccagttagagatcagtcacagccagaaccaacttctgctttcctcttggaaacactaacaagtgccacaggatcagaggtctctcgcccaccatggccagtaggacccattaagaccatcagccgtgggattgcctgtcattcctgaactctagtctcagggattccgagcagtgtgtctcttcttcatctctgaatcttcaagcagaacactgatataacccccctaccactgagcaggggttggtgtgtgcaacacgatgggggaattttctggagtgggcattttcatgtggtctccatcacatgttctggatgacatttgtagtaatagcttgacagctgaggcctgctgcgatgcagtcccactggcaaaggcctctccttgtgcctttacaaatgtcacattcctgcacatgtaaggcaccgcaggagggcttctttatggactctcttccagtgtagtcctgcaacgtgttatccaagaaatctctcagaatgctgtgttgggacaggtggtgcatctctgtctgtggtagatggatgctgctgcctggcccctcctgaggctatttggtccatttctaaattaaaatctctaaacagtaatagaagacctagtgagaactgcgtttctcatcattgttctagtcttagcggagctatgagagcccttaatacagcgttttagctcccacatacaactgatcatccaccccatttctttgcctgggattcctatctttttttcatccaaatagaagaaaagcctctcagcatgtgaatctcaagaagcaatatggcggacatcaagttcttcattatacttcagggtagctatttttttattccaaagtctacttaaatgtcagagagaaggctgaattcagttgcctacaaggagatcttcaagtaagacttctacttagctcctactgtgaatggaactgtgaatgatagggtggggaagatgaagatatgcatgagcctaaggcaggcataggccaaggggagccctttgcacagttattctcttggctaccaaggtcatcactgtctagccaatcagtgagatctctgccaggttgggctcagattgccaacatgtgccctcagttagccccctgcatgctggcccagtgtcagacagtgcagagctgagacaggaaggggagggagaagtctagatcttccaggcccaggatcacacacagtctggatgtcaatggcagcccaaagtcaggaagtagaaaatgggaccagagagagcatccaaaaaacacccaagcccatcccaaacactggctctgaagggggccttgttgagtgcagagtagctgtgtttgccatggggtggggggaaggaacagctttcatgcacttggcatggtgggcacaggaatagaccacttctccactgacggctcacctggatcatgccttagattcccttagtgcttatcttccaaggagctcaaagagtgaataaatagagacaattattgacctcgtaatcttagatagcagcatggatattagggcaatttattatcatttactacttcccctttcgagagaagagaaaatgaatgagtatggaaaataaatcaacttcttgggaacctcagcctagttaacatattaccattgattaagcagctaccacatgccagactgtttgactatggagataggaagggcgataagtcacaattcctgtcttccggaagattgccgtctggtgagagtcagagacataaaccagccactccacaacagccttaggaaagctgccgggctttgccgagtgagggcgcaccaggaggggagagggaggcttccctgaggagaggccaggtgagtgggagagatgagaagaaggccacagataataacatgttctattttttatatcccttctgtgtgccagcctcttcacaaataagtcatctaattccatgtgtggaaacacaagcttagagaagattataagccaaatgccaaatttgaacttgggcttccaaactccagggctcagcaagcaggcactgcatttttaaggcccatctctaatagtttttgttctcaactctgggcgagacctgaggcctaaggaagcatcctggggacccagtgcagccccttcgcctccatacatcttgaatgctggtctttaaaggtccttctcctgaggaagtggggctgagactgtcttgtgtggtcatgttttgttgggtggttggggttggggtccgggggcggacatcctgttcatgcagcctaatgaggagcttccacctgccccttgtgtttctcagcactgacctgctaccaggcccggctctgggctgtagccagggaggggatgccttccagcctagccgtggcaggaagaggccaggagtcattttagccattggtttgcaaaagaagaaaagctttgctgctgccgcctgcacgcacccgcacgctcactccccttgatgctggagtgatgctggagagctcaccgctgctgcttgcttttctagttctcttccttcattttccctttgcagatttcactgattttgaatctctcacaatggagcccttggtttccagagatctgagaaacagaaagtgatcacattttcctagaggggagctcaacattctgctggggaagtaggagatgtcgagtctgaggtcattttcagacaccaacttgttttgttctatgaatttaaggagattttagaattggggaacaaataaaatcattctgtcagagcaaaggagaaacatctttgtatattgccttaagctttccatgcaccgttaagtgattaaaatgcaactgaaaactctgatagcaaaaagaaaaattaataaatacagtataataagtgcataaagattattaggggaaaggaagactcttaggaccagccattctatgtccagatttgaatctgcttggagtgaatcacatatccttgaactacagttgctgttcttctcaggaatttggcctgtctgagttcatgtaagcagaagcccacagatcaaaaccactgtcagccaccagcacagctttttgatagttttccaaggaagatcaatagcacctggtcctctggccattgtcacaggtttgtcacatccgtaggtcctaccgagatctgtgggtccagttacctcccagtgagcagagacttaattaattaatttatttatttatttttgagacagagtcttgctgtgttgccaggctggattacagtggcgcgatctctgttcactgcaagctccgcctcacggttcaagctattctcctgcctcagcctcccaagtagctgggactacaggtgcgcacgaccacgcccacctaatggttgtatttttagtagggatgggatttcactgtgttagccaagatggtctcaatttcttgacctcatgatctgcccgcctcggcctcccaaagtgctgggattacaggcgtgagccaccacgcccagctaagacttactttttaggtagagctcacatctaccttcctggaaagagcttggaatgtttaaattaacataaatacagccccaatttttttcattacagtaccttttagagtaagttaaaatgaaaagcataatgtttaaattatataaaattatgttaatagctatagcattatagcgtatgccatcttgacatttttgtaattcctatagcgactgaggtagtttcacaaccctgaaatctaaggccattttcaggagctgtgttattttttccaagaaactagaatttaaggttgtctgttttgctgtcttcttttttccgaccgtgggattctctatggtgagcgtagatatcactgattgccaataggctgtccgactgccttcaaagtagtgtctgcttcttgcagcttctctgtacatctggtgcttcacctggaattcctgcttgcaaaagggaggaatcaagccttatttagtctctcttaaggttttcatcatttgagctctcaccagttgttgcttcataatgtcaaagtctcgagccttggaaggtatccaggggcaaattcaaaggcacgcagcatctagcttgatcctgaatccacaaaaccagctgtcttcccatcttagaaacaagtcctgtgtaaatagagaattggagatgtcaccctgccttttccttaactgtaaccattttcaaaagtgaatattggatataaactaaagtttataaacacatgactttgcttgtcaaaagtgttctctctagaaggctgtttatctggaataaaacgctgctcccatgctgccagtttctttttcagtgttgacttcagaagcactttaccaactacactgggaagtcagttagtactttacttttgtaggaaccattctgttgtcccaaactttgtgtctccttacgtcacaactgagttctgttccatccctccctcctctgccacctgggggtgtgagaagcagatttcagcgggaggaaggctgtgagagtggacagaggcctgggagaacctcagtgctattgggaagcaggctgagtgccagaccaagctgataacgtgaatgtgatggactctgccatgaatgggaattgtaccagaagttcagtaagggaagtggagggctgcttgctcgaaacagaggcactgagaagagtgtgataaatttataagcagacctgatttaatgctacaagcctgatctgtgagtaatctcctgaataatctttaatgagtaagcattaagtcaatagacattggaaagaactccagtaacctaattccccatcccccaccccacccatgacaatttatagcctcatttgacacaggaggtgatcaacttgtttacctggctctgttgggcataagttcttaggtcaataattgatgcggtaaccataattttaaattaatataatgatttccatttcagttcagttcataaaacctgtctgcgtcccagtatggtacatgatgaatataattttccattttatagctggagaaatcgagccaggaagcagtgatgctagaaggggacactagtcagcgaagtgctggtgtaaatgttttaacaaccagctctctgcgggaagaagtcctggtttgtagtggatgccgatttccatcgtgtaaatactcccaccttggctgattcaagctaccaacatggcatcactgaatgcagagttgggaagaattgcacattttcagctcttgtgagctggtactagctggctgcagcataatggcattaatgattcagtttctggcttcaggctcttggatgaccactgaggaccagctcagaccactttaaatcccaacttaactctcagattctgctcagcctctcactacagtgccttgaagcgtgtttttcaaactttgagttgtaacccattgaacagtcctgaacttaatttagggagctgaatgagcattttttaaatgaaatagaatagagtaaaataagaagaaatgaatagaacaacagaaaatatcagcgtgtacaccacatgtttcaatgatggatgatggatggatggatgggtggatggataggtggatggatgggtggggtgggtgggtggatggaaagatggatagatggatggatgactacatgtctatagcgggttggggtcaaaaactaaaaatattgacccagaagccaatgtacctctgttttctcatctgaaagatggagttaatggagttgcctcctccctgcctgtgatcaggccagggggtgaccagatcactctgtgataatgctgtggtggtgctagcactctatctaatccacagtttatccatttgtggtgacaaaacagggcaaagcagacaggtctggctttgtctctttgggagatggttgtacattgtgtttggacaaagttccgtcttcattgggcacatgttttcttggcattcagccacagcctagagatgcctcccagtggctctcagccttcctctgtccacatgtgtacacatgtgcacatacacacacatgaagttctgcagtcagagggatcagccttcctaagtctgctgtgaaatgtcatgggggagagtccttaggagcaaggactctgtgttggagggaactagtgaacttttaaaaataagagaggtaatgatgaaagctttctccacactctctcctgagtccctcctggaaaaaggtacaaggccaagcagtgtgtaggagtcatcacagcaaccccatgaagcagagactgttagccattttcagagatgaggacactcaccctaggaaaggctcagcaatgagccctctgctcccaacctcaccttctgaccccaggccagtgcccaggccaacagccccttcagagcctcaggacagcctgttagtcatccaggaagcccttccaaactggttttcttatctgtgaaatgggatgttgttctacgtaagaagcattttgctgagaaaagagaaatggctttagagtcagagtatccgggaatctcatgctactttttacaaatcactgctgtgagattgcaagcaaattactttactatagttgccttgcctggaaagtggagatgttgacaattttgcaggttcattatgaagattaactaagataacgttatcacatcacaaatctggagagatatatattaatatgtcaacagtggttatcactaggtggtggcattacaggtggtttcactcttcacttttttgcccgtttttattcagtggtgtaccagtaaatatttaacaaaagaaaaacaaaaagcctgatttgtagtgtttgcccatttccttggtgtaaatacttccaccatggctgatttcaagctactgccatgacgacactaaacatgaaattggaaaacgacatgtatgattggctctcacaagctggtatcagcccacttcagctcaccactgtttttaactgtgcaccgaacgttttgcttgggggtaaattagagagagagggaaggaaagagaattaattagcagagtgcctagcattatgcctgtcattagttctcctctctccctgccctccctccctgctttgtcccccagcccgcattgctctaatggaacagcacagtgcctgtgaacacccagccgtgtgaagtggtggtcttcctgggagccagctgcctgtctttgctcgccatcggcagggccctcaggacctgggcagcctgtagaggagatcctaaggttgactcactgaggaataatcaagcagattcccaggtcctctcactttccacaggagacatgctcagatcagacacgtacaaggttgacacttccctctagggaaactaggaaaagtctcaacgggaaaggcctggaggggaacacacctccaggtggccacagtctctaaggagccgaacctttaccttccgctcactgacataacagatgtgtgtgactgtgggggtgggggagacgggatgggctctgcaggtctctggaggaatacagaagaatggggcgtcagtggcagcctgacaggcctcgacaggtcacccagcatgtaagacaaaggtgcagggacaaattccccacaccctccaatgtctggtctcagcctcccagcactcggcagtttctggcacaagagtagatgttcaagaaatttttgttaatgcttggtttggtttgttgctgttgttgttttaatttttaatatcaccttatattccttcatagcttgacctgttgcagaaaggatgtcaggcagccatataaatgcttattgaataaataaataagttgtagccctcatcagctcctggttttacctgttcctggatataaaatgtgactttaagtcgaaatgagatgcgaagtgttaataaagttttctggtaatggtatttttctttaatttcttctaggttttctgtattttttcaaatgtatcttcggagaacttggatcccttttgttttatttttaaaaaatgaatatatgttacaaaaataacctgtaaattaaaagcaaatcgagagctgtgtcaacagttaaggcccaagaagggtcatctccgcggctctaaggctctgaactgagggtcctgcctgcccacagggtgttggctgggcccaggttcgggctcttgtctcagcctctcttcccacaggcctcccgcctgcctaccaggccctgactaataacgctcccctccagcaactcccagaagacagtgtgtgccagtcttagaagtggcagtagggagagatgagggggatgactggccacaccctttaaaatacagttgggcctgtgtcctggtcaccctccatgaggcaagcagccacctcgggcacctgaaacctggggaggcccctacagtgtgagtcacctgcctccaggcaggcctggtccactctttcaatcataggcttccttcagggcaagtgggggcctcaccccttgcctatgataaacctgtcagttccatttcccttgaagcagcagggctgctctgggaatgcagcacagagcctgggggcctcccttaggtgtctgttgggtttgaaccttcccctcttctggcctaggatcgtggtcaggggaaccatcgtgtttgaggggtttcattaaagacacaggttgaacctagcagatgaaggcttgtgggggttctcaaccagaggaggtttaattcctgtatcacccctgccagtgttcatggctgccctctcaaagccagtcagctaaaaggaggcagtgcggaggtgcctgccagagccctgtctccacccgatggtgcacaagatgtgaccatgggtttcctataactgacctttttttgtcagatagatagatagatagatagatagatagatagatagatagatagtagatagatagtagatagatgatagatagatagatagatagatagatagatagatagatagatagataatttttttctttttctttttctttctgagacagggtctcactctgttgcccaggctggagtgcagtggtgtgatcatggctcactgcagccttgacctcttggactcaagcaactctcctaccttagccccctgagtagctgagactacaggcacaagtcacctcacccggctgatttttgtacatttttcgtagagatgggggtctcacttcgttttccaggctggtcttgatcatcctacctcccaaagtgctgggattacaggtgtaagccaccacacccagctgagatataattcacatactctacagttcaccatttaaagtgtacagttcagtgggttttagtctgttctcagagttatgtgactgtcatcactatcgatcttagaacattttcattgacccaaaaagaaactctatacctgttagcagtcaccctcgaattcctccaggccccccaacccaaggcaagcacttacctcctttttgtgtttatagatttgcctattctggacatttcatataaatggggtcattcaatatgtgaccttttgtgtctgcctctcttcatttagcctaatattttctaggtttatccacactgtagaccggatcagtacttattcctttcagtggatggataatgttctgtggtattttgtttatccactcgtcaattggtgggtgtttgggttgtttccactttttggctattctgagtaatgctgctgtgaacatccatgtacatatgtgttcattgtctcggaggtattgccacgtaactgatcttttaacagtatgcacctgatcccgtcacttctttgcttaaaaagccccagtacttctcattgttcttaaagtcagagtcaaaatcctcacctgggcatggaaggttcatggcttctgggcctggccagcctcaccctgctgtttcccctgttctgttccagccaagaggcgccaagactccctccatgcacagagcctccttccttggcttcagcttcaaactttccgccttccccctgcctggccctttgcttccttaacctctactcatcctggagtctcagatgacctgccccctcctcagggaagcattctcctctgcctcacactaggttagggccacctgccgcacactcccaggggaccccgtgtgtctcctccatagcccctaacacagctgcaggcaatgatgacttgtgtggtggtctgcctaatgcttctctcttctgctcccttaagctccaggagagcagagaactcattcttgttccccagtttttcccagcacctagcacagtgcctggcacattcaggcactcagtaaatatttactgaatgaataatgggtaatgatggcagcaaatgagccacttcttcagcagactccttcagccttagcatgtccctcaagtgatggggaaacccaggcactgccgaggccaaatgacttcttctgtccccagccagacacctctcacttccctgagggaccgctgcttatgcaggaatgggtttgggggagttccccgcatcctgagctatatagagcctcagtgtgtgaatcccagctaacatgtgggttctctcaggacagggtgattcccatagcatgtgactcagagcagcccctcgacaccacagactgaatcaggagcagccgcagtgcatttccaggggagaaataaggagggattctctgaagcacttgcttctctaagaggcggggagttgccttatgacaaaccgagttcccgttagtaaagattattgcctttctgcgtgttgtgtttgaaaaactgtccttgaagaaattccaagaggaaactgtacaccttctgagacttaattgctttttcaaaacacacttgttttcatttcccccacagatatgcacttatttggccattacccagcacatgacgacttctatctcgtagtgtgcagtgcctgtaaccaggtcgtcaagccacaggttttccagtcgcactgcggtaagtggacccctgcaccgtcggccacatctgcagctgccgccctggggacagtcgccttcccctgggctccccgacagggtctcgccatgtcttgtctcagcctgaggctgtgggtaaagtcttcctgggctgctgcctctgctcgcaggctgttttaggagctgtagtccttctgctgaaatccgcagtcctgtcagaacaaatgagagaaaacctgcaacttgtctcggtcgatgggactagactgaagccatctgcccagcctagcgatggcctctgcaggtgaccaggggaggggagagctgcttaaggagtcgctcctgcagccagacattttctccccctgaaagagggtcaggagagagtctccccgagacttacaaaaaggagggctgcggccaagcacagcccagtgtgtggcccactggggtgctgccccaaggaaatggtgcatcagtaaaaccttacattccaattcacctttcccaagaatcctccttgttaaaaaaaatcccaggtggggttgggaactgctttccgtctctaaacatccttgatgtaataaattccttcagttggtcatcaacaaaccatggacagaacagataaagtccacgtggctgccccaccccggggatgaataaacagccatttggccttagactagaagtcacttaacctctctgggtggaagtttccttatctatagcagggaattggattagacaatttccaaagctgtaatatgctgtgagtccagcacagtatctcccaatctttttatttaagctgtattcccttttgatgaacataaaatctgaatgccctccttaccattaaggtttcgaagtacattctattgtgcctaaaaaaagtcaaagcaattataatattgaatatgcttttgcaaattacgcacatttcccctttctcacgttccgaatttctgacttttccccacctcttcagttatcattattctataataaaataaagggagttgagcttatccaagctctttaacagtctctctatatacaaattatcaactgcaaacacgtgtatatgtatgtatatgatatatacatatctacatatatataatctgtatctgtgtatatactgtaggcatattttgtgtttgtaatgtgtagaattcaggcttacggagcacctctgggagtgagtccaggactttcaaaccagcacaaggcaaagcaagggccctagaaagcgctataggaggaggtttggtcagaggccaagtcttctgcccctccctgcagccagcactgtgtcctcgggctacttgcttgatgtctcagggctttggtttccttgtccctaccatgggaagatgacttctgtgggtgtgtccagctctgacatgttcattctggcagactgagcaggaaaggagcaagtcgtgtgcctggcacaagttgaccttcttgcctagtgctctgtaccaaatgaccctctccactgcctggaagagagaaagggttaaacctctccaaagagaaactgtcagctggtaccaccagctgagatgacaggtggagaatccaaagcagagccatggcaagaaggtcccacccagccagtggttcagtgaccaggcatagaagctccgtgaccagtgcttctgtgcgtcttgtgagaacgcagaggctacatcatcctgaatatgattttcattcactcaattcacaaggatgtgcagctgttataggcacggaacaaggggttgcattctattgtaagccatcaaaactttcactgggactgggttcaatggcttacacttataatccgagcactttaggaggccaaggcaggaggatcacttgaggccaagagtttgagaccagcctgggcaacatagtgagaccccatttcttaaaaaaaaaatttagccaggtgtggtggtatacctgtaagtctcagctactggagaggcagagggggagaactgcttgagcccagcagttcgaggttgctgtgagctatgattgtgccattgtactccattctgggcaacagagcaagaccctgtctcaagagaaacaaacaataaaacaaaacgaaacccaaaaaatcttcactgagagcttaattcactggagtctttgatggaaggatcctgaaagggacccaaaacatgggaccccgctgtcccctgcagagttcttcccaggggaaaggtcccagattgccaagggaggaggctctggtgtttagcagagctgatacacctgcctcccccaaccctggggctcttggcatatgagccaagagtcagcttaggggacagcccatggctttgggagctctgagcaatgcagtaaattagtttgggggtttggggttactgatctcgtccctcaaagcccagtctccgttaagcttcttgctgaacaagctgacaagcagcaatggggacatgatcacaactcagcaaattgaggcaccaaggcctccctcagctctaggtgtgtgtcctagtacaaatacaaacttacatttatcaagacccagagagtgcaaagcagaggttagaaccattgtagctctttgtggggagtactttttagtgtccctaaaaattcctgcaatagcttcatgattgtctaagtcagttcaggctgctataacagtatcatagactaggtggcttataaacagcagaaatgtatttctcacagttctggagggtggaagtctgaggtcaggatgccaacaaggtcagattctggcgaggactgtcttccaggttgcagacttccagcttctcactgtgtcctcacatggtggaaagagaacaagagttctctgaggtctcttatatgggcactaatccccttcatgggggctccactctcatgacctaattatctccaaaggccccaactccgtataccatcacattgcgggtaggatttcaacataggaatttgcgagggacgcaaacattcagtccatagcaatattcttttttttttctctttccttgtagcactggccttgctattttccacaagttaataagaatgccagtgtgccgagtgccagacactgtgccaagtgctttccatatctgttatttgtttcgttttgtcttttgggttttgtttttttttgagtcagactgtcatccagactgtagtgcagtggtataatctcagctcactgcaacctctgcctccccagttcaaaaaattctccggcctcagcctccagagtagctggaactacaggtgcccgccaccacacttggctaatttttgtatttttagtaaagacggggttttgccatgttggccaggctggtcttaaactcctgacctcaggtgatctgcctaccttggcctcccaaagtgctgggattacaggcatgagccatcgtgcccagcctccatcgctttgagcatgtaatcttttcaacagccctgtgacatgggtgttaatgttatacccattttgtaattgaggaagctaaggcttaggaggtcagtgctttgcccgaggtctgattttgggcacaggccaacaccctgtggttaactgccaaactttctttcaaatggaatcttatataaaaccccaatccataaatatatatgggaagcagagctgttgaggttaaaattggggcaggggtccaagccccatggacgcagccttctcctaacttttttcaccccccacctgccagggctccacagaacattatttgaactttgttgatgtagaggagacagcatgggctttggaatgagacaaagcaattcacgactcccccactaactgtgcaaccttgagcagctcacctcatccctcttcacctccatttcttcatctgtaaaatgggtactctgcctgcctcagggggttgctgggatgatgtgactgatgtgaggcttaaggttcattttctcttcccttctctccatggcgtctttccccatcgcccccagctggatgcagttcttcgtgctgaacagccacaaaactctgttctcctgtgccacttcccctcctgccatgctgtcatgtgtgccacctcccgcttctcccatgggtgcatggcagtgttcaagatcttggtatactagtcatttaacttaaattgaaaaaagtgtgtgtgtgtgtgtgtgtgtgtttagccagtcagttatggggacttcagaaatttgtggttaaaggaaaactgttgcttactcaacatttctgataccaaattgtgagttttccataccaaggggattctctgcaggtaccaattcagtgtcctacgatttaattcagttccgacaataactacctgtagctggggccgggcgcagtggcttacacctataatcccaacattttgggaggccaagggagggagggttgcttgagcccaagagttcaagaccattctggggaacatggtgaaaccacatctctacaaaaatatttaaaaattagccaggcatgttggcatgtgcctgttgtcccagctactcaggatgctgaggtaggagaatcacttgagcccaggaggttgaggttgcagtgagctatgatggtgccactgcactccaccctgggtaacagagtgagaccctgtctcaaaaaaacatgaaccaaaaaaacactacccagagttagcacagaccccacaggttaaaggctcagtcccacaaaactgtgtccccacttcagatgccagtcacaagtaataggtccccaggttacccacatttctgtctgacttggctacaaattaggggtctccacacccctccttatgttcaataattggctataacaactcacagaactcaaggaaacattttactaatgtttactggtttatttatattataaaggatataaatgaacagtcagagataatagggtgaggtctggaagagtcctaagtgcaggagcgtctgtccctgtgtggagttggggttcaccaccctcccagcatgtggatgtgtgtacccatctggaatctctttaaactccatcctttagggttttttggaggttccatgcatgattggttaaatcattggccattggtgattggctcaatctccaattggtctttctggtgaccggcccccagcctgaaactgcctatgtacgccagccaccagtcatctcattagcataaaaagacactccagagatcccaagggtctgagaagctcttgtgtcaggaaactgaggactaagaccaatacaatgaaagatattcctatcacccctgtcactcaggaagttacaagggttttaggagctctgtgccagaaactggggataaagaccaaatatatgtttcctattatatcacaatatcacagcaccagtgtgaaaaatagaatgtcatagtggaaaagtcatgaattttggagtcaaacagaggcaggttagaatcctaacatttacgggctgtttgaccttgagctacttatatgaccttctgagccttcttttcctcgtctataaaataaggatggcaattcctgctttgcagagttcctgtgaagaacacagaaaaaggttgtatcgttttctggcacatggtaagggaataaagaaaggattgtcaataaattgtggctattttttattaagttgaatgtttcttatgaaaaatgggaaaaccaattcagtcaagtgcttcctgccttcatttcttgccctgtctcagaggatgtgcacgctgaggtcagcccacagactttcgcctgtgattcatcttttgcttcccacactcttggaggcaagaaatgctggcctgaatatgattacatttgctaggagtcctgagggcttggctttgcaaatattggtttacattcacattaggcccctatggcagctcttttagaaatgccgtgaagctccagtatctctctgcgttccctgccgaggtccatccagcctgtgccatagcgtcctacaggggtgacatggagccccccgcccagggctggccacagtccttctgctcctgatcgtgtgccccatgctggcatcccagatgtagaaagcaggtgcaaccactgctggggagaccctttgcctggcatggaagtggagtgctcttggagccacgttctgtgtcaccccattagggatggcttcctagggtctgtttcctaagtctgtaccaacagccttttagacactttttaaacttctccccacgagatctaggatttcaagggattagtttgtttctaaagtcccttaggtgaatggataagcttatttaggaatagttgtagaaagggggaaacagaaacaagaagccttaccttgggagtcccagttccactctgcaggcatctctgtccctcgtagctgtccatcccaatttgatgcattgacatggcgtgtgagcctagtggttgagtgtaacctctctaggacccatttgatagattaaaattccagctctaggccaggcgcagtggctcacatctgtaatcccagcactttgggaggccgagatgggcagatcaccctgaactcaggagttcgagaccagcctaggcaacatggagaaaccccatctttaccaaaaatacaaaaatattagccaggcgtagtgttgtgctccagctacttgggaggctgacatgggaggattgcttgagcctgggaggtggagggtgcagtgagctgagattgtgcccctgcacttcagcctgggcaatggagcaagaccctccctgtctcaaaaaataaaaataaaaaaaattccagctctgcaccttattccctgtgtgaccttgggcaggttactttgcctctgtgtttctgtttccgtattaaaatggaaataatagtttatctcataaagtttcatgttgattaaaggaacttgcatgtggaaagcacagtggtacaacaaagtttgctttaaaaaaaaagtttcacaattattaactgagggataagctacagagatttataatgaaatcttgtccagagttttcacttgtgattactgtggaaaaggagatgtttgtgactcttcgtcttgtcagagctgtggtgggtccttacctcagcccagagagaatccagggacagggcagaggatgatgctctgtgtgtgtgcacaggcatgtatgtaagacaaaaacaaggaggtgcaaggtgcctatactggaaaaaaattttttattactttttagtaattgtgtattttcagtcaatttggactattgtaattaaagaaaaaaataataggtagatccaggttgtagttttgtaattggggtgaacgtttatggtgagttgtctgatttgcctaaatgaaagaagtaggattttttggggggtccttatcttctaatatagttacataactacctacagtaaagcagggtttctcagcatgggcactgtggacattttgggctgaataattctttgctgtggggctcattctgtgtcttactataagatgttgagtggcttctctgacctctacctactggatagcaatagcagtctctaccccactcctaatcttgacaaccaaaaccatctcgggacattgccaatagcccctagggtgcaaaatcgcccccagttgggaactactgccgtaaaatataacatgcccctgtttattatactgtatttcatgcttttctgtatttaaattttttatcaaagtaaaatatgtgtttatgcccagaaatgacttctgtggaatcacagccgcatgtagaaagttgactccttcagcttgcacagagctagccattggaattatttccccatcacacatacatgcaaagtgtaaaacaagttatcttacagcagtccataaaattgcagtcctttccacttcaaaataatttttttttaaaggcaaaagaaataacaccttcatgtacacagatcccacagaatttgtctgccacacttggcactagtcctctcagcagaaggccatacggctgcacaccccgcccatcagacagagataatccttggatgtcactgctacttaaaaaaaaaaaaatggtttagaaccagagaacctggatgtcattcaatagacaagagaggattagattttttttcctccttctcagagagggctttttattcccttttctgattatatttttgaatgcccttcaagtagctgtttttcatgttgatggtgatgcagtagaatttaatgaactgtgagctaaagcagagaggctgagcagaaaaataaataagtggcagaaactcacccctggagtgaggcatggcatgtcctggctggcaccccatccttctgtgtacatccagatgctgatgctggttggatactgagaacagcatgtctcagcagtgctacacatgggagcctaaatcatgaggatccaaggttccctgcaattgttctttttattttgtctatctccaggtgacctctggttgaggaagagacaaaccatgtgtgcctctgagccctagagagagttagtccctcctgatgtcagtgccccctgggcttctcagagtgtcaggggcattatcacctgctaattatcccgccaagacttcctttctgaaggtgttgattgccattgcgtggggcttgggtttttttgtcaattaagttagatttgtttgctgacattaaattgttgttactgttattgttagttgtcttttatatgactagatttttttaacatcagaagtataaaataaaggaaattattctcattgaacatattctttgtcgtttgataacattaattaataagacttggcaagagcacaggaatctgtgcaaactttatttcaccagtagaatttttttaacttgaatttgatcagtctttcccaaatccagaattaactcctggtattgatatcatcttttgagttccttatgatcagaaacaatgtctgctattgtttttgcttatttcatttttccaccatccctagtaaagtgcagttacactatagatgctaaggaaatccttatgatggaccctaggaaaatctcaaaggaaagaaatgacagaatgactgattaacgaaggattatcccataaatcaagcattacaaccgagagaatctacgactaagtaggaccatgttttgcttcacttcaagtttttatattttggacttgctactgctcaaattaaagttaatgctgggtccagaacatagcaggttgacctggtcccacttttcactcccctaatgcaggataaaaataacagcaataaagctaaaacacttactgagcacttactatgtgctaaacattttaatgtgttatttaatcatgccatcaccctaaggtgatatctggtcgtgttatctttatctcacactcaaggaaagggagacccggaggacttaagaaatttgttcaagatcaggctgatgtaactggcagaaccagaattccaatgtctgactccagagtgccttaactactacatcagttatatgttttgtgtctcaaactcgctgcaataccataactaaactttgatgcagaaaagtcatttccatcccctgtaggatgctgaaaagtaaataacaggtgcttggggcaggtgagcttcattgctctttctcattttaatccacaccactgatcttctctgcttattggcataggcagagaacttgaacacaattttgaggtaagggagaaggagaaataaattggtaatagggaatgtgtttagagccttaaccacagcatttgaaatagacctttaaatacatgaaagcaaaaagaaggaagcttgtagaagagatggagtgggtaccacatatgttctcctaaaaattctacctgtagtttcttgtttatccccaacaaatgagcagatccatgagactcacaaagagtagataaatttcctccattcagtgaaattctcttttttcatgtttctgtgaatcgagtagaaatgttgcaaataagcacacagcagatataatggttcagttcaaatttagaaataaattaataggatcttcataactttaggattatttagtctttgtttttttttttttttttttttttttgagatagggtcttcctctgttgcccaagctggagtgcagtggcatgatcactgcccactgcaacctcaacttcccaggctcaggtgatcctcccaccttagcctcccgagtagctgggaccacaggcataagccaccatgtctggctaatttttttttttttttttgtagagatgcgggtttcgccatgttgcccaggctggtctcaaactcctgggctcaagcgatcctcctgcctcagcctcccaaagttctgggactacaggtatgagccaccacattcagccagaattcatttttaattgaaacaatcttctacttattatctcatcaaagcctatttcttgaaggctgaatgtcttggattacattctccagagtcacatggtttcaattcatttgtttatttgaaaaatatttattgagcacctgctatatgccaggcactgttctaatgctgcagatgcattagtgaacaagacaaataagggcctggcttcttgaggcttatgttctggtaggttaaataacataaacaaatacatgatcaagccatgtgaaaagctgtcacaagagtgtcccagcagagaacacagaagagtaaaaacaaacaaggcacatttgagggcttcagagtagtagacaaggaccagaatgtcagagtcatgtagaacagagtctgaaggttgggttttactctacgtgtggtgctaagacactggggggtattgagtgagggaaaggcataatctggtttctgttttctgaagctcactctggctgcagtggagcccaggagacccggaaggagctaatgcatagctagcggtaacagatcatcgtggtagccgtggagatggagagaaaaggataaactcgagatctattttggaaatgtagctgacagaatttgctgacagaatggattggattagattggaaagggaagagtcaacatttatttagagttaggttgaaggagaatggccagtgacttggcagaaaaagcagcagagaatgactacacggaagccaagagaagaaagcgtttcatagatcatgtcaaatgccaagaggttgagtaagacactaaagagaagaggtcgctaagttagcaacctgagggttgttggccttgacaatagccaattgacaataggtgattttatttgtgtcttgagatttttttccaaggacagatgacttcatttttgcttcaccaacaggcaccatttttaggctggcagtaccctcagtgttttattggcatgtatgctgggcttagctgccacccaactcaatcgtcagctggctcctttgccctctgcatctctgtgacctatagcactgattactgtgcagaagagtcactgtgaacactagacagtgagttcctgaaggctaggactgttccttgggcatcgctgagtcccaccagggagcacttttcctggcttctagtagacactcagaagtgtctgggataggccaaggtgggtagatcacctgaggtcaagagttccagaccagcctggccaacatggtaaaaccccagctctactaaaaatacaaaagttatccaggcatggtggcacgtgcctataatcccagctactcaggaggctgaggcacgagaatcgcttgaacctggcaggcagagattacagtgagccaagattgtgccactgcattccagcctaggtgacagagcaggattatgtctcaaaaaaaaaagtgtctgggataaacaggtggataaacaggcagaaggaagcactcctccaatcccaaattcaagtgctgttggcaccttctgcttcaccaatattagcatatatggtggctggtgcaaattcttatgtacttatccacccctcccccctctcacactctcaaggaacaaggacccctgtcaggctcaccattcaattccctgagtccacacaaggagtgctggatctcaaaagttgatgcccaatatactgttttttgtttgtttgtttgttttggggggggggttgtttgtttgtttgtttttcttaaaaaaaaaagaatcttggaagaaagaaggaaggaagccagcaaggaagggaaattggctcaccaattatgaataagccaaattccacatgtaagcaagtacaatcatttggaagacatggctgcttgaaagagaatgaccaactctgttgagacgcagttggaaaggcatccctctgtgagcagtggggaggccatggctttgatccctgaccacagctgattgctggagggctctcgctgtaacgtgacccctggcttctgactcatcactggtgtgtccttgccatacaggctgctccattccattcctcagagctgtatccaccgaggagaattcgggtaacaaacattcctgtatttaaatctgagtaaagaatgttagcagcgctgattcaaaaggtcatctcggaattctccctatcctgagccataagcagagaagcatctcccaaacagtgctttctctggaacagtgagcccatacgaagaacaagggtttgggtagatgcatacccttgggaaactgtgccagactccccctcccagagcctcatagcagctattagcacattaaagcgccaagaggtcttggagtcaaaaacaaaaatgcatctatttcacattggagtcacatcgccctcatccaaattcagccacatgcagtgggcaacaagaacaacaaaactgcatgtttttcctaagaacgtgggcctagacactagctcaccctttcgtctggtgtctgagcaaagaaacaaagatgtttcccaactctggaggagaaactggccatgggaagggcccactgtcccacatactacgtgtactgtactctttcaagaggagtttttgtcctacaggattttcgcctcccaccctgacactagaacccaatcccatgtaagctgcagcattctgcatcaattttctttagggaggccctcggagtattctcaaggagccgattcttatgtcttcatctgggatcacggagagttactgactccttcctggagtgtcacatgctagaaacctgtgtgcaggcttgcccccagatgctacaaatctctaaagatacttccaagctatatcttttctaaacccgcagtgcttcttcccatgatgtgtagagctactttgccaggctttctttctgggttcccccctccccagaaaaaggtgctgttaaactaatgttacatctcacaattaatggcatcctagaatcggggaataccgttgattgtttgggtaggacctttcccttgctcctttgcagggccaggcgcttctgaaaactgggtgcaaatttgggaatgctgcataggagactcataggaaatagataggtctagggcaaaacataaattggggggcataaaggatgaaagagtcagtaaaccatttcactatgatgaatcccactttacctggaaaaaataatcttttttttttccagagaaagcaaccattgtctttgttttaccatgctggaactacagatgtcttaagatttggtttctgttatttgtttgtttattagcgtcatagatactttgcttttctccccctgaattattttctcaaattccgaagccttctctaggggtgcattttcctaagataacaatggcttagtttacattgtggctgtggttttctgctcatctttataagtggctgcctccaccccatatgtaatcttcttaaacaagcaccttcttaaatgaggcaaccctcttaaccaaagcgcattaataatactcattattaatgagtatatggtagtgctcttcttattaatgagaaggctgcggggccgggcgcggtggttcacactgtaatcttagcattttgggaggctgaggcaggtggattacttgaggtcaggagttggagaccagcctggccaacatggcaaaaccccgtctctactaaaaatacaaaaaattagccaggtgtggtagcacacatctgttatctcagctactagggaggctgaggcagtagaatcgcttgaacctgggaggtggaggtttcagtgagccaagatcgtgccactgcactccagcctgagtgacagagggagactctgtctcaaaaaaaaaaaaaaaagggttgctggctctgactgacaccctaatcctgtgacctgcatttgtcagctctgggcatcatcctgatagtgacactagctccaaaaacatgaatcaagtttcccggtgcgtttaagaaggcaggggctagatggtggccctttgaaaattttcctcccactttcttggctgagctgcctttgtcatattcttacaacaaacccatgggtccctagggtttggtggtgaggaacttctagcccttatggccaacctttgccttagctgctctttgaggtgggtactggtgatggtggcagtgcagagccagcctgggagacaagtggggtggccagaggaagagggtgtaccccagagctgccctcctctgtggcttgtaatgtttgtgagccaagaaaccactggactttttgccctccccggtgccccacatgcaggctgaagaactacggtcctatcatttattttttttaaccacttctccccgaccctcacttgtctacacaacttgtaggcctgccatcaatgtgatttgatcaatgttaccacgatcctgcgttccatcctttttaagttgttagggggtttcttttttgtatttgtttcattattcagccggcactggagttgcattggactggtagcacatcctggggaggaactatccatctggttttggttttgattggggggatttttagggggaagtgctcatttttcctgagatacctgggcctatatcttccccctgtgtctcctgtttagcctttcccactcctttttcagaagtgaaagagcagacagaaggtcccctacaaacagttaactacggtattttctcgattccaggatgacattaattgtaaggtgccacagccattaaatagcaccttttcccaggtcccaggggcaattcaaggacagtctcgtcatccacccagcactggcgagcagaaagagatgggtatagtgtggcagtgcagggcatgggcctgggaatgtaccaagagcagcttctagtgccgtatgactaggtcataattaattcacacatgcccttcttgtcttgtgggaatcaggtgcttcactttccctttggcttagagtttagttcaaaatagaaaataatgaagctacaatggtctgggagtttcctgcttcttgtgatacccctgataattgtcatgtaaattaactagtcccatagcaactaggccacacataggaaaaaaaccacaccactgccagatggtaatttaggaatgtgattttagttttcagatgtaaaggatggtgagggagtggccttactattgttttatttttgatttcttgtttaattgatggtggtcagagaacattagttataggttatccattttataattcatgataacttcctttgtgactagctagcatgtgaaccacttttgtaaatgtctcacgtgattgaaaaatgtatataatctctctgttgtgggcagagttccatatatttattgtatattttgtaatttagatcatgtattattagaaaatttatttaatgtctctcttgtgtacagtattccatatattgtttattttgtttaaatcttattcattcttgccattttttgtttgcttgctctgtaatttctgggaagagagttttaagtctcctgtgataattctaagtgtgtcagtctctcctgtaactctgacaccttttgctttacaattttgaggctgtcctgttgggtatatgtaagcttaattgtgaggtctttttagtagtggtgtctttgtgcctattaatgcttttgccttaggttctattttatctgattaagattgctattcaattttctttgggtcaatatgtatttgcctcatttatttctttccaatcttttattttcaacttttctgtgtcattttgttttaggtgtctctcttgtaaagcagtatatcgctggctttttaaaaagtccaatctggccaggcacagtggctgatgcctataatcccagcactttgggaggcctaggcaggcggatcacctgacgtcaggagttcaagaccagcctggccaacatggtgaaaccccatctccactaaaaatacaaaaataagccaggtgtggtggcatgtgcctgtaatcccagctactcaggaggctgaggcaggagaatcgcttgaaccctggaggcagaggttgcagtaagccgagatcgtgccactgcacttcagcctgggcgacagagcgagactctgtctcaaaaaaaaaaaaaaaaaaaaaaaaaaaattccaatctgatattgtcttttaataggtgagttttatccatttacaattattgtaactactttatatatttggacttatttctaacttctaatttatatttccgtttacattgctttttgtttgcttctttgttctccttttctgccttccattagattagtacaattttccttaacctgtccccatttttccccctggtatcttggtcacaatagattttatttctaaaatctatatgtttaatgattgccattacgtttttaacatgcatacagaactttagtttttaaagactaaagttatccacaatctctgtcttctcagataacacaaaaatctttgcatactttacccacttacagtcaactggtaattacaataaagaattgaaatcatggcccaaaacactggcaatgcttctcagcctactaattcataggggattagaggcaccctgattaatttgtgaagcatgaacttttggctgattcactgttttacaccctgagatgctttggggcacatctcaagttcaagtgatacttcattcacagctcataatctctctctcaagttcccgaaagtgttctgaagtaggattggacaaaggggaactcagaatcctatgatccactactaggacctattttcataaatcagatttgtcatttgtcataattttcagtgagaacatcagggggctcctcctccctgcttgacacctgcttccctgtcctttgattctcaaaactttactgtgcatatacatcgtccaaaaaatcttgtaaaaatgcagattctgattcaattcagtaggtctgtattattattattattattattattattattattattatcagagacggagtcttgctctgtcgcccaggctggagtgcagtggcgcgatctcggctcactgcaacctctgcctcctggcttcaagcaattctcctgcctcagcctcttgaatagctaggattacaggtgcccaccaccacacccagctgatttttgtatttttagtagagacgggatgtcaccatgttggtcaggctggtcttgaactcctgacctcgtgatccgcctgcctcggcctcccaaagttctgggattacagacatgagccactgcacctagcccaggtctgtatttttaacatgatccttggtgatgctggtgcttttggtccacagaacccactttgagaagcaagagcttggagaatagaatttagctaggaaatttaagtttcagctctaggtcatggttccttgatgcttacagaataacagataaagaaactttctctttgaaggggttggggttcaggattattttaattctaaaggtctccttaaggtctggcagggtctctccatccctccttgggctcagatcagactggctaaaagtgagtggtcattcagtgctctgtgaagtccctccacctccacccccatttcctctgctgtccctcttgaggtcagcacagcacacacttatagtctcaggcctgtcactgtgtcatttagatgtgactcatgtgagtcaatgccctgaggaaaagtctgcctggggtaaggggcaggcttcctggtaatttatgtttaagacaagcttttaatagagatacactcctaagtagtaaccaggaaaaagattctctcctcttaacgggtatccatttataggactcagctgttgaagctcaagggtagcattaggcttaagcttaatcttctgtatactgtaatttacagcgctgagtaaagcattgtatgtacaactatttcagtcatttgccatgataaatagctattgctcttggcagagcagaaacgccatctatgctttccatttatgaatattgaattgtctcaggcaggcttttgccgtaagtttttaaaggggaaatccccaactaatcacatcactgcactggcccaaaatgtcatctccctgctacatgcaccagtcagatcttgatccaggcagcaattctgcagtgcacgtgtttctggtgaagcctgcacaaagcacttgtaacaattccaaatgcaagtcctgctaaaggctgcagttttacgccgaatgccacgagctgttagggagaagattcagctggtggcagaacgccactggcaaggatcaggaaaataacttagaggtgacaatctgatgcaggaaaaatggaaggggcatgattctgtgggattcctgatggtgaaaagatgatgccacctattgaaactaaggagacaaaaaggtaaaagaaaatgcccaggctataaatccctagggatctactcttcaggaactcagagacacttatgccttctaccagtcttctcttcagatactgtatgccctgctgactgggaggaagcaaagtggatattcaaataggacatccaggtagaatgaccatcttgtcctgggaaatcccttaggcctgagtcagccggtcaccctacactcaggcttccagaaatttcccgtcttcgcccccattccttcccaccaacaaacttcctgtgctcgggggactaaaatacttaggctggcattccttaatttgtctcacatttctgatcacccactatgggccaagcattgcctgagtggtgggataagagagtcaagcacgaacacgagtagagacagcaaacacacaaaatagtgtgccgtcgcctgtttttgaataccgtgaggtagactggcatggtcacgcttccatggtcacgcttccagaagccacttctcagcaatgtctctggaagatgattcctctgaaaacagttgagagtcttctgtactcacgactgccttttgagcttgatcatttgcctatagaaatatcttccatttctacagtatcttgctgtttccaaagcactcttgtagctcactcattttcattttcataacaactcagtaaggtacactggcggaaactggtttcacagatttggaagctcaaagaaattcagtgatttgcctgaggccacacaagtgataggggcagagctgggactagaagtcaggattcctgactccccacaactgcattttccatggatagagaccccagggggggaaaaggcttacagagcagcaaaaaaatgcacccagtacaggaggcaaatttacttttatgaaacttccaacatttacagtttctaattctagatttacatgcaatgaatacatcctctagctgtcttctatcttccttactcaggacccaagctttctgcaataactatttgaaaaccagttttacgattttgactctgaaggaagattactcgtcttcttgtaggttctagtctaccctttcattgcttggccagaagattctatcagaacaaaagttatggtcatttcagcagatgctgggaataaatcccttcagcattctgattagttacaatgggtaataagagaactgtgcagaccaaaaactccaagtacatgtttcatgcatgtaaacctactcgtgatgggttttggctgaaagctaagcattgataaccttgccaccaaagcttagagtcgcttgttagtattctgagagctggagtacaggcacagatacaacttgatcctgttaacgtctctcattcctaggccacagataagtttgttgaataggaagttgagagaaagcgatctggagagagaattgtatgcaagtggctcaagtgacctggcaatttgggagtcccttgcaaccttgctatgacctcctacctctgtttgcccatctatggaatgggtatggtggttatataccaaggttattattagaaatgataaatttgaaaatgccttggcatgtaacttgtgctataattatacctcactgccacatggaaaataggcatttttagctgaaatgtgtaatgaggttaggcagggaacatcagttggtggcaggaagagtgttcccagagacaagaggtttgaggagagggggccagatgctcactaaggagaacagagagatcatctatgaagcgtccttgggcatcacgatggaatgttcaaaacaagcacaaaacaaacgtttagacgtctggcctgaatttagaaacaaataaggggcttggagatgagcctctgtcttttcacactgcaggctctgcactccagccctgagtaccagtcgaactccagaggggtggactggagaaggaggaaggcctgagcaagccagtgcccacatgggctgcagctgctgggtttcaaggagctttctatcggagaggcagcagaggggttctgaaagagccagaccctggagccaagctatctgggcttgaccttagctctgctattcactggctgtatgaccttcagccagtcctcatctctctgtgcctcaatttcatcaagctcaaaatgggggtaataatagtacctgtctcagaggttgtcaggaggataaaataagtaaataggactgcaacatgtaggagaacaccagacatctatacacttaaacacagcaaggcacttctctggccttgtgaatttcagcacatggcagagaagaaacaagctggactggctgaggaaagctcacctccagaggactgagtgggttaaccatgaattacatagtcattcccagagaggacgcatggcgggagagaagcagcaaggatcgtagctggatggatacatggccttggctggaccaggggctggcgagtataggggcttatggagggccgggttttgctcaggtggaccctcttgaaactcccggtgggcctcccttctacccccaggaaagctggaatcttgggggcttctgtgtccccaaaagcggattccagtggccagcatcttggaaatttttgtgcacttatttcacttgtatcagtcttttctagggtcatttactgatattatactttctctgctctggagtcattcccctgcaaaatcattcccctgttatctgtctgcctcaacacgggaaaaatccctgtcatctggaacccttgcttcctgcccgccgtcctgcctcactgcagtgtgtgggcagatctgctctctgctgcacacgtcttcagaaagactgaatttcgggctttcagagcaagcgtctttgaatccactggtgaaaggagacagcagtcatctgctggttgatgtttgccaaaatgtggccttagactgggatgaagtgatggctcctggcacggaagctggttccccctgggtgtacacccagcctgaacagctcctttaaaaccagaagcaatttgtcatcttttgattctcttccagcactgtccctgtcacaggtagataaatgaggcagcatatgggtgtccaaacacaggatcgtctaatcccagcggtttcccttggagccgtcacttctcgagggtggagagcacagtggggtggtccctggcttcggggttgtaaccataagcatattttttcatcacatgtcccatttatatgcatgaaatgctttctcagaatctcccagcttctgtgtcattgataggtgcatttctcatttcaaaattccgaaatgaatcatacgtttgtgagctcaacatctcatgtctgtagttccacagaatgctactaatcaaatcaatgtctcggcacaaaccaacaagcatccctgacttaaaaacagatggaagttgaactttttgtgctaaaaagacttgattacagaaagtcagtgggaaaggtgcatacatttcagtttccttcacgttgcacgcactgtaagtggcttgagagatacattcagagttttttacgcagcccacgtggactttgaatttgttgcttatatatcgataaagccaccagattatgtccaaggatgcaataggcagaagagggctcctgatctagttgccaaaacatggttgacctgcgattcctttgtaaatgaaggataagcctgtgtggcgaatgagctcagcccctcggcacacctcctgcctatgccaaagggttgagtgtgtttctggtctagccagacagttttgatttcttctgtggccataggtcacattcttcatccccacagctgccagattaactagacatccttggtcacaagggcccaggcttgactggatcagttcaagttcatcccagatacaggaaagtcatctactctgatagtattacagtgagtccataagcatctttgagacaccttgagaaaggaggaaatgtggagcatcgtctccaagcaggatctgttgagcatggatcggattcttacacaggctactaatgctggtgaccataagaagtttatagccagctcttcattatctatggtattgaaggagaaatctagcatgaactttaaaatttcaaaataaatcccacagtttaagctttagccggggatttcatactggaaaccttttaggggagagtagtatttccttttatgttttcccaattagtagtttaatgagcagcaagatgacccaagggggatgagagacagcacaggaggatcatttgcctggggttaagagatgagtctgggttcctgtttctgcctctttcagactctgttcatctgcagactgtatgtgtttgctacatctgctttgtaggatcagcatctactttgtaggatcagggaaggatcaaatgagttaatgaatacagatatcccaagcccagcacacaatacaaatgagctgttatgacttatttagagggttttttttttttttctgacccaggctggagtgcagtggcgccacctctggtcactgcaacgtccacctcctgagtttaagcaattctcctgcctcagcctcctgagtagctgggattacaggcatgccccaccatgcctggctaatgtttgtatttttagtagagacggggtttcaccatgttggccaggctcgtctcgaactcctgacctcaagtgatcacctgcctcagcctcccaaagtgctgggattacaggtgtgagccaccacgcccggcctagacttattttaagagaggtggcaagaactcctacttcaaggaagatggtaacactgaatagtttgttcattaagacagacagatgcctaagtgaatctttgaaataatcctgcatttcattcatggtggaatctcataatctttttttttttaagcctaaaagcctgagccagctgtacatgatatattaaacccacacatttacttactttagaaaggttactattttgagagtatgatcgttcctggaaaaaaaaattttgatgtgcctcctgtccattgaaaagttacatataaagaataatttccattccttggattatgtcttcagattcctgcattcttttcaagctttgtaataaagcaagggaagagagtattgtgaactccttgaggaagacattccctctcattcctccacattgccccagagttcaccatgtctgacaaatagtgggtattcagtcaatagcttatgactgaatgaatgatttagatgtttaatcctttaagtcagtgatacgcaacttgtagtcatgtgtcagaatcccctggagggcttgttaaaatcaactgcggctcccccatcccaagtttctgattcagtagatctgggttggggccccagaatgtgcatttctagcaggtccccagatgacgctgatgctgttggccctgggactatactttgagaaccactgctttggggtccactccactgcttaggtccattgtggttttttttttttctttaagctttgccaagccttctagaaaattgacatctatctctgtctgattttgctccgttaaactgagattgattttgtaaaaattactaggatttgaccagatggaaaagctacctggatttttttgtttttagttaaaaactacagccgggcaccatggctcatgcctgtaatctcagcaatttggaaggctgaggcgggtggatcacctgaggtcaggagttcaagaccagcctggccaacatggtgaaaccccatctctactaaaaatataaaaattagctgggcatggtggcgggcacctgtaatcccagctccttgggaggctagggcaggagaatcacttgaacccgagaggcggaggttgcagtgaaccgagaacacgccattgcattccaacctgggtgacagagcaagactccatctcaaaaaaagcaaacaaacaacaacaacaaaaaaaaaactacattttgccccatgtataattatgaaggaagtgactatcagattgccacctcctgcatgggtgtctatgctagcaggacacagctggttggggtgaagtatagcggcccaccttgcagcatttaagccagattgcatcttcatccagttttggaattcccacctagtgtcaaatgcacttaatggcaaagctgaaatgagacatgaccttttgcagaaattgcagatgagcaaaaagggcacaggagatgagcatatgatacaaaggggaacatgatgtttgcaaagtcttctcatgctggctgtgggcctggctgaagttattatgcccccaggtttaaaaacaagaggcagcctcatggcctgaggaagactgccctctgcaaaaaagtcattctcctaatgccagatgtcactctggatggcaggcaagagtggaattgcaaacccaggtcctggggagctcctccctcctccattcccccttcttgggaaagagtccttgagactgtgaggactgagtggacacagagggatgggtcagtggagggggcaacagggataccagacatcctcaagagagaagagatgaaaatagaacctaagaagggaattgaaggggaggagaagacgagagccttaccctaaagtaggaagagtgtgttagtaacctgttgccgcataacaaatgactccagcgttagcagcttagaacaacaaatctgtgttgtcttgcacagtttctgtgggccagggatctgggagtggctcagctgtgtggttcggctcagagtctctcatgaggctgcagtcaagctttcatctgaaggcttaactggagttggaggacccactcctaagatgactccctcacatggctgttggctggaggcctcagttcctggtgctcagtaccttaggcctccccacagccctgctcacagcatagcagttgacttccctgagagccaacaacccaagagagggagggagaaagtcaaaatgccttttatggcctagtctcagaaaggacacgctgtcacatccactctattctgttcattagaaatcagtctctaagtccagcccacacactgcaggaagggaattgggctccacctttggaaaggaagagtgtcacctcagtgagactcttgccaggctcagaaaagcacaagaatcattgacagggcctttggtgtaaagatgaggagggctgcagccattggggccatagggatgcacctgattgggctgaagaaaggtgattgggtaggggaaggggcattagaaactctccatgggcttggagcctaccatcctataggggttgtgcaggccccttctctctttcaagctaaagagtgactttgcttacaaaagcaaagccacctatgagtcccaaggctcagatttggttccagagaagagaaagacagggctggaggcttagacccaaggctgtgctggagaaagagcagtacacagcactgtgcatctccttctaggttgtccgccctgccaggtgcccagtaggaaaagaacagggattgaaggcagaagggtgtcaaggagtaaagagaagcttctgggctgtgattctcaggaaagtcattgggagggagtgttaagcaggtggtggaagaaccccactattttttattaaaatcccacttaggatgatagctcagtcctgccagtaatggcagcagtcagcccttcatggctacagctcctgggttgcacagagtccctcccatggggtggatgtttgttttggccaccctggctccataaatggattccatgtagcagtcttcttttgagaatgcagagcccttggggtcatattgtactgtgtctgttcttatctcccctatcatccccagggaataagctaatcaaacttactgatgattttacactgagaaggagatagctaataacttggatgacaagtattagaatacaatgtgatgtggataaattgggtccatgtattaagagctataaaatgagattctatcaaggcatgaataatggtgcccatgaaaaggattaatcaaataccccattaaaaaggtataggaattcaggtcttgcactcctgcccccaccccaccgccattccattccccctgaaactgctttctactaggagaaatatggaaaagagtttagaggaagtaatggaaaaattgggacatacattttgatagaacaagatcatgaagacgcatttaagcaaccagtgtttaatttagggggaaacatggcaattggcatgagtaatcatttacaaatataatttccaaaggagccatgttgataccattcagcaaatgccaacaaagcatttactttccaaagggagaaagcaagacaacaggagaaatgaaggcatctccaggagtggaccagagagcagccaagccatagagaagcatcaggtgtgagaatggaaaacgcagaagagacgtacaacttctgaaagatctcagaggactggcattgtctggagacggcttcctggaagaggagactccagcagagccctgaagtgtggacaagcttccattcactgcaaattcgtgagcacactctggtgtcaggatctagtaaggaaatgggcttgagcagagcagggggtacctgtggggttcttctcttcattttcaccaccacaaagctggtctaagctgccatcaattcccacctggacaactgcaaaagccttccagctgttcctgcttccactcttgctcctctacaattcattctgcacgcagaagtcagaatcaaaatcaaagttcatcatgtcattctcttgacttgtggcttccctttgctcttaagctaaaagtaaaaatcattatcatggctacaaagtcttgtgtggtctgggccacatcctgtgccaggctccctttcattgtctatattccagtcaagctggccttcaaaatttcagcacattgggtctttctgccacaggcccttgcacatacatgcttttccctctgtacatgtgattttctttcatccccgctttccaaagctaactctgactcatccttcagactgcatcttaatgattacttccttctggaagactcccctaattttcacaactagatgagctctcccttatatgttgaaaacaagtatttcttgtgtgaacagaaatgtttaatgtctgccttcccaactcagccacaagctctgtgaggatggggactcagtctttgcatccctcagagcctaacatagtctcagttaatacgtgatagctggagcgtgacatttcattaggaacagtgaggctagttgagaaattatacctcaccagtatataggagagtaccattaggaattcttaatgggatgaaaacctgaattcatgtctagaccctgccacctgctggctgtgctgttttaaataaattgcagatcctctcaga

SEQ ID NO: 30 - DNA, 28700 bp, Homo sapiens
cttttaccgcacatttcccctcccctagttcatttcgcacgacgcagcggttgggaacacagacattttcggagctggagccgccactgccgccgccattttgtgtctgtggagaaagaagcttctgtggcggctggaagtggacggagatcacccgcgagacggcggcgtttcatacccgaggttccccctgtgtcgtcccccatcccccctccgcggtcagcatgtggtgaagccggagccgcgagagagccggggagaggaagaggagtcggaagggaggcggggtatccagagcggcttcagcttcagctgcagcggacctcggaggggggccgcggcgcaatgtcagagcagacgccggccgaggccggtgctgcgggggcccgggaggacgcctgtcgggattatcagtcatcgctcgaagacctgaccttcaatagcaagccgcacatcaatatgctgaccattctagccgaggagaacctgcccttcgccaaggagatcgtctctctcatcgaggcccaaaccgccaaggtttttatacaccccgcagcctcctattacttctaatactccctgattttagtgtcagcctcatcccaggtctcgcttccatcccaagggggacagtgttccttctctccaacccccccacccccctccaactcaggctcggtctttggcccaggcttcgagcatgggcctctgggggggagggagtggggaggataaagggtggagtcccacttccgctttccaactccctttttaggccaccgcattgtatatcccgacacacacacgctttgaatagagccctttggggtgggggagacttaaaggcagtttgtggtttggggaagtaagagttaacataagccattttaattccctgggaagtgggagagtgggtctcccattttccccaagcaccctttttggtaattgtgttctgtgggttggaaggaggtgaagggggacctgggagcgagctgttggtgggtgggaatagggatttggccccgagtggagcagccgcctgttaggagcccaacatggcgcctgaaaagcacatgatgcgaaagggaagagaggagaatccattccctgccagccaggcagctgctcactcccgtcagccccattttggggtgggggcggctagataaaacttttattctcctattggagggtctaatttgtcccaaaataggggcaagtggggttgagggtggggtttgggtggggggaggagatcttatccaacctgtaggtggagaactggcccagagggtaacaagtacttgcagtttctctgaaaagttcagtccctcctcctcttccttttctctttttctcccttccctgatagcgaaggagtgtttttctttaccccttgacagaagtggtcctctgccaccttatatttccctgtagtcctcctcttctgtggattcatatgggagcgatatgtcatttaagtaaagttactgttcaacttagttacaatgagttttaatagcgtcccagtgctacattttatttttcaagcttgtactcacggtttagttttttctagttgttagtgattgcaattatcaggatgagcctccttttagcagagtgaacccctttttaaaggccactttaacaacaaccaccaatatattgtttagagacggtttctgtctagtgtaaaacttgagtggtctgactctaataaatggttttgaaatgtgtgactggtattataaaatttgtgaataaaacatataaaatatgtatttgtcttttttatttacctttgtaaggtgtagaatctgtttccaagacttatttttatctacgtggttgtgtgttttaaacaaaagtctttaagtgacttgggttcattcttctttaggttccatccactcttttgggtaaacctcttcacaagatacacggtttcaggtggtcctttcataatttaaagaggacgaaaaggaagggttttttttctttttccttttaaggacctcaacaagtttatcatgctcagtctgacagctaagatacaagttttcgttcactttttcctgtgaaagtgtatgtaaaacagcttttttttttaagtgtgagatttaaaaaggaagcattcgtcatactcaacatgctttttattgataccacaaacatcttggacatgaaaacttagtttttgccttgttgaaggcttaacttgacattaaatgccttaaagcacttgtgtttttaaggcaaaaacattgatttttaaaatctaattacctcgtatcttgggatttaatattccacagcgcctaatatttagcagctcaggttgtcactcaaagaaccttgctggtttttaatggatccggaagaccttcgagaaccgaaaactaaatgctgaatatagtgaccacataaaacttgtgtttgtatatcgctacacagtgatgaaaatagatgagctctttgctggtaaaagacagctgaaattttgggggcacacgtttcctggttatttttgtaaagccaggttgaggaaaagatgtaaaagtcactttgggggatctatcttaatctgggttgggatcgagggtgaggggagggatttccgttatttggtagcaaactggcctggttttgtgttttggaggtgaatgtttgtgtccttattctttagcttctctgcgttactaaacttaaaggattcacacttaatttgactcctcccaagagagagcagtagcgaaaaataatacataaaaggacttcacttgtacaataaaaaattagcctacttaacagactttggtgtttaagagagcctgtttatcttcataagtacaataatgactaaaatggtgtaaaacatgacatggtaaggtaaagacacagcagtaaaccatttgacatgttcgtacttaatatagttgacccacatgcagtgggtgaacccttttattagacagtaccttaaaagaaatttttcatacaaagttattcaaagcttcccttagccaacttttggttgtaaaggtgttatcagaagcaagagcatttccacacacttgtatgggcaattggttttattatatatgatggcattgtgtactccagaactgtgagcctaccctagcttcaggcagctatgggtaagtgttacttagggttaagattcctatacacgtggggtgggtaaatggggataacctaagttttttttttttttttttttttgtcttttttttttattttaaatcatgggtgctcctttggagtcagagttaaaactattatggtgtgtcttaatgctcctcaacaagtctgtgaacctgctgatgctttctggaagcttgctgtgccttctaaaagccagtggtgggtaggcattgcagttgaactggggcaacatttctttactttggaaagggccacctgtatcagcatcaccacactggctctgcacaaatttataacccctggtttgtgcatgtcagaggaaaatatctcggcggagagtccaggctgtgaagaaaatcttcaggacaaatcctggtttccagagtcaagttcaacctgatttacatgattcagcggctgctccatccagtttttcttgtctgagtaacaaacttgcaacttcctgcatgttcgtgtgcaagtttcagtgttttgccattgacttcctaggtgaagtgtttttaatttttgttcatttggattatagagaagtaatcctaatgattttacaggtaacaaaagcttcatagacttgaacatataaaatatgcccatggaaattagtttctacaagaggtctaaaaactgctttgagtgtaggcacaccgttgtaagttaatatgggtcacaaaactgacacttggattatataaagtaattttccctcgcctcctccttatttttgtcacttaaaacacaggtctttttaccacatgaacttgaaatttcattgagtgttaaatgagtatattagggattacagctgttgttcatcctggtaattctgagcttttttgtgctcaactaaggattgtgagagttgagagcttgattgaacacttaagtttcataaagattacttcaaaaatatttagtatcaacaaaaatagaggtctgtattgtaggtttaaaaactcatttttaaataattatttggtggtaattcattatactaaacttctcagtttctttttattcaggctccttcctcagagaagcttcctgttatgtaccttatggattctattgtgaaaaacgttggaagagagtatctcactgcctttactaaaaatctagttgcaacatttatttgtgtgtttgaaaaggtacatatgcatttagaaacatttgcgtttttttttaaaaaatgtgttcctgattaaataaatatttgctttgtgttgggttttcttgggtggtgaaatgttttatacttttggacatttatcgttagtaccatttcaaagaaagaggctgaagttaatgttttatgttagatttttagaacagattctaggggtttacattatccatttaagaatagatggatttgcttttagaattgtgctttttaaaaaaattgagtgtgttcatttgaacatctgtttcatcacttacaaaccaggcaaaaagatctgaaatcgtcaagagtaattaaaatttcattgtttacatttctggtgttaggatgttgactgttctcttgggggggtaaaaagcataatccctcagtgtctcaacctgtgattggttcctgaaacttgtgtgtttttttgttttgttttctggaaatgtttacttttgttacattgttcaaggtatgttttaggtgaatgttgttggtatgtgtgaatggtggaccagttaattgctgttggttattctggaaatacttttgcccctaccttagtgttcagaaattaggcttatttttcatatctagagattgtaaatttcttccataacactgtaacatggtggtttggttaaagcagtattatgttgaggaggacaagggatttgctgaggtaattctctgcctgtcaggctatatctttcacattgaacaaaaaggcacttatgagatacttaggtttaaagattgtttcctaacgtcaatatttggtggtagttattatattttagtagatgaacacctgtgtgtcagttgtcagatttgtagaattggaattttttttggaagaactattcagtattagattttacatgtttattagaaaataagtagttgctatttgagaaatgtttttaagttcttagagaaaaacagtatatgcagaagaaatctggaaagctctatatcatatagcattaaaatgcttgttaatagaatattgtagacatttgctgaatactgctaaccagaggctgtagtcttaaggagaagcttaaccaacctcttggtttcggtttcagtatgttcaaattcacttgggtgtttggtagcatacctttactgaatctaactgggcattaacatgacagttgattaaaatgaccttgtaataaatacattattatctgaagacttatgaatatagttaaggctttactgtctatcctaatgttgaaaatctaactcagttttcccaagtcctaggtttcttgatggcgaattttctttctttttcttttttttgttttgagatggagttttgctcttgttgcccaagctggagtgcaatggcacaatctcggctcactgcaacctccgcctcccggattcaagtgattctcctgcctcagcctcccgagtagctgggattacaggcatgagccatcatgcctggctaattttgtatttttagtaaagacggggtttcaccattgttggtcaggctggtcttgaactccctcaggtgatccacctgcctcggcctctcaaagtgttggaattacaggcgtgagccaccgtgcctggcaatggcaaattttctaaacatttttacgccatcacaaacctgaacagaaaagttatttaaaactaaggcttatcagtggttaagattttgtgaatttcagttgttaaagtgctttccacaccacaatatcttgttcctatgtacccaaccatatagtattgctgagcattagttagtgagatagttttgctttaattttaactttgtactactatgtaaataatttaaaacatttaagccatcaggtaatcaatttttctagttgttttatattttttagttttatattttctagttgtcttacatttttttttcccagagaaagagtaactttaggaatattatactaagctctaagatgtggaaacgttttgtatatagaaaggctcacctggttggttgcttgcatgaaggctaggtgaaaatggttttaattactctgtttttgaaggagaaatgcacctttaataaattattactgttgtatatacttaccaatgggtagtacagttctgtatgtgaagtagagcagatttatataacttatatttaatatataaaatattctatagtaacttaacaagccatagaattgttctgttgttctaggtggatgaaaatactaggaaaagtttatttaagttacgttctacatgggatgaaatattccctttgaagaaactttatgccctggatgtcagagtcaattcattagatcctgcttggcctattaaacctctaccccccaatgtgaatacgtctagcatccatgtgaatcctaaatttttaaataaatcggtaagttttaatatgaatagtaagtaacatacttttaagtatcacattttgaattcttctgcagaacttactgccagaaagtcaaaatagaatactcggtagtgaattggttcaatttgaaaaaaaaaaaaatagtgtgtatatgtttggaatttttatttagaaatatattcaccttgtttaggtattatgtaacatttattttgggttttaaatttctgataagttttctgtgtgataggaatttggatcatattaagagttaagctgataatttttactccctagcttccgttttagctgatacgtttttcttaaacaaattgtcttttcttatagcccgaggagccttcaacacctggtacagtggtcagttcccctagcatctccactcctccaattgttcctgatatacaaaagaatcttacacaagaacaactaataaggcagcagttactggcaaagcaaaaacagttgttagaacttcagcagaaaaagctggagcttgagctagagcaagctaaggcacagttggtaagtaagggagattgtcattttaaatattttaaacctgtctaacaatagggaagtaatgtttatgtttgaattttattaacatgttacttttattaatagtgtactcttttttcacttttattttacaaatgagtatatttattagactatacttttatatctttattgtaaaattcacttgattaaaaactgcataggccaggcgcagtggatcatgcctgtaatcccaacacttgggaagtctgaggtgggaggatcgcttgagtttaggagtttgaggccagcctgggcaacatagtgaggccctaccaaaaaaaaaaaaattagccaggtggggtagtgcatccttgtgatcccagctactcgagaggctgagttggaaggatcacttgcggctgcagtgtgctatgattgcttcactgcactctagcttgagtgacagatcaagaccctgtctcaagaaaaccctccaaaaactacaaaactacactatttcctccaaacagttttctgttagattgctatcttataaaatagcatcttaattttgtttaatcattacattatgtggacttaatatttcagtcccaagatggtaggcatgttgtggcaaatatttttgcatagtctttaatgttttatgagcttatgctccatgaacagaaatgacaaaattaaggaggccaggaagattatatctttctacacataaatgactttatactaagttattttgcttagcatctgagcttattcgacagtgaggtgcaggaaggcagaattttataagttcattaatagcaccactttgggagaaactaaattttaggacttagaatttagctgaaatgactctgattcttgtgcagccggagtgtagtgatttagcaatttcttaggagcagtatggctcagaatcctgaacaataaggaagagaaacaattttttttcattctatttagagattatattataaagtctcaaaaaatactagtaagaaataatgggcaacttaaatcatggactttttcttttcattgtaatctcaatttatacattataagtgtacaatttaaatgtagtgttgagtaaatatatttattgaataaagcattatcttcttcagttgtttgcaatttcttgacaatctgcatgttctgcagtgttaacatgaacatttattttgtgttttaggcagtttctcttagtgttcagcaggaaacatccaatttaggtcctggatctgcaccatccaaattacatgtttcacagattccccctatggcagttaaagctcctcatcaggttcctgtgcaatctgagaaaagccgtccaggaccatccttacaaattcaggatttaaaaggaactaaccgggatcctcgtctgaacaggataagccaacattctcatggaaaagatcagagtcacaggaaagaatttctaatgaacacattaaaccagtctgatactaagacaagtaaaactataccctctgaaaaactaaattcatccaagcaagaaaaaagtaaatcaggtgaaaaaataaccaagaaagaacttgaccaattagattctaaatcgaaatcgaaatcgaaatcaccctcacctttgaaaaacaaattatctcacacaaaagacttgaaaaatcaagaatcggaaagtatgaggttgtctgatatgaacaagagagatccaagattaaaaaaacatcttcaggataagaccgatggcaaagatgatgatgtgaaagagaagagaaaaactgcagaaaaaaaggataaagatgagcacatgaagtcatccgaacacagactggctggaagtagaaataaaatcataaatggcattgtacaaaaacaggatacaataacagaagagtcagaaaaacaggggacaaaaccagggagatcgagtactagaaagcgatcaagatctcgatcacccaagtctaggtcaccaattatacattccccaaagagaagagataggcggtcacccaaacgaaggcaaagaagtatgtctccaacatcgacacctaaagctggaaagattcgccaatctggagctaagcagtcacatatggaagagtttacaccaccttctagggaagacagaaatgctaagagaagtactaaacaggatattcgggatccaaggcgaatgaaaaagactgaagaggagcgaccacaagaaactacaaatcagcattctacaaagtcaggcactgaaccaaaggagaatgtagaaaactggcaaagttccaagtctgccaaaagatggaaatctggttgggaagaaaataaaaggtatgatgttaacattttaagtcaagtgtagtagtgtatatgtttcaaaagatagtgttaatttaaaaattggaaaatgtttattaggtgctattagtactttttttccatctaattcttacatctctgtgggttaaatactattattatttctattttacagataaggaaactgaagtttagaaaggttaactaatctacctaaggctgcagtccaggacatgcaagaatcagaattcatatctgtttttgctgatttcatattttgtgctcttaatcatttatttaattactttttgtggttacatatgcccattttaaccatatcctttgaaaagaatctttaaatatggtcctgagtattttttaaaaaaacatttcaatgtaacatactgcttttatggtttcagcttacaacaggttgatgaacatagtaaacctcctcatctgaggcatagggagagctggtcaagcactaaaggaattttatcacctcgagccccaaagcagcaacagcatcgattaagtgtagatgccaatcttcagattcctaaagagttaactcttgcaagcaaaagagaattacttcaaaaggtagttactatgattaatcccatgtagtcatcattatctatcgtctatttttttggtatttttttatatttaaaatattttatttccttttatcacccctatacagacgagtgaacgtttagcatctggtgaaattacacaggatgacttccttgttgttgtgcatcaaattcgacagctatttcagtatcaagaaggtaaacatagatgcaatgtacgggatagtcctacagaagaaaataaaggtggattaaaaaagaaacctctcttatctgatgctgaattaacctactatgaacataaagcaaaactgaaaaggacacaggttcagcattcatttccaagacttgatctcttagatcctgatatttttgactaccctttgactgatgccttgttgtctggaatagaatgtgagccatccaaaagtaaacatgcaagtaggaatagtggagcacagtttgacagaaaagaacaatttagtgaaagagcaagacgtctttctcctatatctgggagtcgtacttatgctgagaatctttcaccccatgagggccggagaagacatgacgagcaagtctctgctaaaggtagaaaaagttaaatcagattatgcctattgaatcacacagcagtgaagggaaaatgaacaagctaagtggggatggatttttgtgactgttcagattaccattttttttcccatttattttgttatgttttttccctttaaggaaagggaagggaagggagctaatatttctaaggccagttgtgtgtcaggtacttcattaggtattttttatatgtaatttgatttaatcctcacaacaatacaatgaagtgtatattctccctattttacagataggaaataaaagagaggttaaataacttgctctcaaaatgaaataattagtatgttgataggatggtaatttttttgttactcaggtgtgtctgactctagagggcatcctcttatctgctgctttacgctgtcggtctctcctgcccctctaatgtagtgagatagttatatatttggataaacattcatacgaaaatagaagattttaagataactttagtgaaaataatttttttcctttttaaaaggtgtgcgagaagagcagagatctccattcaatgatcgttttccacttaagcgacctcgatatgaagattcagataaaccatttgtagatagtccagcatcaagattcgccggcctggatacaaatcagcgacttacagctttagctgaagacagaccgttatttgatggacctagtaggccatcagtagcaagagatggcccaacgaagatgatttttgaaggacccaataaattaagccctcgaattgatggacctcccacaccagcttctcttcggtttgatgggtcaccaggacaaatggggggaggaggccctttgagatttgaggggccacaaggtcagctaggaggtgggtgtcctttgagatttgaaggtcctccaggaccagtggggacacctctgcggtttgagggcccaattggtcaagcaggaggaggtggttttcggtttgaaggttcccctggtctgaggtttgagggatctccaggtggtttgagatttgagggaccaggaggccagcctgtgggtggtctgaggtttgagggacatcgtggtcaacctgtgggtggtctaaggtttgagggacctcatggtcagcctgtgggtggacttagatttgataatccccgaggtcagcctgtaggtggacttagatttgaggggggtcatggtccatcaggggctgcgattaggtttgatggacctcatggtcagccaggaggtggaatcagatttgagggccctttgctacagcaaggggttggaatgaggtttgagggcccccatggtcagtcagtagctggtctgagatttgagggacaacataatcaacttggtgggaaccttaggtttgagggtccacatggtcagccaggggttggtatcaggtttgaaggccctttagtccaacaaggaggtggaatgaggtttgagggtccttctgtaccaggaggtggcctgagaattgaagggcctctgggtcaaggtggtccaagatttgaaggttgtcatgctttaaggtttgatgggcagccaggtcagccgtcactcttgccaagatttgatggattacatggtcagccaggtcctagatttgaaaggactcctggtcagccaggccctcagaggtttgatggaccacctggacagcaggttcaacccagatttgacggtgtacctcaaagatttgatggtccacaacatcagcaagcatcaaggtttgatattcctcttggtcttcaaggcacaagatttgacaatcatccttcacaaaggcttgaatcagtatctttcaatcagactggtccatataatgatccacctggcaatgcttttaatgccccatcccaaggactacagttccaaagacatgaacaaatatttgattcacctcaaggaccaaattttaatggaccacatggccctggaaaccagagtttctctaatccacttaacagagcttctggacactattttgatgaaaaaaatcttcagagttctcaatttggaaactttggcaatatacctgctccaatgacagtaggaaatattcaggcatctcaacaggtaagtctgttattctaaaattgcgttgtatgcagataagttaaccattttttaatgtttctaggagggttttcaggacatagtttattgtgtagattggaaagaagtttttaatgtactctaaagccacatgctaaggaagtgggatgagcatcttttggggatgaaatttgcaacttaaatccaaaattgattttagctctttcaggatctagggaaatatctcaatcaaacccccacctccagctctgttttttctttttcctttttttttgctttaaagcttttgagatattatacaattgtgtgtcatagacctctacattgcagaactgttgagccctgacgtgctttaaggtagccatagaattgattgaactgttctttgaccaagaatttccttaacctgagttaaataagaagatcaaattgtgtccctgctttcacagtctacaattctttttttttggtccttttttcctactttttaccacctttccagtcacttcagttaaacacaattgtttgatattaatgacaacatagcgaatagccttccaaatacactctggttacgaaacatgcactgttacctgttggtattctttcacacttgttctgtatacattttaaaatgcatactgagacaactttaaggcagtatgtttacaatttgtgattaattcggttggttttgaatgactacttttgcttgcgtgctgaaattctcctaggctgagttttacttcttttccaggtgcagacattttcttactatgacagatttattttatagtagtaagattgcatggaagaaaatacaaaataagaaagattttaaaagtacattaggaacattattgatagaaagtagtccttctgttcatctctaatggtacgaaaaaacagttggcttgcctagatttactctactgtatatccttgaaagaaatgatactcttattgacagatactctagaatggtacttacttagtcttgtttctacattacacagaatcggtggggtttttattatgtgtactcactaccaaaagtccacatgtatactgaacaaggattataaatggatatttattcacataccagcaatatgtagaagtcctgcctccctctggactgcaaatgctgtatttgtatgccagtatagttcttgctccatgactattctgttttttaacattccctttgacatcttttacaagaccttttacaagattactttgtaatgtggctataaccatgtgcaaagatgatggccaagcaagatgcttacctgcttggtaattcagaatgctaattagaacaggcttttgatatctgtggaaaagtggcaagggttaggagttctggcctcagttttgctcctaactagcccttgtgattgtgtatagatcatattgcattatgtcagttcttctatttgtaaaataagggaaagcaccagcaaggtaaagtgacttgtgtaaagtaacacagctagttaccttatatttgcatggtatcttacagtttcctttttggggggctactttgcctctctagtaggtaccttaaacttttcaaagaagttttaacccattctcagtaacttatacctctatgaaacagataagggaaggttttattgttcctgtttgtagaagacctagaagtgaagtgatgcagccaagttatctttctaaatctttatttataagccaggccttgtgacatctatgaatatttttatgtaattaggatgttaaaagttttacttgaaatatagaaagcatgttcttaaaattaaggtttttcttaaaggttctgagtggtgttgctcagccagtagcttttggtcaaggacaacagtttttaccagttcatccacaaaatcctggatttgttcagaatccttcaggtatgtactttctgaactttgtttttcaaaagacaaatgattattgttttgttgaatagctaactttgtgaattttaggaaatgacagttttgcaaaggtatatttaatttagagaaatttaatctggctgacatatttttgttccttttctaagtttatttacattgtggatgtgtattcataatgaccctatttacagctagagatggttagcggggacttgtagtccactaaacaaagggaaggaaacctattgggtggaaactgggagtgggagggaaggtatgacatttgtgttgagatagaatgaaataaatgacagaccttagaaatctcagtgaatactgaggatactgcattaataaagttgattaatttttatgtttttgtgggcactcaaatagcaaaaagcggctttcctagccaggttcactgataagcatctttgttactatggggtgatgcttagtactagataaaaggacttttaaaatggattttagttttatttatttatttatttatgaggcagaatcttgctctcttacccagtctggagtgcagtagtgtcatattgcctcactgcagcctctgcctccggggttcaagcgattctcctgtctcagcctcccaagtagctgggactacaggcgtgtgccaccagactgggctaacttttgtatttttacggggtttcaccatcttggccaggctggtctcgagctcctgacctcaagtgatctgcccacctcagcctcccaaagtgctgagatggcaggtgtgagccaccatgcccggcaaaatgaattttagttttaatatgtggtaatagggaagtacatacattagtgatacttgctttcatttctgaatcattgaaacagctgtttcagaaacatgctttactgtagtattgagttaatcagtttacaataaatttatggagttttccaaaacttctgaagtaattaggaaatcctagccaagctcttttttatacattagtccttaaattgtgtcaagaaattcaatgaatttggaagcttttaagttttaatttctacatggacaattatgactaattaatatttgttattattattattttgttactataatgaaaagagaaggaaagaatttgggatctaaagcccagaagaccagggttggaatctctactatgttactttataaatgcgcaggctttaagcaagtatctcccctgaggttcagttttttccctctgtaaacagcatatgggccgggcatggtggctcacgcctataatcccagcactctgggaggacgaggcaggtggatcacaaggtcaagagatggagaccatcctggccaacatggtgaaacctcgtctctactaaaaatacaaaaattagctgggtgtggtggtgcatgcctgtagtcccagctactcaggagactgaggcaggagaatcgcttgaacccaggaggtggaggttgcagtgagccaagatcaggccactgcacttaggcctggtgacagagtgagactccgtctcagaaaaaaaaccaaaaaccaaaaaaaaaacatgatatggtagtatcagtatttgtctgttttgttgttgtttttttttttttagagaatcaaatgatatagtatatgcaaaagtactttgtaacttgtaacttgtcaagtgctatattaatgtattttcctttagaactcagtttttattgttgagcagaggatttgttatattggggttagtggcatgagatgctctacagaaactacaaattttcttgtttctttctttctttcttttttttttttttttttttttttttttgagacgagtcttgctcttgtcacccaggctggagtgcagtggcatgatctcagctcactgcaacctctgcctcctgaattcaagcagttctcccgggctcagcctccccagtagctgggactacaggcacatgccactacacctggctaatttttgtatttttaatagaggcagagtttcaccatattggtcagggtggcttgaatcctgacctcaggtgatccacctgccttgacctcccaaagtgctgggactacaggtatgagccactgtgcccagccttgttttgcttttacaaccttgggttatatgtgtatgtgtacaggacatagcagtgtcacagaggaaatcataattattccccttgttagggggtattgaatgggacattaggtgtgtcttcattcttcaagttcttcttactcttaaaagatgtgtcaacagttttcagtgtgctatatttagcttctctcaaggttccttctctaatttgaaagtgtaaacatcccttttctagtaggaaatatacccatgttcatttttcagacatatattagtcatctgctgtatgctaggcagtatgctaggatgaatttaataaggttcatccttcaaagacctttatttttatttttaaagttttttttttttttttaaagagggtgctcactatgtagcccaggctggtctcaaacacctgaactcaagcaatcctcccacctcggcctcccaaagtgttgggtttataggcatgagccaccacactcggcctcaaagagctttataatatagaaaggctattgattttttttttttggtttaacaaaaaacacataataatgccaaacacctcagttccttagaaatattaattcatttaacctcatatcaatcttaggtaggaactattattaccctttttacaggcacgggaaactgaggcatagataaggaacttgattatgtcacacaactagaaagtggaatttctggttaaaatccctggagtctggttccacagtttatgctgttggttactagacttggctgccctcagacatctgaatagctaattgtgcatcttaggcatataaatagctaatttaaaggaaagtaaaggttaaactagtgagttaaatgttactgtaattgattattgaagttgatctcttcattcatgtattcagacatttagtttgaacagacattaattagcctacgatatataaggcagtatgataaatgtatacagtggttaagggtagggattatctgtatgtggatgcaaattgaatttctgccattaagaggaatttttagtggttcagaacttttctgtataggtgtagtgagatgcatcatagtgacatacaaatacattaaaatattgttttcttttttttgagatagggtcttcttgctcttttgtccaggctggagtacagtggggtgatcttggctcactgcaacctcctcccagtttcaaacgattctcatgcctcagccttctgagtagctggattacaggcatgggctaccacaaccggctaatttttgtattttttagtagagacggggtttcaccatattggccaggctggtctcaaactcctgacctcaggtgatccacctgcatcaccctcccaaagtgctgggattacaggtgtgagccgctgcacctggcctaaaatattgttttcatagttaaagaatcacaattatggccgggcactgtagctcacacctgtaatcccagcacttttgggaggctaaggcaggcagatcatggagtcaggagatcaggaccatcctggctaacacggtgaaaccccgtctctactaaaaatacaaaaagaaattagctgggtgtggtggcacgcacctgtagtccagctgctctggaggctgaggcaggagaacggtgtgaacccaggaggtggagcttgcagtgagctgagatcgtgcccctgcactccagcctgggcaacagagtgagactctgtctcaaaacaaaaacaaaaacaaaaaaagaatcacaattattagaatagtgcttggaaaaatatgagactggaatgattcctcaccaatgaggattccttatcaagcagaacaagattgttaggcttatcttatttattcaagttattgaagctttagtaaccatgacaccttttcagcaatagcttgagctgctttgcaagggcagtatgctttttagcaaaggtcataggagcaggtatactctgagccatctgattcatctccctgtttcagttttcctgttacgtcagggagcattgaggtcaggagtacttccacttaggcttagtgctaaggggtaataaactatttcatctatataaaactactttttccagtgtacttagaagatgaggaagagagattagaaaggtggaaagttggagatggggtggtgctgcattgcttgggagaagggagcataaagggtcattattttcagtgttgtcagcatttgttttagaatatattctcaactccagtgtggtgattcctcaagcatctagaactagaaatactatttgacccagcaatcccattactgggtatatacccaaaggattataaatcatgcttttataaagacacgtgcacacatatgtttattgtggcactattcacaatagcaaagacttggaaccaacccaaatgtccatcaatgatagactggattaagaaagtgtggcacatatacaccatggagtactttgcagccataaaaaaggatgagttcatgtcctttgcagggacatggatgaagcaggaaaccatcattctaagcaaactatcacaagggcagaaaaacaaacaccgcatgttctcacttgtaggtaggaattgaacaatgggaacacttggacacagggcagggaacatcacacaccaggcacagtcggggggtggggggtctgggggagggatagcattaggagaaatacctaatgtaaatgacgagttgattggtgcagcaaatcaacatggcacatgtatacctatgtaacaaacctgcacgttgtgcacatgtaccctagaacttaaaagtataataaaaaaacaaaaaaaaaagaaggaaaaaagaatatattctcaagtcatgctgacttgtagacctaaatgaaaagataatcttaggggcttttgaaattaaacttattaataaattagattttgtcaaatttactgttggcaggacatcttgaagaaaactttgaaaaatgcttagtataatttgcatctttaagttctacattcacttcaaaagtggttttttttctttctttcttttttttgttaggagccctccctaaggcatatcctgataatcatctcagtcaggtggatgtaaatgaattgttttcaaaattgctaaaaacaggaattctcaaattgtcccaaactgattcagctacaacacgtaagtgtgattttatacttaaatttacacaaagcttcattaagtttttgagatgtatgatgtaatataatgatataagttatgataaaggtccttacaataattgaattcctaggtatagcttttatttttgattttcggtttataatgaaattcttttagatttcctaagattgaactaccttatagtggacatgtgtttcagttaactaacatacctaatgtgcaggctttttaccagtaattgtatgttagattaacttttgaaaaggttttgaatattaatgaaataaatgacttttattatagatgacttttaagaaatcagagttaacatcacatatcaaaataaaaaattgtattaggttccttggccagtaaacttgagatcagaagcactgaatggactaggtggatttctctatttgcttataatactatagtgttcctctgtagagaatacatggagaatggtattaagaaatttgtatgtctcttcttaattgaagaagtaagtgaagtaactgctcagcctccccctgaagaggaggaagatcaaaatgaagatcaagatgttccagatcttactaattttacagttgaagaattgaaacagtatgtaatctaattttctttaagataaagaggcagtgactttaataacactgttatagtggacattgttactattagtgctttccctttccctttatcccttttactgttttaacatttaggaagtctttttttttttttaatgtggtaaaatatacataacatagtctttgggaagcctatttttaaatcgtcttttaaaatatgtctgctgtacaagtacttgggccaaaggccacccccaaaagtcttactctgctgcccaggctggagttcagtggcgtgatcctgactcactgcaacctctgcctcccaggttcaagtgattctcctgggattacaggtgtgcaccaccatacccagctaatttttgtatttttagtagagatggggtttcaccacgttggccaggctagtctcgaactcctaacctccagtgatccacctgccttggcctcccaaagtgctgggattacaggtgtgagccaccacacctggtccctcaaaattttcattttttaatctgtgatacagaaaacttagggagtttaaatattaggtattgataattcatgtattcctgtttagtttcattttctgtgtatcatcattttttctgtattgatattcttaacatttttgaggttcagaaatgagattttcatagttcagcatttacaattaaaaaaaaatcggctgggcgcggtggctcactcctgtaatcccagcactttgtaaggccgaggcaggtggatcacgaggtcaggagatcgagaccatcctggctaacaagaccatcctggctaacatggtgaaaccccgtctctactaaaaatacaaaaaattagccgggcgcagtggcgggtgcctgtagtcccagctactcgggaggctgaggcaggagaatggtgtgaacccgggaggcggagcttgcagtgagccgagataacgccactgcactccagcctgggcgaaagagcgagactgtgtctcaaaaaaaaaaaaaaatctatttttcattttataagtaatgttaattgtggaaaattagaacatactataaataaaatcaagaaaacgtacaactctcactttatggataacaactgttaacatttggtgcatatcttttcataattttctattgtattataaaaaacatttaaagatttttctagtgaataaattcattaatcctgtgagtactttataaaaaataaaatagtgaatgagtttttcactcttaaaatcattttttaaatttgaattagatactataatgtaaaatccttttttttttcaaagtaatactttcacataaaggcttttaataaaagatggcatccctttctccttcacccaacactgtaccctagaggcaatcattttatttttttaacttttcaaactattttttctgccatttacctctttttccttttttttttgagacagagtctcactctgtcacccaggctagagtgcagtggccctgtcttggctcattgcaacctccgcctcccaggttcaagtgattctcctgccgcagcctcctgagtagctaagattataggcacccatcaccacgcccagctaatttttgtatttttagtagagatggggtttcatcatgttgtccaggctgttctcgaactcctgggctcaagtcatctgcccgcctcggccttccaaaatgctgggattacaggtttgagccacctatttcttataatacacataattttctgtttcttgatttaccacatctggacataatctcttaactttctgaaagtgatttaggctgggcgcagtggctcatgcctgtaatcccagcactttgggaggctgaggtgggcagatcacctgaggtcaggagttcaagaccagcttggccaacatggtaacatgtctctactagaacctgtctctactagaaatactaaaattagctgggcgtggtagtgggcacttgtaatcccagctactcgggaggctgaggtggggagaattgcttgaacccaggaggcggaggctttagtgagctgagatcgggccactgcactgcatcctgggtgacagagcgcgagactccgtctccaaaaaaaacgggcggggggtggatttagctagctcttgtagtgtcctactaactcccctccatgtagttataagactgttttttattattcagtattaatattgtgactagatgtttattttgttgctgtaacaaagtaccagtgttctgttatttgctttattctatttttttttttttttttttgagatggagtctcactctgtggcccaggctggagtgcagtggcgtgatcttggctcactgcatcctccgcctcccgattcaagtgattctcctgcctcagcctcctaagtagctgggattacaggcatgtgccaccacacccagctaatttttgtatttttagtagggacagggtttcaccacgttggtcaggttggtcttgagctcctgacctcgtgatctgcccaccttggcctcccaaagtgctgggattacaggcgtgagccgctgtgcccggctattttttttttttttcttggagttaataactgctctgtttgttcacttacttggtcttctatatatacctgtttcttcccaaatagggagcccagaatttaaaaaactaattatttgttgaccacagcaaactaattattgtttcccaatggtattctaagttttctctttagttatccatactattattatttcttctgtccttttttcactgttacaccagagtggagaagttgaattattcagaatgccaaagatctagagaggtgaaatttaactgttctgccatgtccatcttgacttgactccaaactaaaataagctaactattgccttgttagctagcacaggatcatttcatttttagctaaaaggaaataaataactgggtcagggctatcaataagaagacaggctccatcttccaaaagtcaccaaagttaaggtaaagagggtcaatcacattgttagagaataatactgatctttgggtattaactgtttcagccagctcttggtttcaccattgttacagtatggaaaattgaaatatttgtaattggcttttaaaggccattaagccatattatcaacactaaagattatttctttttcaaaatagacgttatgacagtgttataaatcgactgtacactggtattcagtgttactcttgtggaatgaggtttacaacatcacagacagatgtttatgcagatcatttggactggcattatcggcaaaatagaactgaaaaggatgttagccgaaaagtcactcatagacgttggtactacagtttaacagtaagtaacccatgtgcctccatagtatcttttaggcttaaattatatcattctaaaagtatattaattttaataattattaaaatttaattttaattaagtaatttaataattttaataactgctggaatctaacattgaaatttcctgaataaaatttgacccctagaatataaacagattttttaaaaaatgaattttgaagagtatttttttttttaaattaagattagagtatagcatacaggcttgttctagctctaaaagtccaaggctttgacccctggaatataaacacattttttaaaaaatgaattttgaagggaatttttttttttttaattaagattagagtgtagcctacaggcttgttctagctctaaaattcccaggctctaggactgttttttgtaaaaaaaaaaatatacttgaagcttgtcttttttgaattagtagttgtaactatagagttaatggaaaagatcttaattattagtttcatgttgtcattagttatatgtttcaaagtataattttaaataatattagagcataatgtagaaaatagtatacccctacctttaaatggcattatattgaagatacacagtaaaaatttagaaataaatggaataatcttttaaaaatcaactccttttaaggactggatagaatttgaggagatagctgatctggaagaacgggcaaagagccagttttttgaaaaggtgcatgaagaagttgtgctcaaaactcaagaggctgctaaagaaaaagagttccaaagtgtacctgctggaccagctggagcagttgaggtgagagaagaacgtttaagttttctcacagtgggagtgtccctcacttcctttatgtaaatactcataaacacatcactatatttatatccctgttttaatgattttaagacttcttgaaagctctactcttcaattttactcttacaatctagctttgagtttcataactacagtggccaaaagcagtgaaatgtttactctttttactggaaagattgacagaatcccataaatgtattttgaatcatactgtatattggacattattcaaacttttggaacactcataaattctttactccacttaacagtgtttgtatatttttacttaatggggttaaatatggtctattatgtaaatttcattttatatgattctattttagagttgtgaaatctgtcaagaacaatttgaacaatactgggatgaagaagaggaggaatggcatttgaaaaatgctattagagtagatggaaaggtaattttcatttctttataaggaagtgttaagattagtgtttttttgttgggttaacacattactttgaaaggaggcggttcataatagtttttgtttgatttttggtcttaataaaaagggtattggactttagtaatagaatgtttgaattagaagggatcttagcagtcacccggttctgtacactttacacaggaggttgcactattagtcagtgacagacccaggactaggtcttctgaatctagttagtcgtttttctgtcgacccacactattttgattgtggatttatatttcatcatcaaactatactgtgctgaaaacaaagcaagttaggctagatacttaaatgggccaagagaagtcagtttttcagactctttaagcataaggatgaaaatttggttttatccattttgggaccaaataatttttgtcttctttccaaagactatcttctggcttaaagttaaaaagaaatatcagaatagcccattagaaatgaatacgcacatatttactttttttctttttgcttcagatttatcatccatcatgttatgaagattatcaaaatgtaagttctttttggttactgtatttgttctcatttgcattaataaattttacttttcagttttttttttgcatcagagcaatattgttattttaaacttaatatattgaactgtttttgttttttgatatagcatttaggttgttcagtaaaaactggtgccagattgacagaattgacatatatgaatatcattttctgtgataacgcaaacaattaaaattttgaaatttatcattccttgcattttattcacttgaatcatggtatcttttactagtccactaggcccaaagaaatgtgaggaaaagtgaagataaggatcctgatggggatacgtttctagagctatgggtagcatttactgctatttttttttcttacatctctattcagccatctaaataggtatattctttttgttgttttgttctgagacaaagtttcgctcttgttgcccaggctggagtgcaatggcgcaatctcggctcactgcaacctccacctcctgggttcaagggattctcctgcccctgcttcccaagtagctgggattacaggcgtgcaccaccacacctggctaattttgtatttttagtagagacagggtttcaccacattggtcaggctggtcttgaactcctgacctcaagtgatccacccaccttggcctcccaaagtgctaggattataggcgtgagccaccgtgctcggccaaaataggtatactttttaatgatcacatacggaatctaaaaatgataccagtcgttgaccttaaaagttcaaatggtcggctgggcgtggtggctcatgcctgtaatcccagcacttttgggaggccgaggcgagtggatcacctgaggtcaggagttcgagaacagcctggccaacatggtgaaaccctgtctctactaaaaatacaaaaattagccaggcatggtggcgggtgcctatagttccacctgattgtgaggctgaggcaggagaattgtttgaatccaggaggtggaggttgcagtgagctgagttcatgccactgcactgcaacctgtgcgacaagagtgagctctgtctcaaaaaaaaaaaaaaaaaaaaaagttcaaatggtcatatttgtagtctgtttttaaaatcaagtaatggaataaataggtttttagagataatgggttggaggcaatttggaaggtttatttaggttgtcagaagactagtgttgagggtgatggtttgtggggatttaaaaaatcctcagactatttgaaattagggtagtaacaagtcccaggatatatgtatgagtttaacatctatgtagagattaaaatgtagaagcatgtctaatcaactttttttggctgtataatgtcctataacttagctgttaactgcttaactcactgctgagtacatattgaacgtgcaatatatattttatttctggttgtctttatggcacattttgttgggaggcaggtgtttcatttgcatttggttgtatgtgtgttctcttgttcatacaagggtcttacaagactaaatgttatttaatgtgagaattttgaactttcatcagtactcatagggcctttcattttgtagacatcttcatttgattgtacaccatctcccagcaagacaccagttgaaaaccccttgaatattatgttgaacattgtcaaaaacgaattgcaggaaccctgtgacagtcccaaagttaaggaagaacgaattgatacaccaccagcttgtacagaggaaagcatagcaacaccctctgaaattaaaacagaaaatgacacagtcgagtcagtttaaataaaatgagaaaggtatgtttttcttttttaaaaaagctgctgttggatctagaaggtgaagaatttttttatgtatatatagacatatctatataaattgtctggctgaggcagggccttcagctatcatttggttaataaatacattttagtatttgcatttcctactgcctgcagagtttcaggtgcttgttgtgtgaaagttctgtagatgtgtgcaaatttaacgaaatgaaattgtatgtgtaaaaatgtacgatttttcactgtgcaactgtaaattataaataaaaaatatttttgctattcatggagtgtaatatttatgcacaccatcaaatagtttctgtactttttattgggtaaaaatggaattgaacagcaacctcaacataagattttttttctagtagcctcccactgattaaagaagcaagtttgaggtttcatccttcaaaagggggttccgagagagcaccgtagggcttttctcaaatagaaaagccagattttgaaaaaattttaaagataaaataggacatattttgcagatatatatatatatatacacaaacacatctccaggtatagagaaccatccagatgttcacttttgaaaatatctaatgatgcaaagttttattcttgaacttggacactgatgccatcaaacaattaacaaatatatttaagtactaaaggtgattttttttttaaagactttttcaaattgtcaaatgatttaatgcagatgaacatatttctattttaagtaacgggaatctgtaagaatgtttgcttgagatatggttaacttttttcttttgttggttttgacttagatggacaccatgagatgttaatattcatacatgtaataaatagaatgatgaagaaa

SEQ ID NO: 31 - DNA, 71470 bp, Homo sapiens
atggctttggtcacggtccagcggtcacctacccccagcaccacctccagcccctgcgcctcggtgagtccttcctggcggccgctccgcttgcttctgtcactgcggctccgctttgcctcagcgggtcccgccgaacgccactgcgcacgcgccgcgccgcttcccaggccttggcactcggctgccgcgaacccccccacacccccatgttaaagactagcagcaggaactacaagacgttgatttttgcccccatcaccctgagcacctagctcctcacaatcctcgccctgaaatcccctgtggcatgcctccctatggcttgagcacttccttttggtaatgagtcattcttgcttttcaccctcccccttcttttaccctctgttgctctgctgcagggaggggaccgtgagcctcctgcgttgccccttacccacacccacatctcttacccacaccatttcatagacctgttcagtatttgcacactgcacacccttcttcgtactcgccagggtgtgtgccttcccctagtcacttgctggctttcttttgctctgtactgttcaggctttgaactgcccaaccgtagttattccttggtttctcccgcctgccccccaccccagagggtagcaatgatctctgtttcctggacctcttacctttcctttatgaggtcccgaagcatctggtgctgcttagtgatcagtgtcaaattatttccgtcttacagatatttatgccttacactcattgctcgtgatcattcttgttctaaggtcgtgtttgtatggctcgttacctcagatgcctatgccaataaagcatgctctcagaaggaaaatacccagtaaccagcctttccccgctgggcccgtctttgccttctctcctcgccccacccccattcgtttacactccattctcttaggctccatttttgaaaatatttatttttaaaaacaatatattgcaccagtggggcaaatgggctttaaaaaaccaacatccagatgttttagagagaaataaactgagtgaaaatgcgagcaactgggaaaaccaccttgaacttcctacagaactgtaattttaaaaacggtgttggtggatttggtagtatcaggttgcaaaaaaaggtatttaataaacactgtaccactttccactgtaaaaaaatcatcaggttacccttaatatttgtatgttaactgaggtgtgagctttgatatcctgaaatttgctggcttgtcatttcagtataatttcctgaatttcaaagttttgttgtgtatggttgtggtttcttcttttctgagctttaattgcattttgtgtgatgaaattgacaactatatcttaataagtgattttatttcaaaggttatatatcttgtgttgtttcagagagcagaactgggattcttggttcagggaggcagatttccagtgattgtaaggaagaatttgtaacagtggagtgcactgccttgcaaaatagtgagtgcacattgctggaaatattcaagcaaaggctggagaacattttgcctgggaggtggtataaagaattcctgcagtgggggacttctaagactatttctaatctaagattttgtgatttgagaatacttgtacttcaaagctggtaaaacattttagggtcatctgaagacaagtatcataggaataaatctttaatataatttattcttatgtgtagtactttatgctagtttttggaaagtcattaacataccatcaaaccttcttaattcactccactagtaaactctttggtttgtggttactaggcctgattttgaagaaatcgattgaaagttagtagagtcatgcaaataaactagaaatcagtactatagtaacatttattttccttgggcactgttgaaaatagcttatgctatgataatatatgtatatcaagttgtcatcatactaatttacttgaagtgaatgattagtatacagtaagaccgtgtacacttgatatgacttcattagccaaaacttgagttactttagaatcttgaggtatgttaatagtcacttttgacataggtaattaaattgatcatgtaataagctcagttgttgagcaaaatcactaatatttctatatctactagcctggttatttcagttgtttatacttggccctgaatgcaaaggaatcctaaggctggtgtaacaatcagcatcattagtataactgataagccagcttcctttctctttaaattgtcttcctattggacttcatccagaattgtgttcagctgagttgtttcgaggtccttgtactctagcatttggctgctgtctgacctccatatattttgctgttctatctcttgctgtatgaataggttgggttgtttgttttaaaatagagagcaaaaagaacctagaggaccatgaaagaagagatttaattttgtgagactggaaatttacatttttttattaatcactttaagtacgctgttaatacttttacactataggatgcagggcattttaatactgccagctctttagtgttgtttcattaggcattaaacaatatgctaggtgtgagtgaccattgtagatactaagatgtataggaaattgacctgttcatcaggatcttgcaatctggggggctggggcattggaggaagaacaaacataaggtaagagggaaaagaagaagaaggggaatgatactgtaggtacctgaagagtttgtgatggtcataagtattgtctgaattcagattaagataagttcactaatggcaatgttaataataagagtataacaatatctaacatttcttgggtcctcatctatgccaggcatcatgttaagcgctttacatgaattaattcatttactttacacagtatgccttagggaagttgctcttatccccatcttaaagatgaagctgaggcagagttattaaggaatatgcgcagtgtcattcagccagtaagtgactggagttataattcaaacccagatgtgtctaactttagaatctgccatcttttcctccttggtgatcaaaaagtatgcctaataggtggctctcgaactagttcttgaaggatggattgaatttctataggccaagagacaagctgtgaagaagagagtattgcaagtgaagagaaattgtgtacaccaaaacttagaggcagaaaagtacagggcatatctgaaggaattaaatagaccagtttgaggaaggatttgtatgggacagtagtaagagataaaggcgaggaggcagctagggctgcacagggactactgagcttgggagtttggagtttgaacttgatggagaaggtagtggagagtctgctgaggttttgagtagaaatgatcacagtggtattttaagattttttttttttttttttgagacaaggtctcactcagccattcaggctggagtgcagcagcacaatctcggctcactgcaacctccacctcttgggctcaagtgatcctcgcacctcagcttccccagtagctgggactacgggcacgcaccatcacacctggctaatttttgtattttgtattttttttttttttgtagagatggggtttcgccatgttgccctggctggtctcaaactcctgggctcaagccgtctgcccaccttggcctcccaaagtgctgggattacaggcatgagccaccacacctggcctattttaagaaaattgatctagtagatatgagccagagggctttgagaaagagagagaggccatgagtggagccagtgagaggctgttctagaagcccaggtgtgaggtaataaatgcccaaactgggattttgaagtggtaaaggaaagaaagagacagatgtgaggggttgtggaaaatacttgggaactgattagatttgcagggagggatcagagatgccaactcttaggatagatattgttcttcctagataatagatgtttcctgattattagagggcaatataagaattatctctgtctcttttgattctttctggtataaattttctttttttaaacttttttattttaaaaaatgtattaacttttaatggacaaaacatttataatatacaacatgatgctttgatatatgtgtacattatggaataattaagtcaggctaattaacatctatcacttcacctagttagctttttttgtggtgaaaacatttaaaatgtactcacagcaattttctttctttcctttatttttttttttttagatggggtctcactgtagcacaggctggagtgcagtggcacagtcatagctcactgcagcctcaagttcgtgggctcaagtgatcctcctgcctcagccccctgagtatctgggactgcccagctaattttaattttttttctttgtagagatggggacttgcttggggtcttgctgcccaggctggtcttgaactcgtggcgtcaagggatcctcctgtctcagcctcctaaagaattgggattatagtcatgagccactgtgaccggctacaattttcaagtctacaatatattattattgactgtagaaaccatattgtacaatagctcttcataacttactcctcctgtctaatggaaactttgtaccctttgaccatcatctcctccccattctcccaccaatccccaatctggtgtgaattttctgaattgatacctatattgatccagggttaaataaacaaagtataatactataataatattttagttttctgtagtgccctatacttttcagagtggtttttggggtgtgtgtgtttgtgatctaatttaattctcaagtagccccaaaaattatgcaggacaggtaccacagtttaaagacttggctgaaagtgacaaaacttgtgggtgtaataactgcatagaagtaagttccttggctcctggtttatatctctttccatgatgtgataagagaaacagcatatgcggtttctgttccagagacttgactgccagttgagtaaaggtgcaagatatgaggcacaatcaagaactcacactctctttggagatcatttatattgcaaccttgactacctagaacagaatcatctaagtttgtgcaaaccattttaggtgacagctttgtttgaagcctattaactcttactttatacataaatcttataaatgtggatattaagtttccttattcttagattaccaaaagcaacataataatggaaaattacaggtgctgctaaaggcaggttccctatagtgctgggaaaggatagctgttggtttcaccacaagggaaaaggaaaaaaaaaacccacaagtacctggcataataaaaaaattgagcaattcttgcctaattaatatagggacagatagccctctaggacccagtagttcctgagagctactattatacgttcctaatgatgattctgaatcatcataagaaggcttactcttgttttaaatcttgatttaagcgatcaggattgagtgtggtatatttttagatagatgtccatctaagtttcaccaaagttttgacatttaagatgcacgttctaattaatgggtaaatcaatttacatatacattttatttcttgatgctgaatgaatattattgagttatatgtacatatggattaaatatagcacacttctctgcctagcttgagaaaataaagccaaggcaaatacaaaattgatttctattaagtataaacacaagtgatgcttttccttatttaggcaccagtgacagagaaaaaaaaagtgatgcctttgaattttttgaagacagctttagaaattttcataaactctagaaatgactattgtaggaaatccagaaatacagagaagtacagaaaagataaaaaaagacatgtgccatttattttataaagctgaagtgctgctgtatatataatttcatatctttgtttttttagaagtttggtgtctatcacagatgtattgccatatcatttaaatcactgcattcagtagtctttgtttgtttgttttggtttggttttttgagacagagtctcagtctgttgcccagactggagtgtagtggcatgatctcagctcactgcaacctccgcctcctgggttcaagcgattctgccttctcagcctcccaagtagctgggactacagacgtgcaccaccacgcctggctgaagttacaggcttacaggtgtgagccaccgcacccggctccattcagtagttttaactcattctaacctttccattccattatcggttggcattcagtttttttccaacccccctgcccccggattttttttttttttgaggcaggatctcactctgttgcccaggctggagtgtagtggtgcaatcacagctcactgaagccttgacctcctgggctcaagtgatccttccatctcagccccaccaaaaagctgggaccatagatatgcaccaccatgcccagctaaatattttatattttggagaaatggggtctcatcctgttgcccagactggtcttgaactcctgggctcaagcaatcctctcacgacagcctcccaaaatgctgggattacagatgtgagtcaccacacccagcccttttttttctattataaattacattacaatgaacatcattggctataaatatttgactcagtttggaacatttattaagatttcaagaaattcaattactagattatagggtataaacaattttaaggccagccacggtggctcacacctgtaatcccagcactttgggaggccaaggtgggcggatcacaaggtcaggagtttgagaccagcctggccaacatggtgaaaccctgtcgctactaaaaatacaaaaaattagctgggtgtggcggtacatgcctgtcgttccagctacttgggaggctgaggcaggagaattgcttgaacccaggaggcagaggttgcagtgagccaagattgtgccactgcactccagcctgggtaacagagcatgactccgtcaaaaaaacccaatttttttaaagacttctgttatatatattttctagaaaagttactccaattaatgtttattccagctagcatagtataagaatgctcatttttcctaactgtatttacactggatattctcatttcattttcatttttgaattggtgtcttgttatttcccaggctagccttgaactccttggctcaagcaatcctcccacttcagccttctgattagctgggattataagcacacaccaatgtgtccagcctcatttcatttttattttaatcactactaattttttaggataaagggtagtacctagttggtttgatttgtattttattgttaggtcacgtatttttcaaatgcttattaggcatttacattaaagtttttgaaaagatatattttttgaggtataatctacaaactctgaaatgtacctgttttaataagtatacaatccaattatttttaattaatttacagagttgtgcaacactcacttcaatcgtatttcctttttatgagctattcttttcagtttgtgtaccctcgatgtattacaaatattaactattatatttgttacaaactatttgctttttaattcagtttgtattattcttagaataaagtctataatttgaattgctagtgagaccttaaatgatccagccttgcttacctcttcagccctgtctcttcccaagtccctgccttgcacactgctcacagttaagctgacatgcccatgctccctttggtctttaggcttttgcacatgctgtttcctttacctggaacacttttccctcatctctctacctaactatttcctactcatccttcaggtctcagcttaaatgtcacttcttctgggaagcttccctgactccaccccctcagatcatggtaggtgctccttctacgcacagcatagcaccctatacttacccatggtggctcttatctttctactgtacttgttttattacttatctcccccactaacctataagtcagggactgggtcatttacatatttttgtattatcagagctcaaaagtatttgacgcatggggctgggcgcggtggctcactactgtaatcccagcactttgggaggttgaggcaggcagatcacctgaggtcgggagtttgagaccagcctactaaatatacaaaaattagccagatgcggtggtggatgcctgtaatcccagctactcctactgaggcaggagaatcgcttgaacccgggaggcagaggttgcagtgagccaagacctcgccatagcactccagcctgggcaataagaatgaaactccctcttaaaaaaaaaaagtatttgacacatggatcaatggatgatcaacagatatagtcatatttagcaatcttctattttgagttcttctactgtttttaagcatagacagatatcttgagaagcccaaaggatatgatcacttttaagacttttgatacatgttgccaaattatccagcagaaaggttgaatcaatctttgtttacaagcattgtataaaaatgtttaagtgtagtctcacagccttaagtagcatcatcatcatagggatatttattgaacacttactgtatactagacactgtgttgagtaccttttgtgcctcatgttgcttaattttcacatcactcctgtggcgtaagcattgttattctcttgattttaccaagaaaatacagactcagataagtgaagtgaattgtccaggattataggcctggtgtctgacctcacaaccccttctcttaatcactagtattttattgttgttttaatttacatttttaaaaattagaggctaaacattttttcaaatatttactattatatgttttattatatattccttgttttgtaaatcgttcatgttctttgcccagctttcttcatggctatttactttttcatattgatgtgtaagtattctttatatactaagaatattaacctttttctgttatgttgcaaattttcctctggtttttcatttgccattttgttttgtttatttcattcatttgtatatacagacatttacaaaattttaatgccatcaatccagtcttgtgtgtgggtttttaaaattatttttcttagttcacttttccgtcaataaggatagaaatattctacttattgaaaaaatttagacctatatgttttaaagctatttatagtattatttttatatcttttaattgtctgaaattaattttactacatgatgtgaagtaaggattatgtttattttattccaaatagcagcttttcttagttcattatatgaaacagtcactccttttttccaatggtgtggaactcctccttgggaagtactaaattcccaaatacttaattcaggtataaggtgttccatagaagttccattgcaagtctcataggaatttagttagtttagcatatattacttagtatttattaaattgcatgcatagaaaataaactttaaactagcttacattttgaattttcactcaagtacctgggaagcccagaaaaagagaaggcctttggtcctcaaaaagtatcttcaggtttctcatctttcctatccggctttaagtgagagggagcagtttctagattatgctcacgctgaaaaagacactgtgcagcactgccttcctaggtttcaccattaaatatcactcctgatagctgggcgcggtggctcatgcctgtaatcccagcactttgggaggctgaggtgggcagataaggtcggcagttcgagaccagcctgaccaacatggagaaaccctgtctctactaacaatacaaaattagctgagtgtggtggcgcatgcctgtaatcccagctactcgggaggctgaggcagaatggtttgaacctgggaggcggaggttgtggtgagctgagatcacgccattgcactccagcctgggcaacaagagggaaactccgtctcagaaaataaataaataaataaatcactcctggtttcagcagcttaagatttactgtttttccattaaatgcctgctgtagtgttgtctgcagcagtgcctagccttttgaagctattcacatgtccatgttttatgtttatttgttaatccattaaaaaaaaaaaacacctagctgtagtttttccattcagtaaacctagtagtagggaaagtatttccaattaaaaaaaaaaaaagtgtaattcttgatgagcccctttgcccaacctgaaatatgccagaggctggatgtacatgagtaaaaccttaagaatcttgttaatcagaagtatttagtgagtgctattttgtgcaggtgatctcatacattcccttcctttgtttctcagcactgagttctcttcagatacctttataaactaccctgcattttcttgcccatctgagcagcaaagctactgatcacagtgcccctcattttcctctcaaggtaaagtctggtgaggtactcgtggctctgaaatgtaatgaaaggtcccatggttccctagacttcctgaaagatagagggaagtacttcatttattgagtgggaaaggatgtgcttagaaacagatggggagagataatactctgttccagcttagtttttatggaactgtttgatttaattttctgaaaaacttatttagtaccttttttgtgtctgagacatatttatttacttactcatttataccactgctgggaatccagcagccagttagtctctaacctcaggaagcttacagtagaagtagaaagattgatattaaataggtcagtagattacagtgtagttgtcacaaatacataagccttgagaaagaggaagaaggccagcaaggacttataacttgagccttgaagagtgagtgggaattggtcagcaaacagagggttaggggtgagtggcaggagggaaagcagcattctttttttttttttatttgagacggtctcgttctgtcgctcaggctggagtgcagtggcacgatcttggctcactgcaacctccgcctcccgggttcaagtgattcttctgcctcagcctcccgagtagctgggactacaggcacaggccaccacacctggctaatttttgtatttttagtagagatagggtttcgccatgttggccaagctggtcttgaactcctgacctcaagtgatctgcccacctcagcctcccaaagtgttgggattacaggcgtgagccacagtgcccagtcaaaagaaacattattaagcaagaacttaaggcacagggctacaaatagcatgatatatgctgggaaccacaggcagtacagtgctgatgccatgtaaagtgcagaaaataaggctggagaagtaaagataatttcttctgaattttaacatctgcacccttatttttaccttgaatacagttggcttttctttaaagtgactgtgcaaatttgtgattgtagacactgggttcagcactaaataggcatcacaataaccattggaagtagtactattattgttctcaatttacagatgaagaaactgagtctcagggaggtgtctagactcccccagctagaaatggcagagctgggatttgaactttgtcagagtcagaaagcaactactaaattccacccccctgcccttaggtgttaccttctcagtgtcaatcaaagtactgtttgattgattgattgattatttgagacaggatctccatctgtcacccagcctggaatgcagtggtacaaacacagctcactccagcctcaacctcctgggctcaagtgggattcttctgcctcagcctcctatgtacctgggatcacagatgctcacgccaccatgcccagctaattttttttattttttgtagagatggggatctcactttgttgcctaggctggtctcaaactcatgggctcaagcagtcctcccacctcagcctcccaaagtgccgggattacaggcatgagccatatgcacctggcctgatttagtctatttttaaaatttatttatttatttatttttgagatggaatcttgctctgtcgcccaggctggagtgcagtggcgcaatctcggctcactgcaacctccgcttcctgagttcaagtgattcttctgcctcagcctcccgagtagctggtattacaggcatccgccaccatgccttgctaattttttgtatttttcagtagagatggggtttcaccatgttagccaggatgggatttattctattttttaatcatttagttttagatttgccctgccatagtttgaatcattgcaatttgtgtcattttgctgctcctgccttagtacttgatatgaaggcagttcagcagaagtttgttgagagccttctcaaacactgagggatgatataaggcattacctttgccttcaaatttacaagactggtggggaaggcagctataaactaagcatgtttaattgcctcgtatggtgagcagtgggaaaggcacaaaccaaatgtgtacatgtgaagaaaacatcagttccaaaggggataatggtcagggaatttggaaaaaactaaattggaaaagatggaagagcaaaatatctttgcagttagcaaaatgagataaattttttccttctagatattaattcctttcagtttcatttataattagaagccagtttttttttctactgaatgattattataagatactgttatctaagacatggcagccagatttgaaacttctatgtttggaaagtgtgtgtttgtgggtatttgcccctcacctattctttgctctcccacctctgtacttttcctcacttaaagaaaaagggaaaaacctgacaaaccctttttttttttttttactgctacagacagatcaggaaatgtaagaaattatatttattgaagttaaagaagacacctccatgcagcttgctgattggagcagtgattctcctattgttccatcagacacaaatagaaacagtaggaatttgagatagccttttcttcataattacaatatttagcacatctcaggcaagtattaggataaaccacgtgttagcatcttgtagtacattatcttaatctattaaggaagctcattgattctttggagtttgataaagtgattgtgatttagaataaaaatgttacctgccagttatcctaacataaaccttatgagggtggagaagccctaaaagtatttttatttctctccttaggacttcaaaaatacctataacattagctgggcatggtggtgcacgcctgttatcccagctactctggaggctgaggcacgagtatcacttgagcctgggaggccaaggttgcagtgagtcacgccactgcactccagcctgggtgacagagcaagactctgtctcaaaaaaaaaaaaaaagaaagaaaaaaaaaatctttaacaacatgatgcagtggcagtacagggtctggaaaactgtctgcttaaatttgaatcctgagtttataatttgctagacttagacaagtcacttaactgctctatgctttggtttgcccacctgtaaaataggggcaatatggtacttctttcacaaaaatattgttagtgttaagccagggagtgcattagcaccatgcctggcaccaaataaacatgtattcacaaagtattagtcatttttataatgatggtgatttagggttgctatttggttattaagcaattttttcattataacaaatttggtggggaagttattttttttatgacaatgtaattcacatggaaagcctatttcagagtttaatttctctttatcgctttttaaatttttgttatttcatgagaacacttggacacagaaaggggaacatcacacactggggcatgttgtggggtggggggaggggggagggatagcattaggagatatacctaatgtaaatgacgagttaatgggtgcagcacaccaacatggcacatgtatacatatgtaacaaacctgcacattgtgcacatgtaccctagaacttaaagtataataaaaatatatatataaaaaatttaaaaaaataaatttttgttatttcataatggcttcatttttttttaattagagaatctttgttttagttgccaatttccacagcaaagtcttttgtgtttgattttgtgatgaccctggagcaccatacagaatgattaatccaactgtaatctttaaaattcttcttcccttgaaagtttatcaatttaataggctatgcttagcagcatattaatccattgactgtttttcaatatagtgggacagatcgttgcaagtggtcactttagtttgtatagtcaaatcatagaatgaatgtgttggtatttttagtgattgagactataaatcatgtggcaaaatagaaattgccagattttttttaaaatatggagatccaaagacactgagtgtattcatgggtttaaatatatctttgtaaagggaaacaataggtgagaagaatgatctgtctaatccagctattacgagcagttggcagttgaaattgaatgctgctcttagatgcatttccaaagcaactgaatgtgctttttctataagtgtctgaagcaacaataggagaacatgtgaatgaactcacatataatataacaagagatctttggttcaagctttggttgctttaagattacagtttttattgaatcctatcaaaaaatagaaacaacctatttcttctttgagtactgaaaaaaatgacactgagttttctgtgaacataatatgctaatttgtcttcttgacctgtctatacaaactgaaactttcacaactctgagcatttttatgctgattccatggttttctattaaattttaaaggaaactgtattgactgtaaaggaagtttggttaggtaaaacagatcatttgtaactgtttatggttgcaaatatatatttgtcaaatatatatttctctcgtgttattttatgagaagttgtatacagtacaccttagattgaaagtggcatgaccatcttggtaatggtaatgaagtcatgtgtaatgaagtatatttgaagatagaactgttgtttgttgttatctacagctaccattaaagctattaaaattctttttagatagagatgcaatgaacttttacattggacatttgcatcctcatttaatgctcattgggcacagttgaatgattttaaaataattggctcttcatttaaattattaatgtttgtttgaagaactgacaagaaatactctttggggttttttgtttgttttttttttttttttcagacagggtctctctctgtcacccaggctggagtgcagtggtatgatcatagctcacctcaaccccctgggctcaagccatcctaccacctcagcctgccaaatagctgggactacaggtgcgtaccaccacacctgcctactttttttattattatttttttagagacatggtctcgctgtgttgcccaggttggtctcaaactcctggcttaagcaattctcctgccttgtactcccaaagtgttgggattacaggtgtgagccaccacacctggccagaaatagtcttttggcagtcgagataggtgtgtcatttcttgaaactgcttgtagtgaaagtcaagcagtttatcctaaatgacagtctccttgaaatgtctcagaacatcacctcaactgtgacttgtaaggtctgctttgtatataagatataagatatacacttgtaagatagctttggatacaggaatcctaaacccttcactaggactgtgcagtggtggtacaagcttactttgctactgagactaccaaatgacaaccttattttcttgcttgggggattttagatgctgtggttttatattgccttgccacttctatgtaagaaatataggaagctggccgggagcggtggctcatgcctgtaattccagcactttgggaggctgaggcgggcggatcacctgaggtcgggagttcaagaccagcctgaccaacgtggagaaatcccgtctctactaaaaatacaaaattaggccggcgtggtggtgcttgcctgtaatcccagctactcaggaggctgaggcaggagaatcacttgaacccaggaggcagaggttgcggtgagccgagattgcgccattgtactccagcctgggcaataggaatgaaactccgtctcaaaaaaaaaagaaaaaagaaagaaatataggaagcttcttggactctttattattggaatcttgggatttattcataaatattgcttcctaggggttcacagaatttcataactggaaaattgactactttaattgcccattttactgttaaataattgccagagtttggctccaagaataaaggtcagaacagcttacctcttgggcagtttcaggagagcttttgctagtgtaaaagccctttactacatctttagtagaaattggatatatatatatatatatatatatatatatatatatttttttttttttttttttttttttttttttgagatggcgtctcgctctgtcgcccaggctggagtgcagtgccgtgatcttggctcactgcaacctccacctcccaggttcaagcgattgtcgtgcctcagcctcccaagtggctgggattacagatgtgtgccaccacacccggctaatttttgtatttttagtagagatggattttcatcatgttggccaggctggtctcaaactcccgaccttaggtgatccgtctgcctcagcctcccaaagtgctgggattacaggcctgagccactgtgcctggctggagatttttttttaatgctaggtgttcaggtggccacttgggttctagaccagacttagattgagatataggaagttgtacatttaagtgtggctataagatttggcagatgacatacattagtgaagctggccaaataggatctgtggtaagtaggagactatgagctctgtcttcagaggctgccagtgtgactctgtgtagacccagtattgccagaaaagtcttatatctcgagaaacattagtaattagcagattatatgaaatcttttgatattttttggtgggaggggtggactttagagacaggatctcactctgtctcccaggctggggtgtagtggcaagatcgtagctcactacagccttcaactcctgggctcaagcaatctgcccaccttagcctcctgagtagtagttaggactatagttgcataccatcatacccagctattttttcttagtttttgtagagatgaggtctcactatattgtccagggtggtctcaaactcctggcttcaagccattctcccacctcaggctctcgaagtgctgaaattacaggtgtgagccactctgcctgtctgaaatcctctgatttttaaatgttggcaactgaattggctggaaattattttgattgtaagtaacagaagaccaaatttaaacagtaggaatatggtttatctaacaataaatttgaagatacatatagtctaggactaacttagctcagcaataccataaagatctaagttgtttatatcttcctgttttgccattaatagtgtatttgattcccatctttctgcttttttccacataaaagatggctattgtagctctggcagtacatccatatttgttgcagaaaggggtaaaaggtacagtgccagcagtggctgtaccattcattaggaagcaaaaattttcccagaaaccaactgctcattcccagtagctttctctttaagtctcctaccagaactaggttacatggcctactctagttgcaatagagcctgggaaagtaagtatatggctttccattttaatcattgagtgacagcaagggataagaatgtttggaatagctattgtcacactttgtataacaactaatacagatttaaagaactatatcttgaaggctaaacagaacatatctgaggcccagatttaactagtgagtcaccaatgtgtagacactataaacaatatattttccttccatttcattactctactactgattcttagcttctatcagtcattttattatatggccaaggaagttgaaattagaaagcttgagtttaagtcctggtatagagacttgttagcagtgttttttgggggtaagtttgcttgatctttctgagcctcccatttcttatctggaaaattgatatataacattgcaatatagcatagtaattaagtgcagaggttttggaatcagaacaacctaagttggaatcctgtctctgccaagcaagttgcataacctctcttggtgtttccgtctctgtagaatggggcttatagttgtatactacctcacgtagtcatttatgagggccaagtgtgatacagtgaagtcccaccttaggattctaaagtgagcatatagggcaaaaatcaaatacagtaaaaattatccttaaaaaatctcttaaatccctcacaaagaacaaagtaaatggttttgggcatacaactctgtaactgagactgtctgaggggcacagtttcttccatctcatgcttactttgttacctacacttgttgagtggaatggcaggtaagatcatgtgcactaaaatataacttacatttttattcatgtttattttctacccagcgcatattcagcttagcatagcacctagcccttttaagccttcaataaatggtaactgttactgttaccataggtgtagcatgtgatatttgaggatgaagaaatggaggttgtccagggcttcaacagcatggatcaatgatgattttttttctgccacatcagccaagatttttaagacatgaatatggccaagggaataatgtcaccatttcagagataaggatatagaattatcaattatatttcaagggaaaatgctaacataactgcttccaagtttatgggccaaaattaacacaatcccatacaaataataagcaaattttattttttttcagtttgaattgtgaagtatatcattcacacaaatgaatattttgatttcaaaagcaaaaaataatgctttgttttaagttgatgatgtaaagatttcaaaagacaaagtggtattaagtagaatgcaagatgtcaggaaaccttaatgataaaattcatctgggagtcattcatcaaggatgttaaccattttcatccaaagcttatgcaaccataaacagttacaaatgatctgttttacagtgttgacacatatgtctaagaagatcttatactattgacaaaaagtattatgtatataatgatataatctttgtacacttactctctgaataaatgtgtatttgttattttgggaattcagttgcttgggtcagattgtggtgctcaaattaatgaatcatatgtagagtaaggcataaatattgcctaggtatctgcagcattgccatacaggaagacaaatagggccttccttttcttaaaggaaatttttttttataggttacaatgggcaggggtgtaccctctgaacatttttcttgaggatccaacatttaaaagtaagaataacagtgagctgggcatggtggctcaagcctgtaatcccagcactttaggaggccaaggtgagaggaggattgcttcaggccaggaatttgaaaccagcctgggcaacatagcaagacttcgtctctacaaaaaataaaaaaattaaccaattgtggtggcacacacctgtagtcccagctacttgggaggctgaagcaggaggactacttgagtccaagaggttgaggctgcagttagctgtgatcatgccagtgcactccaccctaggtgacagagtgagaccccgtttctaaaaacaacaacaataacaacaacaatgatagaataaaactctaagaatagtaatatgcttttgttcaagtgctgtcaggtgctgactttactgaaaataaagtcgtacttgtaccttatcacttgttgctaggtataagactgtcttgtttctaacaaaggaggaaaatcttgttttaaggtgactcatacagtgatgtggtaggttggtaatggggtggtttttttgctcagtgtaagcactggaaataacaaatactggtaactttttcatataatttaactcttatatttgggaattcctaagaatctgtgtgtacaacctggttccatgatagtcttaatagtaagaaaacagctaaatttcactactatgtgatcatggaaatttaaggtatggcatttataacgtctgagttataattagcttatgctttttcaagtctttaaatattgagcagtctcccttacctgtgataatttttcttttactgccccttgagactcattcatctgtgattggatgatttattcatttaaagttaattaagttcagctactgagccttattttttttttaatcttaccgtggttatagaactaggtctcgtggaaacttgattttggcatttttatagctatacaagcattgccatgatacccggaaatattgtttgttagtaaaaagggggacaggtctagttaattggaaagatacatagaaatttattctcctagttatatatctttagagatttttctaatttcctataagagaagtcatgttaaaacttaaacccaagctatttttacagtaggatagagtatagtttttaataataaatcctttaaagctaaggtttggagaaatttttttttttcctttgagacggagtcttgctctgtcacccaggctggagtgcagtggcacgatctcggctcactgcaagctccacctcccggcttcacaccattctcctgcctcagcctcccaagtagctgggactacaggcacccgccaccacgcctgggtaatttttttatttttagtagagatggggtttcaccgtgttagccaggatggtctcgatctcctgacctcatgacccacccgccttggcctctcaaattgctgggattacaggcgtgagccaccactcccggccaatttttttttttttttttttttttttttttttcagatggagtcttgctctgttgcccaaactggagtgcagtggcgtgatttcagctcactgcaacctccgcctcccaggttcaagcagttctcctgcttcagcctcccgagtaactgggattacaggtgcacatcaccatgcccagctaatttttgtatttttagtagagacggggttcaccatgttggccaggctggtctggaactcctgacctcaagtgatctgcccaccttggcctcccagtgttctgggattacaggcatgagccactgcgcccagccagagaaacttttctttaagagacagggtcttcctctgttgcacaggctagagtgcaatggcacaatcatggctcactgtataccgcagccttgatctcctgggcccaagtgatcctcctacgtcagcctcctgagtagcaggactaagacaggtgtgtaccaccatacctgactaatttattttttatttttttggagagatgggttatcattatgttgcccaggctggtcttgaactcttggactcaagcaatccttccacctcagcctcccaaagtgctatcattacagatggattacctggccttggggaaatgtttagtgaaaaatttagggaaaggattataaagtaattaaggttttgtcagggttgggcacagtggctcacgccaaaatcccagcactttgggaggccgaggtgggaagatcacttgaggccaggagttcaagacgagcctgggcaacatagtgagacctcatttctacaaaaaataaaacagccagggttgtggcacatgcccgtagtcccagctactcatgaggctgaggtgggagaattgcttgagcccaggaggtcaaggctgcagtgagccatgatcacaccactgaaacccagatcctgggtgacagagtgagatcctgtctcaaaaaaaaaaaaaaaaaaggttttgtcagggttgatgcattttgacactgactgattggcagttttatctgggagagaagaattagagtctttaaaagtaagaacacttttaaggccagatattgatgaagaatagccagtttggctctggactgagttttttctttctttatttggaagatttcagttagttaaggagctctaggccatggggcaataagactcattcttttaacaaacataacagagcttgtatattcgaaagactgctctctagtgcctaaggaaaatagacaatgtattttttttctttttttccttcagcttttaagttcagggatacatgtgcaggaatgtgcaggtttgttacataagtaaacatgtaccatgatggtttgccacacagatcatcccattacctaggtattaagcccagcatacgttagctattcttcctgatgttctccctccccccactccacccccaacaggccccagtgtgtgtacttccccaccatgtgtcccacatgttctctcccacttataagagagaacgtgcagtattttgttttctgttcctgtgtgactttgctgaagataatggcttccaactccatccatttccctgcaaaagatatgatctcattcctttttatgactgcatagtattccatggtatgtatgtaccacattttctttatccagtctatcaatgatgggcatttagatggattccatgtctttgctactgtggatagtgctgcagtcaacatacgtgtgcatgtatctttataacagaatgacttatattcctctgggtatataccagtaatgggattgctgggttaaattttatttctgcctctaagtctttgaggaattgccacactgtcttccacaatggttgaactaatttacactcccaccagcagtgtaaaaatgttcctttttctccacaacttcaccagcatctgttttttgactttttaacaatagctattctgactggcatgagatagtttctcattgtggttttgatttgcgtttctttaatgatcagtgatgttgagctttttttcatatgtttattggccgcatgtatgtcatcttttgagaattgtctgtttatgtcctttgcccactttttaaatggggttgtttgtttgttttcttttaaatttgtttaagtttcttgtagactctggatattaacctttatcagatggatagattgcaaaaatgttctcccattttataggttgtctgtttgctctgattatagtttattttggagtgcagaagcactttaatttagttagatcccatttgtcagtttttgcttgtgttgcacttgcttttggcgtttttgtcatgaaatctttgtccatgcctatatcctgaatggtattgcctagattttcttctagggtttttatagttttgggttttacatttaagtctttaatccatcttgagttaatttttgcatgtggtgtaaggaaggggtccaatttcaatttcctgcatatggctagccagttcttccagcaccatttattaactaggaagtcctttcctcattgcttgtttttgtcaggttaagttcagatggttgtgttacgggatctttgggtgtcaatttttggaaacctctgtggccagttatgcctttgcctgagttcttgtccatccaggaagaatgaggtagaatgaggtatgcagacaaatgaagggtgaagaagacgaagaagagctttatttaggtttacaactgctcagaggagacccgcagtgggtagctcccctctgtaggcaggcaggtcatccatcgagtgttcagctctcatcagagaggaggccctggagagggtagttcttctctgcaggcaggtcatttggtgatctctgcaggtctctgaaactctcagcagagagggtagctcctttctgcagttagtcatccagttcagttgtctgctcagctctggctgagcccagggttttatgggcctcagaggtgaggaagtgcatgcagattggcccatgggcagtcctgagaaaggcaccagtttccactctggtccatgggactggcagcccagcccccagcccacaggccctccctggcctgagggagggaccttaccagggacccgcccccttccacctggcactctgtctgcctcccactgctgttcaatgacactcaggctcgcctgactttgctccaagatctgagcagttgtggacagcagggagaagccaggcagcaggggcaggcacatctgggttgaggagtggtggctcctgcctgctcccagctccccaaaagcacaaggaggctcagacctgcagctacaacttgggtggctgcagcctcacccaggagagcagggctcctgcttgcgtcttggagcatgcagccccagccacacctccctgctgggcaagtgatggcaggctgactggagcagttgccaccatcagtcatgggtgtgtggtcttatatctgagttctctattctgttccattgatctatgtgtctgttcttgtacaagtgttgtgctgttttggttactgtagccttgtagtatagtttgaagttgggtagtgtaatgcctcagctttgttctttttgcttgggattgtcttggctattcaggctcttttttggttccatataaattttaaaatagattttctaattctgtgaagaatgtcaatgatagtttagtgggtgtagcattgaatctattaattactttaagtaatatggccattttaacgatattgattcttcctatcagcatggaatgcttttccatttgtttctgtcctctctgatttctttgagcagtggtttgtagttctccttgaagaggtccttcacttcccttgttagctgtatttctaggtattttattcttttttagcaattgtgaatgggagttcattcatgatttgtccctgcttgcctgttgttggtgtatagaaatgctagcaatttttgcacattaattttgtatcctgagacattgctgaagttgcttatcagcttaagatgctttggggctgagacaatggggttttctagacatatgatcatgtcatctgtaaacaaaagtaatttgacttcctgtcttcctatttgaatacctgttatttctttctcttgcctgattgccttggccagaacttccaatactgtgttgataggagtggtgagagaaggcattcttgtcttgtgccggttttcaaggggaatgcttccagcttttacccattcagtatgatattggctgtggatttgtcatatatggctcttattattttgaggtatgttccttcaatacctagtttattgagagtttttaacctgaagggattttgaattttatcaaaggccttttcttcatccattgagaaaatcatgtggtttttgtctttagttctgtttatgtgatgagtcgcatttattgattcacatatgttgaaccaaccttgcatcccagggatgaggccagcttgatcgtggtggataagctttttgatgtgctgctggattcagtttgccagtattttattaaggatttctccatcgatgttcaccaaggatattggcccgaatttttctttttttgttgtatgtctgccaggtttaggtatcagaatggtgctggcctcatagaatgaattaaggaggagtctttccttttcaattttttggaatagtttcagtaggaatggtattagctcttctttgtacctctggtaaattcagctgtgaatccatctggtcctgggctttttttttggttggtaggctatttattactgccttaatttcagaactcattattggtctattcagggattcattttcttcctggttcagtctcaggagggtgtatgttggataatgtatttatgcaaatgatgcaacatttgtttagcatctttggagctcctttttctggcatcgccttcaattcttttaaatatttccaagggtagcaaatcttcctttgaaggtaaatttgatttttggaaatagccaaaaataacttgtatccatatttggtgaatattaattaattaatcccaaacatcttaattgagtgtcttgtacttcagcccctaggggaaaaagagcgaaataatcagttcctgctttcagagctgtagaggaatggttgatacatagcactggggcagatggcacatcaaaagactaagggatttatcagggagatgcagaacagagaaggggctcttggccatggagaattattcacaaaattaataattttagtaaaggaaaggcagtaaaaataggcttgtctataagttagtgaaatgattttttttttttttggtaaatcttgaactggcttaaacacagtttccaagcagatattctgaaaatgcttcaagttgtggtatatcatagaacttctcaaaatgactatttgaagggaacacttttaaaaatatatattctgttgtgttggttaaaaagtattcattatttttaatttatatatatatattttaaatatattttgaaattatattttaaatatataaatatatttttaatatataaatatatatacacatatatgtgtgtgtatatatatatttttaagttgagacagagtcttgctctttgcccaggctggaatgcagtggcaccatctcggctcactgcagcctctacttctcgtgctcaggcaattctcctgcttcagccttctgggtagctgggactacaggcgcccggcaccatgcccagctaatttttgtatttttagtagagacggggtttcaccatgttggccaagctggtcttgaattcctgacctcaagtgatcttcccgcctcggcttcccaaagtgttcatattacaggtgtgagccactgtgcctggacagtttattattttatagacttaaattgaattctatgtttttaccttgagatagtctcaaaaagtattcaccatggaaaattaatacagaattggtccatttttcctacctctcctagatgcctctacgatgtcctttttaaaaaatttctgagctaaagaaggcaagggtgttctttcacagcaaatatgggggtgagggaggggggaagaggtacattaatagtaaaattgaagaatatttttagccaattactctcagagactgagtagttaaaactggatacctttttttcctaaagatattaaagatgttaaatgatagaaactgacctccagaatgaaaagacaaattattggggtttttttttttaagggcaacagaaagtagatgataggtagggtgaacttataatttgctattcaaaaattttattccaggataataatggaataaaaggaatgctagtgatcatttcactgtgcaacaagtgttaactagaacgggcaaactggggtatatggctaccatagtgatggggattctagaaaacaatctaaggtgaacattcatggggttgctattttaaagtagttatgacacactcataacaaagctgcttttatgcatctatatgagttggtattttactttgcaattgagtaaagaagagaccttacagcatattaaatgtgaattttggaaactaatttttaagtttcatgtatcatatctttcagaaagtagtgtacattcattgccatttctgccttattagttaaggaataggccaagctgctataaaaaagagagcccatggccagacagggtggtttatgcctgtaatcccaacactttggaaggccaaggtaggaggatcccttgaggccaggagttcaagaccagcctgagcaagagataggagcctctgtctctacaaaaaaaaaattaaaaattagccaggcatggtggcatgtgcctatagtcttactacttgagaggctgaggtgagaggatcatttgagcccaggagttcaaagctgcattgaggtatgatcacatgccattgcgttccagcctaggcgacacagaaagacactgtctcttaacaaggaaggaaggaagggagggagggagaaagaaagggaggaaggaagggagaaaggaagggagaaagaaagaaaaggaaggagggagggaggaagggagtggggaaggaaggaaggagcctcagcacactgagacatattagtaagattaaagttcatttctctctcttgtagcagtttagaggaagaaccatttcttgttaatcagaggtcaaagaacgtctgtgaaatgggatggttagactcaacaaacctatattgtattcatgagcatatattgctggattttcctgaatattctaatgtttgcctttttgactacttagaatttttacttaaaatttaagtatgcccacatcctgttatactgtgaggctttgcaacagaggaatacaaaaacttgtcacttgtttagaaacaggaatttatcttgatagtgattgaattttatcctaatctaactcttaagtaaaaaatttcatcttactgagagagaaaacattgttttttttttattattatactttaagttttagggtacaggtgcacaacgtgcaggtttgttacatatgtatacatatgccatgttggtgtgctgcacccattaactcgtcatttacattaggtatatctcctaatgctatccctctcccctccccccaacccacaacaggcccaggtgtgtgatgtttcccttcctgtgtccatgtgttctcattgttcaattcccacctatgagtgagaacatgcggtgtttggttttttgttcttgcgatagtttgctgagaatgatggtttccagcttcatccatgtccctacaaaggacatgaactcatcattttttatggctgcatagtattccatggtgtatatatgccacattttcttaatctagtctctcattgttggacatttgggttggttccaagtctttgcttttgtgaatagtgccgcaatgaacatacgtgtgcatgtgtctttatagcagcatgatttatagtcctttgggtatacacccagtaatgggatggctgggtcaaatggtatttctagttctagatccctgaggaatcgccacactgacttccacaatggttgaactagtttacagtccaaccaatagcataaaagtgttcctatttctccacatcctctccagcacctgttgtttcctgactttttaatgatcatcattctaactggtgtgagatggtatctcattgtggttttgatttgcatttctctgatggccagtgatgatgagcattttttcatgtgtcttttggctgcataaatgtcttcttttgagaagtatctgttcatatccttcgcccacttgttgatggggttgtttttttcttgtaaatttgtttgagttctttgtagattctggatattagccctttgtcagatgagtagattgcaaaaattttctcccattctgtaggttgcctgttcactctgatggtagtttcttttgctgtgcagaagctctttagtttaattagatcccatttgtctattttggcttttgttgccattgcttttggtgttttagacataaattccttgcccatgcctatgtcctgaatggtattgcctaggttttctttgacggtttttatggttttaggtctaacatataagtatttaatccatcttgaactaatttttgtataaggtgtaaggaagggatccagtttcatctttctacatatggctagccagttttcccagcaccatttattaaatagggaatcctttccccattgcttgtttttctcaggtttgtcaaagatcagatagttgtagatatgtggcattatttctgagggctctgttctgttccattggtctatatctctgttttggtaccagtaccatgctgttttggttactgtagccttgtagcatagtttgaagtcaggtagcatgatgcctccagctttgttcttttggcttaggattgacttggcaatgtgggctcttttttggttccacatgaactttaaagtagatttttccaattctgtgaagaaagtcattgatagcttgatcaggatggcattgaaaatctataaattaccttgggcagtatggccattttcacgatattgattcttcctacccatgagcatggaatgttcttccatttgtttgtatcctcttttatttccttaagcagtggtttgtggttctccttgaagaggtccttcacatcccttgtaagttggattcctaggtattttattctctttgaagcaattgtgaatgggagttcactcatgatttggctctctgtttgtctgttattggtgtataagaatgcttctgatttttgcacattgattttgtatcctgagactttgctgaagttgcctatcagcttaaggagattttgggctgagacgatggggttttctagacatacaatcatgtcatctgcaaacagggacaatttgacttcctcttttcctaattgaataccctttatttccttcttctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaaggttgttgaattttgtcaaaggccttttctgcatctattgagataatcgtgtggtttttgtcgttggttctgtttatatgctggattatgtttattgatttgcgtatgttgaaccagtcttgcatcccagggatgaagcccacttgatcatggtggataagctttttgatgtgctgctggattcagtttgccagtattttattcaggatttttgcatcaatgttcatcagggatattggttaaaattctctttttttgttgtgtctctgcccggctttggtatcaggatgatgctggcctcataaaatgagttagggagaattccctctttttctattgattggaatagtttcagaaggaatggtaccagctcctccttgtacctctggtagaatttggctgtgaatccatctggtcctggactttttttggttggtaagctattaattattgcctcaatttcagagcctgttattgatctattcagagattcagcttcttcctggtgtagtcttgggagggtgtatgtgtcgaggaatttatccatttcttctagattttcaagtttatttgcgtagaggtgtttatagtattctctgatggtagtttgtatttctgtgggatcggtggtgatatcccctttatcattttttattgtgtctatttgattcttctctcttttcttctttattagtcttgctagcggtctatcaattttgttgatcttttcaaaaaaccagctcctggattcattgattttttgaagggtttttttgtgtctctatatccttcagttcttctctgatcttagttatttcttgccttctgctagcttttgaatgtgattgctcttgcttctctagttcttttaattgtgatgttagggtgtcaattttagatctttcctgctttctcttgtgggcatttagtgctgtaaatttccctctacacactgctttaaatatgtcccagagattctggtatgttgtgtctttgttctcgttggtttcaaagaacatctttatttctgccttcatttcattatgtacccagtagtcatacaggagcaggttgttcagtttccatgtagttgagcggttttgagtgagtttcttgatcccgagttccaggttgattgcactgtggtctgagagatagtttgttataatttctattcttttacatttgctgaggagtgctttacttccaactgtgtggtcaattttggaataagtgcagtgtggtgctgagaagagtgtatattctgatgatttggggtggagagttctgtagatgtctattaggtccacttggtgcagagctgagttcaattcctggatatccttgttaaccttctgtctcattgatctgtctaatgttgacagtggggtgttaaagtctcccattattattgtgtggaagtctaagtctctttgtaggtctctaaggacttgctttatgaatctgggtgctcctgtattgggtgcatatatatttaggatagttagctcttcttgttgaactgatccctttaccattatgtaatggccttgtctcttttgatctttgttggtttaaagtctgttttatcagagactaggattgcaacccctgcctttttttgttttccatttgcttggtagatcttcctccatccctttattttgagtccatgtgtgtctctgcatatgagttgggtttcctgaatacagcacactgatgggtcttgactctttatccaatttgccagtctgtgtcttttaattggagcatttaggccatttacgtttaaggttaatgttgttatgtgtaaatttgatcctgtcattatgatgttagctggttattttgctcgttagttgatgaagtttcttcctagcctcgatggtctttacaatttggcatgtttttgcagtggctggtaccggttgttcctttccatgtttagtgcttccttcaggagctcgttttatttagagcttgttctaattcttttgtaactacttaagtgagttatttattcctctttgttctcatagaaattatataaatatatatatacacacccatatatgtatgtctttatagcattacagtagtatttttgtcaccctatcacattagattgaggtcaggaacctttcttgttcattttcgtaccccccttagtgtctggaatatgataaataggtaataaatagatgtcagtgaagaactgttaatctcatttaattacagacttactcattactaaaataagacagttctggagttgataattttacctaagcatagtggatgaattgcttgtattttgtaatattaaataggttgagaatgaatatttaaatgtgtaggctgcattttacatatgatacatagaaaatttaaaggataggattagaatatcatgtaattaaaatgaaatgaaaaagaccagcaataaagtgggaatgggattgaatggaccatatagataaaagaatgtataaaatacattttataatgtattttataaaatgccaaaatatatttaaaataaaatatattttataaaataccaaaatctacagatgcccaagtgcctgttataacatggcatagtatttgcatataagctatgcaatatttttataaaatatattttatatattttatacatgaaatgtatatataaaatacattttatacatgaaatgtgtatataaaatacattttatacatgaaatgtgtatataaaatacattttatacatgaaatgtgtatataaaatacattttatacatgaaatgtgtatataaaatacattttatacatgaaatgtgtatataaaatacattttatacatgaaatgtgtatataaaatacattttatacatgaaatgtgtatataaaatacattttatacatgaaatgtgtatataaaatacattttatacatgaaatgtgtatataaaatacattttatacatgaaatgtgtatataaaatacattttatacatgaaatgtgtatataaaatacattttatacatgaaatgtgtatataaaatacattttatacatgaaatgtgtatataaaatacattttatacatgaaatgtgtatataaaatacattttatacatgaaatgtgtatataaaatacattttatacatgaaatgtgtatataaaatacattttatacatgaaatgtgtatataaaatacattttatacatgaaatgtgtatataaaatacattttatacatgaaatgtgtatataaaatacattttatacatgaaatgtgtatataaaatacattttatacatgaaatgtgtatataaaatacattttatatatgaaatgtgtatataaaatatattttatatatttcatatataaaatgtgtatataaaatatattttatatatttcatatataaaatgtgtatataaaatatattttatatatttcatatataaaatgtatatataaaatatattttatatatttcatatataaaatgtatatataaaatatattttatatatttcatatataaaatgtatatataaaatatattttatatatttcatatataaaatgtatatataaaatatattttatatatttcatatataaaatgtatatataaaatatattttatatatttcatatataaaatgtatatataaaatatattttatatatttcatatataaaatgtatatataaaatatattttatatatttcatatataaaatgtatatataaaatatattttatatatttcatatataaaatgtatatataaaatatattttatatatttcatatataaaatgtatatataatgtatatataaaatgtatttataaaatatatataatatataatataatgtatataaaatatatgtataatgtattttatacattctgcgatctataaataaaatagaatgtataaaatacatctatctataaatagaatatatgaaaacatgacagcatagccatttgtagaaatacatgtgattttatgtggttggagtggagagtctatgtcagagaaggggcatgatgggagatgagactcaagaggctagatcatgaagagccttatgtgatagcagtttgaattttgtcttgaaaaccatgaggaatatggaagaatttaagtatgatcagatttgcacatctgaagctgtattgggggggcgggggtggagctagatgtacttagttacttaattgggggaaggtggaaggatggtaattgagaaggaagggtctagaatatggcttcagtgttccagatttaggcatctaggtagattgtggttccataccctgaggtaaagaatactggggccagtttaagtggtgggagtgggtggtgaacatcttgagttggaggtaaatagttagtcctttgtagctggaagttctgcatctgcagattcaaccaactgtggattgaaactatttgggaaaaccccaataaaaataacaataccataataaaaataatacaaattaaaaaatagtataacagctatttacatagtatttacatcgaagtaggtatcgtaagtaatctagagatgatttaaagtgtacaggagcatgtgcatagcttatatgcaaatactatgccatgttataacagggacttgggcatctgtggattttgatatctgtaggggtcctggaatcaatcctctgtggataccaagagatgactatatacaaaacaagcaaaggaaagtcccaagctgaagagatacatgtgttactcagcaaggagatctaggctggagaaagaaaaaatgatagtgaccatttattgagcctttgcataaatatgtcaggtactgtggcagaaactttatatatgtcatttagtacttaggaattattattattctcattttataaattaagaaaccaagatccaagcttacacagtaagtggcagagaaacttataggctctaaagctgtactgaagccatgaggatatgaatgagatcacttatggagaacgtaacatgagacaagtggagaactaaaaggtgactaaggtgtgagatgagagaagcctaaagatagacttttggggaatgggacatttgggagactaatgaaggaaaatcctgcaaataagactgaaaaagaacatcaagagcaatgttaacccaaaatgtgtttcccaactcaatttgttatttaagatagttctttaaaagggatggaagaatttaatagtcaagaaatttgggaaaacattggagaaactcatcttgtagagtcacaatacacctcagtatattgaagatctgagaaaatctgtagtaaagaaaaatacttaactttaataccacatttcccaaaagtatttgatcatgtacccttgtcatagtctcattcctgctactataacaaaataccacagaatgggtaatttataaataatagaaatttatttctcacagttctggaggatgggaagtccaagacaaggtgccagcagattcggtgtctgggaaaagccttcttgctgcatcctcatgtagaaggaacaaatgtggtgtcctcatatagcaaaaggggaaaacgggtgaacagttatatggcacttcttgtataaggtcattaattccattcacgagagctctatcctcatgacttacttcctgaaggcctgacctcttaatactatcatgttggtgattaagtttcagcatatcaattttggggggatgcattcagactatagcaattctcccccaccccccctttttttttgcctaaattccattgacattccaggactaggtactctagttaggatgaaattctggtgagtgtggcatcacagactctaagcaaagagggagtttcaggaaggaagtgtgcactgttgggtcagatgtattgaggaggtgaagagaaggaagagtagaaagtccattgactttggcagttaggatactagtgactttcgtaagatcaactttggtggagtgggtgatcagaagaccagttgcagcaggttagaaggtaaattagtggtgaggaaaggaaagtagcaagtagagactgttcttttaaaacctagtatcaaggaaaggaagagtagctagagggaaatttagggtgagagaagggctctttttggttatttggaagagatctgagaatatttttctgctgaggggaagtgatcattaggaaagaaaagggtacgggaagagggtagggaagagggaatgattcatggagcaagtttctggaggaaatgggaggagagaggttccagaggacagagagagagagatttggaaggttggataatattacagtgagctctagtacagaaatgcccttaggaacttcttttcctagtaagattgttatgtttattgtttttgtctactttttattttattttaatttacaaaaaaaaaatttaagctagtcagtcatggtcgagacaatgttaatgagcttaacagtgacccacaaccttcagaccaacttgggtctactttgtatagctttactgaatcttcctcttcattgtcacagtggtggctgttgacattccctactgtcattgtgccttcctctagcagcttttacttttactttgctgtttcctatctgcttccaactagaaaaccagacttttcaggaattaagagtaaataacctgaaggtctaaagagcaacaccctcatccacaccagggaagcagtttataaactttggggcatcttttctgcacttagaattccttttataggtgaggtgggggtgggggctgctttggaaactttcagatgtttttaatttatatgtatttactatttaaaatgtttgctattagccaaatgctgtggcacatgtctgtagtccccagctacttgggagactataaggcaggaggattgcttgagcccaaggaggtcaaggccaacctgggcaacagaacaagaccttgtctctttttaataaaaaaagaaagaaagaaaagaaagaaaaaaaaaagaaagtcggctattacttcatttgtgcattttagaatttcttttgtaaattctaaaagccattttcctaattttataaagcttctttcttagtggtagatatcttcagctatatattgtttatacaaaatctcttcagtttgaagatgggttttaactagaatctggaaagctaatgggctagtcagaacataaggttctgacttataaccataaaattgtgcaagattaaatattcttagtggtgtggtctgtactgagaccttttgatttatagtgggtcactatataatgatgcggttctgctctgtacttttttagctaattatgtttcttttgtctataattgaatagcccttttggtcaaatgagaagtctggaaattctgcaattacctttggtctgctcttcacctgtcagaagtttgaaggctattttgtttttttttttctattactatgacataatattcaacattttagaatttagaatttatttagggctcttgagctgcttgcttgagcctgctttcactctatggagtgtactttcgtttcaataaatctgtgcttttgttgcttctttctttcattgctttgaaaaaaaaatttatttagaagtgaaggctaaatctgatgggttttgtctagataacagtgcagagaactatttgtagcaaatgtggttgctaaccacttgcactagattcatgtgggaacttaagcatagtagatttgtgggtttcatctctgtcctactcagtctctcttgagatagtcaggactgtgtgttttttaacaggctcttgggtgattctgttaagtactaacatatgaaaagtactggtgcagggaatccagcctgtgattaggcctgatccaggctggtccttacactgactgtagcaaaagtgtccatggttagaacccaaatcagaggagtgtatgttcaggtgcttctcacaggatgatcttttaaagatttttttcagaccgggcgtggtggctcacacctgtaatcccagcactttgggaggctgaggcaggcagatcacgaggtcaagagatcaagaccatcctggccaacatgatgaaaccccgtctctactaaaaatacaaaaattagctgggtctggtggcgtgtgcctgtagtcccagctactcgggaggctgaggcaggaaaatcacttgaacacaggaggcagaggttgcagtgagccgagatcgcaccacagcgctccagcctggtgacagagcgaacagctttagtgaaatataattcaaatgctatacagttaatacattggttttggtatattcacagatatatgcacccaacaccacagtcagtttttgaaaattttcatcacctcagaaagaaacccctttatctatgaccactctatcccacccaacacctcacctcatcctaagcaaacactaatctctgtctctataacttccctattctggactggcctatgagtgggatcatatgttgtctttgtgattggcttctttcagttagcataatgttttcaaggcttatccatgtcatagcctgtgttagcacttcattcctttttatggccaaataataatagtgttttatcctttcatccacctaaatgatgacatttaggttgtttctgtcttttggctattatgaatggtgctgtacacatctgtgtacaagtttctgtatggacatatgttttcatttctcttgggcatatacctaggagtgggattgctagagcatatgataactctttttaactgatgaactgccagattgttttccacagcagctgcaccattttacattcccaccagcagtgtatgagggctctgattactccacatcctcatcaacacttgttgtaacctaacttcagattctagccattcttgtgaatatgaagtattatctcattgcagtttgggtttgcatttccctagtggctaatgatgttgaacatcttttcatgtgctcactggccatttgtgtatcttcctcacatgagaaatatctattcagatcttttgcccattttttatttttttaattaaaaaaattttttagagactggggtcttgctctgtttcccaggctggagtgtagtgaaacaatcacagctcactgcagcctcacactcctgggctcaagccatcctcctgccccagtcttggtgtctgatctcatacctggctggttttttttttttttttttttttttttggtagagatggggcctcactgtgttgcccaggctggcctttgctcatttttaaattggactttttgtctttttattattgagttgtaagagttctttatgtattccagatacaagtcccatgtcggatatgtgatttgcaaatattttatcccattctctgggttgtcttttttctttctttatggtgtactctgaagcacaaaatttttaaatttggtgaagttcagtgtacctattttgttgttgttgttcatgcttttggtgtcatagctaagaattctttggcaaatcctacatcatgaagatttacccctatgttttcttctgagagttttttggttttttgtttgtttgttttgagacagtctgtctctgtcacccaggccggagtgcagtggcgcaatatcagctcactgcaacctctgcctcccaggttcaagcaattcttctgcctcagcctcccaagtagctaggattacaggtgtgtgccaccatgcccagctaatttttgtattttagtagagacggggttttaccatgttggccaggctggtttcaaattcctgacctcaagtgatccacctgccttggccccccaaagtgctgggattacaagtgtgagcccccatgcccagactcttctgacagttttatgatttttctcttacatttaggcctttgatccattttgagtaaatttttgtatatggtatttgtttgcatgtggctttgcaggtgtcttagcaccatttttttttaagaaaactaaactcaaattttatatacaatgcctttaattttattttaaattagaaacatagtagtctttttttcttttctttccttttttttttttttttttttttttttgagatagtgtctcactctttcacctaggctggagtgaagtggtgcactatcatggcttcaaccctccgagctcaagtgatcctcccacctcagcctcctgagtagctggtctacaggagtgtgccaccacgcctggctttttttttttttttaagttttttgtagggatgtgattttgccatgttacccaggctggtctcacactcctggcctaaagtgatcctcccacctcagcctctcaaagggctgggattacaggcatagccattgcagctggctgtcactttctttatactgactttttctactgtttgtatggttaaggttgctgttaatactgtagaaatataaaccatcaaaatatttggtctataaaaattactaggtttttgctttacacttatacggattccatcccagagagttgtccagtttccaagctgtccatgctatggcactaagtctcatacataaaactccaactctgctttcttgggatttcagtgggaaagaaatacactgaatgcctgattctctccaaatctctttccaaccatccaatggaaccataaagattcctcagtcttagacttcgtgattttaggctttttctcaccactatctgttagtttccatggtagagtcaagtgcagtctctgtctcagcatagtttctttctgggggtagggtggatgggacagggtcttactctttcggtcaggctggaatgcagtggcatgatcatggctcactgcagcctcaaccttctgggctcaagtaattctcctgcctcagcctcctgagtagctgggactacaggcatgtaccactatgcctggctaacttttaaatttttttgtagaaatgagatctcactacattgcccaggctggtctcaaactcctgggcttaagtgatcctccagtattggcctcccaaagtgctgggattgcagtcatgagttaccacgcctggcctcagcatagtttctttcataatcttcacatatactaatctgcaaaaactatattgtgttctgtaaggtcatcttagtttttataaaagataaggaaatgttttcttcacattaaattacattaaaataagctgaaagcacttatttattttctaaaattagtatttagtaatagcattccctaacctgaactgcagaagaccatttaaaagtagctctgttccctctactatgatgaccaggtttctgctcttcaaagagaaagaaataagaacaaccaacattggcttactctgtgctaggcactattctgaactctttatcaatatgatctgattcagtcctgacaaccaccctctgaagatgtgtactattaccatcctcattttacagatgaggaaatagaggcacagataaggggtaggacaggattagaatccaggcaatccgacttcagagacccttgtcttgaaagcacgtaccaaagattggcctgccttacccttcttgtcttaaactccagtcttgaattccatgtcatttttgatgggtctaggaaataggacctaggaaatacacctaaagtactctgttttgtttttgtttattcttactaaagctcaagtttatcctctattgatcctcactaaataatttcgtagttataatatctaagatgtacaaaaatttctatgcctgctccaagatttttttttattgtgttctatgctaatagcttgcttttataacactactactgatctcaagtattaagttgttaacaaaatatcctctataggcatataattaaataagataggtggccccaaagtagtataagctgcatgatgttgaagaaattacattggctcgataggagagccattcatctggctttgctaccacttaactctggctctggtcaatcttttcatctttctagtcctggttttcttatccgagaaaaaaatctttaatctctaaggtcctgtccagctttagcacttaaggataccacatactcttggtaaagtgtcttcagaactgtgtaatagaagttgaaggagcgctataattggtgattaacattcagccccttgttacttatgcaacttcttcagcaggcttgaatttctccccagaaaatgggttattttctatcacatcatcagtctgcaaatttttcaaactttttttttttttttttttgagatggagtctttctctgtcgcccaggctggagtgcagtggcatgatcttggctcactgcaacctccaccgcctgggttcaagcaattctcctgtctcagcctcccgagtagttgggactacaggtgcacgctaccatgcctgactaatttttgtatttttagtagagacagagtttcaccatattggtcaggctggtcccaaactcctgacctcaggtggtccatccacctcagcctcccaaagtgctgggattacaggtgtgagccacgacacccggccattttccaaacttttatgcgctgcttcttcttgaacactttgccacttagaaatttcttccaccagatacctaaatcatctctctcaagttcaaagttccacagaactctatggcaggggcaaaatgccaccagtctctttgctaaaacatagcaagagtcacctttgctccagttcccaagttccttatctccatctgagaccacctcagcctggaccttattgtccatatcgctatgagcattttggtcaaagccattcaacaagtctctaggaagttacaaactttcccatatcttcctgtcttctgagccctccaagtttctaggaagttccaaactttcccacatttttctgtcttcttccgggtcctcgaaactgttccaacctctgcctgctactcagttccaaagttgcttccacattttcgggtatctttatagcagtgccccactacctggtacctatttactgtattagtctgttctcacgctgctaataaagacatacctgagactgggtaatttataaaggaaagagttttaatggactcacagttccacatggctggggaggcctcacaatcatggtggaagaataaggaagagcaaaaggacatcttacatggcggcaggcaagagagccatgtgcaggggaaatccactttataaaaccatcagatctcgtgagacttgctatcaccagaacagcacaggaaaaaccagcctccatgattcaattacctcccactggctccctcccatcacatgtgggaattatgggagctacaattcaagatgagatttaggtgggtacatacccaaaccatatcagtaagcattattgattaaatcattggtcattggtaactgactcaatctccactccttccctggttatgtgatggagctgaaaattacaagcttctaatcaaggattggtgtttctggtgactagctcccatcctaaagctatctaggggccagccaagagacacttccttaaaactaaagatgcttctatcactcgtgtcactcaggaaattccaagggttttaggagctctgtgtcaggaactggggaaaaagacctgatttttttttttttttttttttttatgatacaatagcaagaaaccccagtctttggttaataagagttaaaagttagtacctgcttgatagaaaaaaagcataatatgcaataggttgcataagacttggtgagaagaaagaggaacagcaaaagcatggaagccagagacacttggataagtgtaaatgaattcagtactctagataataaagcacgtgatgggagaaaaagggaggtgctagattagagaactaagtaggcaagagccaagaccttggaggctttttatgccttggtaagaaatttaaacttaaactttagcccgtactcaggctttacattgcatcagaataagttgaaaaatatgtaaaaatgcagattgacccaggaatatgcatctttacaagcatccacaggtaaccctgacacaaaaaatactgcttttggcagtgaggaacataaaagttttatgtagagatgtaaggtcagagttacaatttagagtggattgttgcagttgccaagtcctggaactaacatagactcaaactaaggcagttgtggttgggatagacaggatgagatagattacagaaatatataaaaagtgaagtggtagaggcctgatgatggattatgaggtgaaataaagatagaagactggttaactcttgaagactttgagcttggttgggctgagtagatggcagatgatattaacaaaagtacaagaagtaaagctttagtgggaagatgagttcagttgcggaccagctgaggtatgtaatcctgtggaatatgttagcaaacatgttccaattaggcagtaagatatccaagaagaccagtgatgaaaatatcctaaagtaatgtttgtagtctcttgaagctgtgagagagatgacatcactcaaggaatgcccatggagatagatgccaaggacagaaccctgaaagcccccatatgtaaggggtaaaagtagaaaaggagaatttgacagactgaaaggagcaatcagaaagcaatttgtggaagaccagtagaaaatagtgtgccaaaagttttaggaagaaatcaatggtccaattctgtcaaatgcaactgagaaattcgataatacaaagaaaagtgttatgagttggtagtgtggaagccacctgtgactttggctacagtagtttcagtggagaggtgggacagagaagcctgattgaggtaagttgaagagaaaattgatcaaacaaattgtgaatataggccaggtgtagtggctcacacctgtaatcccagcacttgtggaagccaaggtgggaggattgcttgagcccaggagttcgagaccagcctgggcaacatagtaacctctctcactcatcatatatatatgtatgtaaagaaacagtaaaaatagagtattcattttcacaagagttctcatgaatagaaggagaaaaaggattatatctagatggaggaatgcaaggtcaaatatttttcttgtttttaaagtatgcagtagacttgaaaatgtttctgtgctaaaggaaatgaaccaaagtaatggcagtggggaaagagatagaagataaaagtgagacaggagataattgataggaacaggtctcaggggactggtctaagacactaaataaggagttagtctggaacaggagaagttaggctgtccaggaagagaattaactcatcctctgtgacttaaatatctatttcctgttatgatttaaccttactatacaggatgacattaccattctttactccaggagaacttataaagtgtatccaatgtgcagttttatcaattcatcatgcatagataaaaatttctatttatatacagtataacttatatttagatattatagtatgtcatgtatagttaagactaatctgttgccctgactactatagagattagcagaaacctttctgaaacacgataggataatgtgtcttctgattcttttaaaattctttcttctttttacagctgttaagcacatagtgggcactcaataaaatgacacctaacataggatttggaaaatgtgtgaattacaaagatataacccaaaatataaaaggtactcattattcagagtttaaattctttgaacttactaactctaaaaattaataccagtttttaatagaagccttttaccataccagaattcaacttgtcactaagcataagagttttttttttcttttttcttttctattttatttcttttcacatcagacaggtaatgtgctgatattgtaacaaggtttaagggaggcacatctcacacaaaagcatgaaaacccagtcaccatgcttatgaatcacaaaaggattctaggcataagattatgatttggccattaagaaaaaaattgggctgggcatggtggctcatgcctttaataaaaacactttgagaggctgaggcgagaggatcgcttgagcccaggagttcaagaccagcctgagtaacatagtgataccccgtctctacagaaaaatttttaaaaagaaaaaaattgtctttgatgataacttggtagacttccagctgggagcatctttattttatttatttgttatttttgagatggagttttgctctgttgcccaggctagagtgcagtggtgcgatctcagctcactgcaacctccaccccccgggttcaagcgattctcctgcctcagtctcctgagtagctgggattagaggtgcccgccactgcgcccagctaatttttgcagttttaatagagacgaggtttcaccattttggccaggctggtctcgaactcctgaccttgtgatccacctgcctaggcctcccccaaagtgctgggattacaggtgtgagccactgcgcccggccagagcatctttatttaaaagcatgtattgtaaagctccatgtgagaatagaatgctaccttgagtatataatgaggtgcagggaaaagtccaggctactatcttaaggccagttataaatccttgatgatttcaaatttgttggattcttttgatggtgatgatagtgggagaaagaaatatgcacatcaaaagggatttactagagaaaaggctgtgagtttttgaaaggttttggtaagtgtgccaaattgctttctagaaaagttgtattagtttacacttccatcagtaatatgctccagacatcagtgagtatgctccagacatcattttccaaatattaaaaattacattctcattttagaagactggcattgtataataggacagctatgtatcaatctttgtatctccctgaagctttcagccattgagttctgtaaccaaatgacttcctgtacatcttaagaagcaaataatgcagttttttcctcaattgaaatgtttggagatgtttgtttgtttgtttgtttttctccttgaagcctgtaaaagtttgagttcattttaaagttttggggaaattttcaagttctgatttcatctcccacgtgtacttttcataattatttcattttattaacaaagtagggccaggcgcagtggtgggctgggtgtggtggctcatacctgtaatcccagcactttgggaggccgaggtgggcagatcacgaggtcaggagtttgagaccagcctggtcaacatggtgaaaccccatctctactaaaaatacaaaaattacctgggtgcggtggcaggtgcctataatcccagctactcgggaggctcaggcaggagaattgcttgaacgtgggaggcagaggttgcagtgagccaagattgtgccactgcactccagcctgagtgacagagcaagactctgtctcggaaaaaaagaaagaaagagaaagagagagagaaaagaaaggaagaaaaggaagaaagaatgaaagaacaaacaaaagaaagacaggagggaaaataggcactacagattgttcacaattccctaactccatttaatataaggattttgatttctccttttcactgaaaaactatcctactgttctttggtggccaatgataacaaacttagtttatagctactataactgaggtttgggaaatcttcaatacttcacatatgtatagatgctggcagtgtatcaaattctagtttctagtctttagttctttaaaaactctttagtcactttgttattcttacatttcatttgtgataattgattaacatgtttgtatttgaagacattaatcacaatttagaatatataaggagcacacagatactactctgtatcttttagatttccttatacctatgaaagatgttattcagaattcaatatgttcatttaagtttgatataaatatttttctgaaaagaaagaattgagccataaatgaattgttgtgggatatgctgtttggtcctttgggctcaaggcttaatattaataagactcctgaactgagccaggaatccccaggtctagccctaattggctttgtaaccatgagcaaattcatttatctttgcatccttataaaatgtcctacacaaaaaatgttatttttatgaaagtattactcaaatatgaggtagtgttctcagggagaagaaaaaacctttgcctttgagaattgggatggaagggaagtaactttcttaattaaattcagcctgtactattagagaaggcagcacagtgcaaagcaagagtcagaactcatttgcttaccaaagccaggagggaagcatgaatatatgaattgggcctatataagacttagggaattgttggagtctctgtgtatctctcttgtctaaaaatcagattaattaaaaataaataccatgaaagttatacagaacagttctacagggaggattcttcctgtgagcttccagttttcaacctctggtttaaagaaaaaaatgggcctggtgtggtggcttgtgcctgtaatcccagcactttgggaggccaaggcagttggattgctggagtgtaggagttcgagaccagcctaggcaacatagtttgagaccagcctaggcaacatattttgtctctacaaaaaatagaaaaaattagctggtcatgggtggtacgtgcctgtagtcctagctacacggcagactgaggtgaatcatttgagcccggtggggctcgagcctgcagtgagctgtgattgtgtcactgcactttatcctgtatactgttcagcagagtgccaaacatgtagtaggcactcaatgatgtttgatggccagctagctagatggataatggatggatggatggataatcgaatgaatgactagaaggctgttcatcctagcagcatgtgtatacagtatattgagttgtctttgcaattggtttgctcttttttttatttgagtctcatgagcaaaatataacaatagatttttgaaaacatcttttatgtttttaacattctagtctcttacatctttaggtgtcaaaatttagtatgcccaacattaaatttgtggcattgctttcaccagcttaatttcatgagctttggctgggatttggaaacattgcatcttgttttgatgattttctgattggctggaagcctcaaatggatgtcacatgctgttagagcagactttgcaaagaaaaagacagttgatcttctttgtttcaggtggtctgttccctcagtttaggttttgtttgatttggggagtatttattaactttagggatgagttgcattttctttctaatatccatttgttcacaaaaacacctagtaggtattcagttcatattggaatgaatgagaaaatgagcagcacatcaattgtaacaaatgtaccactttggtcggagatgttgataatgggggaggctatatgcatgtgtggaggcaggggatatataggaaatctgtctaccttctgttcaattttgctgtgaacctaaaagcgctctaaaaaataaagtttattaaaaaaaaaaaaaaaaacagcagaaagcactgttcctgagaagtggaaacagcatgagcctctgaataagaaaaacctatttgaatactgattctacctctcacaattatcactcaccttggatagataacatggctgagtccgtgtatatccataatatggaaatgataatacttaaactatattacagattttcaatattcttagtttaaattaggtcaacattctgatttttttgttgggaaaatatggtcatcatatttcagctcttggactttttaccatggaattttaaaaccatatacttctggacacattttaaaaagtaaaatgtacagacatgagatgtgaggggaaatcatgtaatttagccaccaatttgtgcagtttgtataattatgacaaataacacaatgctgtctgtatttgttaagttttcctgtgattgacttcagaatatcaatgaatcttaaaccagactttttctgttattcatttgctgctttgagcttgtttctctgcctatccattttttatatagctcagaaaattaaacaattgagatcttgagtttcatattataccattaatttgcttattacaatcataacatagtatatttagtagggcacagctggattttcttttatttgcatatgccttatggtaatactatgactagtaactcattatttaatatggaatatctactgtagtggaaatctagaagaaatatgagtgctgaataaggtagtaagggagatttgtagtctatacttatttgatctttgtttccatctatttctccaattgttttttttaaaatctcatccattgatttatttattctaaacatatattttgagcatcaactatgtgtcacacactatgctaggcaataagtatgcattgatgaataaaccatgcataattccctcatgaagcttgctttatctgtagcagtagacgcaattttgctcctgttacccaggctggagtgcaatggcacaatctcggcttactgcaacttctgcctcccaggttcaagcgattctcctgcctcagcctcccgagtagctaggattacagacatgcaccaccacgcctggctaattttgtatttttaatagagatggggtttctccatgttggtcaggctagtctcgaactcctgaactcaggtgatccgccctccttggcctctgaaagtgctggaattacaggcatgagccaccatgcccggcctctttgttcttttaaaaggtacagttattattgactgtagtcaccctgttgtgctatcttcgagacagggtcttgctgtgtcacctaggctggagtgcagtggcatgatcttggctcactgcagccttgacctcctggactcaggcaatcctcccacctcagcctcccaagtagctgggactacaggcacaagccaccatgcctggctaattttttaattttttttgtagagacagggtcttaatatgttgcccaggctggtcttaaactcctgggctcaagcagtctgccaaattcccaaagtgctgggattacagatgtgaaccatcctgctcagccaaatactaggtcttattcattctattttttttttttttggtacccattaaccatccctacctccccttcacccctctactactcttctcagcctctgttaaccatccttctctatctccatgagttcaattgttttgatttttagatccataaataaatgagaatacaagatgtttgtctttctgtgcctggcttatttcacttaaagtaatgacctccagtttcattcatgttgttgcaaatgacaggatctcattttttaaatgactgaatagtactccattgtatataagggccacattttctttatccattcatctgttggtagacacttaggttgcttccagatcttggctattgtagacagtgccacaactaacataggagtacagatacctctgtgatatactgatttcttttctttggggtatatactgagcagtgggattgctggatcatatggtagctctatttttagttttttgagaaacctccaaactgttctccatagtggttgtattaatttacattccgatcaacagtttacaagggttcccttttttccacatcctcaccagcattcattattgtctgtcttttggataaaagccattttatctgggatgagatgatatctcattgtagttttgatttgcatttctctgataatcagtgacgttgagtaccttttcatatgcctgtttgccatttgtatgtcttcttttgagaaatgtctattcaagtcttttgcccattttttaattggattattagattttttttcctatagagttgtttggagctcctcatgtgttctggttattaatccctcgtcagatgggtagtttgcatatattttcttccattttgtgggttgtctcttcactttgttgattgttttctttgctgtgcaaaagctttttgccttgatgtgatcccatttgtccatttttgcttaggttgcctgtgcatgtggggtattactcaagaaatctttgcccagtccaatgtcctggagagttctcccaatgttttcttgtagtggtttcatagtttgaggtcttagattcaattctttaatccatttatgtttgattttttatgtggtgagagatagaggtctagttttattcttctgcatatggatattcagtttttcagcacactttttgaagagactgtcttttccccaatgtatgttcttgaggtttaactcgcaggcaacctaagcaaaaatggacaaatgggatcacatcaaggtaaaaagcttttgcacagcaaagaaagcaatcaacaaagtgaagagacaacccacaaaatggaagaaaatatatgcaaactacccatctgacgagggattaataaccagaacacatgaggagctccaaacaactctataggaaaaaaaatctaataatccaattttgttcttgacacctttcccaaaaatgagttcactatagatgtgtggatttctttctggattctctattctgttccattggtctatgtgtctattttcatggcagtagcatgctgttttggttactattcctttgtagtataatttgaagtcaggtaatatgattcctcctttttttttttttttctttttaccttaggatagctttggctattctgggtcttttatcgttctgtataaattttagggtttttcctatttctgtgaatgtcactggtattttgatagaaattacattgaatgtgtagattgctttgtgtatgtactgtgaacattttcacagtattgattcttccaatccatgaacatggaatatctttccttttttttttttttttttggtgtcctcttcaatttttttcatcagtggtttatagttttcattataagcatgtgtacaaattcgtagttacaaattataattctatgactgaaataactagggagcagtacatagattaaatgttaggcaaggccttcatgatggagttataccgagtgaggtttgaagaataagtaggagccaggcatggggtaaaagaaaaagagtcatttaaacaaaaggcatattcaaagccccaaggtgggagagagtttggcatgtttgaggaggttgaagggagggcaatgtggccggatcataatgtagtggggctgaatgaggaaactatggagaagtagataaggatgaaatcatgtgaggctttacagactgtagtaagaagttttgatttttttccccaagaactatgggaatacaactgaaaggttttcaacatgggagtgaccatgtttgtgctttcaaaagatggctttggatgctgtgtggagaagagactataggagataaggatggaaagaaggaggccagtagggaggcaattgcagataagaggtgatactcaagaggagatgacaagagttagataaacttaagacatattttggatatagaacctacagggcttactgataagctgaacaggaggcttgaggcaaagggtcagggatcactctagatttctgattagagaaactgaggtgtatgtttgcattgttttctgagataaggaatactagtcctgggcaggcttatggggagagaatggaagttgaagtggggagtatagttctaacatgataagtttcagatgactgtgagactgtcattggagatgacacatagttgaatatatgagttcagagtttagagagagtgatatacagacagtctccagcttaccatggtttgactcaatgattttatgactttatgatttttttgactttatcagaactgagccttgtaagttgaggagcatctgtacatttgggattcaccggcaaatagttgatatttaaagtcctggtactaatgggatcacttgggggaaagttatagagagagaaaagagagctcaggaccagcccaatcttttgaaaatctgcagcattataattaacttaattttctgactgatttagatgttatctgacaatcacagagaattctgcatctccatgttcttttcacagctcataaaggcaatttaattatttatttgtaaataattaaagtattagtctgttctcatgctgctataaggtcatacccaagactaggtaatttataaagaggtttaatcaactcacaattcagcatggctggggaggcctcaggaaatttacaatcatggtggaaggcaaaggggaagcaaggcaccttctttacaagatgacaggaaggagaagtaccaagcaaaatggggaagagccccctataaaaccatcagatctcatgagaactcactcactatcatgagaacagcatgcaggaaactgcccccatgattcaattaagtccacctggtctctcccttatcggggttatagggagtacaattcaagatgagatctgggtggggacccatatcaaagcctaaccatatcaaaatatttatttataaaaccaaatttattttgtaagttaaatgtgttaacctgaaacccacccaccccctccccatttttttgagacagagtgttgctctgtcacccaggctggagtgcagtggcacaattggcttactgcaacctccacctcccaggctcaagcgatcctcccaccttggcctcctgagtagctgggactgcaggcacgcaccaccatactcagctaatttttgtattttctgtagagatggggttttgccatgttgcccaggctagtctcaaactcctgagcttatccgatccacccacctcagcctcccgaagtgctgggattacaggcatgagctgctgcgcccagcctgaaaaccccctttaataaaatatctttctttagcctattaataaacttttctggaaaccaaacattattttgaacacttccctctcaagggaaaataaatgtagaaggtggaggaaactcaaccaaatatctaatttgccaagaactttccctagaagcttgtttaagtaagtcagtcagtcactgatagcaatttctgttcttgtctataacctcttctaaaaacagaatggaaaatggaaggaaactttcccttggatggggatttccaatttaaatttgctctattcaggccctatgtcctatatcaatagtaaaagttgattgatgtttgccttggtaggtgataatgctacagctcaacctttcttctggatttatggctttgttttttatatttcttgtctccatatgtttgttccatgtgtttctttggaattttttttttttttaaacatagtctggctctgtctcccaagctggagtgcagcagggcgagctcaggtcattgcagcctccacctcccgggttcaagtgattctcccgcctcagcctcccgagcagctgggattacaggcgtgcaccaccatgcccggctagtttttgtatttttagtagagatggggtttcgccatgttggctagactggtctcgaactcctgacctcaggtgatctactgcctcagcctcccaaagtgctgggattacaggtgtgagccactgcgcccggcctctttggagatttttgagctagatgtacatcttaaagattttttgttttaaaagtcatattaaaaccaatcctacccaattccatttctcttggctttttaggtaacccgtaagtaactgtggatattttgttttgcttgcaggttggcttgcttgccttgttaactccgtagctctaaaactcaccaaagttaattttaaaaattattctttctaacatgaagcacttcagagttctattactttcaccttactgtaccaaaaaatactttttttttttttgagaccaagtttcactctgttgcccaggctggagtgcagtggtgtgatctcggctcactgcagtctttgcctccccggttcaagtgattcttatgcctcagcctcctgagtagctgggattataggcacgcggcaccacgcccagctaatgtttgtgtttttagtagagatggggtttcaccatgctgtccaggctggtctcgaactcttggactcaagctatccacctgcctcgcctcccaaagtgctggaattacaggcgtgagccaccccacccggcccccagaatactttttacactaccaggaatatccacctataagccctcctcttgtactccatagcaccttgttacgagaccgctagctcctctgccttttttttatttttattttttatttttgtagagatgggggtcttgctgtgttgctaaggcaggtctaaaactcctggcctgaagctgtcttcccgccttagcctcccaaagtgctgggattataggcgtaagccaccatgccaggacttctctgccttctttagttattgttcctgtacccacttaaccttttgtaaatatcattattctcttttgggagggagggagatttctttctttgttaatgtagtctctaggaatagggatatacactctttttaatattactattttgattcttgaatgggagccaagagttcatgttgatgttatactgtgctgttatggccactgagtaatattaataatagtcaccaattccatgggattgtaaaacaaattgaaagctgtaaactctccattttcaagaattagagctggagttagtttaaaaacaaacatgtgcataatacaaaagaaacaatttaaccctttaataactttgaaaacaaagagcaatcataatgtctaatagacaactgctttccaccagtgtttttccatttaacaaaatcaatcaggcttattaaaggatttggctgaaataagagttccctatgttgtattaaggacagtaactcatttcagtgttctacaatgtaattattcatctgttgttgaacatttgagctgatatatgtaatataagaaaaaatagggaatatttttgtataaatatttatacacctctctatttctttaaattctgtaatcgactaataggtcatgaacatctttaagatttttgacacaatgtcatattactttcagaaaaattttactattttacactcccagccattagtatgtgagagttcctctttcacttttcccaggtttggaaacatttataatctcttatctttgccagtctgaaagatgaaagtggagcttgttttattttgcattttttattaattaagtagggcatgtttatttttatgatttattttcttatttattttaaaaaatcaaatgaatcagaaagcactaatataaatagaacagtgtatctttattccacactgacatgaaaaagaattgcctacaaatggctgcaagagagtatattttcaaatcttgttgtcttgagagattagatgtaaacttacaattctgctatgaatatctcaagctctaaacagtattcagtaggatgttaacattctgagtccaatgttccagaacataaatttgccagttctctgaaaacactggaacagaaatggaaaattcaatagccctacttcagtgacttccttacaatccaccaatgggcaaaatgcaggcaagactgccagctgctctgtatctgcaaacatttgtgcagaactaattttaagagcagatgttggaaataaagagaaaaaaaaaaacaattgcagcctcccctctgagaaagttagacctatcccgtgacttctcagatgccccataaccctgttagccagagtttcattccaaaaataccatattttgcttccttactttctcatgtgaaaagttttagaaatgcttaagggaatataacaacttcaaaaagtcttagtactgcttcagttggccctgtatgatgttgtcatatatagaagagtctttgtctgcaattagagtttactcatgaaagattccattctgacctttggggtgtgcagacttcaattgtatcatatccatctaaaagaaagcctgtttgttttgtattgaggtagaaattacagattatgaagagaaaaactctaagagaaaactcttatttttatcaaatagacaatgaaggcatggtagttcagtagaaatttgctaaatcagtgtctgaatgatttcatgtacagattttagatttatggtatcagtattccagatctccaaacaagttcacacagaccccagtagatgcctgtgtgacacttgtcagtatcctcactcacatgtcagagtttaatcaaatctggtttttcctgggacttgcttactgctaaaaggctaaagacgttcttttgttattattcgattttaaaatttatttttgtttaattttttaaactaggtaagacatttacaaagttcaaaagtcaaaacctcataaagggtatataatgaagtcatcctctactttcgtaccctggccatccagttctcctcttcacaaacaatattaatagttttctttgtctctttgcatgcatagacatgcaagcatacacacacacattcttctcttttacactaatggtgacatactatatacaatattgcatattttgctttttttttttttacctattctgctttagaaatatttccatattagtacatcaaaaacttccttgtttttatttatttcagataatattccattatatagatacaccataatgtatttaaccagtctccaggatatcgttattataataaatgctgcaatgagtaacattgggaaaatgtcatttaacataattataatcaattcctagaaatagaattgcgggcccaaagggaatagttttatttttaatagacataaagctaggatgggacccaaggtcctatcctaaaaccaaacctgaaaaaaaaaatagtaccgaccaatatcccatgcaagaagtccatgcctaaactccaggtttttttctaggatcaggccaatgactatcataaacacctatgatttagtatctattcctactgcctatgaggagagttctgatttcaactgggcctgcactctgtgcagagatcaacacagactgatttctgcaggcgaccttcctgcacttcatatggtttatgagaaaaagccgttgtcaaaagcagcttattctttcctgcaattttcttttcagaggaactcttttctttggcaataatcagggggtcttattcacaagggtctctgctaatctcttgccctgggcagggtaattcttccctatgacttggcagttccccgatctttcatttcttccttgatgctctcctattttgggtctctagtctcttgcttttgttagttagggctaaattcttgtcctgaatcttccctttggcctaaagcttagagacccaaggtgtttctctttggcctccataaagacacaaagcatcctaggcaagggacactacaaggggacagccttgtggctatctctgaagccctacctcaaagttgagcttccgctcaccagcaagctgctctttaagttatggttggcttggatttcgggcaaccaacactcttgattgtaggaggcattccttgattactgaagtccctagattactaagatcctcctttagcttttgggagtttctcaccccagtggttctcatgacacctcccaattatggtttagtaggtaagaccccttgtattgaccatctctctagaatctctgtccgttgaagcaatttctgaattcatctccaaaatccttttcctaagatggaaactagtttagagaaatgttcatttctttgagaaacatctctttttagacactctcactcctctgttctctggctctggggcattgctattttatggctagaatcttttgaaacacttctactcttatccctttacttatttcctgacattgctcaacctgtaatcagctctgagctacctctattagcattctataaagtcccacttttctaggttattttccatgatgctggatgagagggactgaaaagtctgccaatttttctccccatccaagggaacggggaggattctgcaggcccatgaccaatattcgacagggcttcttccaagaatttcctggtgggaactgagtttttttttttttttttgaggtggagtcttgctctgtcgaccagcctggagtgcagtggcacgatctcagctcactgcaacctctgcctcctgggttcaagcaattctcctgcctcagcctcccaagtggctgggactacaggcacaagctgccacgcccagctaattttttgtattttagtagagatggggtttcaccttgttgcccaggctcatctcgaactcctgagttcaggcaatctgcccgcctcggcctcccaaactgctaggattacaggcatgagacaccgcacccagccgggaactgaattttatgtgagcaccttgtcttctgcctccatgagggttcccccaaggcgcttggcaacctccctatggtgttggctactgaactgtgggtgaccgagaagaaaggcagactaggacaaaatgtgtaattgggcttctctcatctttaacaattttatggattcaaggatcttgaggggtaggtactacctctgctgtacccaaaattaactgagtttttagtacatgtcaagggtttagatcagggaagaagagccctagagagttattcaggtgatattcttctcagagagttttaatcattggtataactgtttctccaaagaatagggaatgaatctctttgaaagattatacctgaggtttacaagctttcacttagctccttctaggcagcttctctcatcatagtgcacttaatcaattagaatacaaaatgaccttgttacagtgtgaggacatcttgtggtcagaatgctatataggaaattaattgcaaatataagaccatcactcactttacccccagttcagcctggtagttcttaattttaggtatctctagccttccttgatatcaatctaggttcctcttctaatactagagctaaatctttcagttctcttatttattaaagaaggaatagagctctttacttgcgaggaaataggctcttttcacaatcatctgacacctaactttgtagtctcagcattctaagtaacagcgatctttctgcacttgtctttctttcctggcatacatccccagacaaatgttcaagggatgcttttccctcctttcttactcagtgtcttcttttcttcagatgcctttctgaagttgcttagtttctctaaaatatctgccttttgctgttcaaaccttcattctgtaaggaaataacagaactccacctctttgcacacatacagtgatcatactacctgatacacacgttagcatctctaaaacctaatttactttcatagtccaggtcccaaatcaagctacacagattttttttgttaagtgtttttgtggcaggggctgggggaagttgatggttgtatttaaaccacagatagctctcatatattggtctgaggagagaaataaataactagaatgctacagttttaaagactgtaaaactaatatgtaaggtgatttacaagtgaatggaggtcaaaagaattgcatgctttcagcacacacagagttaaccttgcagtatctccttgttttgccagcctgctgttacctcatgaagttaacaggactgatcttttaaaaactcctacacagggctggatatgttggcttatgcctgtaatcccagcactttgggagggagcaggaagatcacttgagccgaggagtttgaaatcagcctgggcaacagggagaccccatttctaccaaaaaaaaaaaaatcaaaaaattagctgggcgtggtggcacatggcctgtagtttcagctactcaggagactgagatggaaggatcgtgtgagccctggtgatggagtttgaagtgagccgatatggcactactgcactccagcctgggcaacagagcgagaccttgtctctaaaaataaaaataaaataaataaaactacacagaacaggagggaaatcagcagctaacttaatagcagaagcctaacccaaaatggaaaataatagaatatttggtttgcctaaggagagagaaaccagcctctctatgaatttccatttcagttctcctcagccatttaattagcaactagacacataactccaagagcttctcttttgtgccctgatattctaggtctagaagttctgagatgctgttgccatttttttctcattgttcttttcatgggttttcagacaggagtgaacatctacctctggctccttggcttttccctgtctgtataaacttgtttattaacttgttgttttttgtggatgattacttctcagaatctgtcatagtacctaacttggtgtgcattttgcactatataggtgttgatcaaatacaagtagcagccctctatgtaaaccgaataacttgtacatatgaatgactgcttttgcatctcactggagataaccccactttgcttttggtagttttgctatcagttgctagtttaggaatccaagcattagttaggaatgtttctgtgagaaaacataattcaatatctacacataaatttctaaatgatctttgtactgcttgttttcagttaattgatttttctaaactggtttcaaattcttccagcatatagtctcctttgctcccttatttcttttctttcttttttttttttttttgagatggagtttcactctgccacccaggctggaatacagtggcacgatctaggcttactgaagcctccgcctcctgggttcaagcgattctcctgcctcagcctcctgagtagctgggactgcaaggcacccaccaccatgcctggctaattttttgtatttttagtggagacagggtttcaccatgttgaccaggctggtctcgaactcctgacctcaggtaatccgcccgcctcagcctcccaaagtgctgagataacaggcgtgagcctccatgcccagcctgctccctcatttctgatatttgtaaatttattgttcttcatcttctggtagtctttagaagacactaatttttaattaatcacaattagactttgtttcaggttccattgctattttctctgcagcttcaactatttctgtcttttataggttaaattaatgaaaccaaaccccatttgggttcagtgaaatctgtgataggaattaaggtcagcaaagtcttcttccccttcaaggaatgattttttagagtatttgtgatttattcttggtatccatgattcttccttaaactagggttagaagttccttagagccctgacaaatgatacagtgcatttttactctcagcaaattatctgccaggaagaggttgaatcccaagtcctccctctttattttatagactggataggaaactgggttgtaaagctttcctgctggggatctctaatttccaaattgagtttaaactgctgattctctttcttccctccaagctctgatgttaaaataaatgttatctctccacacagctgcagtgatttaattgttgtgctgtatcaatcttaagttgcagaaattactttacacttcttttaattgtagacttaccattttagaatattaagtctgtttttgtatctgagtcaaatatgtataatagagaagacatttatctcttatttcaatttggttgtagagaaactgtttcttcagtgcctggagaagtcattggaatttggaaacccactgcttaactgttttcataggagtgatatgattccaccattctagttttaatgcagtgatttaagtgctatatacagaagcaaatactttggaccagtggctctgaaactttaatttatatctgaattacctggagggcttgtgaaaaacacatttctgggcactacactagatttttatttggtagatcaggggtggggcccaagaatttgcatttctagcaagttgtcaggtgattctgctggtctggagaccacactgagaatcactgcttagaggatttttttctctcatttcagaaacatgcccttttagggaagctgattatattagaaaaagagaagggaaaaaattcaaaaacaaaaaacaaacaaaactacctcaaggagatgacagcgttgtttctttttttttttttttagtaagtattcagattatctctgtgtgagggtgtgaatttgcaactacaagtaatgtggcatttgtatgggatctgagatgtgatcaagtgaacattcaaagaatgataagcaaaatctttaaatcttatcaccgttagttgcaatagaagacttagaaagacaaggagagatattgtgaaaaagtatgagtatatctataagagacctgaattaaaatctctactctaccacttagacttcatttatatgaatttggagtgtgtaaccttactgggttcttttagtatttttttaatctatctatctatttatttatttatttatttatttatttatttagatggagttttgctgttgttgcccaggctggagtgcaatggcgcaatcttggctcactgcaacctctgcctcctgggttcaagcaattctcctacctcagcctcctgagtagctgagattacaggcgcctgccatcacgcccagctaattttttgtatttttaatagagatggggtttcatcatggtggccaggctggtcttaaactcctgacctcaggtgatccacccacctcggcctcccaaagtgcaggggtacaggcgtgagccaccgcgcccagcctagtattgaatgagataagaaatctgaaatgctttacctatggtagctgtccatcaaagttactttcatagaagctggcatcctcagttgcttttgtacactcaggaatcttttcaaagtttaagggtgataaattttatccaaagtaattactcgtaaaataattggatcccaacaattacacccctgtgcatctgtagaagtgcagacatagaagatgtgggacttactctccaagcacacaaaatctacttatagatttaggattctttcttttgaagtaccagaataccatattaaaagtgagataatgtttaagatgagaaggccaggagcaaggcaattatagacttgatacagtgattaatgcagttgtcaaggttctgagttctgtctgtctgctctaccatctttaacttgcttccttttgtccttgggcctctctttttgaggtcacaaaatggctgtcacagctctagatatcaaatctgcataactgcatccaaaggcatagaaagggcagtttgttttctcaaatctcctttgtcatggtggaaaacttttcccacaagccacagcagacttgtcctcaagccttgaagaccagtattaagatgtatgactgttctgggcttcagggaggctaagctgaaaaggcaggtacttggcattgttagcctgagtactggactggtaggtaaaagaggttagagatgactgttgggtagacaacagaaacagaagccacagggagacaagactgcacagattagagaacagttctgggcaatttatcattaggctgaattgtgtgctctaggccaggagttggcaatctttttttgttgttgttgttaaggaccagttagtaaatatttcaggcctcccctaaagatgccaaaagccacatatggtctctgttgcacattctttgtccttttttttaaaaaaaaaacaatcctttttaaaatgcaaaagccattcttagcttgctggctgtataaaaacagaccatgggccacatttggcccacaggctatagtttgccaacccctgcctacataaggaaggttcagaagggatctcctacttcagtggggctgaagtaatcattttgaagcctcctgaaattctgggatttgactggtgctttgaaggatgggtgagatttggactgagagatgtgttccttctaaagggcacagtgagaggagaaacaagcctatgatacttaccataacacagttgtgtgttacgtgcaatgagtgaagagcagcaatacctttgcaaatgaaataggctaattgcaggccagagttagggagtaatgtggcatgagtatcttgactctcttagccactgacaggccaagctgctaagaggctctgagaaatgaagatgctcttttggcttaaagcttccatgttgatctggagcccaagggaggcagtgtttcatgtaacggctcttccagtaggagctgttgctactattactattaaggaacaaatatcatgtgttcaggggagtgaagactgttggtctcttaattatacctacatacaaagattataacttatcttcaagttgtgttatttttatagcaacaaggaagaattgcaacaactaatactaagtcactgattcattgaacatttattgaatgtttactgtgtgccaggccctggcagtacaagttgagaagctcatagtccagagggggataaagaacctgtatagcaataattacagtagtgagttaagagttagaaaatgtgtgcacaaggaactgtggatgcctggaagaaggaaccagtcaatttatcctgatttaaattttcaaattgactcagttaaattcagtaaccacagattgtatccctaatactagacaatttgcaaatctgtaccatttatcacgaaaaaagcctatgtaaaatactatgagtggattaaatccaaatcatcacctctccagaaaaagctatttcaaacattctgtggctgatattaagtttttgcgatcctctttatgtgcaaagtatataactatagtgttgtatttcccattgtacttaattaattttttgcttcccagtttattggtgtaaacactggattctagaaaacaattgtttccccccagtaaagccttcaaagacgaagattatgggccaggcacagtggctcatgcctgtagcactttgggaggcccaggtgggcggatcatgaggtcaggagttcaagaccagcctggctaacatagtgaaacctcatctctactaaaaatacaaagccgagcatggtggcgggtgcctgtagtcccagctacttgggaggctaaggcaggagaatctcttgaacccggcagtggaaggttgcagtgagccgagatcgcaccactgcactctagcctggacagcacagcaagaccgtctcaagaaaaaaaaaagaagaagattatggtggtgggcagaataatggcctccagtagagtcctcattctaatcagctgtgaacctgtaaatatgttatcttaacatagtaaacgagaaattaaggttgctgatcatatataactttaaaataggaagattaccctggattatcggggcaggatgcaacataatcagtcacaaaggctgttaaagtagaagagggacacccaaaactataaaaaccctagaagacaacctaggcagtaccattctggacataggaacaggcaaagattttatgacacagatgccaaaagcaattgcaaagaagtaaaagttgactagttgactctaattaaactaaagagcttctgcacagcaaaagaaactatcaacagagtgaacagacaacctgtagaatgggagaaaatgtttacaaactatgcatctgacagaggtctgatatccagcatctataaggaacttaaacagatatacaagaaaaaaaaacaaaaaactccatttaaaagtgggccaaagggctggacacggtggctcacacctgtaatcccagtactttgggaggctgagatgggaggatcacttgaggtcaggagttcaagagtggcctggccaacatggtgaaacctgtctctactaaaaatacaaaaattagccgggcgtcatggcacacgcttgtaatcccagctacttgggaggctgaagcacgagaattgcttgaacctgggaggtgtatgttgcagtgaactgagatcatgccactgcactctagcctgggggacagagcgagactctgtctcaaaaaaaaaaaagaaaaaaagtgggcaaaggagactgagcacagtagctcatgcctgtaatcccagcactttgggaggccgaggcaggtggatcacttgaggtcaggagttcatgactagcctggccaacatggcgaaaccttgtccatactaaaaatacaaaaattagctgggcatggtgggaccctcctgtaatcgcggtggctgaagcaagagaattgcttgaacccaggatgcagaggttgcaatgagctgagattgcaccactgtactccatcctgggtgatagagtgagactctgtctcaaaaaaaaaaaaaaaaaaaagtgggcaaaggccatgaagagacgcttttcaaaagaagaagtacatgttgccaacaatcatatgaaaaaaagctcaacatcactgatcattagagaaatgcaaatcaaaaccatagtgagataccatctcacagcagtcagaatggctattattaaaagtcaaaaaataacaaatgctgaggagattgtggagaaaatggaatgcttatacactgttagtgggagtgtaaattagttcaaccattgtggaaagcagtgtggcaattcctcaaagagctaaaaacagaattaccgccggcatgctgactcacgcctataatcccagcactttgagaggccaaggctggtggatcacctgaggtcaggagttcaaaaccagcctggtcaacatggtgaaaccctatctctactaaaaatacaaaaaattagctgggcttggtggtgggcacctgtaatcccagctactcaggaggttgaggcaggagaatcgcttgaactcaggaggtggaggttgcagtgagccaaggtcgtgccattgcactccagcctggaaaacaagagcgaaactccatctcaaaaaaacaaaaacaaaaaaacagagctaccattcgacccaacaatccccttactggatatatacccaaaggaatataaatcattccatcataatgacacatgcatgtgtatgttcattgcagccctatttacaacagcaaagacatggaatcagcctaaatgcccatcgatgatagactggataaagaaaatgtggtacatatacactacgaaatactatgcagccataaaaaagaacaagattatgtcctttgcaggaacatggatggagctggatgctgttacccttagcaaactaacatgggaacagaaaaccaaataccgcatgttcttataagtgggagctaaatgatgagaacacatggacacatagaggggaacacagacaccagggcctaccagagagtggagggtgcaaagaaggaggggatcaggaaaaataactaatgagtcctaggtttaatacctggatgatgaaataatctataaagcaaacccctgtgacatgagtttattcatataacaaacctgcatatatacccaggaacttaaaagttaaaaaaagagaaagaaaaaaaagtgtaagaggaacccaggaaaggaggtcagattgatgcgttaagagaactcaacccacctttaccgatattgaagatagaggaagggagccatgagccaaagaatgcagatagccactagatgctagaaaaggcaaagaaattgattctcctaaaaatagttagggctaccataacaagtataagccatttaaacagactgatcacttaaataacaaatatttattttctcatagttttggaggctgaaagtcaaagatcaatgtgttggcaatgtgttgatttcttctgaggctgaccttcttggcctgtagaaggctgtcctctccctctgttttcacatggtctttcctctgggtgtatctgtgtcctaatctcttctctttttctattttatttatttatttttttttgagacagggtcttgctctgccatctaggctaaaatgcagtggtgtgatcatagctcactgtaaacttgaactgctgggctcaagcaatccttctgcctcagcctcccgagtagttagggcgacaggcatgcccagctattttgtttttatttttttgtagagatggcatcttgctatgttgctcaggctggtctcgatctcctggcctcaagtgattctcttgccttggcctctcaaagtgctgggattataggcatgagccactacatgtggccctaatctcttttcatgagaatatgagtcatattggattagggcccacctatattggattagggcct

SEQ ID NO: 32 - DNA, 2967 bp, Homo sapiens
gcccactcgctgcggcgcttctggctccagaccgccctccggatcggaccctgcgaatggttttggctatatcttcatgtaggacctactccctatcccgtcggccgcggtgaatcccacctgcggtgctttaacttgtgtaacagagatgctgcctctgggagaggcggggagggacgggccaactggagcgggcggcgggagggtggagggcggggcgcggcttggggcctgggttcctttgccccttgcccaccagggaggggtgggagacgagagagggtgaactttcccctgcgagattctggtgaaaggggaaatatgcttcgagtcagtaaagctgcgcaagtgcacagtcaaggagagagtcttgggaaaaccaaggatagttcccggagatgacttttggactgcggaaacgtttgtcagaggaaagaggcttcagtttaatgtgagatcattggaagttgaactattcaggcggcgagcagagcccctttctccatcttcccactgtatggtcttgtcccttagcctataatttcttataaagagcgttttgaagactaggtttttactggcagggccctgattcaggctcacagtataaagagagaagtcagagaatcctagaaatttattgcttgaagaaggggttggtgtcctcatatctcaccttcctcaggctgggcttcatcaccaggcctcctcacagattcctgtcccttctgtgtcctggactccggatacctcaactctcagtactttgtgctcagcccaggtaacacgttttgttgtgtcctcagtgcctggcacttagatgctcagtttgttaaatggatagtgggagacacaggagtgtcaactatccacacatttgattggtgagccctactagccctgggtcaacgtgccctgtaagagcatgatcaaaaggaagtccagctttcctgcctctccacttgcaccccttagcattaaatttgcttccctgtgctatgaaatctgagaatcctgcctatgctgttcacaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccaggtatcagggaaatagcgagggagaggtagaatctttgttggacagtgtccctgggttgccagatatgagggtagagccttgagaagtcagtgaagagttgtcagtgtcccttccccccagggaatgtggactctggctgtccttgggtggtttccatgagcgtggccaagactgggagcagactcagaaaatctacaattgtcacgtgctgctgaacagcaaaggtgagactttataaccctttagcctgcctcttcccatgctcttctacctagattctccagaattgtttctcaactcttatttccttgacccaaggatttaggggtggtcctacttcagttcctagcctataaactatctcctccttgggaggagtaagcaaggcttctagaacaccagcactgatattccttctttcttactgtaggggcagtagtggccacttacaggaagacacatctgtgtgacgtagagattccagggcaggggcctatgtgtgaaagcaactctaccatgcctgggcccagtcttgagtcacctgtcagcacaccagcaggcaaggtaggagttgtgaaaggatgagggaggggaacaggaatactttgaactggcagtagaggatagaaagccctaagagagggggtaatggaaatatgactagatgctgtgacaaacagagcaggaagactactaagtaggctgtttttcattccaga[450 bp omitted]tggacgccaccatgagaagagagcaagttatggccacagcatggtggtagacccctggggaacagtggtggcccgctgctctgaggggccaggcctctgccttgcccgaatagacctcaactatctgcgacagttgcgccgacacctgcctgtgttccagcaccgcaggcctgacctctatggcaatctgggtcacccactgtcttaagacttgacttctgtgagtttagacctgcccctcccacccccaccctgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtc

SEQ ID NO: 33 - DNA, 541 bp, Homo sapiens
tccttttctttttttttttttttccttttctttttttttttgcacatgacagtgtttgtattgaggacctttcaaggaaaagggatgctgtaacaatggtgcctgggtgcctggccttcaatgtcccaccttcttcaccaccccacttggctcctttgccatcttgatgctgaggtttcctgtttggtgagatcaggttgtttgtggtaaaagaaaggaaagggcttctgatggctttgccacaagcttacctgtgggtttcagtcctgagaggccaccaccagttcccatcagcactgtctccatgcagcagttgctgggtcccatgtccagctgcctctttggcttcatgggtttttctgcttcctgcccccacccccacatgtgcaatcctcaagatttgtcctgattctatttcctggcacctccctgcctgtccttggggattctacttcttcctgtgtgggagcccatagctgttgtctaacaggtaagaaatgaaattgaactattgactgggccccagaaatccataaaatgg

SEQ ID NO: 34 - DNA, 61060 bp, Homo sapiens
ggcaagtgggggggaggggggaagggcaccaccggctctgcactgggcagggcggcgcgccgggtaaaccgcaaagcgcgctgaccctgagaacgcgccgagcagtccctccgtgaggcggaaagggcctggtgagccgtggcccaggcctcgccggcgcaggagaaggagaagggggcggatactgcaccttccccccggccccgcccggaccgtcccgacgtgcgctatggagcgggcctgcgccgcttcatgctgcgccgcctccactccggtcctggttgcagtggcttcctcggcggcggcgccggtgacaacccaggcggcgaacgcggcactaagaagcagcggcggcagtagcagcggccttggcctcggaggctttagcacttccggttcgttgcgatccgctttccgactggcgaaggcgcagccgggccaagaagggcgccgctgtctgctgggtggggtccaacaccacagcgcagtctagtggccggaggagccaaggaggcgcggggtggagactgggccgagcaggggatagagatgaactccagaaaggaacagcgacttgctgaaagtcacagggcaaaatgtggcgcgtctgtagtcaataaataatatatattgagtgcctgctcaaaatagacaaaattcctgtccatgtgccaggcagagagagccttagacgctgggagcaaaccagggtaaatccctcccctttcaacgagatgatattgaggaaagagactagggccttggagatctaagcgtctccttgtggtggaaagaaatctgaacctggagtccgaaacttggctctaatattaactagcgatctttcagcaggtcactcaatctatttgagccataatttctttacctctaaaagggatataatacatttcacttaattgcaattaaagaaaaccagctgggcgtggaggctcacgcctgtaataccacactttgggaggccgaggcaggcggatcacttgaggtcaggagttcgagaccagcctggccaacatggcgaaaccccatctctacaaaaaattcaaagcttagcttggcatggtggcgggcgcctgcaatcccagctactactcaggaggctgaggaaaggagaatcgcttgaacccggaggcagaagttgcagtgagctgagatcacgccactgcactccagcctgggtgacagagtgagactctgtctcaaaaaaaaaaaaaaaaaaggtatgcactttaacacataaaatgaagaaactggggcctaggggaaagaagtgaatgacttgttataatcagagccagaggcaggtcccttgacctgcaatttctttcctggtctacactgtatattggctgagaaaaagggaactcaggaagatatccaggaaagtagcaggtgtacaacaaaactgtgcaaaagcggggcctcccctattttctattattacaaagaacaatgtgtcagagtcgtgtgtcattaggatttattataatagcactaataaaaaatccatttgggtactatgctccactccacagtatataattattcactctgaggttaaatgagccttccctcaggctttttaaagttgagctcccttaaaaaaaaaaaaaaaaaaaaaggcaaagtcattttccttgggtctcttctattaattttctccaaatgacctgagagcagattttaaaggctttaaatgcacacacaaacacacacacacacaaaatacagagaaatatcttgcacttcattaattcaacaagtgtttgctgaatctctgccttgtacctgtcactgttttaagcagcggggccacaatagtgaacaaagtagataaagcccctgttttcatgcagtttatagcctaataagaagagatagagccccctccccgcaaaagcaaacaattaaaaatatataatttcatgcatttaaaaaaagagccatggacagataaaatacttgcttatatcacatagctaattatatatttgactagattggaatctagatttcttttttttaatttttatttatttttttttgagatggagtctcaatgtgtcgcccaggctgaagtgcagtggcaccatctcgactcactgcaagctccgcctcccaggttcacgccatgctcctgcctcagcctcctcagtagctgggactacaggcactcaccaccacgcccggctaattttttgtattttttttagtagaaacggggttttaccacgttagccaggatggtcttgatctcctgacttcgtgatctgcccgcctcggcctcccaaagtgctgggattacaggcgtgagccaccgcgcccggccagagttcttgatttttattcttattttcaaaccctgagaaagctgtagaggaacatctccaccgtggaacgctggccaccttgcatgcatcataggcgtaggcttgaatccagggatctctgactcttagcagaatgctgtgtgatgttcctagaatagaagaaaacaggaggctgatagggacctggaggcaacctcctcggggaggcagtcaggagacagcttctcctctcctcacagtttctgatgaggtgtggggctttctccccactccctcagaatagcactgctgaatacaaaatcatctggccgcagtctagaattggctcccgttcaacagggtatctcgcaactcacgttgcagtcatctggccccttttgtttcagtacagttgtcccttggtatctgcaggggattggtttcaggattcctggcagatattaaaatcagcggtactcaagtccctgatatcaaatggcatagtatttgcatgtaacctatgcacatcctcctctcatatattactttttttttctttggtgacagtctcactgtgtcacccaggctctggagtgcagtggtgtgatcttagttcagctcactgcaaccacctcagtctcccaagtagctggaattacaggcgtgtgccaccacgcccagctaatttttgtatttttagtagagacggggtttcaccacattggccaggctggtctcaaactcctgacctcaagcgatctacccacctcacttcccaaaatgctgggattatagctgtgagtcactgcgcctggctgactttttttttttttaattgagacaaagtctcgctgtgtcgcccaggctggagtgcagtggtgcaaccttggctcactgcaactcctgcctcctgggttcaagcaattctcctgcctcagcctcctgagaagctggaattacaggcacccaccaccatgcctggctaattttttgtattgtttgtttcctttgagacagagtctcgctctgttgccaggctggagttcagtggcgcgatctcggcccactgccacgtccacctccgggttcaagcaattctcctgcctcagcctcctgagtagctgggattacaggcatctgccaccacacctggctaatttttgtatttttagtagagatggggtttcaccatgttggccaggctggtcttgaactcctgacctcatgtgatccacctgcctcggcctcccaaagtgctgggattacaggtgagagccaccgtgtccagcctattatttttttatatcagtttttttctaaatacttttgacccgaggtaggttgaatcccagatgtagaacccacagatacagagtcaactgtattgtcgtttttgatgtatgagacaaggatcacaagcatctatcaccattgtgcatttttccttttgcactgtatgtaagtaataaactacctgaatctaaaagtggcttggccgggcacagtggctcacgcctgtaatcccagcactttgggaggccgaggcgggcagatcacgagatcaggagatctagaccatcttggctaacacggtgaaaccccatctctaccaaaaatacaaaaaattagccgggcgtggtggcgggcacctgtagtcccagctacttgggaggctgaggcaggagaatggcgtgaacccgcgaggcggagcttgcagtgagccgagatagcgccactgcagtctggcctgggcgaaagagtgagactccatctcaaaaaaataaaaaataaaagtggctcaatgtatctttactggctgaatcggtcaggccgtggccttgccaagtcttgtttgtgtggttgacaaaccctagctggctttctttgccctgcactctagggacccatcaggaaaagacaagttatctagcacatgaggtgtgatgagatagcacggccggggtgatgcaaaaccatctgtatctagcagtgggtattatcatcaacaaatatgttttaaacatctactttctgaagcacattgtgttagatactacaggataccaaaaggaggtaatctgtgctctattgaggtttataatctcggtgagaaaaaagatcataagcatgtagtacatacactaacagccattgattataggatatggtgggtctacagtttctttttccacttccccccatactttcccccttttcagggtgtagttcaaaccaaactgtaataagaaaaaaagaaggcgggcacagtggctcatgcctgcggttccagccctttgggagactgaggcagaaggatggcttgagcccaggagttcgaaaccagcctgggaaaagtagtgagactcaccgggcatggtggctcacgcctgtaatcccagcactttgggaggccaaggcaggcggatcacctgaggttgggagttcgagaccagcctgaccaaaatgatgaaaccctgtctctactgaaaatacaaaaatcagccaggggtggtggcacatgcctgtaattccagctacttgggaggctgagacaggagaatcgcttgaaccccggaggcggaggttgtggtgagccgagatcgcaccattgcactccagcctgggcaacaagagcgaaactccgtctaaaaaaaaaaaagaaaagtagtgagaccctgtctctacaaaaagcacaaaaattggctgggcacagtggctcaggcctgtaatcccagcactctgggaggctgaggcgggtagatcacctgaggtcaagagtttgagaccagcctgaccaacatggtgaaaccccatttctactaaatacaaaaaaattagccaggtatggtggcccatgcctgtaatctcagctacttgggagtctgaggcaagagaattgcttgaacccgggaggcagaggtcacagtgagctgagattgcactattggaatccagcctgggaaatgagagcgaaactccgtctcaaaaaaaaaaaagaaaagaaagaaaagcacagaaattagcctggcgtggtggcggcatctgtagtcccagctcctcggaaggatcacttgagccctggaggtcatggctgcagtgagctgtgatcacaccactaatctgggtgacagagcaagactctgtctcaaaaaaaaaaaaaaaaaaagaaaaggaaagaaagaaaagaaaagaaaaaaagtctttccctctgattttctttttcatatttaagtttttatttatgtacttaatttattttgaaacaaagtcttgcaccattgcccaggctagagtacagtggtatgatcatagctcactacagccttgaactgggctcaagtaatcctctggccggaacctcctgagtagctggaactacaggcatgcaccaacacacctggctaatttttaaatttttgtagagatgggagttgtattagtccattttcatgttgctgataaagacatagctgaaactgggcaatttacaaatgaaagaggtttaattggacttacagttccacatggctggggaggcctcacaatcatggcagaaggcaaggaagagcaagtcacatcttacgtggattgtggcagaccgaaaaaaaaaaaaaaagcttctgcagagaaactcctgtgtgtgtggttttttttttttgttttttttttttgttttgctttgttttttgagacggagtctcgctttgtcacccaagctggagtgcagtggtgcaatctcagctcactgcaagctctggttcctgggttcacgccattctcctgcctcagcctcctgagtagctgggactacaggcgcccgccaccatgcctggctaattttttgtatttttagtagagacggggtttcaccgtgttagccaggatggtctcaatctcctgacctcgtgatccacctgcctcggcctcccaaagtgctggaattacaggcatgagccaccgtgcccatctaaactcctgttttttaaaaccatcaagccaggtgcagtgactcacacttctaatcccagcactttggaaggctgaggcaggcagattactagaagtcaggagtttgagaccagcctggccaacatggtgaaactctgtctctactaaaaatagaaaaaaattaaggccgggcacggtggctgtagtcccagcctttgggaggctgaagcagttggatcacctgaggtcaggagttcgagaccagcctggccaacacggtgaaaccccatctctactaaaaatacaaaaaattgggctgggcacagtggctcacgcctgtaatcccagcactttggggggccgaggcgggtggatcacgaagtcaagagatggagaccatcctggccaatgtggtgaaaccccgtctctactaaaaatacaaaaattagctgggcgcagtggctcatgcctgtaatcccagcactttgggaggccaaaatgggcggatcacgaggtcaggagattgagaccatcctggccaacatggtgaaacccagtctctactgaaaatacaaaaattagctgggtgtggtggcatgtgcctgtaatcccagctacttgggaggctgaggcacgagaatcgcttgaacccaggaggcggaggttgcagtgagccgatattgtgccactgcactccagcctggtgacaaagcaagactcagtctcaaaaaacataaaacaaaaccaaaaattcgctgggcatggtggcacgcacctgtaatccagctactcctgaaggctgaggcagaagaatcacttgaacctgggaggcggaggttgcagtgagccgagattgcgccattgcactccagcctgagtgttgagcaacgagagtgaaattctgtcaaaaaaaaaaaaaaagaaaaaaaagaaaagaaaatgagactttattttctataaagggttacagcttgtaaggtgaccgtgctgataggctgggaagtgtagcctctcgtaaagaccagagtcaggtactttgaaggatgaaggggtgggacaggagctttatgctgaatagattggctaaacatacatatgcaacaggttataggaggaggtatgaatattcatgaaggtggtcctgaagcacgaatattgaagaaacatgtatgttacatatgacccatgttcaccttgcagtggagacttaacacttaaatgtattacaatttgacctatatgtcaaaaggtcttttcaggacacaaaggcactcaaatgtacagcctctgtaaactagacagaactcgtccgtggttgatagtcttcttatcagcagaaggttactgaaataagtctcttgtccaatcaaagctatagttatggcttgtggaacaaggggtcagttggccagtgtctggtgaggggtaagctagaaattttaatattgattatcttaaggctagtgcttgtttagctgctagagaaagaaaaaccttgtggcagttaaacatggtttattctttaagtgtaggggtgtgtgacttaactcttgcctagcatggctttaggtcttatttataatttggtatcatattgccacaaagagtccgttccatcagtctttaaacacattattttttattattttttgttgttgttccatcagtcttatgctctctattttcacattaatgctggtcagttgttgtgtctcaaccgcaaaagggagggggtataaggaggcatatgtgacctcccatcccgtcatgacctggaactcagtttttaaggtttttctggtgtccccttggccaagaaggggtctgctcagtcaattgtgaggcttaggatttcatttttagttcacacttctgaactgtggattgacaggtagaggggaaggttttcccagtaaagatggcctacaatacccattctccaggcagagttgggaggctacatgtgtatgatctggctgtggaggattccccattagatacctgcactgatccagtcagtctccctctccacacttagctttgtaccatctagagaaacctgactttgctcagggataactggctgggtgaccctgggtggtttgaatccagccaaattctacagctcattttctaaaacctcttccagaatagaagattttatacatagataacaacaaggatgtgtatgaccccttgccaaaggcaggaaatcagccttcagccctgggaatgagcttaatccatggcaagtactcagcaaatgcttcctgtagttagtggtgactattctctgagaagggagagctggcccttggccaaatgaggctgggaaggctgcatctagaaggtaggacaaaaagacaaggctaaatttgcattttcatttgaccgatagtatcataaaactcttagccctacctatttcagcttggcactgccacttggctctgccttttaatctcccctgccaccttccagcgtattttggtttgcttttttttttttgagacaaggttttgctctgttgtccaggctggagtgcatcggtgccatcacagttcactgcatctctgaccttccaagcttaagagatcctcccagcctccttagtagctaggactacaggcacatgccaccgtacctggctaatttttaaaattttttatagagatggggtctcactgttttgcccaggctggtctcgaactcttaaactcaagcgatcctcccacctcagcctcccaaagcattgggattacagcataagccaccatgtccagccccaccctggagttttatagttcaccagaatgatactctttcttctctccatttctattttttttcttgttagatttctcttgcagagaggggtccataatagtggggtctctttgcagaaaaatttagaaacagctgataagagcattagagggaaccaaatccaactcatcaaatttacctaatttgatgaatgtggaaactcaggcctaaagaagtcattttgcagtatgttactagtggtcaaaccaggctggataggcccacttccactggacctttcttatgaagcatctgaggcaaaatgccaacattcagtcttcttctatatcaatagctttcaccttggtagaagtcagctgataagcctcaggtttcaaatacgctgaattaaaattattctattttttattacccacctaccaggatggctaaaattaaaaacattggctgggggtgggggtggtgctggaaaaaaaaaattaggctgggtgctgtggctcacgcctgggaggctgcagcaggaggatcacttgagcccaggagtttgagaccatttgagcctagaagtttgagaccagcatggccaacatggtgaaaccccatctctactaaaaataaaaaaattagccaggtgtggtggtgcacacctataatcccagctacttgggaggctgaggtaggagaatcatttgaactgcggaggtagaagttgcagtgagctgagatcgcgccaatgcactccagcctgggcaacagagcaagactctttctcaaaaaataaaataaaataaaataaaataaaattaaattaaaaagtctgaaaatactagggatatagagcaactagaactttcaaacattgccgtggaatgtaaattgaccaaaacactttgtaaaactgcttagcacacctactaaagctaatcatacacctgtgtaacctagcaattcccttcataggtatttattccaagataattaagagcatttatccccaaaagacaggtacacaaatattcagagcagctttatttgtaatagctaaaaactagaaacaacacaaatatccatcgataggagaatggataaataatttgtggtatactcatatagtcaactactacagagcaaaaccaaaaactaaaagaatgaattactgattcactcagcaacatggataaatctcatacacattatgttgatgaaagaaaccaaggcccggtgcggtggctcacatctgtaatcccagcactttgggaggctgaagcgggtggatcatgaggtcaggagttcaagactagcctggccaagatggtgaaaccccgtatctactaaaatacaaaaattaggggccaggcacggtggctcatgcctgtaatcccagcactttgggaggctgaggcaggcagatcacgaggtcaggagttagagaccatcctgaccaacatggtgaaaccccgtctctactaaaaatacaaaaattagctgggcgtgatggcggacagctgtaatcccagctacttgggaggctgaggcaggagaatcgcttgaattgggaggccgaggttgcagtgagccgagactgcaccactgcactccatcctgggtgacagagcaagactctgtctcaaaaaaaaaaaaaagaaaaaagaaaaagaaaccagacactgtaggttccatttatataaaattcaagaacagaacagacaaaaaagactctatggtgatatatcaggatagtaattactgagaggcaaagatattttaacatgaaataacctctgggatactggaaatattccagatcttgatctaggtgataattacatggatatatacatatagaaaaattcagcttaaactgaatatttaagatttacccatgttctatatgtaaactacatctcaatgtttttaaaaagtgccccatattgcatctgcattgtagtaaacacaatacaataaaatacctttatcataaaaaatattttatcgttaaaattcaagactgtcaacgtcactgctttcatcaactcattcttggcagattgcattggtctcccattgctttgcctactaccaattcctcctcctctctgacaggtctttcttgctgagcacatttgattttactaatctccaggttaacaaacttccttggctcccatgtgtctgtgggatacagtataggcacctcagtgaagcaaacaaagactttcctaatgcaccctctgcctttccagattcagggcgacctctctcctctatgcctttaatccctagcagcagaacctccttccacaaccctctctcttttttaaattttaagacagggcctcacactgtcacccaagctggagtgcagtggcgcgatctcgcctcctgggcttaagcaattctcccaccctagcctcccgagtagctcggaccccaggggcgcgccaaccacgccctgctaactgttgtattttttgtagagacagtgtattgccatttttcccaggctggtctcaaactcctgggctccagcgatcctcccgcctcgtcctcccaaagtgctgggattacacgcgtgagacgctgcacctggtccacatcttttcacctgtgaacgaagcaagcgccctgtgcttccacggcctacctggttcttactcagtcaaattcctactcgcatttcaccatcccgttctcaagggttggctctcaaatgtctgacaatggttcccacggccctcagttcctatcatcataaactctttgtgagctcagcacattcattatatgaaaactctctatattttattctgtccactcttgagctaaatgtttccagagagctagcagaatttgttttcagcgttagatccctctgctaaacaaacgggtgctaatagaatcactttgctaaataaatgggagctaacaggattgaatatgagttccatttttgtcccagagttctagttttcatataaatatttcttcccattaaattcttctctgcagaagaacttggggatgaaacccgatacagacaagacagcttaagtaagacataaatgagtgttgtctctagtttgagtttcctatttttttgagacagtctcctgcactgtccaatagaatagccaccaaaaatatggatatttaagtttaaattagaagtgaataaagttggccgggcgcggtgtctcacgcctataatctcagcactttgggaggccaaggcgggcggatcacctgaggtcgggagttcgagaccagcctgaccaacatggagaaacctcgtctctactaaaaatacaaaattagccggtggcgcatgcctgtaatcccagctactcgggaggctgaggcaggagaatcacttgaacccgggagacagaggttgcggtgagccgagatcgcgccattgcactccagcctgggcaacaagagagaaactccgtctcaaaacaaaacaacaacaacaacaaaaaaaaaacagaagtgagtaaaattgaaaattcggttattcagttcaagtactcaaaagcctcatgtggctagtggctaccgtattaaagagcgcaatgtgcaatatttccatcatcacctacagttttattgggcagcgctgccctggtctttattttcccttgttggaacgctcttccacgctgctcccacaccatgtcccctatcaccattattatcctcatttcatctgtaattacttgcatcttttaataggctgggagttctaagacagaagggactgtgtctcacttctgttgttccagtgtttagctttgaaacccaggcacacagtaggtactcagtaaacagaatgcgaaggaccgtccagagacaccagtcccaaacccttttccaggctgatcggtcccccataagtctccagccttttttattttaaagcttattttaaagcatgtccctgaagacgagtggggagagcagaccacccgctgattccaattccctaggcggccgcggcgagctgcggcgtctctgtgccccggcctgcccctatcccgcctgcgccccgcccccgcccggctcgcgccaaggcccgctgctggcgccgccgccatcccggcgcgtcactgcgcaggcgcggcccgcgagcgtggggtatctcgaggtgccgggttgcaggcgctcaggagcgctagggtttgaggcctgctttctgctcgcgccagcagagcactacctgaggcagcgaggcgcagcgagcctagcctccccgcgccctgggcagtgtggccatggagaatcaggtgttgacgccgcatgtctactgggctcagcgacaccgcgagctatatctgcgcgtggagctgagtgacgtacaggtaaaggccgggtcgggcggcgggaagcgcgcgggatcgcggctccgggtacccgccaggacccctgccccctttgtccgcgtgcgcgccggagagcctgcagtgcgccaacaaggtcggcgacgcggtgcgcttacggcgtgctggcgcttttcgaggctcatctgcagatctcgggccgggggcacaaccccccgagggctgcaggaaccttcgggtccccagagagctcggcctgggcctctcaggctaccccgggcctcttctttgttcgcagtcggcggccttcatggagcccaggcccggccctggctgcctggccgtcggggttcgagttggctggggcccttcgagatgtgggatgagcttgttgggtcaggggtgcggttgtgacagcggcttgctgggccgtagctgaatgcctgccgctggcctgagaggtccagccaggcccctcggacgttactgaggctgggcgctgccggaggtgggggagggggaggggtggggggccacacccacctcgcaaccgttcagtgatggaaatcattctcattacttttaattttaaaattcacaagagctggaggaagtgatttccccctctgttctgaaggttgtgagctcaggtttgctgagttgcacagagaacttaaaaagttcttaagttacattaagcatttctgtttgagctccttggcccttaatgtaagcaagctgaaggcacgtagtagtggagactccaggacctgtgtatcctcatgtctctgtccaaactaaagattctgggctttgagaaactggaattttcattctggaaggttctttctttctttctttctttttttttcttttcttttttttgagacggtgtttcgctcttgtcgcccaggctggagtgcaatggcgcgatctcggctcaccgcaacctctgcctcccgggttcaagggattctcctgcctcagcctcccgagtagctgggattatagacgcgtgccaccatgcccggctaatttttgtatttttagtagcgacagggtttcaccatgttggccaggctggtctcgaacttctgacctcaggtgatccacccgtctcggcctcccaaagtgctgggattacaggcatgagccaccgcgcccagcctctggaaggttctttctacagtcattcttattggaaacttctccttaacatctatggcactttgtcatctctttcactccatttaactctctctgcctctgaacaggcatctgcttggatcacccgtggatccggtaaaatgtaggtgctttctgagtgtcgacttgaatttattgaatttaatataatctttgcttctggaatataaacagttttcctgttgaaagatgaagacagtagtggccagaatgcctttaaataggctatgacattgcatggtgtgtcgtttaatgtgttcatccagactgaggctatacttttgggtcagagtatgagtaaatgttctgtgctgtctccctctactgctccacggtggtttaatagaataggaaaaaacaaacaaaatcttttgtagatggggatcaaagtccccgtctagagagggttcttccagcagtcaataaaaaagtacggaacaggccaggtgctgtggctcacgcctgtaatgccaacactttgggaggccgaggcgggaggatcacctgaggtcaggagttcgacaccagcctgaccaacatggagaaaccccatctctactaaaaatacaaaattagccgggcatggtggtgcatgcgtgtaattcactatgttggctactcgggaggctgaggcaggagaattgcttgaacccgggaggcggaggttgcggtgagctgagatggtgccattgcactccagcctgggcaacaagagtgaaactctgtctcaaaaaaaaaaaaaaaaaagtaaccatctaaaaatttttggggaaaaataaatcatttttcccccttattgagtttttgttttctctggggtttcacatctgtagttttgaggcacccatatttcaactaccattagtttaaaagcatgatgttaccctcataaaagagtgtttacatgtgttagcaatcctctaacacatgtaaggtagtacagatttacaaaggtgagtcagacccagcttttcaagggcatgctatctagaaggaggcgtatcatatacaaacaaaaagttttgtgtaggagtatgtttattggtagaattggagttggatgttgaaccaggtatctggtgttaaaggaatttgttacctttctttcatttagttagtgatgacttccagaaatgagaattatttttgtcaaactaagactgggagaatgttccagaaagagaaaggcatagacttttagacacttgtaatctctgacttaagccgtgtcaatgcccaaaggccaccaataacacacccgtagttaaacaagttgggtttattactcattgcattgagagagcatactccatggggaaccctggggtgtttcattaggagggtgttagaactgattataggatttgggtgttggtgattaggggaggggagggttaaggaggttgggtttcacttcagataagatcctgtaagaaaatatgggagtttcgtggttgggtatctgaataaatcttacctgtagggcagggagactagtataagaacaaaactgtaattgctacaggagtagcagtcactcaatttggccaaagggtgtttggtatttcgtgagtggcatagccactatgtatttgtctgtgcttataacaaaattgtgaaatggcctttgtctcattttatgaggatttcagagtaaccttgtctgaggttggtattctgtgagattgtttatgtcccataggagaataacatggcctggctgtgagtgctatgcctgcttctggagtgtcacgggttgccttttttttttctttctcaactgattgctctatgcagggcctgttgaaaccagtggttttacatgtgcagatttgttatttaaaaaaaaaaaaaagaaagaaaagcagccgggtgtggtggctcatgcctgtaatcccagcactatgggaggccgagacgggcggatcatgaggtcaggagatcgagaccatcctggctaacacggtgaaacctcgtctctactaaaaatacaaaaaaattagccaggcgtggtggcgggcgcctatagtcccagctaccaggaggctgaggcaggagaatggcgtgaacccgggaggtggagcttgcagtgagccgagactgcgccactgcactccagcctgggggacagagcgagactccgtctcaaaaaaaaaaaaaaagaaaagaaaccagtggttctggctctggatgaagcacttcatttatttgttcagtaaaaatcgtttatggagtacctactcttgtctatcattaagctaggtgtggggttcttggacagcactttaacactctctgctttctatagcatgacccacagcttatgtgtaagtgtgagttttaaagtgttaagttccagtttggaggcattggctctgtctccctccatcctgacacagggaactgtccagtcatcacatctctattctgtcttggatgctgcagggctagtgactatgagagaacacggctgatgtgaggagaaatggtggacaataaagacttcagcagtggcatcgtctgtgcttgaggtgaacggtagcaaagaggccagctaaagcagggttactttcaagattgaatttactttcacgatgaacataatgaacgtgtttgtcccgagaaacatagttgttaaagcattggtttatttacaaggtgcttgtttgttttgggtgttgtgagcagagaacagagcgtagctgtgtttgagagctgtttgaaagatattgttcctgtccttacctaacagagtctggtggaaagagtgctaactgaacacatgagattgggtccttgttcttattacacttatgctctagtgaccatgattcacttaacctttatgaacctgacgctcttcatccagacagatatgaacagtagtgcctaactcataggaccattttgagatttgaattggaaaatggatttgaaagtgctttgcaaattctagtgtgcagttcaagtgagtgattatgatgattgcgatattaaaccttagatgagagggatggtcacagagcaatggaagaatagagcctattagcagacctattcatatatgaaaagttaaggtatgacaagaggcgctcttacaaattaatgaggagagaatgacccattcaggaaattgtactgggacaattggtaatccaaatggcaaaaagaaaataagatcctgccttatgccatacacaaaaatcagtttcaggtgcattaatgacctaaacgcataaagaaaaactactaaaaagaaatataggagactatctttataatattggaaagggggagaatgtgttaagcaagatgcacaaaacacaaaccctaaagacaaagattggcacatttaagacaaacttgaagaagacatttgcagtgcatatcattgagagatgactaatatcacgactatttaaagaacacctacagaccaataggcaaaagacgtattacctaatagaaaaaggggcagataatataaacatttcagagtaaaaggaaacaagaatgaccaataagtctgaaaagatgcttgactgcaattatgaccaggcacatgtacaggcataccttgttttattgtgctttgctttattgtgctttgcagataatgcggttttgacaaattgaaggttgtggcaacaaagtctgttggcgtcatttttccaacagcatgtgttcatttagtgtctctgtgttgtattttgttaattcttggaatagttcagattttttcattattattatatctgttctggtgatctgtgatcagtgatctttgatgttaactttttttttttttttgaggcagggtctcactctgttgcccaggttggagtgcagcagtgtgatcatagctcaccgtagccttgaactcctgggtttgagcagtcctcctggctcagcctaccaagtaggactacaggtacctgcctagctaattttcaattttttaatttttttagaggtggggtctcattatgttggccaggctggtcttgaactcctggacttaagcaatcctcttgccttggcctcccagatccctgaggttacaggcttgaaccactgtgcctagccttgatgttactattgtgattgtttattatttatttatttatttttgagacagggtctcactctgtcacccaggctggagtgcagtggtgtgatcttggcccaccgcaacctccgcctcccagcctcaagtgatccttccacctctgcttcccaagtagctgggactgcaggcatgtgccactgtgcccagctagtttttgtattttttgtagagacgaggttggtctcgaactcctaagctcaagtggcctgcccacctcggcctcccaaagtgctgggattacaggtttgagccactgtgcccagccaccattgtgattgttttatggcaaaatgaaatgcacctatataagatggtgaacttaatcgataaatgtatgtgttctgactgctctcactggccattcctccatctctctccctctccttgggcctctcctctgagacacaacaatattgaaattaagccagttaataaccctacaatggggtcgggtgtgatggctcatgcctgtaatcccagcactttgggaggctgtggtgggtgtgtcacttgaggtcaggagaccagcctggccaacatggtgaaaccccgtctctactaaaaatatacaaaaattagctaggtgtggtggcgggtgcctgtaatcctaactactcaggaggctgaggcaggagaatcacttcaacctgggaggctgaagttgggtgagctgagatcacgccaccgcactccagtggcagagtgagactctgtctcaaaaacaaaacaaacaaacaagccctacagtggcttctaagtgttaaagtgaagagttgcacatgtctcactttaaatcaaaagctagaaatcattaagcttagtgaggaaggcatgtcaaaactgagacaggctgaaagctaggcctcttgcaccaagcagccaagttgtgaatgcaaagaaacaatttttgaaggaaattaaaagtgctattccagtgaacacccaaatgataagaaagcaaaatatccatattgctgatatgaagaaagtttgagtggtctggatagaatataaatcagccacgacattctcttaagccaaagcctaatccagaacaaggccccaactctttcaattctatgaaggctgagaggtgaggaagctgcagaagagaaatttgaagctagcagaagttgattcatgaggcttaaggaaaggctccataacataaaagtgcaaggtgaagctacaagtgctgattgtagaagctgcagcaagttatccagaagatctaactaagatccttgatgaaggtggctgcactgaacaacagattttcaatgtaacagccttctactggaagaagatgccgtggaggacttttatagttagagagaagtcaatgcctggcctcaaagcttcaaaggacagtctgactcttttgttaggggctaatgcagctggtggcttgaagttgaagccagtgcccctttaccattctgaaaatcctagggcccttaagaattatgttaaatcggccgggcatggtggctcatgtctgtaatcccggcactttgggaggccgaggcaggtggatcacctgaggtcaggagttcaagatcaggctgaccaacatggcgaaaccccgtctctactaaaaaataaaaaaaattagctgggcatggtggcgggcgcctttaatcccagctacttgggaggctgaggcaggagaatcgcttggatctgggaggcagaggttgcagtgagctgagatcgcaccactgcactccagcctgggcaatagagagagactctgtctcaaaaaaaaaaaaaaaaagaattatgctaaatctactctgcctatgctctgtaagtggaacaacgactcctggatgatagcacatttgtttacagaatggtttactgaatattttaagcccactgttgaggccaacttctcagaaaaaaaaaaaaaaaaaaaaaaaaatatatatatatatatatatatatatatatatatatatatatgtatattcctttcaaaatattactgctcattgacagtgcacctagtcccacccaagagtgctgatggaaatgtcaaggagattaatgttgttttcatgcccgctaacataacattccttttgcagcccatggatcaaggaataattttgactttcaggtcttatttagaaaatactttccgtaaggttaaaactgtcgtaggtagtgattctgtgatggatctgggcaaagtcaattgaaaactttctggaaaggattcaccattctagataccattaagatcatttgtgattcataggaagaggtcaaaatataaaaatgaacaggagtttcgaagaagtggaattcaaccctcatggatgattttgaggggttcaagacttcagtggaggtagtaactgcaggtgtggtagaaatagcaagagaactagacttagaagtggagcctgaaggtgtgactgaatgcagcaatctcatgataaaacttgaagggatgaggagttgcttcttatggatgagcaaagaaagtgatttattgagatggaatctatttctgatgaagatgctctgaacattgttgaaatgacaatgaagggtttatactgtttcataaacttagttaataaagcagtggcaggggttgagagtatactctgattttaaaagaaattattctctgggtaaaacagtatcaaacagcattgcatgctgcaaagaaatctttagtgaaggaaagactcaatcaatgagacaaacttcattgttgtcctcctttaagaaattgccacagccactccagccttcagcagtcaccacctggatcagtccacagccatcaacattgaggcaggacccgccaccagcaaaaagattacaactccctgaaagctcacatgatcattagcattttttagcaatgaaatattttaaagttaaggtatgtacactgttttttagaataatactgcatacttaatagactatagtataatataaacataacatttatatatactgggaaaccagaaactttgtgtgactcactttattgtgatattagctttattgtggtggtctggaacagaacctacaatagctccaaggtatgcctgtaaattaaaatgataggatactgtttctcacattagagtaggaaaattgaaaaagcctgacatgaccaagtgtttctgagaatgttcagtgacaggactttttttttttttttttttttttttttgagatggagtctcaccgtgtcaccccaggctggattgcaatggctcaatcttggctcactgcaatctccgcctcctgggctcaagtgattctcccgcctcagcctcccgagtagctgggactacgggcgcccgccatcatgccctgctaatttatgtatttttagtagagatggggtttcaccatgttggccatgctggtctcgaactcctgacctcaagtaatctgcctgccttggcctcccaaagcgctaggattacagacgtgagccaccgtgcccagccggactttttttatacagttggtggaagtactaattggtacaattgatttggagaacagttttacactatcttgtcaagctgaagttgtatgtctttatgagttggaagttttgctttttagagaagctcttacacatgcaggtggaggtagaatgttcattgcagcaaaaaattgaaaacagcctcaatttttgtcagctggaagaatggataaattgtggtatatttatacaatggcacactgtacaacagctacaatgaatgaaacagaaccatctttatagaattaaagcttagaaatataatatcaaataaaaagcaagttgaagaatgatataggcagtatgaaattatttttgtgacatgtcaaatcatactgtatattgtgaatgcccaacgtgttttaatgaataaataaatacagtggaaacgaccaactccaatcctggagtagtggttacctgcgaagttggggcatgtttgagggagagggcattgggattgagaaattgtataatgtatctgtttctgttttatttctttttttaaaaattgaggcaaataaagcaaaatgctaatggatgttagatatagtggtgtttgctatatttttctgtttgattttgcttgaaatatttaataatagaaatcaataagtctaagctgtttattaccacagtacaaaaactacttataaagcagtaagttaaataatctggtaactgttgaccactcacaatggtccaggcacagtgctaagtactagatattcagtaatgagcaacacatataaaggcactaccttcagattgagggagacagacaatagatatgttaataaataattacctagataaagtgctatgagggaaataaagagggtgatgaaatagagaataattggtagaggctattttaaatagagtggtcagggaaggcttccttgaagaggtgatattctagccgggtgaaacttgaaagttaaaacaaatggtgcagaaagctggggcaagaacattccaacaagtccacagacttagaggcaggcaaaggcttagtggggttccaggagcagaaaggatattagtatgtttggagtgtagtgaggaataagttagagggagatgaggatagaagggtttgcaagatgtaggtcatgtagagccttgttgccatggtaaggagcttgggttttattgtaagagcaatgggaaactattaaagagttttaagcagagaagtgactttgtaggatttgtgtttcaaaaaagattattctggctgctatgtggattataaaggggcaaaagtgaactctagaaaaccatttagggaggctgttatagtagtatgggtaagagatgaggtggctcagtttagggttgtggaggtggaaagccatggacacatttgagatatatctgaagagaaccttgaggccttgatggactcgttggagaggaagggaaaagaattaatgactagtcttaagattttgacttaagcacagagtagatgacaactgaaatgattaagactggagaagagatttaggggccaaaatcaagagtccccttttggacatactagtttgagagtcttgttataaacaatttccatgtgaaaatgtgaactagtgatataactatacaaatacagagttcagggcagtagtctgggtgaaaatagaattttatagtatcttagacttaattgattgtaaaatgcaccactattttatttttttccctcatgatgaggggaaaaatgctgctgattatactgtgatacaagctttcttattactttgagtatttttaatttattgaaagagctctctgagagtttatttaaactgttaatgctgttcagccaaagatcaccaaaacacaccttgtagttaaataagttgggtttattgcttgttccagtgagggaaaacacacatcgtagggaaacatgtggtatctcagtaagatggtgttaaaaaagaccttgttatataggatttgggctttgattatgtgatggcgggggtgtctaaggaagtggggtccgctatagattggatgttgacagaaagcagggacagttctatgatttggtattttgtggttggcatagtgacctgtcattagacaaatttatgcaatggtcttgttttgtttaattttaccatggtctcatagtaacctcaagttggttggtattctttgaaattgtctgtgtccccaaaagggggaattagaagatgatacaaacttttacatacacccaattgagtattatacagctataacaagaaagagtaaggtctttatgagctgataaggatttatttaggtgaaaaaaaaagcaagatgtataagaatgtatattgtatgctaatttttgtatagaaagaagggaaaataagaatatctgttttggccgggtgcggtggctcacgcctgtaatcccagcactttgggaggccgaggtgggcagaccacgaggtcaatagatcgagaccatcctggccaacatggtgaaacggtgtctctactaaaaatacaaaaattagctgggcgtggtggcatgttcctgtagtcccagctacttgggaggctgaggcaggagaatcgcttgaacctgggaggcagaggttgcagtgagctgagatcatgccactgcactccagcctggcgacagagtgagactccatctcaaaaaaaaaaaaaaaaaaagaaaagaaaagaatatctgttttgtatgtttgtttgagacagggtctcactctgtcacccaggctggagtgcagtggtgtgatcctggctcactgcagtctccacctctcaggcccaagtgaacctcctacctcagtctcccaagtagctaggactacaggcacatgccatcacgccaggctaatttttgtattttttgtagagacagggtttcaccatgttgcccaggctggttttgaactcctgagctcaagcgatctacccaccttggtctcccaaagtgctgggattacaggcatcagtcactgtgcctggatgaaaataagaatatctaaatatatttgcaaatttttgcaaaacacgcatatacagagaatagataaaccagaaatgaatgaaatggttaccggtatgtggggaataggaatgtggtaaaggaggatgggtttgggagcaagacttctgaggaaatcattttataaagtttgaattttgaacaatgggaatgttttacatattcaaagataaaattgtcttaaaaaaaacaggccgggcttggtggctcatgcctgtaatctcagcactttgggaggctgaggcgggcagatgacgaggtcaagagatagagaccatcctggccaacatggggaaaccctgtctctactaaaaatacagaaattagctgggtgcgatggcatgtgcctgtaatcccagctactcaggaggctgaggcaggagaatcgcttgaacccaggaggcagaggttgcagtaaaccgagatcgtgccactgcactccagcctggcgacagtgggactctgtctctctaaaaaaaaaaaaaaaagaaagaaaagaaaaaagcaaattaaataaacagaaccaaaaggacctaactgtgtatcaaattgatgacaaaatcttacagataaattaatcaatacacataatatttgaacacagtactctggtactttagtagatcatgtcctttttaaaaatcaaccttccccccttttagtggaatatattctaaggacaaaaagaactgcaattaaatgttacacttacaagggttatttctcccttttctttttttttaaattgaatacaaattttcttttttcttattttccacagggaaacttctgcaagtaattagtaggtttattgttggtaaaaaatattgatattctaattctgaaacttttttgggataaaacaaatatataaatgtactaatgttattaggaagcttttcactgtaaaagatataaatcttaaataacaaggtagggagaagccttgtaagagcttgaattggaaacttcactatgacatcgttttttaaattcctagctagcccactgaaagatgaacattgactatacctcagtgtacttagatcatggcttctacattaccatttccaaccaaagaaactatgcctccttgaaaaaatggccaattattccaaatctgtgccagaaaaagaacagtatcctcaaaagctacacggtcatgtcagaatcatacaggacttgatttgaagggatttctactggccaagtttgtgacaatttgaacatcaacaagagtaataatggtaatggaatttggctgagtggatcacaaaagaaaatctgtgagtcggcggggcgtggtggatcacacctgtaatctcagcactttgggaggccgaggtgggcagatcacaaggtcaggagatcaagaccatcctggctaacatggtgaaacctcgtctctactaaaaatacaaaaaaattacccgggcctggtggtgggcgcctgtagtcccagctactcgggaggccgaggcaggagaatggcgtgaacccgggaggcggagcttgcagtgagccgagattacgccactgcactccagcctgggtgacagagcgggactccatctcaaaaaaaagaaaaaaataaaaagaaaatccgtgagcccatagtgaaagtaaaaaagaaatatagaccagagagggtacaggctggtggtgtttgcgaaggcatcatgagggatctagagctgttcagtctctttactgtgacagttggtagatgaacctatacaggtgatcaaattggatagaacttaacacacagacgcacatgcacatacctgcaagcgaatgcaagtaaaactgggaaatctgaataacataggtgggttgtgtcaatggcagtatcctgattttgattttatactatagttttgtagaatgctaccattgggggaaactaggaaaagtgtacaagggatctctcagtactatttcttttttaaaaatttttatttttgtgggtacacagtaggtgtgtatatttatttcttagagcttcatgtgaatccatatctcaataaaaatttcaattaaaaaaagggagaggagaaaaagggaaaactcctttttacagaagaatgccaactagaaaatgaaaaaggaatgattgaattagaaaattataatgttgccgggtgcggtggctcacgcctgtaatcccagcactttgggagtccgaggccagcagatcaccagaggtcgggagtttgagaccaacctgactaacatggagaaaccctgtctctactaaaaatacaaaattagccgggcgtggttgcacgtgtctgtaatcccagctgctcgggaggctgaggcaggagaattgcttgaacccgggaggcggaggttgcggtgagccgagatggcaccattgcactccagcctgggcaacaagggaaattctgtctaaaaaaaaaaaaaaagaaagaaagaaaattataattttgtgacctccagtgtaaaattgcatcaggtaaggattaacaatggttgaccgtaccattggatgaaagagtgttgtgagggaatggcagattacattattaggtaacttgctaattacaaaaggaaacactacagtggaaagttctggcagtcaccttctcaatttaatgatcaaatttattgtcaccctcttaacataaggatgccataagtaaccatatcacctatgaaatatttttgttaaaaatggttaatatgaaggaatggccagacaaatccagaatatgatacattttacaagacaattggcatgggctaataaataaaagtgtaagtctgtattaaataaaaataggcatggcaatcaagaggaatgcatgaacctggattggatcctggatttttttttttttttttgagacggagtctcgctctgtcgcccaggctggagtgtctcagctcattggaagctccgcctcccgggttcacgccattctcctgcctcagcctcctgagtagctgggactacaggcgcctgccaccaggcccggctaatttttttttttttttttgtatttttagtagagacagggtttcaccgtgttagccaggatggcctctatctcctgaccttgtgatccgcccgcctcggcctcccaaagtgctgggattacaggcgtgagccacccgtggccgattctggatttttttaaagtgtaaatgtagtggcttcaggataactgcatcaagagtgccatcaaaattcgcaatttatttcttctttccctgaatctgggcaggccctctggcagcttagtgaatagaatgctggagaatgatgctgtgaccagttccaggcttactctttgtaagagaactgccagcttccgcttcttctctcttagaccacttgctcttgagacattccctctcggaactgagcagtcctgttgcgggagacccaagccacatggagtggccaaatatagttattctggtcttagctgaactaccaaatgacaaccagcaacaattatgagctaagtgagcgacccgtcttgaatgttccagcccaatatactatagccccagccaacatcacatggaatagaactatatagctgagccccagtcaacctgtagaatcatgtaggataataaaatagttgttttaagttaagttttagagtggttgcgtgcattacagtaaataacaaaaacaattgaacatctttgagacaattgttcatgtagattttttattagataatatggaattattgttcttaggtattagaaagctttggtaattatacaagataatataatttcttaggagaggaaatatgtggaggttaagtatgatgtctgcagctcattttgaaataattcagcaaaaaactatgcatataaaaggcaaatattgggagctttcattatattttgtagaatggaggctacccccaccctaaaaaaaccaaatatgacatttagcaatcaattggtagaaggtatatgagttttcattatattatactattttttctttttttacttgagacagggtcttgctctgtcacccaggctggagtccaggctggtcccaaactactggcatcaagtgatctgcctgctttggccttccaaagtgctgggattgcaggtgtgagccaccatgcctggcctagtttttcaatttttttgtagatttaaatgttttcaaaataaaacattggggtgaaaaggatcacattaaaaatacacagagttttggggttccccggcagccaccagtgtgctcagtgatttgctcgaaggattcatgggacttagtatataattgtactcatgactaaggtttgttacagctggagaatacaggacaggatcagtaaaggaaaaaaagcacaagtggagtctggagaaatccacgtataagcctctttatcattcttcctcctgtgagggggtatatttgagcacactccaccagcgacgaaaaatgcaatgacttatgtataacttttctgcccagggaagcccgttagtgattgagttcccaggattttttttttttttgagacggagtctcactctgtcaccgaggctggagtgcagtggcctgatctcggctcactgcaacctccgcctcctgggttcaagcaattctcctgcctcagcctcttgagtagctgggattacaggcgcacgccatcatgcctggctaatttttgtatttttagtagagacagggtttcaccatattggtcaggctggtctcgaactcctgacctcatgatccacccaccttggcctcccaaagtgctgggattacaggcatgagccaccgcgcccggccaagtacccatgatttttattggggcttgttacttaggtaacctctgcctaacatgtaccaaaatttcaggctcctagaaggaaagttgatattcaccataaatcacattgtttgtaggcacagtttaggaacattggaccacccttattagttaggtgatggaggaaagccgagtttctagatagatgccagccaaaggctgatcttggaagcaggcccttttaaagactgcagcctcaggcttgctatattaactcttctgcacacatactaatcacataaatttgaagataaatactaatgatttgaatgagaaaggaaactcttgtctaaagggttagatagcaggtagtttattgtgaactctttgtagttctgccagagattctgaaaatgggatgaattgatttcagttcacttaacagttattgaggcattaggtatatggaaatgaataagacacagtccctgccatcaaagaagtcaggtcaagaggggcagttaaatgatcaacaatgattgtggaacagtgtgataagtattatagtaaaggtgaatacaaagtaggaaggaaactgttgattctgatgttagggtgaggaggagagaacaggaattaacatttgacctgaactttgaaagagaagtagtgttcaacaggcatggaaacttagatgggcactttagtcagaggaaaaaaagcaactggaatgtgaattcttactagttgccagggtctgtgtgtgctattataacttaatccttacagcagacctgtgatgtaagtgattttattgttatttttaaaattatggctgggcatggtggctcatgcctgtaatcccagcagtttggtaggctgaggtggaggattacttgagcccaggagttcgggaccagcctgggcaacatagtgagacttgtctctgcaaaaaatttaaaaaagatattagccaggcatggtgatgtggacctgtagtcccagatacttgagaggctaaggtgggaggatccttgagcctgggagatggaggctgcagtgagccgagattgcaccacttcactccagccctgggtgacagagggagattctgtctcaaaaaaaaaaaaaaaaaaagatgattaagatgatttgaaaattttcgtattcccttttccctcttcactcctttttttgagacagggtcttagtctgtcatccaggctggaatgcagtggtgcaataaaagctcactgcagcttcgacctcctgggctcaagttgtcctcccagcttagcctcccaagtagctgggaccgcaggcatgtgccaccacacttggctaatttttttatttttgtagagacggtctatgttgttcaggctggtcttgaactcctgggctcaagtgatcttcctgcgtaggcctcccgaagtgttgggattataggcatgagctaccttgcccagccactctctttctctttttattttttaaaagaattagagacagggtctgactacttgctatgtatgttcccctagctgcatttgaacccctgggttcaagtgatcctcccacttcagcctccccggtagctgggactataggtgcatggcaccgggcctggctgttcactcctcctttcataagcaaaggcacagtttcttttcttgtaagagatgggctaggttgtgtagattgagctttctaataaaaacaactaaaagtgttgaataaaaatgtcttaaaaacatcgaaaagttaacacggtagaaatgaaattgggaactcagataagctgaacgtggaaactgcttttgccttgcgaacatttgctcaactaagtgaacttgaactttggttttgacagcccaacagggcgcaggcaatagaagtaaggtcaaacccagcctggtgcggtggctcacagctgtagtcccagcactttgggaggccgaggtgggcggatcacaatgtcaggagtttgagaccagcctgaccaatatggtgtaatcccatctctgctgggaaaaaaaaaaaaaaaaaaaaaaaattagctgggtgtggtggcgcacacctgtaatcccagctgctcgggaggctgaagcagaagaatcgcttgagcctgggaggtggaggttgcagtgaattgagatggcgccactgtactccagcctgggtgacaaagcgagattccatctcaaaaaaaaaaaaaaaaaaaaagatcaaagcccaagacccaccaaaggtgtaacatgtaataggaaatcttctccataaaccgtatttcagagaggactatacacttagggttaggatgaactagaaataagcccattccatctgcctgtctccagttgccttaacacttagctaagtattaatagaagaaaaggtccttgagaagttaaaactgtaagttggctctcaaaggttatgtagcccaaattcacacaatttaggagaaccaaaactctaaacttgagaaccctcaagccatgcatttagtttaaagtggcctcaactggtaggacccctaggtccctggcagaagcaaatgcagatcgatcctctgtagtagctatgctgatatcacacaaaatagacttttaggcacaagtgtatttttagagatagaaagggcagttcataatgataaggtttcagtttaccaggaagatacaacaatattaagttatatgcatctaggctggacacagtagctcatgcctgtaatcccagcactttgggaggccgaggcaggcagatcacctgaggtcaggagttcaagactagcctggccaacatggtgaaacctcgtctctgcaaaaatacaaaaattagccgggcatgatggcagtcgcctgtaataccagctactcaggaggctgaggcaggagaatcgcctgaacctgggaggcagaggttacagtgagccgagactgagccattgcactccagcctgggtgaatttttcaaaaaaaagaaagaaaatattaaacaagttcatatcagataaaatggataaattccaagaaataaagacagtttctataaaagagatagaaaacctggatagcccaataaccattaaatacatggattcagtagtcaaaaatcttcccacagggaaacttgcaggtctaaatggcttcacctggaagttctaccaagcatttaaataaataattgcagttaataattatttgttaatctgttgctacataacaaatcacccaatatgtagtggcttaaagcaacaatagtcgtttattgtctctcacagtttctgtgggttaggacttcaggaggggctctgttgggttgttctggcttggaatctcatgaggttgtggtcagatgacagctgtagttggggaacacagaaagctaagcccacagaagaaaaacaaacaccgtgacactgggaaggagctgcctcttgcttgttaaccttgagctggaagtaggagttgggttgtttctcatccactggaaaaagtgttaagtagtttcactttacattatgatgctaaattgaaggtatgtagcaacttctgggaatcaatgagcagtctggagaattttgacctctcccgagtcttgtttcctttgggggttaagagagtctggagcctctaagttagagacacaggcacagcgtgtttcattttcattcaccacctgcaatcctctgcccttccctctacctgttggaattaatttatcattcaggttgcagtacaggtctcacctttggtgaagcttttccccaccactctattcctgttgtgctctctctctctcctaactctgctaacacttactgccttttaccacccttttcgtcttgaccatatgtttcttaataactatttgatatcttctcacagaaagtgcctcatctgtcccactggatcctctgttctacagctcaggggttgagtcctggagatctctgtattcccgtgtcatatctcacatagcaccttgcatgactggccattttcagaatggactaattcagtacttgattgtttgcacagttagagcaggttagggtccttcttgcaggagtctgcagtcttagataggtacagacagacatagagaaagcctacagagatgtgaataaatgactaaatatatttctgggggaggcacagagtaggagtttgagtccttatgggagagggatgaggggaagaagccccttgtttaatctcattttttctcttcattaaaatgccttcttgcatccttggtctcttttcacagaaccctgccatcagcatcactgaaaacgtgctgcatttcaaaggtcagtatcccagcaaatgctcccatctctatacacagttaaggaggtgtggtggtggtttcccttttttaaaaaaatgtatttgtcttacttgttttttgctgatgttcacgcctctgatcctcatgaggtaagctaaattgttttgaaatatatgattagaaaagtcaaagaattggtttaaaatcctgtttcccccatggagaggcagtagatacagtgaaggaaaaaaaaaaaaagaatcctgggttagaaatcaggagacgtgtcttctagctctaattctgccgctatcttggacaagttattgacttctctggacctgtacaatgaagatgctgggttttaatctgtgtttctcaaactcgaggacccgtggacaccaaataatgtttccacaggactctcaagggctcatggacccgagattgagaaacgtgaagaattaaatatggtcactttaagtgatatttggctccactgcagctgtgaatacagacacacatacagctactgattgcatggcagtacttgattatgaagtggccatctagatgatccagaatatgctgctttttttaaaaaaaaattattatggaaacataaaatagaaaatttatttatttatttattttgagattgagtcttgctctgtcacccaggctggaatgcagtggcatgatttcggctcactgcaacctccgcctcctgggttcaagtgattctcgtgcctcagtctcccgagtagctgggattacaggcatccgccaccacgtccagctaatttttgtatttttagtagagacagggtttcactatgttgtccaggctggtcttgaactcctgacctcaagtgatctgcccacctcggcctctcgaagtgctgggattataggcgtgagccaccgtgcctgttttttgttttttgtttttgtttttgttttttttaaatatttttcttttttttttaaatttattatttttttattatactttaagttttagggtacatgtgcccgttgtgcaggttagttacatatgtatacatgtgccatgctggtgcgctgcacccactaactcgtcatctagcattaggtatatctcccgatgctatccctccccactccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaataaaaatatggaacgcttcacgaatttgcgtgtcatccttgcacaggggccatactaatcttctctgtatcattccaattttagtatatgtgctgccgaagtgagcacatatttttctttttaaacatttaaaaaaataataattatttattacatcccttctcactattcctaagaaattttcttgatgagactttgtggctccctgatactagattagcagaccagtttgagaaacactacactctagatgatgtctcaggccttttcagctctgacagtctctgattctgtgaatctgcctctatctgccttctcctcagtccctcagcagatttactgctctactggagagggtgggatttccattcactgtcacccagtggggtaggattctctctgctctctgttccagttcctgggattattggagcataaagagtttctgctttatgtgaaattccatctactgtaatatacttgcatgaaagtacagcctggcttttgtatctgcttttcaagatgagagtagtcaccactcagctcaggttttttgggaattatatacatttacatgaaaattaaagtgataaaagcatatcttgccacttagaccttatatactgtcctaccttaaggaatttatcgtcacagagaataattgctacctgtagcgaatattaggcaggttattagtctacatatgatcagataaggaaagagagtcccagaagggaaccaaatggtaaatgaatcagagaggagagtggaagggtggttcagcagcagctgctgggtccagcagtcactggcatctaggcatggtgccagctagaattggggaaaggagccatgtcaaggcatagggatggggcattggccaactcaggtacttccctcctagttccacctgtccttcataagctgcgaaagattgtatttctttttccttgttccatttgggatgtgctaaaggaggagtcagcttctgccttcattctctctccctggttgggaggttttagattcagagctgtccaagacaacccagcatttccatgtaccctgcagtcaagatgatacacccaccaatttttgtctgctctagatttagagccaaagtaattgtgaaagttaaatttatatccgtgtggctcctttggcattgctttctctattctttttcctgcctgttatttgtgtggggtatcatcagggtcacagtggaagattgggtaaatacgccaaaactgacatcagaggacatatggagataaacttgtgtcaaagatttggcctatctagctgttgaggagctctgcgcacaagcccccacacattttaacaggacccattaagatttgtggactacgatgcttcttggccttttggctacaatcaagtatgatattcgtgccaggtacagtggctcatgtctgtaatcccagcactttgggaggctgaggcgggtggatcacaaggtcaggagatcgagaccatcctggttaacacggtgaaaccccgtctctactaaaaataaaaaaaattatctgggcatggtggcgggagcctgtagtcccagctactcgggaggctgaggcaggagaatggcatgaacccgggaggcggagcttgcagtgagccgagatcatgccactgcactccagcctgggcaacagagcaagactctgtctcaaaaaaaaaaaagtgtaatattcgcatacttgggaaagaactgcaccaagctggcttttggatggccttgctctgctcaagtttgcagtaacccacatttctttctttatagctcaaggacatggtgccaaaggagacaatgtctatgaatttcacctggagttcttagaccttgtgaaaccagaggtatgttctttcctttctcacttcccttcccattttaggaaatgaataccagtagtttagtgaaatggggagcagggtttgtggagagaagaagataaaaaccaaaggggaataatagagttcttttatttggaacagagcccaggttttagctgcagaggaatgggaaagtcagagaccccaagttgagtcagggccctgccatttattagcagtgtgatcttgaacaagtctcttaacttcttcgagttctggtgttctcatgtgttaaatgaaggtctggactaagtgatccttccagctctgatattctctggttttagtgatggcagaggaatatggcacccattgagaacagagttacatagagtggttgaagcccccaccaggggttactttcatgtgactttgccacagttgcaggtgagaaaaatagaaatcagaaagggtgaaggcagctggccttcagaaagaatgctgcagatatcatcaaaacttcccttcccttagagcctgaggaagcttctctcataagcagggagagaatccaatagatggggtattttggcttctggaattacacttagctctggtggcttgagcttcttgatttccgtgcgcaggtgctcagttgttttgagaaagcatgaataataaccagtggtacagtgggcagagaacctgtcatggagcttcctttggagaaaagggacaggacatgtagacaaacaatgagctggaatggcctataagaatttgagtttagttgggaagactccccaaattgacccctgtgaaaaaatctgtaactgatccaatacagttctgatcttgatgcaggtgtttctaaaaccggggtctgctgagccaggacagtcattttcatgggaggaaaatttataagctgagggtaattggatgcagtacccttgagagggtgattggacatagtaccttgcatgatgtggctgtggcaggaggttcatgctagttccctccagcctaaccaggaactatttgcctttcttatcctgatatcctcctgtatcattcactgggggaatcagagaaggacattatgtccttaccagttctccatgccagccgttggtctagatcaacctttttggcaccagggaccaattttgtggaaggcactttttccacagatggtggaatggggatggtttcagggtgattcaaatgcattacatttgttgtgcactttatttctgttattattacattgtaatatataatgaatacaactcaccataatgtagaatcagtgagagccctgagcttgttttcttgcaactagacagtcccatctgggggtgatgggagacagtgacagatcatcaggcattatagtctcataaagagtgagcaacctagattccttgcatgcacaattcacaatagagttcacgctcctatgtgaatcttgtgccaatgctgatctgacaggaggcagggcttaggcagtaatgcaagtgatggagagcgagtctaaatataggtgaagtttcactcacttgcccaccactcagctcctcctgtgtggcccgattcccaacaggccatggaccagtatcagtccatggcccaggagttggagacccctggtctagatgttccctttgcatcaggacttgcaggaccagagaaagaaggagaataaatatatcctgcagcttctatgtacggcgcccctggcatggtgctgcttcagggaacagaagagggcattctcacattttcactttctctcctagcctgtttacaaactgacccagaggcaggtaaacattacagtacagaagaaagtgagtcagtggtgggagagactcacaaagcaggaaaagcgaccactgtttttggctcctgactttgatcgttggctggatgaatctgatgcggaaatggagctcagagctaaggttagtaaggatcctaggatctagccattgaggacaaatcatggggaacccacgttattcaggccacttcagatacctctcggtctgaaagaatagctacaaagttacaaattcatttaaagacctggtgatgtgattttcaagaagtattggctatgtattttatagactttccttcggttgaaatctgtctgatgtttctcttacaactagactaaggtgatagatgttgaggagaagaccactgaagtaaagtgcaattcttatcacatcatatcaagagtacatacggccgggcacggtggctcacgcctgtaatcccagcactttgggaggccaaggtgcgtggatcacgaggtcaggagatagagaccatcctggctagcacagtgaaaccctgtctctactaaaaatacaaaaaattagccgggcgtggtggtgcatgcctgtagtcggagctgctcaggaggctgaggcaggagaatggcgtgaactcgggaggcggggcttgccgtgagccgagatcacgccactgcactccagcctgggcaacagagcgagagtctcaaaaaaaaaaaaaaaaagtacatactgtcaacgtgacacatcactgttgatattaaccatgggttagctggcttgaggtgacgcttatcaggtttctctaccataaggttattttcctcttggctctccttggaaggaagtcactatgtgtagcctacatttaaggagcagggagttatgcttcctgtcctttagatggagggagtatctacataatttatttggaattcttctgcataggagaataattatgcatgtctattgtctcccatttatttattcaatcatttatatcatgtgagtacatgggtatttattttatactttgagttataatctaatattatttattttgttgctcaaattcttccagctttggcactaactggcctttggttatgtcctcatcctgcccatctttcatttggcttttgtatctttttgagaaagcgccatcattatgggactgtttttttttttttttttgagcacttccttactttctggcagtataagctgctccaggcttatcttgcatgtatgtttcctgctccagccctggaacagccatttcttcaagcatctctgttcttattgtggaatagcattggaaaccaagatctgggtgccgggtatgctcattgctaccaggttgccattgcctttaagttctcttcactgacagaacaagaaaatatatgtttggatagtaacccatgcatacacatacacctgtaaatatttctgtatggatccatctgtatctctgttaagctaaacgtgagttcatagtgatgttggaaacatgatcttagcttctggaaaaattatactaaaattctagaagtcttgaaaaataaaatagcagtctacctcctgccttaaacttctgttttatttctctgactgcgacagatcttctggatgtcctttccagctttaagattccaaggtcacttgtcagtttggaagccagctcactgggttaattttgtgaacaatggatgggcacctgtgatgctaatgctgcttagtaagcaggagtcaggcgtttggccctatgacctagaatattctcccaatgatgcactgaccccaactggaggagttggctttgagggagtcagattactcagccagcatatggacttttgcaagcatctgggaattctaacttgtgttcttggaaaacttttgtctaaattctaggaagaagagcgcctaaataaactccgactggaaagcgaaggctctcctgaaagtaagttgtgctgctgccatggtagttaccagttaacttgtgctagtgttggaagtatggataattgtgatgtggcaggagagctaatgatttcatcccggtgagctgtgtgggtgagtttatgaaaaagcttttaggtccagtgcttaaggtctgcactacccacgtcagaatccttacctttaatgtgtcctttgtgttttggttgttatttcatgagtacaccaaggctagtgtagcagaatgaaagaactcctggactggcctcatggcagatggcaaccaaatcctgcagagacttgtggaaatgattgcatggatccaaggctacactccttcagcctggtgtttttctcccagctgaaatctcaaaggctgtatgatacataagtgtggttgtcagcctgaaagatggagagtattctgtgtagtcctgctattcattaacctttaacaaatcaatttctgtttccgtctaaccactttaagcaggaagctctgtaagtgtattatcttctgggtgatgtagttagattaaattcagcagctatctgttaaagtcatgctgtgtggcaagcattgtgctgggcccttgactaagagccagagggatccatcgtagcgcctatactcaaaagggcttacattcttagtgagggaactgcaggtgtatgtaaaactacctctgaaaagcagaatgaaataagtccttcttacttgttctaagttgaaatttttcaaattttagtggtacttatctagcatgccataaataagggaggggaaagttttggagcagtagttttcaaactgtgttccatggtgccccagggggttcccagagatgctttggaggagtagatcacacaaacaggtctacctcagtcagagcagctctcttttgagtgttatgtgttggcattccgaataaggtttcttttgagaaggaattttaaaaaatatttgaatagcgactaccttaggggaatattctttcaggaaagccgaggaggggagaggttcagtggaggcaaagaataacaacataaaaaagccactttgagatttaaattaatgttttggtgtcttaaagggataaacttcaaaaatagataaaaattctaatatatggattttttgggtgttaggtaaagctttaactgttttacctaaattcataaagttttctgaacaaggaagttctttatggtggggaagtgtaatagatttttgtagttttgaagaaataacttttaattagctaaatgttgctagaagtctgacattttttggagtcttaggataaggctgtgttgtttttttttttttgagatggggtcttgctatgctgtccaggctgatcttaagatactgggctcaagtgatccttctacctcagcctcccaagtagctgggattacaggcatatgccactgtgcctggcttaggctgcttttgattgaccacattattaaatgtgattatttgaggaccaaccagatgtctttgcagaatatctgtagcctaggaataaatatgtagcagcaaaatctgaacaccatagatctcctcttaagaactgtccttttctttaccctactcctttgactcaacaatgactctgtcaaagcctcttgtttcttcctttactctgtaattggctgtatcttcatgaatcttaggctgcagataaaattaatgtcccttattttcctgcatgttggtttgaaattgtcctgctttggttatgtcctcagtctgcccatctttcaaagcccagatcaggccaagtatgatggctcatgcctctaatcccagcactttgggagactgaggcgggaggatcttttaggccaggagttcgagatcagactgggcaacgtagcaagactgtgtttctacaaaacataatggaatataaaattagcaaggtgtggtggcacagacctgtagaactaactacttgggcggtgaggtgggaggatgggttgactccaggaggtcagggctgcagagagctatggtcccaccactgcattctaacctgggaacagagtgagaccctatctcaaaaaaaaaaaaaaaaaagcccggattagataccagctttatccatgtagactagcttgatgcctacttctccagcctaatgtcgttttttcaccttgaaagtttcacaagacattacttgttactccccacctggtattacagtttttagattgtaagctctgagggcagccttgaactacctttgtatcccagtagttcttctcacagtaccttgcacattgtaggtattcagttaatgcttggttgagtgaatatataaccaaatatcagggttgtttttttcatttactgtatctgtctctttgagctagtttgacctcagtgaccttaaagaaattccagaaaagaagaaactatggattatattaagatgactggagggccaggcacggtggctcatgcctgtaatcccagcactttgggaggccaaggtgggcagatcacctgaggttaggagtttaagaccaccctggccaacatgatgaaaccctgtctctgctaaaatacaaaaattagccgggcgtggtggcggaagcctgtaatctcagctactcgggaggctgaggcaggagaattgcttgaacctgggaggtggagcgtgcagtgagccgagattgtgccactgcactccagcctgggtgacagagcaagactctgtctcaaaaaaaaaagaaaaaaaaaattgagccggagctgaggaaatctttatttcctttttgtaatgcctcttcagatggccactcatttttttgccaggtgttatggaaaaaatacaacactacaacactcaactgctttttcctattttcttactcaacaacaatcaacacagaagacttctgtgaccaagtgggtgggttttttcccccacataccaagcaagcaatgagttctgcagcagacaccagctgggtgccctctggttcaattctgacactgtttacctagagatagcatcaggttcccacagatggagggctcagtccccaagacacacccctgcccccagcctgtcccgagtctgaacctccagaacttgtgaccaataggctgtaaattacggttcccacaacccgctcctgtggtttgattgatttgctagcgtggctccacagaactcagggaaacacatttgttcatttattataagggatattatgaaggatacagatgaagagattaggaggaagtatggaggaagtggcgcggagcttccatgccctccccaggtgtgccaccctccaggaacctccgtgtgttcagctgtctggaagctgactaaaccctgtccccttgggccttttatggagacttcatcggataggcatgactgaagcgtgttgaactgtgttgaaatgtgattggacaaaaagggtctgacctaaacccagcaaggcctgtctgtccagattcttctcagcctctctgtgcagtgttccctcctccagagtatgaggcaagaccctctctggaatgagggtcttaggacccacaatcagattagagtcgtgccttgggcagctgaaaggaaggcagggaaggtcatagagggagattctgttgtctgaggcctaaagtgtcccaacattataacaaaaaactgtaacaagggctgtgggagttataagccagaaaccgttgccgaaaacctatatatacatatacacatatcataatatcacaccaggggtaatatttttttcttgggtttgttatgtctgtatacctattcttcaaggctgggaaaggaagtcctgctgaaaatacatgctggagagcaatgttccttgtatgtttctctgtgggagtaggagcccaggctggtgaggacctggaccaggtatttgtgtgggagcttaggagcattcaggaaggaaaaagggttgaagtcatccagatatgcctcatacacctgtctcctgctgggactattgcttttaatagcttactgctttgctttgctttacagctcttacaaacttaaggaaaggatacctgtttatgtataatcttgtgcaattcttgggattctcctggatctttgtcaacctgactgtgcgattctgtatcttgggaaaaggcaagtaagacatttttggattaattttccctttctcagtagtttggcccagtattcaccaaagggagcactctctgcctttgatgttaataataacccctgcatttgtgcagcaccctctacttttcgttgtgctttcatagctcttatttcccatggccttgtgaaataagctgactggtattctttccatataacaggtaataaaatataggcctagagatggtcaaaaatggttcacatccatagctagccagagccacatcttgggctagaatccttttgtaaaaatgttcactaacaactaaataaattgatgtgatacttccagtgccaaagttatgcaaggccaaaagggttctcacccttttggagcctaaatacgttctaaaatgaactattctaaaacagaataaaaagagcatcataaagatattagttcttcttaaattaatttatgtgtttagcaggattctggctttgaccagtggcattccattggtaaatgccaatgggaaatttttgagaatttgatctaaagtattctgaaactttatttgatgaataaataggtaataaaatttaggagaagaaagattaatgggagaggatttttctacctgataatgaaagtatggaccaggtgtagtagctcatacctgtaatcccagcactttaacaggctgaagtggaaggatctcttgcgcccaggaggttgaagctgcagtaagccgtgatcatgacactgtactctagactgggtgatggagcaagaccttgactcttaaaaaaatttagaaaggtggctgtgcgtggtggctcacgcctgtaatcccagtactttgggaggtctaggtgggcagatcacgaggtcaagagatcgagaccatcctggtcaacatggtgaaacccccatctctactaaaattacaaaaattagctgggcatggtggtgcgtgcctgtagtcccagctactcgggaggctgaggcaggagaatcacttgaacccaggaggcgggggttgcagtgagccaagatcgtgccactgcactgcagcctggtgacagagtaagactccatctcaaaaaaaaaaaagagaaaggcatataaggtgtacgtgttaactttctggtaactggtagagcttactattcatgaccccattggcctgcacccttcctgcttagttaagtaagaaacttgaatctgactggatgtttgttattcctttcttacagttattttcacgaaaggagtaatctagtttgagaaatagttctgttggaatttaccaactgattcacccttaatgtatatttttgcctatagagtccttttatgacacattccatactgtggctgacatgatgtatttctgccagatgctggcagttgtggaaactatcaatgcagcaattggagtcactacgtcaccggtgctgccttctctgatccaggtattgaatagttaagctgaagggtgggtaatggaaggtcccattatttgtctagtgggtatgtgtattagtccattttcatgctgctcataaagacatacctgagactgggcagtttacaaaagaaagaggtttaattggacttacagttccatgtggctgggaaggtctcacgatcatggtggagggcgaaaggcacttcttacgtggtggcggcaagagagaatgaggaagaagcaaaagcagaaactcctgataaacccatcagatctcgtgagacttattcactatcctgagaatagcatgggaaagaccggccgcactgattcatttacctccccctaggtccctgccacaacacgtgggaatcctgggagatacaattaaagttgaaatttgaatggggacacagccaaaccatatcattctagccgtggcccctccaaatctcataccctcacatttcaaaaccaatcatgccttctcaacagtcccccaaagtcttatttcagcattaaccccaaagtccacagtccaaagtctcatctgagacaaggcaagtcccttctgcctttgagcctgtaaaatcaaagcacactagttacttcctagatacaaggggagtactggcattgggtaaatacagccgttccaaatgggagaaattggccaaaataaaggggttacagtgcccatgcaagtctgaaatccagtggggcggtcaaactttaaagctccaaaatgatctcctttgactccaggtctcacatccaggtcacgctgatgcaaaaggtgggttcccatggtcttaggcagctccactcctgtgactttgcagggagcagcctccctcccggctgctttcaccggctggcattgagtgtctgcagcttttccaggtgcatggtgcaagctgtcagtggatctaccactttggggtctggaggatggcggcctcttctcacagctccactaggcagtgccccagtagggattctgtgtgggggctccaaccccatgtttcccttcctcactgccctagcagaggttctccatgagggccccatccctgcagcaaacttttgcctgggcatccaggcatttccatacatcttctgaaatctgggcggaggtttccaaacctcaattcttgacttctctgcacccacaggctcaccaccacgtggaagctgccaaggcttggggcttgcaccctctgaagccacagcctgagctgtacattggcccctctcagccaaggctggagcagctgggacacagggcaccaaatccctaggttgcacacagcacagggaccctgggcctccgcgcctgtgatgggagggactgccatgaaggcctctgacatggtctggttacattttccccatggtcttggggattacattggggattacgttaggctccttgctacttgtgcaaatttctgcagccagcttgaggttctcctcaaaaaatgggtttttcttttctactgaatcatcaggctgcaaattttccaaacttttatgctgtttctcttttaaaacggaatgcttttaacagcacccaagtcacctcttgaatgcttttctgcttagaaatttctcctgccagataccctaaatcatctctctcaagttcagagttctacagatctctagggcaggggcaaaatgctgccagtctctttgctaaaatataacaagagtcacctttgctccagttcacctttgcttccaagaggttcttcatctccatctgagactacctcagcctggactttattgttcatatcactatcagcatttttgtcgaagccattcaacaaatctctacgaggttccaaacttacctacattttcctatcttcttctgagccctccaaactgttccaacctctgtctgttacccagttccaaggtcacttccacattttcgggtatcttttcagcaacatccaactttactggtaccaatttactgtattagtccgttttcccactgctgataaagacatacctgaaaccaggccgtttacaaaagaaagaggtttaattggatttacagttccatgtggcgggggaaggtctcacaattgtggtgcagggcaaaaggcacttcttacatggcggtggcaagagagaatgaggaagaaacaaaagcggaaacccctgataagcccgccagatcttgtgagacttatttactaacatgggaatagcacgggaagaccagcccccatgattcagttacctccccctgggtcccttccacaacatgtgggaattctaggagatacaattcaagctgacatttgaatggggacacagccaaaccatatctgtatgttacattttgctaagaagtctcaattagtaaaaacacctatttgtacaggaatagcattattttacctgaacaagaaagaacatttaaaaccccagggttatttaccaaagtagacttttactatttcaggtctttttcattttttataatatccttatgaaatcacaaagttataaagagctttaagactagggaaatttgactcttaggcaggagctgaaaaacctaccttcagtctccttagttagaaatgtatgtggtctcctcccaccttgtgtagatgaaggcagtacttcttaaaaacttgtattaatgaaaagtacaataatcaaactttaaaatttacagccaggcatggtggctcattcctgtaatccccatactttgggaagctgaggtaggaggattgcttgaggccagcagttggagaccacccttggcagcatagtgagaccccatttctaaaaaaataaaaatttgccaggcatggtgatgtgcacctatattcccactacttgggaggctgagacggaaggattccttgagtgcaggagttcgatgttgcagtgagctgggattgtgccactgccctccaacctgggcagcagagcgagacccctgtctctaaaaaaaataaaaaataaaaatttaatggatagtttgtgttgtagattagacatagctgaagagaaaattagtgaactgttttgagatacaggaaggaatagagagcacaaaaagtaaatatacagacgtaattttcttgaattataagactcaatattataatattgttagttctcatatttccctgtagattcaatacatttccaatcacaatctaaaaaattttggaatgtgaggagaaaattctgaagctttttgaaaaaacagagggccatccaggatagtagcatcattttcgataactaaaatgtgcaagcaacccaagtgttcatctacagatgaatggataagaatgactgttacatacatacaatgggatattatgtagccttaaaaatgaaagaaattctctcgtatgctacaatgtggatgaaccttaaggaaactatgctaagtgaaataagccagtcacagaaagtcaaatactagatgattctgcttacatggggtacttaaaatagtcaaaaccatagagacagaaagtaggatggtgtttgccaggggctggctgaatggggagttattgtttaatgggtcatagtttctttcttttttttttttttgagagtctcgccctgtcgcccaagctggagtgcagtggcacaatctaggctcactgcagcccctgcctcctgggttcacgcaattctcctacctcagcctcccgagtagctaggaatacaggtgcccatcaccacgcccagctaatttttgtagttttagtagagatggggtttcccatgttggccaggctggtctcgaactcctgaccccaggtgatctacccgcctcggccttccaaagtgctgggattacagacgtgagccaccgtgcccggcaatgggtcatagtttctattttacaagatgaaaagagttgtggagatggatggtgattatggttgcacaacataatgaaggtatttgataccactcaactaaacacttaaaaaatgattaagatggtaaagtttatgttatgtgtattttttttttttcagatggtgtttcactgtcacccaggctggagtgcagtggtgtgaccttggctcactgcaacctcggcctcccacgttcaagcgattctcctacctcagcctcccgagtagctgggactacaggcatctgccaccacgcctggctaatttttgtatttttaatagagatggggtttcaccatgttgtccagtctggtcttgaactcctgacctcaaatgatctgccagcctcggcctcccaaagtgctgggattacaggcatgagccaccgcacccagccattatgtgtattttaccacaatttttaaaatgggaaaaagaaaaaagcaaaaggtcgagaatattctttaaagacgagctcaaattggggacttaccctataaaaaatcaagacagtataaagatttagtagctaataccacgttgtatggtacaaagatagtcacacagaccacgggaacagaataaaacccagaaacagacaacccagatatctatgaagaatagaatgtctatcatatattggaatgtcttgccacgtgaaaatgagtggactatagccacatgcatcaacatagatgagtcttggccgggcgcggtggctcatgcctgtaatcccagcactttgggaggccgaggcgggtggatcacaaggtcaggagatcgagaccatcctggctaacatggtgaaaccccgtctctactaaaaaatagaaaaaattagctgagcgtggtggcgggcgcctgtagtcccagctactcgggaggctgaggcaggagaatggcatgaacccgggaggcggagcttgcagtgagccaagatcgtgccactgcactccagcctggacgacagagcgagactctgtctcaaaaaaaaaaaaaacaagaccaaaaaacatagatgagtctctggcccgtaactctgagtaagaagtagtcacagaatgatacatatagaatgatttcagaaagttttaaaacaggcaaaatgaaacaatatactgttcaggaatacatacacaagcagtaattcataaagaaaagccatgggccaggcacagtggctcatgcctataatcccagcactctgggaggctgacgcaagaggatcacttgagcccaagagtttgagcaagcttggccaacacagtgagaccccgtctctacaaaaaaataaaattagccagtgtggtagtacacacacctgtgatcccagctacttgagaggctgaagtgggaggattgcttgagcccagaagttcaaggctgcagtgagccatgattgcaccactgcactccagcccgggtgacggagcgagaccccgtctcgataaaaaagaaaagccatggaattattaacacatgatagtagttatttataggggtcccacgtttgtagtgctctatttcttaacttgggttatataaactcaaatgtttatttggcagtattctttagactgcgtttgaacatgtgtctgtattttaaagaaatgatttatgatatagttacacaaaatactgtacctgtctagtcacaaagactggtttgggcactttacttgttccagaactggagcaggattaaactggtcgaggtcaatcttttctatttgccttgcatttagtggggttagatttcagataacacatttctataactttacatatattttattaacttttttctctcttttgggtctttctaatagcttcttggaagaaattttattttgtttatcatctttggcaccatggaagaaatgcagaacaaagctgtggttttctttgtgttttatttgtggagtgcaattgaaattttcaggtgggtagaaatgccaggatggtgtttgaatgctgctccctgtttgcagcagctctgttcttgagggagttgttatcttagccagagtctcatttggtttgggactaagattacatatgtggagaattctggttgcacctatgtgctctgcaaagttgagacagatttttttaaagccgtcattggatcataataccagactggatactagggagcagaagaggagaaccagagaaagggaagactcatcttaccatgacttcaggatcttgcagtcttggaaagagaggacccatccacatggaaaaattcttgaaagggctgaagaaacaggaggttgaaggagcaatccaggttggatagaactaatttaagactaaatttctacaagggatgatagaaatgaatcttataccacaagattattgaagtttgaaatggcctctaacccaattttcccgttctcggttgttagtagcataaatatcttttaagaaatggatctagttaaagtagatgtattcttctttaccagaccatacacactccatatgtcttccctttcagtcagctggagcaaggattttgcaaatgaacttctcagctccaggtttggtggtattttgacaaagttgctagttgagagagagaacaggccatagcagccttaaattgtgtcttaaccatggtctgtgtcccatggcacccagtgtaccctctaatagccttaatacaaaggtaaaacagattataggtcctatgtttttcaaatcagacacgtaatgtgctgatgtaacaaggtttgagggaagcacatctcacacaggagagtgaaaatccagttatcacacttatgagctataaaaggatcagattatgggtccttaatgcaatgtttactgtttgagaaggaacatttattttctcaagggatgtcttttaaaatagcatatgtctgattctagattagaggtcttctgtatactttaattttggtaacaactcacttatccagaaataaagtatctaatatccttacccaccgggaatgtatatcagcactaggaataaagccaaaaaacatctgagtatccagtccgtttaccgaataaagagggttcctttgagacctaaacttagtctgccattaaagagcgttcagatcctttgaaaatttagggcgcagtgtggcaggagtttatgggttgatagccagcgttataattctgttctgaagaagccatgtgtggctgagaaatagaattcttctatttaaatgatattctaaggttgcattcggaacctgaagtggcttttcacattggaatcatttattttcaataggtactctttctacatgctgacgtgcattgacatggattggaaggtgctcacatggcttcgttacactctgtggattcccttatatccactgggatgtttggcggaaggtactctcagggactcttagctttcatagcttagctccagggggtacccagaggctgagagaccagtcctttcttccccggccttagtccgataaatggaaatgttggatttttcagggatttctttccatgggcttccttccataatactcctggtacccagactgttcgagaaaagtagctcattttgtaacattggaaagccaggtggttatgtcctgcatgcttcccatttgtatgatgcttttagtattccaaagggggttcttactgatgactttattttattctgacaaacatctcatacataagtcagctagggattttcctctccattttatagaatagaagaagcccactaccatgacttcctcatctgtctctctgttgacaggttggaggctgatctcttagaaaagtaggggaaaaaaaggagaggcatgagctttctgtacaaagggaggagaaagcctttccagcacacccagaactgaaactttagagtactaggactggaagttcctgtcattaaatgtgactgtttcatttgcttctaacaagttcttgtttctgttttcagctgtctcagtgattcagtccattccaatattcaatgagaccggacgattcagtttcacattgccatatccagtgaaaatcaaagttagattttccttttttcttcagatttatcttataatgatatttttaggtaagtattgattctttaatacagactttttcttgtcacttcttagacagtagaattaaatcattcagaaatgtaaaagtccatatgagaattcttttgggacagaattagagaatgattactttgcaaaaacagacccactaggggaatatgctatggtaaggaaatatttcttttctaaatctccagcagttaaattatgttctttaagtgctcttggtgattgggaatataccataagatatttcttgtttaaaacaatgtaaggggacaggcatggtggctcacgcttgtaatcccagcactttgggaggctgaggtgggcacatcacaaggtcaggagttcgagaccagcctgatcaacgtggtgaaaccctgtctctactaaaaatacaaaaattagttgggtgtggtggcgggtgcctgtaatctcagctactcaggaggctgaggcaggagaatcgcttgaacccgggaggcagaggttgcagtgacctgagattgcagcattgcactccaccctgggcgacagagcgggactttgtctcaaaaaaaaaaaaaaaataaataaataaataaaaattaaaaaaaaaaaagtaaggagccttttaaaatagactaagaagctcccacttttactaatttcagtagcatattcctcatccagagtttatagaggtgataagacaaccagcagcaaggaaggaagaagggaataaaggcctctgagcagccaagggttgtcataaagccttccacctcacaataggaaagtcccctgctcctcatggaaaacctgctgacctattaatttatataaaatcataaattcctgcctttataaactaacagaagggaaaaagaaagaaacctaaattattacaaatatgacaaatttaaaaggcttcctaactataaggatttttttttgttgttgttgttgttaaattcttattagaggccaggtatggtggttcatgcctgtaatcccagcactttgggaggctgaggtgggtagatcacttgaggacagaagtttgagaccaacctggccaacatggcaaaaccctgtctctactaaaagtacaaaaattggctgggcttggtggcgcatgcctgtaattccagctacttgggaggctgaggcaggagaatcgcttgaacccaggaggcagaggttacaatgaaccgagattgtgccactgcactccagcctgtgtgacagagcaagactctgtctcaaaaaaaaaaaaaatttattagtaatcagtatttggtaatttctaaatgcaactatacatgattctacccatattatctatactatactctatacatagatgtgaaaatacatacattcttatgtgtaggttaaatacaatttgagaaaaataattttttccttttaagagcaaactaatacgtatcgattttagtatgacaactaagaacataaaaacagaatgaaaggaattttgtcattaaatatatttgagaggagaaaacactgattatcatacatagaactttacatgtttaaggataagacaagctcctaactataaggactctttaaagttctgatacattttagtggtaatttatatatttctccttgctttatttcacaaaagacttaaggtggccctaaataaatataactgtccagtctcctagccacagaaggatgcaacaatagtatattagttctctattgctgtgtaacaaatgacccccaaaacttagcagctgaaaacaataaatagttattatctcacatagttcctgaaggtcaggaagcagcctggctgggtggtactggctcagggtctcatgaggtttcagttaggctgtcagctggggctgcagtttctgtagacttgactggggctggaggatctgctccaagctcactcttgtggctgttgacaggaagcttcagtttcttgccatagcccgtctccatatggctactcatggcatggcttcccccaaagcaattggttagagagagagagcccgaagccacagtgcctaatctcagaagtgacaaatcatcacacagaccaacccagtataacatgggaggggactacacaaaggtatgaaataacaggagatagaggttgttgggatcattgtcacggcttgctaccccagacagtgagaggaagaccacgcaaggtaagcccaggaagccagaaagcccagtggtcttggtcatttagtgttgcgggaggagagacttataccatagtattaggagccccttagtgtgccagtgcctggcagatgtacagttaaatagtatacattgtaggcccacgtcatttgcaaaaggttaaaatttctttctttttttctgtttcagcaaagggtataatccatttcagaaatattgccaaccaaaaatattaaaatgttttgcccttgaagagaggaaccctcagttcagaaaatgtactaattaaagacagctttttacctttattactgtataaattcagtataactaggccccatgaaatgggcataagataaagaggaataaatattggaaagacatttaaaatattttagtgaacagggtagaggggtagaaatattttaaagtgcattgacttagtatctttttttgtgttgtttatattgtacactctaatttgcaagattttatgttcatatctactttgcttatagtgaatatgtagttgctcttttcttattctttagaatgaaataaatcctaatttcacatttataattttgaagcagtgtaaacagccagttaacatttgtatataggtcaaaggactttttagtttttttttttttttttgagacagagtcttgctctgtcacccaggctggagtgcagtggcacgatcttggctcactgcaacctccacctcctgggttgaagcaattctcttgcctcagcctccggagtagctgggattacaggcacctgccaccatgcctggctgatttttgtattttcagtagagatggggcgtcacaatgttggccaggctggtctcaaactcctgacctcaggtgatccacccatcttggcctcccgaagtgctgagattacggtcgtgagccaccacgcctggccatgttcttgagtaggcttgaattaaaaattaggttgtttctgcactttagatttgtgcatttcattgtaaattttactgtaaaagaaagaaagaatattgaactatacctacctgaagaattaggggggtgaggtgtattgatatctgcaacttaacactgaagtgcataaaaaatgagatggctggagggatagatgaatagggatgtgatatagccaatatagtaaaaagcagtaaatctagatgttccctgtataatgatttaatcttttgcgtgtttgaaaattttataagagaaaaaaatgttttaaactcactgggaggctgggtgtggtggcttacgcctgtaatcccagtactttgggaggccaagctgggcagatcatttgaggtcaggagtttgagactagcctgaccaacatggtgaaaccccacctctactaaaaatacaaaaaattagccaggcatggtggtggacgcctgtaatcccagctactcaggaggctgaggcaggaggattgcttgaacccaggaggcggaggttgcagtgagctgagattgtgccactgcactccagcctgggtgacagaatgagaccctgtcgcaataaataaataaataaacccactggggaaaaattgctttgtgtctattgtattgttaatttgttctaaattgtactccttcctgagccgctgcaataagctttttgctgtggaatatgacgacagctagatactgtccctgccacaagagcttctggttataaatagacaaagactctaatttctaattgacctcttttctttttcaggtttatacataaattttcgtcacctttataaacagcgcagacggcgctatggacaaaaaaagaaaaagatccactaaaaagaaagatttagatggcttcttgccagtttgagcctaatctgattcttacagttttaccttcttgaaccaatgtaaaagtttttttaatgttaaatgattaaattctcagtgaggctatcttccttttccccagtaacattcctgaatttactgttatcttattgtagtacttgcatgacatggattcctgatatctgatgagaggttcattcttgtgtattcagttaatgacaccaaaaggctcagcccaccccaaccctatctcatgttcagtctgtctaatacatgccagagatttttttttcaaaaagtgctttatccctacaatgtactgacagttcttacagttgagatttgttcttttcagctattgcttgtgaaaaaaagcaagactatgtcactctatagaaggctgttaaagtgactcaggcaggaattaattattctgtacctaaggggttacttgtttaatgggatggcattgactttttgaaaatcaagtggactgagtcattgataaaacatttctaagagtggggctagagaacatactttacatctgacatcctttggcctaacaacatctattattatagtgctcagcagtgtgggcattgaagaggcgcagaatgctttgaaagaaactaatcagaatcttggaacatcatgatcatgccattcttaagtaaatcaactattttcaacactgaagaaaaatgaaacattatttagaaaacaatgagattacaagttccaaactcagccaggaatgtggctcacacctgtaatcccagcactttgggacacctaggtgggagcatcgcttgaagccaggagttcaagaccagcttgggcaacgtagtgagacccctatctctacaaaaaataaaaaaattagctgggtgtgatggcacacacctgttgtcccagctactcaagaagctgagatgggaggatcctgagctcaggaggtcaaggctgcagtgagccgagattgtgccactgcactgcagctggggtgacagtgcaagaccctgtctcaaaccaaaccaaaccacacacacacaaacacacatacacacacacacacacgaggtccaaatggtagcagggatccaaagggaacacagtatgtaggtcaaactggcagtaacagtgtacagcctttgacaaactagaaatattagagtaggccaaacacacctccaaactgtaaggctgtgcacaaacataaaaaatggcagccttccatctcctgcactggctgagtccatttacttgtgtacttgttctagtgagtggtgggactgtacatttttgaatagacctcaaaaatacttcattctgctgctgttcagttggctttttaaacctgtctgcagtaggacactgaaaacagcaagaacttcggggtgaacacccgctgatcctttaacaaggatttctggcaggaaactcacaaaaaggagaactgaaaatttagacatacagttggccattgtaaaaaacatcagtttcctctcatacattccaagtaaaccaagtaaaataagtgttggagtaacacttgcataaaagaatttaaggagtgatagctctttctgttctgccattcccaacattcctgggggaaaggagactcaatgagttaatactatttcactgagcccaagatggaaacttggtttgacctaaaacatctgattaatataggctagctgatttcttaaaaattcgttgcattgaaggatattttgcatgtctgtaacacctgtcaatacttgtttgtattgatttctgatattcttgcagctgactacgtgtaattgggcagatcagctttgcagtagattatgctgcatcctcgtggcaaaattctgtattcttagtgattgttacaaacccctttattgctgtctgagaaagtgaaagattgtgtatttctattaaaacatttacaatcaaaattctaa

SEQ ID NO: 35 - DNA, 44779 bp, Homo sapiens
aaaccaggcggcgcgttcccggtggcggcgccctggactcccgggcccgcgcatccccgccagccttccttaaggcggatgggtggcccccgagaccccgtcggacccatggtttccagtgcagcgcggagtgggcgatgccagcgtgccaggtgagaggcggccaccggtggcgggtgagggcgaaagagggcatggcgcggccgggagcgggcgccgacagggccttctccgcggcccggcgccggaggttggaggcgtggacccgcagagccggggttggagggggcttgttccaactgcctgcaggcgcgtggagtggagggtcgccttgggattcgccctttccaccgcagaaataggacccgcaggcttggtggtagaattataggatttgggatcctggaagaacctgagacataacccatccttttaccagatgcaaaaacctagtctcccccgccctgtgccgagcggaccacctgactgtgtgaggatggacgctttgtggatgaggatgtgtgaggtgtagaagctcagacaaagggctcgtggggtagctggttcgtcccctttcagaatgagatgggacttttggggataaatctttaagaaacgggtgttcagttgacaggtggaagaagggacaccccagaaggtgcgagtggctctgccagctcccatgtgccctatggccacgtctcaatggccctggcctacctttgtatttgtagctctggaaggaagcagatggacttgagacaaaaggtgaagtgaggtcttcccatcaaggccctatcacacttaaaaggtgagggaggaagagtggacagggacatgagggcttgggaatggttgtgtgaagagtttaccctccagactacagcacgatctaaagaacaaggcaggatagaagagttgaaagctgtattggataggcatcagggaagcttatttaactgtcttatttatgttcattgttcccataatgttatcctgagggcaagaaagtggatgtccttttaaatgtccagaaagaactagggcagggcaccacctttgtgatctgtggggcccaaaagcctctaaaggaatagcccttagtgtgtggcccttaagttgaagggaacagcatttaatttagaaaaggaaggcacttaaatttattgtgatatggagcaatatagagaagatggttgtttttgagtcggggaagctagattcattcttgataaggaaacttatttccttctggaaagctacactagagaacaaaagagttttaaggccatccattttacaggaaacgtgaaaaaattaactgctttgggattgggagtttagagaacctgcctggaccaagagaggaaattttcaacagacggttctgttggtcgaatccttatttcacagataaagattctgttgtgagaggttatctcttaccacctggttttcccactttgccatggaataatcattggtctgggtctaattctctatctatctatctatctatctatcgagacggagtctcactctgtcacccagactggagtgcagtggtgcgatctcggctcactgcaatctccgcctcccaggttcaagcgattctctggcctcaacctcctgagtagctgggactacaggcatgtaccaccacgcccagctaatttttgtatgtttagtagagaaggggtttcaccatgttggccaggctggtcttgaactcctgacctcagatgatctgcctgccttggcctcccaaagtgctgggataacaggtgtgagccaccacacccagccctcattattatttttatttgctagggcaattgctatctgatttctatagtaatactagaacacattggtagtagaactagcaattttttagaaagcctcctctgacccaaaacttaaaaattagaactatgtgatttttaaaagatggtccctgattctaatcatcaaagtcagtttgtccctagcttgataaaaactaattttctatttacatttgactttgcagcaggtttttccccttgcccttataagaagatacattggaagtataataatgttaacaggtgaaatcagtttaaagaagaaagctttgggccgggcgcagtagctcatgcctgtaatcctagcactttgagagaccaaggtgggtggatcacctgaggtcaggagtttgagaccagcctcaccaacataatgaaaccccgtctctactaaaaatacaaaattatcggggcatggtggtgcacgcctgtaatcccagctacttgggaggctgaggcaggagaatcgcttgaacctgggaggcaaaatttgcagtgagtcgagatcgcgccattgcactccagcctggacaagagctaaactctgtttcaaaaaacaaaaaaagaagaagaaaactttgtcttggcttcataattcagcatcataccataactatgggtattgtgactgtgctttttaccaacttttcttgcacctgtggggttattttgtataaatacctcaggagttataatggggcattatcaaaagcaaatgtaacctctggggaaaatcagtactgttaaccaaattctgtcagaaaggcttcatgaaaatcattgtgttctgtgcagaaaccttcattactttcacgttgacccagaggaaggtaagacaagtaggccaaaatcaagtcaaggtaaaatggaagggagcagttgccacctgtggaactggatggactgtgggagggtgttttgaacgtgggcacaaatactttgaatgagcttttggagagggtactgcttaaatacggctgtggtgtgacctgtggatttgtgtgagttttctgaactccaatcagaaaaacacttgttttcagagaaaggtagacttacagaggactctcaaaagtcctggttgctatgacagtgaaacctttgacaaataattacttaacttctatgccattttctggagcagctgagggcagttatcatatctggcctgtaataaagtaatcaacagtgtttgacaggccaaccatgaggaaaccctaccagataaaccagcaatgctaatagaagctactttcactgaactgattttctagttttcccataagaggagaaatggaatggggatgcaatgtcatctgatgttagaagttgaaatgcagaggtcggtgttcagaaaacacaggatcagagagaccactaacttagaaataggaaaagtgcctttctgatgcctgaaaagtcactcatgcatatttatttttaaatgtttattcatttttgagacagggtcttgctctgtcaccaagcctggagtacagtggcgtgatcacagctcactgcagcctctgactcctgggctcaagtgatcctcccacctcagcctcctgagtagctgggaccacaggtgcatgccaccatagacagctaataaaacaagttttttttttttttgtagagatgggggtctctataacagggggtccaattctagaacaaatccacaattggaattagagtacatctaggaaagaatggaattggagattttgctatttttgagaacttatatacagtatagtaatggaacattatctttcttgcattcaaaagtagtagatttatattagcaaacttaaaagcaaactgaaatttggagtctaaaagtccttattacttgaaaatttaaatggcaggtgttttaaaaagtgagaatgaaagacacttgaaaagcttgggttcatgaaagttagaatggtaggagatactgagaaaaacatgaaagcaggaagaattccctacactctaacacctccttataaattagacattgggttgggaatgagctcactgaagtaccttgtcttcaaagacaaaaaaaaattttctctcatggtgatgtgaataaacacttagaaaatatggattagagccaggcgcggtggctcatgcctgtaatcccagcactctgggaggctgaggcaggtggatcgcctgaggtcaggagttggagaccagcctggccgacatagtgaaaccccgtctgtactaaaaatacaaaaaattagctgggtgtgatggcgggtccctgtaatcctagctactagggaggctgaggcgggagaattgcttgaactcgggaggcagaggttgcagtaagccaagatcgtgccattgcactctagcctgggcaacaagagcgaaagtacgtctcaaaaaaaaaaagaaagaaaatatggattaaacattaagaaggaagaatcgaatatttccatgttacttagtacccttgaaccctgtccttaagcacttgtttgctagctcctgctcttagaaaggaattgcaagtagtgtttttgtccaaggtactgtcatttctcaaggtagccagtgataaaatgtatatactctttgggaccctggatagtcctgaaattcgtgggaacatagctcactctctctgccacctttctaagtcattcccaagagcttctgtaaagatttctatcagtcctctataatcaaggatttggaatgaagactgtgaaaaatgggaactgagtacttagtgtggtcttcctttctggcctgggataactgtgctactctcaaattgtcagctctcaatttctcatgagaatagataaccccaaaatagaacccaaaacacttctacttggctttgagattttactgtatcactttataacctcaaaatctttattatttactttcataattgtattttacttaggatgataaccttaggcaaatcgtgtaatttctggatcgtaatttttttttttttttttttttgagacagtgtttctatctcccaggctggagtgtagtggcacaatcccggctcactgcaatgtccacttctgggttcaagcgattcttgtgcctcagcctcccgagtagctgggattacaggtgtgcgccttcatgcctggctaatttttgtatttttagtagagatggggtttcgtcatgttggccaggctggtcttgaactcctggcctcagtgatcggctcacctcagcctcccaaagtgctgggattacagttgggagtgaccctgcctggcctctggaccataatttcttaacctgtataacaggaagcaaaatgaaaatgtcataaatgtgtaacactagagaatgaaaagctagttcatacggtcagtggctgtgatattgtgaaatacatatttggtcttctgtctctgtttcctggcatgcaatttcaataggttggtgcaaaagcaattgcagattttgccgcaaagtaatggcaaaaaccgcagttgcttttgcaccaaccaaatccctggaatctcctgagtgatggttttttgtatgctaatgagttaactggtggctggcagctcctgggtagtttcaggctggggactggtcataggaaacatcaaagcatgattagagggttgtgactttcagccccactctgcaacctctggggaggagagtgggactgaaggttaagttgatcgtcaatggccagtggtttaatcaatcatgcctagttaatgaagcctccataaacacagggagggcatgaaagctccaagccccttcccccataccttgccctatgcaccttcttcatctctatcctttgtaatattctttataataaaccagtaaatataagtaagtgtttcccagagttctgtgagctgctctagcaaattagttgatctgaaggagggagtcataggatctccagtctgtagcccatcaggcagaggcacagttgaaacaacctggggcttttgatggcattggaagtcgggaaggggaagtctgtgggactgagccctctacctgggggatctgatgcgattctccaggtagatatcgtcagaattgaattgaaggacaccagcaggtgttgactgcagaattgcttgcttgcttggtgtgtggggagaaacccccacacatttggtcttctgtgttgattattgtggtgtgaaagcagaggaaaaacaatttgaatttgtctttccactttcacaatgacatacctgttatgtaacccataaaactatttatgataacatgaaagatgcttatgtctggccagtgtggcggctcacgcctgtaatcccagtactttcggaggccgaggtgggcggatcacttgaggccaggagttcaagaccagcctgaccaagatggcgaaaccctgtctctataaaaaataaaaaaaattagctgggtgtggtggtgcatgcctgtagtcccagctactcaggaggctgaggcaggaaaatcacttgaacttgagcgcccagcagaggcgctcctcacatcccagacagggcggcggggcagaggtgctccccacatctcagacgatgggcggccgggcagagacgctcctcacttcctagatgggatggcggcggggaagaggcgctcctcgcttcccagatgggatggcggccgggcagagacgctcctcactttccagactgggcagccaggcagaggggctcctcacatcccagacgatgggtggccaagcagagacgctcctcacttcccagacggggtggcggccgggcagaggctgcaatctcggctctccgggaggccaaggcaggcggctgggaggtggttgcagcgagccgagatcacgccactgcactccagcctgggcaccattgagcactgagtgaacgagactccatctgcaatcccggcacctcgggaggccgaggctggcggatcactcgcggctaggagctggagaccagcccggccaacacagcgaaaccccgtctccaccaaaaaaaaaacgaaaaccagtcaggcgtggcggtgcgcgcctgcaatcgcaggcactcggcaggctgaggcaggagaatcaggcagggaggttgcagtgagccgagatggcagcagtaccgtccagccttggctcggcatcagagggagaccgtggagggagagggagagggggagggggagggggagggggagagggagagggagagggagctctttattacatttttaaacattgcaagagcctactgatggttttggtgagctcagtatatatggttttctatagtatggttttgatgggctcagtatatatgtcttagtttattgactgtgcaggaactaggtctgaaatctttcattctttcagcaaatatttagcaccaactacatgtcagaccttgttttaggcactagggatatagcaatgaacaaaacagacaaaaaatttgttgtcttcaaggaggatacattctagcagggatggtggggagagacaaacaatggaagaatacacctgtttctgaaaagccaacatggaagtagagacctgaaggaaacgtgagagagagagagaaagccacgtggatgtctgcacaatagaggttcttggatgcagggtatattttgaaggtagagagccagcaagacttgttaatggatcagatgtgaagtgtgagagaaaaagaagactcaaggataactccaaggttttaacttgagcatttgaaaagtttgtgttaccagtttctgagatgaaggcattgtgggaagagtatgtttggtggggagaaacatcaggagtttagttctggacattttaagtgtgagatgcctattaaacatccaagtagagatgttaataggcggttgtttgcacccgtctggagcttaaagaggacctggctgataactttgggagtcatcagggaatagataacatttaaaagccatgacactgaatggaaccaccaagggagtgagtatagatagaaaagagaaatagactggggactgagccatggttactacagtcaccatcaggagaaatgagcagaaggaaccgagaagtggtcagagaggtaagaggaaaatcagaagaaatttgtgttgtggaagtcgggtgaagagtgtttcaaggaggttggaacctgccatgtcagatgctgctgataggtcaaagtgggatgaaggtgagaattgaccactggatttaattgtatttgacaaagatgagatagctgaagcttggttatttgtagtatgatttacaaccaataatccagggttttcagccatgatgcctgaacacagagcatcatgagagagttgcataattgcagtttgaagttctgaacattgtacttttccttcctacctcttttggagtcttcattctgaagaaatgcttttgggtctggttactgctctggggaaggggagtgtctgttaatcacaaattgggtttttaatgacattgggctgctgtgccttttactgcacaaccaatgtcaatgtttgggtttttttcatggtgatgaagactttattcaggaccatggcggcaggtataggtacctctgcaatgagtcttgcagttggggagagagactgagctcaactctgaatagagcacagcaagtggggattgatagtcaaggagcagggtaggggtcagtggatagaaaatgactcacaatgtcagtgtttttatcgtaattgagcctcagagtgtgaaacctttctcacgtggaactcaaagtgcattataaatctgtcattgaacacttttaaaaataaggctaactggccgggcgcggtggcttatgcctgtaatcccagcactttgggaggctgaggtgggtggatcacgaggtcaggagatcgagaccatcctggctaacacggtgaaaccccgtctctactaaaaaacaaaaaattagccgggcatggtagcaggcgcctgtagtccagctactcgggaggctgaggcaggagaatggcgtgaacccgggaggcggagcttgcggtgagctgagatcgcaccactgcacttctccacttcgtctcaaaaaacaaaggctaactttgggaggccaaggcgggcagatcacttgaggtgaggagtttgagaccagcccggccaacatggtgaaacccggtttctactaaaaatacagggctggcgtggtggctcatgcctataatcccagcactttgggaggcctaggcaggaggatcatttgagcccaggagttcgaggctacagtaagctatgatcgccccactgcactccggcctgaccaacagagcaagaccctgtctctaaaaaaataataaataaaaatacaaaaaaaattagctgggtgtcgtggctcacagttgtatcccaggtactcgggaggctgaggcaggagaatcatttgcacccaggaaacagaggttgtggtgagccaagagtgcaccactgcactccagcctgggtgacagagtgacactctgtccccaaaaaataaaaaatagataaacataaggctaatttggctgggcacggtggctcacgcccgtaatcccaacactttgggaggctgagacgggcggatcacttgaggacaagagttgaataccagcctcaagaccagcctgggcaatatgggaaaccccgtctctaccaaaaatacaaaaaaaatagctgggtgtggtggcatgtgcctgtggtcctagctactcagggggctgaagtgggaggaatgcttgaacccaggaggcagaggttgcagtgagctgagatcatgccactgcactccagcctggtgacagagtgagactccattataataataataaggctaatttatatcctgctgagtctctcatagcaccattcttttcctttatagcatttaatctcaaatcataattacatatttatgtgattatttgattatcttatctctcctcctagactgtacactctttgcaagcagaaactatatctgtttggcttactgaagtatcctgcactttgctgaggcctggctcatagtctgtgcttaataagtatttattaatcaatctacataaattacaggtgtcattttatacacaagcacctaaaacacctaatcagcctagctaatgtcccaatcttttttttttttttcttttgagataggctctgttgcccaggctggagtacagtggtgcaatcacagcccactgcagccttgacctactgggctcaagagatcctcccaccccagtctcctctcctgagtagctgggactacaggtttgtgccaccatgcctagctaatttttgtattttttgtggagaaggagttttgccatgttgcccaggctggtctcaaactcttgggctcaagtgatccacttgcctcggcctcccaaagtcctgggattacaggtgtgagccactgctctcagccctacagtttgttttaagttaggttgaggatctgtctcacttcataactagggccgtgaccctcacctctggccccagtgctttatattaggatgaaattactgaaaagaattcacagaaaaatcaaattatcaaatgagtcttatttgcatttcaaataaagggaattctacagtatgggtcttgacactggccttttggaatgtgcctgaggggacagaggtgtgcatcaagtctgtggaggtgcctctcaggatgcagtgctctggaaggtgtggggctggatctggggctagtctcatggtgagtggcccttgaggcacagtggaggctgacactaagtgagggcttgccactctttcagtgccaagtcttattgcccaacctgtatagctacaactgcaaactgatacataccaatgctctatgaatagccatcattaaatttgcttgccagaaatgatacgggagaaccccttttgaaccctcccttcctcagtatgagttgttcatgagtggtgaggacttcctaacatctggagctcagccactcacccagtgtgacacactgcccagggaaaagtgccatcttcagatacgctcagcaagtgctgggattcaccagcctactgggccttagcttgaagtttctttctcagaaaacttattctcttggccccagcctgtaccgatgatgtccccaaaagtaagcttacaggtttttttgttttgttttaaaggaaagagacttctaattcacacatatccatttagtttgattacagaactgaatttgcaaggtgtgaacaggttgttctatgtccttgggcacaactacttaaggtgattaaaaattaaggtataatttacatacaattaaaaacacagatcttaaatattcaatttgatgagttttgacagttgtaccaccatgtaacccaagcaccaaacaagatacagaacatttccatcactctagaatgtagccttgtgcctctttctgttcgattccctccgcctcagccaccaccgccactgccgccttctgactagtgttgctataaataaggctggcttattcctgaatttcaaaaaagtggaattctacagtatgggtcttctgtgtgtgggcctgccatctttcactctacataatgtttttaagattcatacaggctaggcgaggtggttcattgtaatcccagcactttagaagactgaggcagggggatcacttgaggccagcaggttgagaccagcctgggcaacacagtgagactcacatctctacaaaaaaattaataaaatttttaaaaagaaaaaaattcattaatagttaattcctttttactgttttactgtattccattgtgtgacatcataatttatgatgtgaacatttgtttctagtgtggggccattatgaataaggctgctgtgaacatttgtataattttttttgtggacttatgtttttattttcttagataaatatctataagtggagttgctgtgattgggttgatatatgtttaactataagaaactgtcaattttccaaagtggttgtactgttttacattcccaccaagaatgtatgggagttccatttgccgcatatcctctccaaacttcaggattgtaagtcttttttttttttttttgaaatggagtttcactctgtggcccaggctggagtgcaatggcgcgatcttcactccctgcaacctccgcctcctgggttcaagcaattctcctgccttagcctcctgagtagctgggattacaggcatgcaccaccacaccaggctatttttgtattttcagtagacatggggtttcaccatgttggccaggatggtcttgaactcctgacctcaggtgatccacccatcttggcttcccacagtgctgggattacaggcgtgagccactgcgcccggacatttttttttttttttttgagatggagtctcgctctgttgcccaggctggagtgcagtggtgcgatctcggctcactgcaagctccacctcctgggtttacaccattctccttcctcagcctcccgagtagctgggactacaggtgcccaccaccatacctggctaatttttttgcatttttggtagagatggggtttcaccatgtgttagccaagatggtctcaatctcctgacctcatcatctgctgatttgttggagttctgcagacaagtcctttgttacatatatattcagctcatattttttcccaacctgtggcttgcattttcatttttttaatgatgtattttaatgagcagaaattattttaaattttgaaatccagttttcaatgagttagtgctttttgtgtcctgtccaagaaatccttaccccatgatttcaaaaagtactctctgatgtatttttctagaagctttatggttctggcttctacatttaggtctttgatctgtcttgaattaatttttgcatataacagtgagagagaggggttaaggttgtttgccatatggatatccaattgttccaacatcatttcttaagaagaatttttttccccattgaattgatttaatgctttggctgaaaatcagtttaccgcatttgtgtgacttgcagggtaaagatagtattacaaggctgtaactttgtctatagaaatctctaatggctctttttaaaagcccagcactgagaaataaaaagcatattttgtaatttaaaaaagtatggtcaggccaggcgcagtggctcacacctgtaatcccagcactttgggaggccgaggcaggcagatctcacaaggttaggagttcaagaccagcctggccgatgtggtgaaaccccatctctacaaaaaatatgaaaattagctgggcgtggtggcacgcgtctgtaatcccagctactcaggaggcagaagaattgcttgaaccccggaggcggaggttgcagtgagctgagattgcactactgcactccagcctgggtgacagagcaagactccgtctccaaaaaaaaaaaaaaaaaaaaaatcacagggaaaaccataacaggcacttttttttttttaaagatagagtttcactctgttgcccagcctggagtgcagtggcgtgatctcggctcactgcaacctccgcctcccaggttcaagtgattctcgtgcctcagcctcctgagtagctgggactacaggcatctgccaccgtgcccagctaattttttgtatttttagtagagacggagtatcacgatgttggccaggctggtctcgcactcctgacctcaagtgatccgcccgccttggcctcccaaagtgctgggattacaggtgtgagccaccacacccagcctattacaggtacattttttaaaagcttggatggaaccacccaggctccattcatctataaatttctgaagagctagctcactgctgctaataggatcggggagacacaatcccagaacaagtaatgacacttgaaaaaacctgtaggtaggctgggcacagtggctcacgcctgtgttctcagcactttgcggggctgagatgggtggataacttgaggccaggagttcaagaccagcgtggccaacttggcaaaaccctgtctctactgaaaatacaaaaattagctgggcatggtggcacatgcctgtaatctcagctacttgggaggctgaggcaggggaattgcttgaacctgggaggcgaaggttgcagtgagctgagatcatgccactgcactccagcctgtgcaacaaagtgggattgtgtctaaaaaaagaaaagaaaaaactggcaggtgatcaaaagtattcttgaagatatactgagaggtatttaggatgaataatggataccatggcagggaaaacaactattcaactcctatatttctctttcatcagagacccagctggaaggaccatgtgcagggaaggtagcatacccagtgcccagtgggtttgtttcctctgatcaatttgaattacatcccacgggtctcagaaaagtagcagctgaccatgatatactccataaactactgtcaataagccttgaggcattgtggagcagaggcaggtgccagatgataagcgatacacaatgtctgtgatgtttgagcctgatgctggtgattcctcagaactatgcaagaacatctcatcaaacaaatgatccctgagcacctagaaagagaactggagaacactgcaaggtgtgtggatttataaaggacatcatcatctaacatttattaaggcctaactctgcgtcaggtgcctatacacatctggttgttggccttgtggatattatggtcagttctgactgtgtgtgcacttggcaacaatttggtttttttagtatgcttgctggattattagtaaccttgaggggagtgccaaatataaatatcatttatttaaatgtgagctgtgggggttttttgtagtttctcatcccattgggcaaaaagagaaattagagctagtatacttctgtgaaattgtaattactgtacttgaaatcactaatccaaaaaacgatggcagcctcagtttcctcatctgtaaaatgaagataataataatggcacctgcctctggaagttataattgttaaatcagatgatgcctgtaaagcacggggcacgtaatgtttactcaaaaagagatgttgttacgctgatctcattttcagctgacacaaagctggtagggacagtgagtaaatatccaaaattatctcagctggtaaacagtcacccaaattaaactaaatgaaatttattagagtgaaaatttaaagtactgaactcggggtcaaaaaactataatttgtactcccaagttcatagcagcattatggacatagtaaaatgtagaagcaacccgagcattcactgacagataaatggataagcaaaatgtggtatctacacacgacggaatattattcagcctttataaaaggaaggaaaatctgacacatgctacaacatggatgaaccttgaggacattacgctgagtgaaatcagccagacatagaagcacacatactgtatgattccacttatgtgaggtacctagggcagtcagattcagagacagaaagtagaatggtggttgccaggggctgggcacatgggtaatggggagttatgtcgtctcttccaggaagtctttcctgcctgtacactgcctctagcccctgtagttaatggtgctcttctctgcaacagaggcaagtttctgttgctctgcctgtctaccatatgacagatttgctcaagtgcctgtctgatctgtggagttctttgagggtacaggtaacatctgattcatcttttcagtgtcaaaatctgcaagaaattgtgttttatcctcaagtcacctcctggtggtaattccagacagaaaggggcaggggtgacagttcctgccagttgagattgcctcctttaaagaacatttccagacattctgccaaactataccttctatatttatctcatttgacacacctctttacaaggaatgctaggaaatacagggtttttttttcctttttgttttgttttgttttgttttgtttgagacagagttttgctcttgttgcccaggctagagtgcaaaggcgctatctcggctcaccacaatctccacttcctgggttcaagcgattctcctgcctcagcctcccaagtggctgggattacaggcatgcgccaccatgcccagctaattttgtatttttagtagagatggggtttcaccatgttggtcaggctggtctggaactcccaacctcaggtgatccgcccgcctcagcctcccaaagtgctaggattacaggcatgagccaccgtggctggccaggaaatacaggttttaactctgcactttaaaaccccaacgttataaagacttgtcaggaaagaagaattcttaggcaccttctgctgagggtctaaccactatacaagctgcctaatgagtgagtgacctctaaagttatccattgactccaaaattcccagaatctgatttctcacacacagtgaggtgggtgattctttttttactgtaatcctggctactggccgggcgcagtgtcttactcctgtaatcccagcactttgggaggccgaggcaggcagatcatgtgaggtcaggagttcaatactagcctggccaacatggtgaaaccccatctctactaaaaaatacaaaaattagccaggcacggcacatgcctatgatcccagctactcgggaggttgaggcaggagaatcacttgaacccaggaggcagaggttgtagtgagctcagattgtgccactgtgctccagactgggcaacagagcgagactccatctcaaaaaaaaaaaaaaaaaaaaaaaaatcctggctaccttcatgacaatactgcgtcagttggagttcctgggccttataacagagcgtagggcaggggtcagcaaatcttttctgtaaagggccaaattgtaaatttttttttttttaagacagagtcactctgttgcccaggctggagtgcagtgacatgatctctgttcactgcaacctctgcctcccaggttcaagtgattcttctgcctctgcctcctgagtagctaggattacaggcgcacaccctgaagcctggctaatttgtgtatttttagcagagacagtgtttcacatgttggtctcaaactcctagcctcaagcaatccgcctgcctcagcctctcaaactgctgggattataggtgtgagctactgtaccggcctccaaattttaagtattttaagctgtgtgggccgtatggcttctgttgtacctattctgctgttggtggtacaaaagcaaccataaataaaggagtaggtaaacaaatgggtatgactgtgttctgtcatacccatagaactatttacaaaaacaattaccagattggatttctcccacccctgtgataggcagtgggtcgtggcctctagtttggcagaagctggggttctacagactagatacacagaaggtaagatgatgttcaggcagtctgggaaaaaacaattcacaaatctcagcctccacaccaaagtctcaacagtcgggccttttgggttccatgtttctcttaaggacactgcagtttctcagtcacttaggcttaaaacttcagggtctttttttttttttttttaagtggggtcagtcacattgattgaagtataatttacagaacagtgaagtttatcctttttctgtatattctgtgctatcagttttgacaaatgctgtcatgtaattgccaccctagacaagatacagaacagtttcatcaccccacaaaaattcccctgtgcccctttgttgtctacacttagccccagttccaacccttgacaaccactgatctactctttgtccctatagttttgcttttccattatggcatttaaatgggatcacacagtatggtgcctttaagtagggcatctttcagttagcagaatgcatttgagatttgttcattgtggcatatatccgtagtatgttctttctattgctgaatagtatccattggcgttgatatactactgtttatctgtttacctattgaaggatatttgtgttgattacaagatgtggcaattatgaataaagctgctgtagacattcacatataggtttttgtgtgaatataagttttcatttctcttggtaagtactaaacctagaagtaggattgctaggttgtgtgataggtatctatttagctttataagatggcaaacttttccaaagtggctatattattttacattttcgccaataatgaatagttgcttcctacccttgccagtatttgatatcaggttttctgaatttcagacattgtaatgtgtatttaataagttttaatttgtatttctttttttttttttttttgagacagagtctcactctgtcacccaggctggagagcagtggcacaatctcggctcactacaacctccgcctcctgggttcaagcgattctcctgcctcagcctcctgagtagctgggattacaggcgtgcaccaccatgcctggctaatttttttttttttttctagtaggaacggggtttcaccatgttggccaggctggtctcaaactcctgatctcgggtgatccgcccgcctcggcctcccaaagtgctgggattacaggcatgagccactgaacccagccttaatttgttttttgtttgtttgtttgttttgtttttttgagatggagtcttgctctgtcacccaggctggagtgcagtggcacaatctcagttcactgcaacctctacctcacgacttcaagcagttctcctgcctcacccttccaagcagctgggattacaggcacccgccaccatgcctggctaatttttgtatttttagtagaggcagggtttcaccatgttggccaggctggtctcaaactcctgacctcaggtgagccaccgtgcccggccttaatttgtatttctaattaatgctgtctaatgactactgatacggtaagttatagtaattgattttattttttaaattaaatttaattttttttttttgagacggagtctcactgtgttgcccaggctggagtgcagtggcacgatctcagctcactgcaacctctgcttcccgggttcaagcagttctcctgcctcagcctcctaagtagctgagactacaggcacatactgtcatgaccggctaatttttttgtattttagtagagatggggttttaccttgttgcccaggctggtcgcaaactcctgagctcaggcaatctgcccaccttggcctcccaaagtgctgggattataggcgtgagccaccgcgcctggcctagtttttatttttttgaggcagggtcatgctcttgttgcccaggctgaagtgtagtggtgcaaaaatggctcactgcaacctccacctcccaggctcaagtgttcctccctcctgagcctcctgagtagccacaggtgtgtgccactgcacctggctttttttgtttgttttttgtagagacagggtttcaccatgttcaccaggctggtcttgaactcctggcctcccaaaattctgggattacaggtgagccactgcacctggccttttttttttttctttttcagttaaacattttgctatccaggctgggcgcggtggcttgctcctgttaccccagcactttgggaggctgaggctggtggatcgcttgaggccaggagtttgagaccagcctggccaacatggcaaaaccccttctctacaaaatgtacaaaaattagccaggcgtggtggtacacatctgtggtcccagctgctcgggtggctgaggcacgagaatcacctgaacccaggaggcggaggttgcagtaagccgagattgcgccactgcattccagtctgggtgacagagtgagactctgtctcaaaccaaactaacaaacaaaaaaacaccacattctcctatccaatagtagttgattttagaatgttgagccagccttgcattcctgggattaaacccctgttggtcatggtgtattttttttttaatttttatttatttttgttttgttttgttttttagagatgaagtcttgctctgttgcccaggctggagtgccagtggtgcgatctcagctcactgcagcctctgcctctttggttccagcgattctgctgcctcagcctcctgggtagctgggactacaggtacccaccatcacgtctggctaattttttgtatttttagtagagacggggtttcaccatgtcagccaggatggtctcaatctcctaacctcatgatccgcccgccttggcctcccaaagtgctgggattacaggtgtgagccaccacgcccagccacattgctagatttaatttgctaatattttgttgaggatttttgtgcctaagtttatgagacgtattggtctatagttcagttatttattttattttatttttttggctctcccaccctgctgataatcccaaatcctagtgataactgtctgctccatttcattccctccattagaccctccttatgtcttacttgatatcctaactggttctctgtgtctaatgtctcctaaactctatcctacctacgtctttctgccaaattaaagaaaaaaaatgcaggccgggcacagtggctcacgcctgtaatcccaacacttcgggaggccgaggtgggcagatcaccagaggtcaggagttcgagaccagcctggccaatatggggaaaccccgtgtctactaaaaatgcaaaaattagctgggcatggtggcgcacacctgtaatcccagctgctcgggaagctgaggcaggagacttgcttgaacctggaagcagaggttgcaatgagccaagatcacgccactgcactccagcctgggtgacagagcaagactccatctcaaagaaaaagaaaaagaaaaaaaatccaatggttcttattgcttacctgcattagtcaaggtctagacaggaaacagtcagtgtactcaaagggttaattaaaaactctttaatgaagggattattcacaatagtgtgagtagtaaaggaaacatacaagggatagtggagcacccagggactggcaaggtagtgtccccaccctaggtgcaatgacggagtggggatgtgtcactggaacccagcaaaagcaatggccatgggagagaggggtcctctaaaggagctgtgaccttggttaaggaacacagctctgccagaaccatatcctgggagggagagaaggcaaaaaataaacaccttggcctttcctcctgctcgctgatctcttcctggttctttcccttggctggactcagatggaagccagaggacctggagcccagggctttagagactgaccttctgactccagagacaaaaagcagggcagagaggatcaggtagggaaggaggagcagaccaagaatactgagcacacccacctgtcaaagtccaaactcttgagattaacactttacgccaccagttctggctcctactcaccttgctgacttgtcacccctgaaattaggacttttcatctttttatgtcccacagctccctcgttagctcctcagaaaaggtgagacattgaccagattagtattggttttgaacagtggatcagaggcaaacagtcacccccagagcagacagtggaaggaacttgcctggctcacactcatgaggaaggatggaagaagagttgctccacacatgcacatgttacaaaatgactctttttctttcttgtttttatagaggctcagagaagtgaagtaacctgctcaaggtttcatgctggttgtagcaggtcatgcacacagccaggcgtggaaccctgggagagttacctcacctctttgagcatgttttcttatctgtacaacagggttgcatggaacaagggacagactaaacactggctgccctattatactcacttcatattagctcagaattatgaccctcatatttctactcaacttttgaagaagagacatctaagtcagtcacagatagttaacagatatctttttttcagaaaaagattccctatgtactgactcatatctaattggccaggcccaattataagtattctacaaatattaactcaatccttaaatcccctgtgaggtagataaaatttccccattttacagatgaggaaatggagatacagagtgactaaaggacttacctgaggtcacccagctggaaagtgacagagccaggatttgaacccaggcaaggccttgtcaaattgtatatagcctgtcctgccaaggcacacttcattcctgaccagcatgtggtgatgggaaatgtatgtggtcttggcaggactgggtttgtggagatctttggaggcatctgaaggatatgtgcaaggatgttaaagacaaagagtggggaaattttaggggtgagaaagggtagccactgaaattaacaaggaaaaccagctctgcctgcttgggcaggaaatacctagtcagcaagcctgcctgccttcatgccatctggcttcctcgggggccagccaatacccctttatgggagttgatgaagcttccctttgagtcagtggcagtaaaacaggttattaaaaatttttcggccgggcgcagtggctcacgcctataatcccggcactttgggaggctgaggcaggcggatcacgaggtcaggagatccagaccatcctggctaacatggtgaaaccccgtctctactgaaaatacaaaaaattagccgggtgtggtggtgggtgcctgtagtcccagctactcgggaggctgaggcaggagaatggcgtgaatccaggaggcagagcttgcagtgagccaagagcgcgccactgcactccagcctgggtgacggagcgagactgtctcaaaaaagaaaaaaaattctagtccattctgttgttttaagctaccgatacttatatatatttttcacttcatattggctcaaaattatcatcctcatattcctacacagcttttgaagaggagacatctaagttggtcatagatacgtaatagatcatttaaaaaaaaaaaaaagattcccggccgggcgcggtggctcacgcctgtaatcctaacactttgggaggctgaggcgggcagatcacgaggtcaagagatcgggaccatcctgtccaacatggtgaaaccccgtctctactaaaaatacaaaaaattagccaggcatggtggcgggctcctgtaatcgcagctacttggaaggctgaggcaggagaatcgcttgaacctgggaggtggaggttgcagtgagccgagatcgtgccattgcaccactccagcctgggcaaaaagagcgaaactcgatctcaaaaaaaaaaaaagggttccctatgtagtggatacatacattccctatatatacccaaatacaactagggtgagaaggaacacggtgtgagagtggaggaggtgtgccctgggcatgaatttagagaagacatggactgtgtctcactcccttagccctgtaacaattagtaattaatgaccaacaaaatttggctgggcacagtggcttatgcctgtaatcttagcactttgggaggccgaggcaggaggatcacctgaggtcaggagttcgagaccagcctggccaatatagtgaaaccctgtctctactaaaaatacaaaaattagccaggtatggtggcgcatgcctgtaatcccagctactcgggaggctgagacaggagaaccgcttgaacccaggaggctgaggttgcagtgggccaagatcatgccacagcactccagcctgggtgacagaaatgagactccgtctcaaaaaaaaaaaaaaaaaacttaagtagaatctcactacttacctaatgctgcatgcttgacactgtcaagctcctataacagccataacctgtaaataaccaagacacctgtaaaagcagacagtgaccaaatagccgaagggagtccaggacatgaaaattgtagaagataactgtgtgcttgacctgttttctaagaaaactagtagagaagcctgtaggggcagaattagcaaagagaaaagagagagatggtggctgggctcagtggctcatgcctgtaatcccagcactttgggaggtcaaggcgggtggatcacctgaggtcaggagttcgagaccagcctggccaacatggtaaaaccttgtctctactaaaaatacaaagattagctgggtatggtggcgtgtgcctgtaaccccagctactgaggtagtagctgaggcaaggagaatcgcttgaaccggagcggcaaaggttgcagtgagccgagattgcaccattacgctccagcctaggcgacagagtgagactccgtctcaaaaaaaaaaaaaaaaaaaaaaagagagagatggagaaagtagaaaaggaaagcaaggtgactgagtggccacagacagtttaccatcagaaagaatgaaagctggttaaaataaaacaaccccagtgagagtacaggaggcaagccaagcttcacagtcacagagagtggagacaagaggcacgaaattggcagggatctggagttagaggcagcccaagtcatgtgtaatttagtggttcacaaaggaacaggtgtacttcagatagaatcgagcagtacaggatgttatactgggctatgctgacaaaccatcccctactatagacattttcttagtccagtacacttgtgtctacagtaggagcaaaagagatgctgggcttgaaaatgaagttgagaaaacaatttctccagccgtggtgtctcatgcctataatcccagtgctttgggtggccgaggtgggaggatcacttgaagccaggaatttaagaccagcctgggcaacatagtaagatgctgcctctatattaaaataaaattaaaaaaaacttttttattaaaaagccaggctcagtgggtcacgcttataatcccaccaccttgggaggctgagctgagagaatcgcttgaggccaggagtttgaggccagagtttgagaccagcctaggtaacacagtgagaccccatctctacaaaaaataaaaaattaggccaggctcagtggctcatgcctgtaatcccagcacttctggaggcccaggcgagcggatcacctgaggtcaggagtttgagaccagcctggcgaacatggtgaaaccctgtctctactaaaaatacaaaaaaattagccaggtgtgatggcgtgtgcctgtaatcccagccagtcaggaggctgaggcaggagaatcgcctcagcctcagagctcgggaggtggaagttgcagtgagccaagattgcaccactgcattccagcctgggtgatagagcaagactctgtcttaaaaaaaaaaaagtatgtcctaaatgccactggattatgggggttggtttttttgtttgtttgtttgttttttgtttttgagacagagtctttctgttgctctgtcacccaggctggagtgcaatggcatgatcataacccactatagcctgaaactcctgggcacaagtaatcctcccacctcagcctcccaaagtgctgggattacaggcatgaggcattgcacccagcggccactgaattgttcactttaaaatggttaattttggctgggtacagagtttcagtatggaatgatgatgaagtcctggaggtggatgttggtgatggttgcacaatacgaatgtattagtgcactgaactgtacacctaaaaatggtttaaaatggtacattctgtaatgtacatttttccacttcccaaaaaagattctagccagggaccatggctcatgcctgtaatcccagcaatttgggaggccaaggcaggaggattgcttgagcccaggagtttgagaccagcttgggcaacatgatggaaccctgtctctacaaaaaacacaaaaaattagccaggtatgattagcagggcgtgatgacacgcacctatagtcccagccacttacttgaacccaggaggcggaggttgcagtgagtcgagatggcaccactggactccagcctgggtgacagagtgagactgtgtcaaaaaaaaaaaaacccaaaaagccaggtgtggtggctaatttgaaataaggttctttgtctgaattataagtggtcctggctaaatatgcagatgcagtgctactccctggatttggctagatcagggagcttgtgatggtgtcccattagtaggaccagaggtacatatatctgtcactttgtgtttgaaatgcaagctttttatttaaaaagtgagaaaggattccttttagaaccacattttccttttttttttgtttttgtttttgagacagagtctcaatctgtcgcccaggctggagtgcagtggcgcaatctcggctcactgcaagctctgcctcctgggttcacgccattctcccgcctcagcctcccgagtagctgggactgcaggtgcccaccatcacgcctggataattttgtttttgtatttttagtagagacggggttttaccatgttagccaggatggtctcaatctcctgacctcgtgattcgccctcctcagcctcccaaagagctgagattacaggcatgagccaccgtgcccggcctttttttttttttttaaattattcccctttatcccctttctctactctggtttccctatcccctgtaaatgtatttagtatgtatcctttcatttgtataatttcctatgaagcatttttgtttctgtgcatgtgtgtgggtttttgttttgttttgttttgtttgagacagagtcttgctctgtcacccaagctggagtgcagtggcattatctcagctcactgcaacctctgcttcctgggttcaaacgattctcctgcctcagcctcctgagtagctgggactacaggcgtgcacaatcacatccagctaatttttttattttttagtatagatggggttttgccatgttgatcaggctggtcgtgaactgatctcaggtgatccgcccacctctgcctcccaaaatgctggaattacaggcgtgagccaccgcactcagcctgtgtgtgtatttttagtttatataaataatgtattagagctcgctatgttttctttttttttttttttttaccaagttcattcatgtgactgtattcatctagtattgtttctaacttgcagagaaccccagtgggtatatcccccacactttacctgcccacttctgatccccagattgtctccaactctgcacctcagacatgatgtggtaaatatctttgtatcccttatcagtgcatccctatgagaatttctttgggaacacacatacacacacacacgagtagaatttgtgagtcacaaaatgcatagttttaattatatataaggccagattacttgttattcagaacagctgtacgattctgtatcactatcagtagcacgtgaggatagaacctccagtatgttttcagagggtaactttggtgtttcatggacgaatgtggccatgagaagctggtgacaccagtgagtaggcgcatccagaaaacactttactgagcacagtgagttcattaatttattcattcactaatcagtggagggcctgctgtgtttgtgggcctgaggacacaaaagaggagtaagtttagttcctattgcaagtatatagaaggtgcagagggaggagctcctgggggggtacagtcagaaaagatttacagaggagggaagatgtagggtagagaggagttccaggagttggtcatctcaaagaaagcagaagctgtgctatgcagagggacctgccgcagagtcttaatttttttttttttgggggggggtctaggcacagtgtgacttgcttctgtaatcctagcgctttgggaggccaggatgggcagatcagttgaggccaggagttcgagaccagcctgggtgacatagtgaaaccctgtctctacaaaaaatgcaaaaattagccaggcacagtggtgtgcacctgtaatcccagctactcaggaggctgaggtgggaggatcccttgagcctgtgaggttgaggctgcagtgagccatgatcaagccattgcactccagcctgggcaacagagcaagaatctgtctcaaaataaaaattatgatagtgaccaagatcaggagtagttagctttttaaaggtaattggtaggccaggcacagtggctcacacctgtgatcccagcactttgggaggctaaggcagacggatcacctgaggtcaggagtttaagaccagcctggccaacatggtgaaaccccatctctactaaaaaatataaaaattagctgggcatgatgacacatgcctgtagtcccagttactcgggaggctaaggcatgagaatcggttgaacccaagaggcggaggttgcagtgagctgagattgtgccactgcactccagcctggatgacagagtgagactccatttcaaaaaagaatcaataaataattggtaaacaaagggaccgtatggtgtttataaaattattggtaaaatgatgttaccaaaggtaatacatagaagttaaaatagttgtgttagagatttttccctcttaatgacagatttgtccttttaatcataatacagagggtgagaaggttcaggaaagtgtacatataacaaacaggacattttgttatgactccaaatgtagataatttttcacatgcgttaaacatagttcagaggttctcagctggtggctgcacactaggatcacctggggggctttaaaagtgaacgataaaagtgaatgatgaagccaggcatggtggctcatgcctgtaatcccagcactttgggcagccgaggcaggcagatcacttgaagtcgggagttcaagaccagtgccactccactccagcctgggtgacagaacaagactctgtctcaaaaaaaaaaaaaaaatagtgaataatggtcacctcacatccatcagaacggctaaccaacaaaaaacaccagaaaataacaagggttggtgaggacgtggagaaatcagaagtcttgcacgctgttggaggaaatgtaaaatggtacagccactgtggaaaacagtatggtggttcctcagaaaattaaaaatctaattaccatgacccggcaattccacttctgggtatatgccccaaacaaatgaaagcagagtctagaagagatatttgtacaccatgttcatatcagtattattcacagtagctaaaacatggaagcaacccaggtgtccattgatagaggaatggatcagccatacaatggcatattactcaaccttgaaaaggaaggaagtcctgacatatgctacaaggtttgtaagggtgaaccttgaagacattatgctagccaaaataagctagtcacaaaagcacaaataacgcatgatttcacttagatgaggtatctaaagtagtcaaattcatagagacaaagtagaatgatggttgccaggggctggggcgggggtagtgggaatgggaagttattatttaatgggaataatgggtattatttaatgagtttttagttttgcaaggtgaaaagagttccagaagtaaccatccaccagggtggtggtgatggttacacaacaatgtaaatgtatttatttatttatttacctatttattttattttatttgagacagtcttgctctgtcgcccaggctggagtgcagtggcttgatctcagctcactgcaacctccgcctcccgggttccagcaattctcctgtctccacctcccgagtagctggaattacaggcacatgccaccacgcccggctaatttttgtatttttagtagagatggggtttcacgatgttggtcaggctggtctcaaactcctcacctcaggtgatccacccaccttggcttcccaaagtgctgggattacaggcatgagccaccacgcccagctgtaaatgtatttaataccactgatgtatatacttaaaaatagttaagatggtctgggcgtggtggctcacgcctgtaatcccagcactttgggaggccaaggtgggtaggtcgcttgagctcaggagttcgagaccagcctggtcaacatggcgaaacctcatcactaccaaaaatacaaaaattagccaggggtgatgacacacacctgtaatcccagctatcatgtggctgaggcaggagaatcgctcgaaaccaggagggggaggttgcagtaagctgagattgcgccactgcactccagcctgggcaacagagtgagactgtctttaaaaaaaaaaacaaaaagtaggtcaggctcggtggctcacgcctgtaatcccagcacttcgggaggctgaggcaggcagatcacaaggtcaggagatcgagaccatcctggctaacacggtgaaaccccgtctctactaaaaatacaaaaaaaaaattagctgggcatggtgggggggcgtctgtagtcccagctacttgggaggctgaggcgggagaatggcgtgaacccgggaggcggagcttgcagtgagccaagaccatgccactgcactccagcctgggcgacagagcgagactccgtctcaaaaaaaaaaaaaaaaaagtaaattttatgtatattgtactacaatttttaaaataacattaaagtttaaaaagagaaaaagaaaatgacggtgatgtggcccacatcactcttgtctgtttcagtgggtctagggttaccagtgatgctaatatggagtggggaactgctggtttagctgggggaaatgttggatggggaaccctgatattctgagcacacctacatctcatcttggttttcccacgacattgatcccaagcaaaggacttttgtttggttttgttctttattgtataacccttgtgatcagaagaaaaactctacaatgaataagacagaatcatgtctcagaaaatttggcaaagttcaaaaattgaaaagaaacaataaaaatcattcataatcccatcaacctcagcaatcaataaattcaggagtattctagtccttctacagcattgaatagagatattttatagatatattacagatatccttatatatatactcatacctattatacttcttttgtgtgctttttttaaaaaaaaccccatacttctgatagtgtgtgtttttccctttcagtgacaatgtggtgaatgtctttcaggttattgagggccttctacttcatggttttcagtaactccacagcattctttatctaacccattacttgtattggacatctagattgtctcccagtttttcactatgatagccaatgctatagtaaatatctgtatacaaaaaaaccttttttcctttcttgagacagtctcactctattgcccaggctagagtgcagtggcactgtcatagctcactgcagtcttgactcctgggctcaagcgatccttctacctcagcctcccaaatagctgggactataggcatgtgccaccatgccaggctaatttttttttttttttttttttagtaaagatgggtgtctcactaagttgcttgtgctgatcttgaattgttgatctcaagcaatcctcctgctttggccccccaaattgctgagattgcagacatgagccaccacacccagcctaataaaatcttttttttttctttttttcttttttttttttttttttgagacggagtcttgctctgtcgcccaggctggagtgcattggcgcgatctcacctcactgcaggctccgcctcctgggttcacgccattctcctgcctcagcctcccgagtagctgggactacaggcacccaccaccacaactggctaattttttgtattttttagtagagacagggtttcactgtgttagtgaggatggtctctatctcctgacctcgtgatccgcccgcctcggcctcccaaagtgctgggattacaggcatgagccaccgcacccggcctaataaaatctctttaagcatactttttcttttagccagtttgatgaaaaaagttttttggtatttttttttctagtgagcattttcctatgtttgctaccatgaaaattttaattatacttaatctgtatagcaattagttctttcactttcctcttgaactggtttttgttttccattcttctttttcttttcttttttttttttttttgtgacggagtctcattctgtcacacacgctggagtgcagtggcacaatctcagatcactgcaactttcacctcccaggttcaagtgattctcctgcctcagcccctcgagtagctgagaatacaggcttgcaccaccacacctggctaactttttatatttttggtagagacggggtttcaccacgttggccaggctggtctcgaactcctgacctcaagcgatccacccacgtcagcctcccaaagtgctgagattacaggcatgagccaccacgcccggcctccagtctttctttctttctttcttttttggatagagtctcactcttgtcgcccaggctggagtgcagtggtgtgatcttggctcactgcaatctctgcctcctgggttcaaatgattctccttcctcagcttcctgaagagctgggattacaggcatctgccaccacacctggctagtttttttttttgtatttttagcagagatggggtttggccatgttgacccggctggttttgaactccttacctcaggtgatccgcccgccttggcctcccaaagtgctgggattacaggtgtgagccactgtgcctggcctccactcttcttttctttgtcatatatagaatcatgaacttttatagcaagaaggaaccttaaagatcaatcactccccttattatacatttaaggccctgaaagttgaatcttttgaccagggttacacagaaagttaagtagcagaacagagatttaaactcaactttattcattttccgtttttcctcttatccttcagtctccatggaagaagaagattctgcagtgtttcatcttggaacagtatttcttttttcttttgagacaaggtcttgcactgttgcccaggctggagtgcagtagcacaatcatagcttactatagttgtgaactcctaggttcatgtgatcctttcacctcagcctcccaggtagctaggactacaacaagcgcatgccaccacatctggctattttttaatatatatattttttaatagagatgacatctcgccgtgttgcccaggctactctcaaactcctggcctcaagtgatcttcccacctcggcctcctgaaatgctggggttacaggcatgcatgagccaccatgcctggcctcgagccctatttcatttgtgcttttctggcagagaacttgttacttccttatttgaaagtagccttcgcaccactgcactccagcttgggcaacagagcgagactccatctcaaaaaaaaaagaaagtagcctcagctgagtgtcctctccagtaataaccagtgtaatgtttgctattctaggagccatgtctgaccaggacgtttggaagatcatatccatgccagaggctcttgtgaggagatgagttggtaaagagagaggctgggatgaagatgctgccaggagtgggcgtgtttgggactggcagctccgcccgagttctggtcccactgctgagggcagaagggttcactgttgaggccctgtgggggaagactgaggaggaggcgaagcagcttgctgaggagatgaacatcgccttctacaccagccggactgatgacatcttgctgcatcaagatgtggatctggtgtgcatcagcatcccccctccactcacccggcagatatccgtgaaggctctaggtacgcccggcaggccacagcaggggcagatcatgtctctccctctgggcagtcctctgagggtcactcctctcctctgagctctccttcctgggctcgcatctgcagggaggagaactctgggacatcacttgtccctgaagcagtgcttggggagggcatgaaaaaagacatagcctaacctacctcccatctgtaaatccctgaacagaaattaaggaaatactctaagagacagccatcaaggggctggagatggttgcatctcagtcaacataaagtttgcctctgtgaagttagaggtcagagccctgggtggcggggaattggttgtgactagtgtgtttgttctcccatttctggggcacacagcaccacaggaaggagaggctgtgtagcaaggctaccatttcccatgttttgtcagcgtttgactatagtgagcacacacccttcctgccaaactgcagtcttgtattgccggaggacaggaaggctctgccagcattgggcttccctgacaggatccgtcgacagcctgcttacatgacatctccactcccttgggaagttttgggcttggtaacctcttgcccctgactgggcatggcctgctgagctgttctcctacagttcccgttggtcttctatttccagtcaactggagtcaacttcttctctttatctaatataaatcagaacctagtttactaagtaaacaaaccagtaaacattcagccagcaatttttattttattttgagacagagtttccctcttgttgcccaggctggagttcaatggcgcaatcccggctcactgcaaccttcgcctcccaggttcaagtgattctcctgcctcagcctcccaagtagctgggattacaggtgcctgccaccacacccagctaatttttgtatttttagtagagacagggtttcaccacattggccaggctggtctcgaactcctgacctcaggtgatccatccgcctcggcctcccaaagtgctgggattacaggtgtgagccaccatgcccagcatttttttaaaattattattattattttattttatttttttagatggagtctcactctgttgcccaggctggagtgtgcattggtgcaatctcagctcactgcaacctccacctcccaggttcaagcgatactcctgcctcggctttgcaagtagccaggactacaggcatgtgccaccacgcccagctaatttttgtctttttagtacagatggggttttgttatgttggccaggctggtctcgggctcctgacctcaggtgatccacctgccttggccgcctcccaaagtgctgggattacaggcaggagccaccacacccagcctcaattatttttttaatgcctcctgtgtgccagtcactgtcctgatgtcattttggacattcaaagctgtgttagattggacccctccctgtcttcagattttatagtccaattgaggcaactagaaataacacacattacaaggtagatgacagaagacatagtcacaattcaactagcacatacttacttgactgagtaactgttttatgtgaggtaataggagccaagtgtctccttgatgcagccgaagatctctaggtcgaggaaccggtgccatgaggttgtcctccactcttcctgaccactgccatggtggcaaacctcagggtctgctacttatctcctccctcattctgaggaatgtcataggaaggtgtctgtcacctctggctcagtgggtagggaaggataaatgttctttgaagtgagaaagaacttcagtctgtccggttgtcaatttggagcaagtaagttttggccttattgtttgtttcttccagagagctctctctgaggatgtgtgacattggagttattcattcattggtcaccaaatgcttgggaggtcagatggtggctcccagattgaattcagaaatagacctaagtcaacactttagcagcaagttggttcaaggggaagcaagccgctattggtcacttgactccttgccatcccttgtggcttgaatgcaggctggaaaggtgaggtgtgtccggagccagaactctggaggctctcagtcttcttcctgaattttagggttccccacagagaccatttccaagctatacgggaagaaagaggaaaccccagggttctttggcaacaagcttgctttttttctggttcttggtatgctccaccagcagcagcatcacctgggagcttgttagaaactgaattctcagctgggcaacatagtgggatcccgtctctacaaaaaagtttaaaaattagccaggcatggtggcacgcgactgtggtcccagctacttgggaggctgaggcagaaggatcgcttgagcccaggagatagaggctgcagtgagcagtgatcatgcactccagcttgagtgacagagtaagactgtctcaaaagcaaacaaacaaaaagaaatctaaattctcaggccccactccaaacctactgaatctctgggatccagctatctgtgtctgaacaagccttgcaggtgactctggtggacatgaaggattgagagccactgatccaatcattttgaattaaactgaggcccaggagcattaaggaatgacatcttggttacatttcaccaagtcttcgtgctgtgatttttctctccttgctagagctttatatttttaccttacttctaaggccacgagatcatttcttgccctcattattagtttttcctaaaattaatgattggacttaaccttccagagataatacttttcatatcacagctctttttatggcatcttgttttctgctttggtctgacctatgttcttcatcttctacctccgatttcatccttaaagctttcccatgaatttcttaaaggggagaggggaagggccctaatatattttattcttcagttcagaagtggttcaggaaattatattttaagtgcaaggtgcccctagcatctttgccacagttgaatgttttcttaagtctgtcactaaaaggtgggcttctgtgcccaattcttggcacttctgtggttcattagaaaaacactaagtttgcaggccaggcttggtggctcatgcatgtaatcccagcactttgggaggccgaggcgggcggatcacaaggtcaggagtttgagaccagcctgaccaacctggtgaaacctcgtctatactaaaaacacaaaaattagctgggcgtgttggcacgtgcctatagtcccagctactcaggaggctgaggcaggagaattgcttgaacccaggagatggaggttgcagtgagccgagatcacgccactgcactccagtctgggtgacagagcgagactccatctcaaaaaaaaaagaaaagaaaagtaaaaagaaaacatttttgtagagacaggatcttgctgtgttgttcaagctggtttcgaactcctaacctcaggcaatcatcctactttggccccccaaagtgctggaattataggtgggagccactgtgcccagcagatttcagcttctccaatctctcccttgacttcctggcaggagagctagataaactcaggtagacatgtctttcatggctacccaaagactctgtacagctagccctcaggagcctgtttaagtcaagatgtccttgcagtcccacactgatactactgagccctaagtttaagagtgctgttattcagggttgggctcagtgcctcacacctctaatccagcactttgggaggccaaggtgggcagatcgcttgaactcaggagttaaataccagcctgagcaacatgatgaaatcccatctctaccaaaaatacaaaaaattagctgggcacagtggcgtgcacctgtggtcccagctacttgggaggctgaggtgggaggttagcttgagcccaggaagcggaggttgcaatgagccaagattataccactgggtaacaaagcgagtccccatctaaaaaaacaaaaacagactatttttcagattcaagaagagaggtctttccctctttcctcacctcttgaggcatgaaacaggaattccttatcctagttttatcaccaccaaactcctagcagtcataaaagtcctttttcctctaaacccacctcctctctgcctcacactgcagtatccactctgtcgccagcagcgaggcattatagcaggaggcttctgaattggccagaacagcagctctcaggtggggtgtctgagaacctcatttcctcattacatccctccctggtcagccatatgtgttcagcagccaaatggcaaaattcacccccagaactgtgattgtcttccctaatctggaaggcccacaagtgtggagaagcactggagaccctccagaagcagtagtgctagcagtcaggggctactctccctgccgggccccgtgcaagggcctggccaccctatcccaggtatgtgacacttggctggctgttctttattgtcctgctagtacctgttgtaaagcttcttttattaaagaagagcaggagattgaagtgtcataaattgaagagattcacaccaacacggcacatgtatacatatgtaacaaacctgcacgttgtgcacatgtaccctagaacttaaagtataataacaaaatatgtattaaaaaaataaataaataaattgaagagattgaatgatgtcatagactaccaatccacatgccttgttccttgctgcagcactgaggtttgtaatcctgggagtttagacctacgtaagatgcccataagtacaaatgacagatgctctgtggggttcttcagggtcaaggtggcagaggtgggggtaggaagtgagaggagggggaagggttgaccagaggcaccaatttgtctcctgtgggcttggtcagtatgtgagctaccagggggccaggctgggcctgactctcggagaggcctaataaacagtacgtatgataaaacaactcctctgtattcgttttgattttatttattttttgagacagagtcttgctgtgtcatccacgctggagtacagtggcttgatcatagctcaccgcagcctctaactcctggactcaagtgattcttccaccctagcctcttgtgtatctgggactacagctgtgcactgccacacctgtgagccacctcacccagcctgaaaattagattttctaaaaagacattataaaatcaacatgggttgggcatggtggctcatgactgttatcctggcactttgggaggccaaggcaggaggatcacctgaggccaggagtttgagaccagcctgggcaatgtagcaagaccctgtatttacaaaaagtttaaaaatcagctgggcgtgctgtcactcatctatggtccttgctacttggaaagctgggaggaaggctctgtttgagctcagaccaagactgcagtgaaccagaatcccgctactgcactccagctaagtgacaaagcaagaccctgtttttttttgttgttgttgttgtttttttttttttgagacgaagtctcgctctgtcgcccaggctggagggcaatggcactatctcagctcactgcaacctccgcctccggggttcaagcaattctcctgcctcagcctcctgagtagctgggattacaggcgcctgccaccccgcccagctaattcttgtatttttagtagagatagggtttcatcatgttggtcagggtggtctcgaacccctgacctcgtgatccacccgcctcggcctcccaaagtgctgggattacaggcctgagccactgcgcccggccaagaccccgtctcttaaaaaaaggaagaagaaactaaatcagattttcaaagtacagaacatagaaattatttacctggggccgacgcggtggctcacgccccagcacttcgggaggccaaagtgggtggaccacctgaggtcaggagttcaagaccagcctggccaacatagtgaaaccccatctctactaaaaatacaaaaaacttagctgggcatggtggcaggctcctgtaatcccagctagctcaggaggctgaggcaggaaagtcacttgaacccaggaggcagaggttgcagtgagctgagatcgtaccattgcactccagcctgggcgacaagagcaaaactctgtctcaaaaaaaaaaaaagaaaaaaaaaagaaattatttacctggaaaatgtagtttctatgtgagtcttttatttatttatttatttgagacaaagtctcattctgtcacccatgctggagcgcagtggcttgatcgcagcaaactgcagccccaatctcctggactcaagggatcgtcctacctcagtctcccaagtagctggggctacaggtacacgccaccacgcctggcttattttttatttttaataaatactaggtcttgctatgttgcccaggctgattttgaactcctgaactcaagtgatcctcccaccttggcctcccaaagtgctgggattataagcgtgagccaccacgcccagccaagtcttaaaatccaagtcacaatgggctttttttctctgtatttacgacattggctgaatccctcccttggcgatggtaataaaatgtactgttgacagagctgtactgagccaggtactttacatatactgctttggttgccttagtcctcctttcttcccctgtaactgtaaaatcctgctttacagttatagtagtaaacaaaaacccagggaagtttagaaacttcccagatcatctagcagtgaagtgagagagccaagatttgagcacaggaatttctggctccaaagcttgagtccagcaccagtaattgactcttcctgggtagtcagttgtcctggggcccatccatcatgtgggacatcggccatttctttttctttttcttttttttttttttttttgagacagagtttcactctcgtcgccaaagctggcgtgcaatggcgcaatcttggctcaccgcaacctccacctcccgggttcaagtgattttcctgcctcagcctcccgagtagctgggattacaggcatgtgccaccacgcccagcgaattttgtatttttagtagagacggggtttcttcctgctagttaggctggtctcaaactcccaacctcaggtgatccacccaccttggcctcccaaagtgctgggattataggcgtgagccaccatgcccagccaagacattggccatctctatgaagttttcttagtttttgttgcaagatttattgtctgtagttactattgtttctgctgtaagctggcccctcctgagcctgtgtgaacagaatccatcttggtccatcagggtaagctgcaccctgcagtgagccatcagaaataatctgtgtcttaaccattacctcatctgaaaacattcagaaaatgtttgggggcctgagggaagatgagcaccatggttactgaagatgcacatacctggagaaggcacattcttgtgaccggttgccccaggtcacaggcatccaggcctaaggctgcccctccaaccaggaagtacctgtggagtgccagagtggagcctggatggctgtggaggagaagcccaggtgcacacattgcccagatgggcttcaactagaagggtaagcacatgaattagtccagcccaagacttggtatccagttttccacattgcatgtaggctctgtgtaatgctttcagtctcgtttcctaacccacccctgccttctcagtccttcagcatttcgtgatcattgcctctccccaatccccaagtccttctgcacagcagcccccatctcacattcagtggctagagcaggatgagcaaccgagagaccacaggaggcaaagagtcaaaaagataattttggagtggtcaggcatggcagctcatgccttaatcccagcactttgggaggccaaggcgggtggatcacctgaggtcaggagttggagaccagcctggccaacatggtgaaaccctgtctccactaaaaatacaaaagttagccgggcgtggtggtgggcacctgtaatcccagctactcaggaggctgtagcaggagaaccgcttgaacccaggaggcggaagttgcagtgatccgagatcatgcgactgcactccagcctgggcaagagtgagactctatctcaatatttttttaaaaagaaaattttggaggagtgcacagatcatgtatcaagaccttatgggtggggcctttgtaaggactttggcttttattccgagaagctattgcacattggagagctttttcgtgggtttttgccagggtgtctttaccctttctggcttactatgacttgtaaacttctgtatgtgtctagtccatactgctttttgggctttctaagttttctatttaaagtattagcacaggatttccttcgacttgaaccacacaaagctcgcaggaacactgcaggtgttagtgtctcatggctgctcatatcctcacaagctttcatcttgaaacatggagcagcattcatcccttcagttcccagctgcttatcctctagcactctcctcagggctttgtccagctttgtttacctctgggtgcgtgttggctgcagcgtacccagaatgggtgtgagggcaaaaagggtattctcacttccttcccttcctgccggagccaaacatgttctagccttgggccactctaacttgttggaccagtgttttcagagaacaatctgcagggaatcttagggccctctctggagttatgactaagagtagaagttatgaatagtccatcccctagaaaataggttagatttccttgccccaagctgatgacctaataaatgcatgacaacatagagacacgtccatgaagtgtgcccacctctctagcccacctgtgttattcagggttctccagagaaacagaaccaatagggtgtttaagacagagatttatttgaagaaattggggccaggcatggtggctcacacctgtaatctcagcactttgggaggccaaggcaggaggatcacttgggccctgcctaggcaacagaggaggaccccatctctacaaaaaaaaaattttaaattagccaggcgtggtggtacacacctgtggtcccacttaggaggccaagatggaggatcgcttgaggccaggagattgagactagcctgggcagcatagcaagaccccacctctacaaaaaagaaaaaaaaattagttcgtgcagttgtaaggcagagaagtccaaaatcctcagggcaggcggacatgctggagattcccccttgaaactttgagatttcctgttgtgtcctgttgttaggtattgggaagaatgtggtttgcgagaaggcagcaacatcggtggatgccttccggatggtgacagcctcgcgctactacccgcagctcatgagcctggtagggaacgtgctgcgcttcctgcctgccttcgtgcgcatgaaacagctgatttcggaacactatgtgggagcggtgatgatctgtgatgcccgcatctactcaggcagcctgctgagccccagctatggctggatctgtgatgagctcatgggcggcgggggcttgcacaccatggggacctacattgtggacctgctgacccacctgaccggccggagagccgagaaggtgcacgggctgctcaagacattcgtgaggcagaacgctgccatccgtggcatccggcacgtcactagcgatgacttctgtttcttccagatgctcatgggtgggggtgtgtgtagcacagtgacactcaacttcaacatgccaggcgcctttgtgcatgaagtcatggtggtaggctctgcaggacgcctcgtcgcccggggagccgacctctatgggcagaagaactctgccacgcaagaggagctgctcttgagggactcgctggcagtgggcgcaggactgcctgagcaggggccccaggatgtcccgctgctgtacctgaagggcatggtctacatggtgcaggccttgcgccagtccttccaggggcagggcgaccgccgcacctgggaccgcacccctgtctccatggccgcctccttcgaggatgggctgtacatgcagagcgtggtggatgccatcaagaggtcgagccgatccggggagtgggaggctgtggaggtgctgacggaggagcccgacaccaaccagaacctgtgtgaggcacttcagcggaacaacctatgagcctgcacctgggctccttgccacagggcagagggaccagggaggggaacaggagccagacatgacagggacttggccctagcagagacagtgtctttcatttaatgagtctgggtgaagccagaggtggctctgggacttcgccccctccagtggctcatctgctcctcagacttgcagggtggcaaatgttcctgttgccaggttaccacggtgtgcacagggcagagctgccgccaggcctcctcatggtgatgccagtgagtcggaccaggaaaggctcaccctggggagcccttcagcctgatccgcagtcctaacagggtgagaaagcacaagaggggccagctcggctgaggcctgaggagaaatgatgagaagttttgtttcgttcttgggctggggcatctcaggaacagtgagggcaacaagctgtccctcagggaccctcacctgccctcccatgtgaccaggcccttcccaggtggggactggggcttgctttattaagtgagctcttgggcttttgaagtaggacagagggccctggtttggcagagaggaggcaagggagggctttagaacatctgagaaatgttaataaataattcagaaaata

SEQ ID NO: 36 - DNA, 155813 bp, Homo sapiens
gattagtcaggcctcagaaagatggcgtcctcggagcaggcagagcagccgagccaggtaaggggagtgggactgccccgctgtgcggcggagaccccggctggagggggcgctcagcatacggctgggagccgggtagggaccccgagtctccgaagctggggaccccgacctcttgccccctcctgagccccgcccctccccaggtcctccccacccggcccctccccccggtgacccctctttgaccacattccggagcccgggctctggtgtttggctgtgcccccgggtccccacttcccgcctgccagcacctctggtcccacttgagcttgttggggagggtgacgggacccttgggaagtccccagccttgagctgcgagggcttgagaaggagaggatagatcgatcgttcccggctgtcccctccggggaggggcctgtttccattagggttcccactccctcacggcctcagcctcctggagcggctgccagcctcttcatctgtggtcacctttgcgcttctctcgtcaagttggatagtcagaaataatctagtcgagccctctcagtgcgttgataggaaagggacgcactgtgactaacagacgccaccaagcttttggctgaggacccatcctcgcttccctgggtttggttttgttggccgagggctccgctctagcttttcacctgcagattcagacaaatcccactccaataaggggaccataaggaccagcgttgacgcctgtgcctctgcggccgggaggcagtggatgataaggtctccgaaggggtttatagtccaaaggtggggtagggtggggtgaggagaaaagggctaagagacatcttacatttaactgcctgtgtggtgtcatgttgagcacaaattacatctattatctcgtttagtgttcactacaacctttatgaagtgcaggctactaacctccatttcacagaaatgaatactaagggtttgtgacatgccccaaatcgtgtgctctgttgagcctgtattgaacctgtgtgactccactagtcatccatacatttttgagtttagttaggattagaatgaggaagaagaaaatagtttcaacttggggcctcattcctcctctcccatctccttgaagcacctctaagagttttcagcaacttactagtatttcacttccttcagaggcagaagaccaccgcttagtgtttcttactgtcttattctgcacgtctgttacaagaattgaacttaaaggagttggtgtgttcccccataccagtttctattagcagtgtgaatgattcaggaagaagatgtcttgattgtaaaacatgggagataacaaggactgattctggccttctcactgtcaggtgttctggagtttggcaagtgtctcgagaggagggcctctcctttcttgccttaccacatttagtttgctgaaatactaaggcatcttggggtctgggtttctctgaattgttttgtgttaggaatgcccacaggctgggattgaagggtgtcctcagttcctgattcttttttctttcttaagacggagtctctctctgtcgcccatgctggagtgcattggcgcaatctcggctcactgcctcccgggttcgagcaattctcctgcctcagcctcccaagtagctgggactacgggtgcctgccaccacacctgactaatttttgtaattttagtagcgataggtttcaccatgttggccaggctggtcttaaactcctgacttcaagtgatctgcccgcctcagcctcccaaagtgctgagattatatgcgtgagccaccgtgcccggctctgttcctgattcttataggacatttaatttgccagtgctgtaaacagtactaaaaatcttgccacttggagccactgttatgcccaaggattcttttggttttgcaagtttgccctctctgtatatgtatttaatagaaaaggatctaaggtcctttaagggggcatggccatcacttgtttgattttcagctctgcttctcctttgccctcctttccaaagctggtggaggtaggattgccacagaacatgctggcagcctgggggaaaaacttgaacttttctttttttttttttgagacagagtctcgctgtgtcacccaggctggagtgcagtggcgcgatctctgctcactgcaacctccgcctcctgggttcacgccattctcctgcctcagcctccctagtagctgggactacaggcgcccgccaccatgcccagctaattttttgtgtttttagtagagatggggtttcaccgtgttagccaggatggtcttgatctcctgacctcatgatccgcccacctcagcctcccaaagtgctgggattacaggcgtgagctgcagtgcctggccaaaacttgaacttttcataacagactctatggctatctaacaagaagcaaatgcacgctttttgaatgaaccaatgctcttcagcaattgcctgtttcattttcaagtcttgatcaatccagtttcccatttctccgattaaagcagagtaggattgaaaggattgtttagctaattcccccacgccttgttgtgtagggttagaactgtggggctgagccagtattctgtctttcacagaaagtttgttggttagccttgtcatatcaatctctggtttccagctattaaaggtgaataaccttctcttcccttgagaggcagtgtagaatagcggttacaagtataggctctaaagccagacccactggcttggaatcctaactccactaacttaccagcaatgtcatctcggacagatctacttaatttttctagacttaatttctccatgtgcaaaacagggaaaatactaggacctatctcacagagttgctctgaggactaaatgagttatttatttatttatttatttttgagaccgagtctcactctgttgaccaggctggagtgcagtggcgcgatctcggcttactgcaacctccgcctcccaggttcaagtgattctcctgcctcagcctcccaagtagctggggctacaggtatgcaccaccaggcctggctaatttttttttttaagtagaaatggggtttcaccatattggacaagctggtctcaaactcctgacctcaggtaacctgcccacctcggcctcccaaagagcttggtattacaggcgtgagccactgcacctggccttaaatgagttatttatgtaaaaatgccagaacagtgcctgaaacaatgtgttgtctattattattattattcaatttaataagctctgagttttcactcacaaatggatctaaacctttcttcaagttctattacgacatcttttggggtatgatttttcatgtgttgactacttgtctagtaaagttcttttattcagaagtaattccttaaaatttcaaggaatgccctgaatgctagtgtttattctagctgtccttcatgacttttgcatttcaggaacatacttactttttcataatggtatagtctttttagtctatcctcaagacgacttgctggaatttcatttattgcttcctttgttctgtgttccccacattgctctgttttatgtggttgatctattgattgagacagggtctcactctgtcaccagagtgcggtggtgtgatcatggctcactgcatccttgcccgcccaggctcaggcaatcctttcgtctcagcctcctgagtaaccgggactacaggtgtgcaccaccatgcctggctaatgtattttttttttttttgagacagagtctcgctctgtcgcccaggctggagtgcagtggtgcgatctcaactcactgcaagctccgcctctcgggttcgaaccattctcctgcctcagcctccagagtagctgggactacaggcacctgccaccacgcccggctattttttttttatttcatttttagtagagacgatgtttcaccgtattagccaggatggtctcgatctcctgacctcgtgatccgcccacctcggcctcccaaagtgctgggattacaggtgtgagccactgtgcctggcctggctaatgtatttttaaaacaatttttgtagtggtgagttcctggctgggcgtgatggctcatacctgtaatcttagcactttgggaggctgagttgggaggatcgcttgaggccaggagtttgagaccagcctttgcaatatagggagacctcgttcctactgaaaattaaaaaattagccaggcatggtagtgcttgcctgtggttccagctactttggaggctgaggtgagagcatcacttgggcctgggaggttgaggctgcagtgagcggtgattgtgccattgccctccagcctgggtgagagagcaataccctgtttggggacgggggaagagacagagagagagaaagtgctgagattataagcatgagccaccacgcccagccagcatggctgatctctcattgaagtcctttctagtgtgtacacgttggagcccgtaggaatgagaaacgttatctctatttcccaactttcctactagcttttcttccttcgctgaacagcagaggcatggttcaatctgattacttcacagttactgagtatcgagtattattgcagaaggtagatttcctatctgtggaggttcactgggtacagtaaattttgcattgagaggctacagaagcaggcagggagaagagcagagtgaaagagtggaagagcatggcttcgcatcctggcaggttttggtggaacttcatcactcacaactattggacttatcactccacctttctgagtatgttttctcctctgtaaaacgagagcaataatagttacccttaaagctgggtgtggtggtgcatgtctgtagttccagctactcaggagactgaggctggaggattgcttgagcccaggagttggagtctgtagtgcacgatgatcacatatgtgaataaacccctgtactccagcctgggcaacagagtgcaaccctatcacttaaaaaataaataaataaaataaaaaataattacccttttagtgttgactgaaatcacagatgtgaagagcacctgctgcatagtaagtgctcagagttagttttcttctcccagtctttacatgtagttttgagagtctgttgaactcttgaataacagcaggtcagacaaggtatttgccctctcaatgttttttttttttgttttgttttgtttttgagatggagtctccctctgttgcccaggctggagtacagtggctcaatctcggctcactgcaacctcagcctcccaggttcaagcggttctcctgcttcacctgcctcagcctcctgagtagctgagactacaggtgtgtgccactacgcctggctaacttttttttttttttttttttttttgagacggagtcttgctctgtctcccgatctggagtacagtggcacaatctcggctcactgcaacctctgcctcctgggttcaagcgattctcctgtctcagcctcctgagtagctgggactacaggtgcccgccaccatgcccagctaatttttttgtatttttagtagagatggggttttgccatgttggccaggctagtcttgaatgcttgacctcaggtgatccacctgcctcggcctcccacagtgttgggattacaggtgtgagcctggcacctggcctcaactttttattttgaaaaatttctcacgtatagaaaagttgaaaggataatactgagaacttctgtaaaattcccataaaaacttaaccaagatgcactgttcacattttgctgaatttgctttatgtcagtctctctctctctttctctctctctctctctctatatatatatttttttttttggaaggatttgtggtaagttacagacatcaaggatatttcatcctagaatatttcaccttatctctcataagagtaaggttattcccctgtataaccacaatatcattatcacacaagaaatttaagtgttgataaatagtattatttaaaacagaatctgcactcaaattttcacacttaaaaaaaatcagaatctagtgaagaaacagagattgcattgatttgtctctttagtcttttttttttttcctttccttcctttttttttttgtttgagacagagtcttgctctgttgcccaggctggagtgcagtggtgcaatcttggctcactacaacctccgcttcctgggttcaagcaattctcctgtctcagcttcccaagtagctggaattacaggtgcccgccaccatgcctggctaatttttttgtatttttaatagagacagggttttgccatgttggccgggatggtctcgaacccctgacctcaagtgatccacccacctcggcctcccacagtgctgggagccaccgcgtccagccttaaactttgtttgtttgtttgtttgttttttgagacagggtcttactctgtcacccagtctggagtggagaggtgttatcacagctcactgtagccttgacctcctgggttcaagtgatcctccagcctcagcctcccgagtagctgggactatagtcatgcactatgatgcccagctaattattttttgtagaggtcgggtctcgctgtgtcgcccaggctggtcttgaactcctgacctcaagtgagcctcccacctcagtctcccaggcttcttttacttaacacatatttttgagattcattcatgatgagaacagtgacagtttattatcactgctttatacagttattgtatgaatgtgtttggccatttattattaaccattctactcttttttttttttttttttgagacaatgcctggctctgttgcccaggctggagtgcagtggtacgatttcggctcactgcaaactgcttcccaggctcaagccatcctcctacctcagctcccctggtagctgggaccacaggcgcatgccaccacacctggctaattatttttgtattttttgtagagacggggttttgccatgttgcccaggctggtcttgaactcctgagctcaaccagtctgcccgtctgggcctcccaaagtgctgagattaccagtgtgagtgaccacatctggccaccattctactttttgttttttgagactgagtcttgctctatcacccaggctggagtgcagtggcatgatcttggctcactgcaacctctgcctcccaggttcaagtgattcttctgcctcagcctcctgagtaactgggattataggcactggccaccatgcctggctaatttttgtgtttttagtagagacgggggattcaccatgttggccgggctggtctcgaactcctgacctcaagtgatccacctaccttggcctcccaaagtggtgggattataggcgtgagcccctgcgggtggcccatcttacttttttttttttttttgaaatggagtctcgctctgtcaccggctggagtgcagtggcgcaatctcagctcactgcaacctccgtctcccgggttcaggtgattcttctgcctcagcctcccaagtagctgggactacaggcatgtgccaccatgcccggctaatttttgtatttttagtagagatggggtttcttcatgttggccaggatggtctcgatgtcttgacctcatgatccacctgccttggcctcccaaagtgctgggattacaagcatgagccaccgtgcctggcctgagccattctacttttaatggacattagattgtttcacctttagggtcattacaaatagtactgctgtgaaaatacctgtacgtgtctttttgtgaacataatatgtgcatttctggtgagttcatctacgttttttattttttatggtattgacatgtttggagagtctggactacttgttttgtgaaatgttccaccatctggatttgtctgatttgttcccttacatttagatccgggttaaacattcttttgtgagaatattatgtaagtgacgttgtgtctatctgtgtatcatatctggaggaacgagtcccattgtcgaagatgaagtttgattgtttggttaaggtggtgtctatcacatttctccatcataaagttaacttgctaaattagttgctttctttgcaactttgctagtattgttttaaatttttgagacagggtctcactctgtcaccctggctggagtgcagtggcacagtcatggctcgctgcagtcgtgacctcctgggctcaagtgatcctcctgccttggcctcccaaagtgctaggattacaggtgtgaacatggccaagtttttctttttttctttcttgagatggagtcttgctctgtctccagggtggagtgcagtggtatgatctcggcttactgcaatctccacttcccaggttcaagcgattctcccccctcagcctccggagtagctgggactgcaggtgtgcaccaccatgcctggctaactttttatatttcagtagagacggggtttcactatgttggccaggatggtctcaatctcctgacctcatgatccacccgcctcggccccccaaagtgctgggattataggcgtgagccactgcgcctggcctggccaagtttttttttagtattttagtttaatattgtattgactgacaaagtcttatggcctaaactttactgtggaattctaataggtgtgttgtgatcagtttgagttttgacaaattgtatatacgtgtgtaaccactaccaccctaaacctgtgtaaccaccactgccacaagcaagatcaacagtttcagtatccctaaacgttcccttacgccccttcccattgaatccttgcctgtggtcctaggaaatctgaactgttttctattactatagagtatatttgtccctcctagaatttcatatgaatgaattatgtattcttttatgtcttttttggctcagaataatgtttgtgaaatttatttgtgttatggtatgtatcagtaattatcagtaatgaattacctttttttttttttttttgagatggtatttcgctcttgttgcccaggttgaagtgaagtggctcagtcttggctcactgcaacccctgcctcctgggttcaagagattcccctgccccagccttccagtagctgggattacaggcgcccaccaccatggccggctaattggctaatttttttgaatttttagtagagacaaggtttcaccatgttggccagagtggtcttgaacccctgacctcaaatgatttgcccacctcggcctcccaaagtgctgggattacatgtgtgagtcactgcgtccagccaatttttttttgtttagtagagatggggtttcactgtgttggtcaggctggtctccaactcctgacctcatgtgatccaactgccttggcctcccaatgtgttgggattacaggcgtgagccactgcgcctgaccatgaattactttttaccgctgagtagtattccatcgtatggatggctatatctcaatttgttgatctgttcaccagttgatggacatttgtagtagtttttgattcctgcgtaacagtattaccacaaatttagccgcttggcacagcacacattgattatctcatggtttctgtgggtcaggagtcaggaaaccactgggctgagtctcaccaggctactattgagaaatctgtcaggactgtggtcgctgactagggaggggtctgcttcctagcttgtgtggttgttggtggcattcagttccttatggaccatgagactggagactttagtgtgttactgtcagccagcggccgccctcagtttcttgccaaatgagtcttcccacttgcctcctcaaagccagcagaagagagagtctcttagtaaagtggacattaccacgacgtatctcacccacattaatgcagtcacgtacatgctgtcacctttgccatattgtgttggccagaagcaagtaacagatcctggccacatttgagtagaaggaacagcacaggggcatggataccaggaggtggggatcatggggtcaccttagagtctgttccccacaggattccttctcattctgggctactgtgagtatttgtgtatgtgtaagtgtttgcgaggacatattcttcatttttctggggaaataacctgtaagtggaatggtaggcttatgtagtaagtatgtttagctttgtaagaaactgtctaaattgtctaaatgtttttagccattctggtgagtgtgtagtgttatttatttgtgtgtggttttttttttttttttttttttttaagagacagggtcttttttgtctttgtcgcccaagctggagtgcagtggtgcaatcatacatagctcactgtaatctccaagtcctgggctcaagtgatcctccagcctcagcctcctgagtagctaagactcaggtgcatgccaccatgcccagctaattattttttgaatttttgtagcgagggggtcttgctgtgttgcgcaggctggtcttgaacttctggacttgagtagccctcctacctctgcctcccaaagtgctggaagtacaggcatgaaccacagggccgagcctaaatatttttttgttttcaggatactgttatatttatggattttattttttaattattcaatgctactatgtagaaataaaattgaattttatatattggtcttgtatctgcaaccttgttaacttataattctagtagtttttttttttttttgagacagactcatgctgtgtcacccaggctggagtgcagtggcgtgatcttggcgcactgcaacccccgcctcctgggttcaagcgattctcctgtctcagactccctagtagctgagattgcagacgcccgccaccacgcctggctaatttttttgtatttttagtagagacggggtttcaccatgttggccaggctggtcttgaactcctgacctcaggtgatctgcctgccccagcctcccaaagtgctgggattacaggtgtgagccaccgtgcccggcctctagtagcttttttgtacattccttgtgatttctctatagatgatggtatcatctgcaaataaagacagctttacttcttaccttcccattaatatgcttttaatttttcttgctttattgcactgtctaggactttgagtgcaatgttaaaagtaacagtggaagtggatgtccttgctttgttccccattttgggggaaatatttttagtcttctacagttaagtgttagctataggtattttgtaataggtgcctttgtcaagttgaagaaattcaaccttcatttttagtttgctgagttttttttttttttttttttaatcatatgtgttttgaggccaggcacagtggctcacgcctgtaatcccagcactttgggaggctgaagcaggaggactgcttgaggccaggagttcgagaccagcctgggcaacatagcgaggctctgtctctatacaaatttttaaaaaatgagtctgacatggtggcacatacctggagttctagctactcgggaggctgaggcaggaggatgacttgagccctggatttccagcttacaatgagctatgtcacaccactgcactacaggcactacaggctggctgaaagatggagactctgtctcttttttttttttttttgagacagactcttgctctgtcacccaggctggagtgcagtggcgcgatctcggctcactgcaacctccgcctcctgggttcaagcgattctctgcctcagcctcctgagtagctgggattacaagcatccaccgccatgcttggctaatttttttgtgtttttagtagagatggggtttcaccatcttggccaggctggtcttgaactcctgaccctgtgatctgcccaccttggcctcccaaagtgctgggattacaggcgtgagccattgcacccagcctgaggctctgtctcttaaaaaaaaaaaattatttttgaatgttgtcaggtgctcttttttgtctctattgagttgatccttttgtttgcttcctttcttttattaatatggtgatttatgttgattgatttttgaaatgttaaaccaattttttattcattggataaattctactcgatgtgttatgctttttatatatagctggactcaatagtatttcgttaaggattttaacatttatgtttgtgagggatattattctatagtttttttgtatgtggatgtgtaaaatctttggtttttatgtcaagatagtactggcctcatggagtgagtttggcagtttttttttttttgtattctttgaaacagtttatataagattgccattatttcttccttaaatgtttgatagtatttaccagtaaagccatctggacgtagagttttctttttaagttttaattatatactttattactttttctttctttcttttttttttttttttttttttgagacggagtcttgccctatcgccaggctggagtgcagtggcgtgatctcagctcactgcaacctctacctcccaggttcaagcgattctcctgcctcagcctcccaagtatctgggactacaggcgtgcgccaccacaccaagctaatttttgtatttttagtagagatggggtttcaccatgttggccaggatggtctccgtctcttgaccttgtgatctgcccacctcggcctcccaaagtgctgggattataggcatgagccactgtgcccggcctactttttttgtttttgaggttgagtctcactctgttgcctcggctggagtgcagtggctcgatctcggcttactgcaacttctgcctcctgggttcaagggattcttctgcctcagcctcctgagtagctgggattacaggcatgtgttaccacacctggctaatttttgtatttttaattgcgatggggtttcaccaccttggccaggcttgtctcgaactcctgacctcaagttatctacctgcctcagcctcctgaagtattgggatttcaggcatcagccactgtgcctggcctattactttttttatttacatatttttaaattatatatttagttttaaaaatagatgtgaggatattaaacttttttattttttccagagtcagttttggtatgttgtgtctcaaggaatttgtccttatcatttcagctatcactgctctctacaacctccgcctcctgaataaaagcgattctcctgcctcagcctcctgagtagctgggattacaggtgcctgccaccatgctcggctaatttttgtatttttagtggagatgcggtttcactgtactggccaggctggtctcaaactcctgacctcaggcgatccacccgccttggcctcccaaaatgctgggattacaggcgtgagccaccgcacctggcctgaaatttttattttacatattatacttttcatgtctagaaattctattttctttttttttgagacggaatgtcactctgtcgccctggctggagtgcagtggcgtgacctcggttcactgcaagctctgcctcctgggttcaccccattctcctgcctcagcctcctgagtagctgggactacaggtgcccgccaccatgcctggctaattttttttttgtatttttagtagagaaggggtttcaccgtgttagccaggatggtctcgatctcctgacctcgtgatccatccgcctcggcctcccaaagtgctgggattacaggcgtgagccactgtgctcggcctctattttctttttataccttacatttctcttcttactgtgacatgttttcatttaaatacttgagtatagttgtaacacctgtcttactgttcttgtctactagttatatcgtctggtttttcttattgttattggttacattttcctgcttcttgacatatgttgaaatttttaaattaaattttatgtttttgagactgagttttgctcttgttgcctaggctggagtgcaatggcgcgatctcggctcaccgcaacccccgcctcctgggttcaagtgattctcctacctcagcctcccaagtagctgggattacaggcatgcaccaccacacccggctaatttttgtattcttagtagagacggggtttctccatgttggtcaggctagtctcgaactcgtgacctcaggtgatccgcccgcctcagcctcccaaagtgctgggattacaggcgtgagctaccgtgcctggccatgtgttgaaattttttattggatgctggatattgtgagttcagtattgttgaggttatggattttgtggtctttaaagagtgcttaaagcttttttcttctgtgcagttttttatggtttactgttatcattttgagtcctgttttttagctttgttagagtggatctggataatctttaatctagggatcatttgacctctggtctctcctgaatgccctgtgaggacactccagtctggctgcttgggactcatgattcccctgagagttctaagaaatgtcagctcctagcttcttcttcactgtggagtttcaccctatgcatgcacaaattttagtattcagcagagacctgagggaacctccagacagatttctggaccactttttctgcatagctctttctttctgaagtctgtcctgcagctttcagctgccttggcctccctgaactctgatctctgtctcttcaacttaagtgggtggcgtgctctgctggggatccccgtctctctccagggcctgaaatgtgtctcctggcaggaagccagagtgattttagggcccaagtaatttgtttctctgctttcagggatcgtagtcctgcactgcctgctgtccaatgtgtacacacagtggttttatttatttggcttagttttctagttgtttacagtgggagggcaaatctgttccctatcactccatcatgacccgaagtggaagtgcattggttgactttgagcagaggagtgacatgaaataacttatcatctcctctaatcccaaatgtgaggtggtggtattattcccgttattcccatagatgaggaaactgaggctcagagaggttgagcagcgtgcccccaaatcactgagttcttaatgccaaagcttgtgtactttctgtcatgccactgcatctcaaaggatattggtgggatcgaatcttattcttcccagcagagaactacacagactggcttaggacctatctggagtcacagtcaccgggcagatgcaggatgggttctcctatctgaagtcgcagttactgggcagatgcaggatgggttctcctagacctggagctttcgccagttgctcaaatctgtgagctgcttgtgaggttgttctttgttggacagcaggtcaggatctgggaacgccttccagttggggaaggtcagcgccttggcagcaggagtgagagcacctttgtctctaccaaaagaaaagcatttctctctctgccgccgtagtctttgcctgacttgtttttttaaagcagttttctgcttttgctttcttctcttcctgctctccccattcaggcctctaaggatcctgggcatggattgccttaggtccttttcttacatcgttacaatagatgcctgtgggtggtttctaagcctttttttttttttttttttctgagacagtcttactctgttacccaggctggagtgcagtgatgtgatcacagctcaccacagcctcaacctcctgggctcagttgatcctcccacttcaacctcctgggtagttgggacttacaggcatgtgccaccatgcgtggcaaatttttgtattttttagtagagacagggttttaccatgttgctcaggctggtctcgaactcctgggcccaagcgatcctcccacatcggcctcccaaagtgctggtgtgaaccaccatgcccggccttgttttttttttttttttaatcatggactactctgtgaagatttccaggatcagttggagatgaggttttgctatgttggccaggctggtcttgaactcctgaccaggtgatctgcctgcctcgacctcccaaaatgctgggattacaggcgtgagctactgtgcccggcctgcttcgattgtttaaacagctagcatggtggaagattttaaaaaaatgttcacagggtaggccatgattaaaaaaataaaaaaaaggccaggtgtggtggctcacatttgtattcccagcttcatactgggactgtggctctgggaagccatgacttgaggaatttggagtgttgctgtttcaaattccatggtaggaatatgcatacacatgcaccctttttttctttttgagacagagtcttgctctgttgaccaagctggaatacaatggcaccatcatagctcactgcaatctctgcctcctgggatcaagcgagcctcctgagtagctgggactataggatgcaccaccacacccggctaatttttaaattttttgtagagatggggtctcgctgtgttgcccaggctggtctcaaactcctggccttaagggatcctcccattgtaccctcccagagtgctgtgctgggtttaaggtgtaagccacacttggccatgctcctttttttttttttttttttttttggagacagagtctcactctgtcacctagattggagtgcagtggcatgatctcagctcactgtaacctccgcctcccgggttcaagcgattattgtgcctctgcctcccgagtagctgggactacaggcatgcaccaccacacccagcttatttttgcattttttttgtagagacggggtttcgccatgttggccaggctcatctctaactcccggcctcaagtgattcgctcaccttggcctcctgaagtgctgggattacaggcatgagccactgcacccggccggccatgcttcttatatgctttgaatatccttggcagaatatataaggaaccagcgtcagtgtgggtcccctagggttggaatgagagggaagctttcttttttacttttaatattgaattttctaaaacaattcatttacatggcttataatttaaaaggtactaaagggtttatgatgaaagagacttatttggcactgtgtactgtttgaagtttttccctctggtaaatactagctattcaagggatgaactaattttaagagcagttccttggtggaaacaattcatagtgattagttttattttaggaagaaagttttgggttaagtcagaatggggcttcctaaatactaaagctgtttgcttttgtgtgttttgtctggtcaaataacctacattattatttatggggtagcattaaggttgttgcttaataaaatgtggtttaaacaaaacttgcttattttgattaagtagaagggttcaaatccctgtagtaccagttactatctgagtaatcatgggcaagttatttaacctcttttgcctcagtttcctcatcagcagtaatttgatatacttattgtgagaattaaaggaggaaagagctaagtgaatgttagcacttagtatctagcaaatggagtagaggaaaccctcaggaagataatgaacggaagaatctaaataatccattcagctgagttgttgccattgttctgtttttttgttgcccattcattcattcagcaaatttctattgaaggcctcctctgtgcctggcactgtcctagcccccagggatacagtgataagcaaacacaggcagtttctgcacacgtggagtttataatctggtgagagagacaggcatcagtccgatagtcacacagatgtaaagttgcacatctgctcaggtccttgaaggagaggcaggtggtgttacctgaatgtgtcacagggagatctgacctagtcatggatgtcagagaaggaatgcttccctgaggaagtgtcttagctggatctgaaggatgaactaaagggaaggaagggcatgtgcaaaggcgcagtgacagagaaagcaaaggccagtgcgtctgtcagggggcagaagtgggcaatgtggtgccgcttgagacctgaggtgtagtcagagtagacgtgaggccttgtaggccacgctgaggtttttctgtcttctaagagcaaggagaagcccttaaatttgttgtgtttactggggtgagtgggtggacaagggatgggacgagcagattctcctttggaaatgatagtctgtttgcatcccagaatatgaattggaagagcgccagcactgatgagaaagctgacgcagtggtccaggcaggggattttggtagcttggactgaagtgatggcagtagagatggagaaaaacggatggattgtttccatggactttttaattttttttgagacagggtctggctctgtcacctgggctggagtgcagtggtgtgatcatggtgtactgcagccttgaatttacaggctcaagggatccttctgccccagcttcccaaatagctgggagtacaagcgcacaccaccacacctggcccatttttatattttttgtagagacgaggatttgccatgttgcccaggctggtttcaaactcctgggctcaagcaatccatcctcctgggcctcccaaagtgctggcatttacaccactcttccatggatattgaggaaggagtatggcagacttgatgtaatgagttagctctgggagcgagggagaaagagctgtctcaagatggccttttggattctagtttacatcatttggtgaagtttgtcccattcatgccaagagggaatgctggaagaagacatatgtgtcagagaggactgtgagtctgctccagggcagcttaactccaagaagaggcaggaaggcagtcggatgtgtatctcagaggggtgtgggctggagctctaaaggtttgaagttaccaatgcctggagctttgggaggacaggaggcagggaggcaggggaagcttgctcacattccctgagacggaccctcactttctagatcgtttcctgctggctgacctcttgtcctggggtggtgaggctcttgggacaggacttcggatggagggatagaggccttcacccagcagagtgcttgccactgtgctgtgtgccagctaatgtggtagtagctgggcatgaggaatttttgggaaccctctgcagaccgggcctctgtccttttccaaggcggcctggcacttccatctgatctgtaatagccgggagaatggaggctgcaggctgtctcctgggacacacagattttgctgcacttgtctggatattaactgtagatagatggcaattggcctgaccatcagtcacagtaaactaatcatagctcacttagcagcatacctgcttactttattcttttggagatttgtaaatttcttcagaatctgtctctacctctgcctctccctttctctaaattttggccagatcagtcaagggtcgaaggcgcctgtgagggtgaggtagtggccccaaggaagaggaaacgggctagagccagggcctcggccacagtgctgcctgctcgcctggaggttggtctgcttatatgccagcctgtcactagcttatttccaagaaggatttaagcctggggctttctttactattgtggggtggtgtccttagtggcaggtgatgaataggaacctgtgtagtttactggcttctgggctccagaaactagatgcccagagaaaatcctgagcgtgggcagctggggccccctggtggtggaatctggttctccactgctgcgcgacttttcttcccagtcccctgacgttggggaggtggcagaaagaggaggtgttgtgctctctcttcaggccttttctctggactctactcttcccgtggattttgggatggtccccagcccttgctgctcagtaggtgatcgtgggccttcctgagcagaaccaagccttgttcttggagtggtgtgacaagtgaacccagaaacagtcttcatcttccctggtgaattcagactctttgggctactttttacaggtagtccactgcaaaatactcttgtgtcgtgaaaaaccagtgagagatgtgagaaagaggtgccagcgtgcatcgtttgagaacggaacatctttggttttttgatgtccattgggtggcactgtgatcttatttttgtttccatttttctctgcagccaagctctactccaggaagtgaaaatgtgctgcctcgagagccgctggtaagtacccaagatatgtggtatcactttctagtaattaaaatgccacgcgagtgaaaagaaaccttctgttcctatggttctgcgtcagtagtgtccctttaaaagtagctgttacctagagactgcctctgtcagtgacctctgacttctcttctcgcgtgtggggacgagtgagatctctccttagtaaaggctggtcctttctaggactaaaagcatccaccccagatggtcctgcaccactttgtttgtggctgatcaatagtaattagtgagattcctgcgcccgtgggaggctgaggtggagtgaggtggctgggcttctagattgtttgaagtagccgccctctgctctgcccctcagggtgcgagcgcctcagtggtctttaaagaacaggtaagcgatggaattctggttttgcctggtcagtaattgtgtgattgtcattcccaacgctgtcttcttagactatggatagggaagaggcctattaagcactgcaggtaattttctctcccaagtgcttttcatttggtggccagagtcccaggctgcccaccccattttcattcttttttgcttttcagggcctgctgtaagtcctcttggctgggtagtaagactggctctgtataaaccagataagtttgatgggagagccagctctaggtttaacttttcagagctttttcttcctgcgtagcgatagcaggcgtagggctgtactgccaaggctttgtttcagcagggcctgtggtttcacctgttctgcttcactccccttctggcagtcgcgggaggagatgacgtgagggacttagcgggtatgaacacgtctgaattccagtgtgtacgaaggctttcccaggctgagggcgagttggatccagttgagctgtctgtagaaaggccgaggtgatacaagcactgctgggactgtttcaggggagcagtgttgtcattcatgtcacctgctgttacgtcaccagttacgggcttatatcccagcactcccacggtggcctcgtttcactcttttggtattgcccagttccttccttgaggtcatggtggtgggaaagcccaggaggccccaccttgctagtctctccggacgtctgcctgcttccctggggcctgcctcagtgcccctcaggccgaagttgtggttgttttagactgaagtgcagattgaacaccataggccgctgcagtcctttccttcctctctcttttcaaattttgatgtacccatttaactggtcatcggaggagtggccagtccatcttttggggcttgattcgacaagctctttgggagccctgagcagttggccagctcactgatttctggtatttggagccctgcagaccccttgctctgctagtgtttctgtgccctgctcttcctgctgtactgtgcatctgcttgttggttggttgtatttttatttctttcttttctgggaggccctgagcagtcttcaaaccctagtagcctgtgatcgtccagagttcagactcattctctccaggccaactccacaattaccttatatttaattaatattttttctcctctttacgtacttgctgcataattgctcagaggaaagaaaacacatagcggcaatttatatatatatataaaataataattaaaaaaacccccgaaataaactcccatctcatttgggctgatcctatgagttgggtaattagggccctattaaaaggtagaccctttctccttcccccacttttttgtttattaaattttttatattaaactcccacagtctctcagtcatgcccttattgcttttggccaagcatttgcagcagcctgattaaacgggggcaccagctgagtcgcgtggtcttgtgtgaactgcttcttcctcctgggagtggtgttgggagggtgtcaggcagaggagcccgctgaggactcgtgtggcagggcgggggcacaagatgggcagcccccttgcacagaaagccccacagctcagtgtggtggtgttgcggtttgtgaaaacacacagcagtcagcccttccacagggagggagctttctcaggccatgtgtatttgctgtctcctgcatgctcagcttagctcagctcaggcctgaggatggggaacagacaattgaggaataaaactaaaccttgttcttgagtaattcacgtgttttactttgggaagaaaaggcatttatacatatgaaataagagcaaactgcacacgactgtatgtaattttagcaaatagcacaacattgtgtatcatttggtgcagagctgcctggttgggcgtagaagagagccccaagttattcagagcaggaagagctctgcggagggcgagggccacttagggatggcttttgggaaacttgaagccaggccttgaggaatgggatatttcagtgttgggggaacacactgctaagttgttttgtttttgtgtttattattgttaattttttcatttaagcttcgggaaatacatattctttttgtttttaactgaatgcatatttttcatacaattccttaatggaagttgcctggtctctacactaaaggcaaataatcttattctttgtcccagactagatgatcactttgaaataatttttccccttattaaaaaagtaagttactggccaggtgcagtggctcatgcctatcatcccagcactttgggaggccaaggtcgggggatcacttgaggccaggagtttgagaccagcctgcacaaaatagagagaccccatctctattataaattttaacattagccgggcttggtgcctcatgcctatactctcagctgctcaggaggcagaagccagaggattgcttgagctcaggagtttgaggctgcagtgagctatgatcaggccactgcactccagcctgagcaacagagcaaggccctgtctctaaaacaaaacaaaacaaaacaaaacaaaacaaaacaaaagaatgaaaataaaagtaaattacgacagaagaagttctatttagtagtcagtgcggtgcaggtgacattgtgatgtagtcaatatgtgcatgattgttttgttttatttgctaggcaaagaagacttgattttcagttctgtcctctctgaatcataaaaactgtctcgagattttgtggtgagaagtgtaatcttgtagtctctaaacgacacattcgtgtttgtagccaaatcctggccttgattctagcaaagtagtgaggctgcgtgtttccttttcttgcccgttcaatcctgcctcgatcctggcctccaaatcaaaccaacccagcaacattgaccgtctcagaggagtattgctctctaatatcatgtcattagggctagagattggtgaacagaccagtcttgagaaattctgcaaactccaagttgaaattctctgttgttgacaaaactccgccaaagttaaaatggctggttacttttttctctttatactctcttcactgagctttgcctgctgaggcaaggagttcggacaggcctccagagtacagacctccagcttctcccagatctgtgaaaacctgtgaatttcccacagactctggttttctagccacagttgtgtgcctgtccttaggcccacacagtctctggatccagcttcttgtgctgtcctagtaggaccaagtccctgcctggtctataagtattttagaatgggcggacaattgtccacatgtgcatggggtaattcagttcccatcttgtttggatactgaaacttgggttaaataaacttttgagctttccatttagtcatatgatttttggttatttgaagtaagcagtaaataaggtttgatttacacatctgctcacttgtttcaattcagtttctcaatgttcagcaatactatagctcatctactttaaacagtgcttatggattttggctaaactagaattttagctttttgctctttgacaccaagttctctctaatggatgagtccttggccatcgtctcttcctttaacttttaggtgtaggttctttttgttttttctttctgtcctctttcctgcatctctccaccaaaataatcccaaagaacaatttttttttttttttttttttgagatggagtcttgctctgtcacccaggctggagtgcagtggtgtgatctcggctcactgcatcctccacctcccgggttcaagcgattctcctgcctcagcctccagagtagctgggattacaggtacgcgccgccatgcccagctaatttttgtatttttagtggagacagggtttcaccatgttggccaggatggtctggatctcctgaccttgtgatctgcccaccttggcctcccaaagtgctgggattacaggtgtgagccaacgtgcctggccccaaactacaattttttctgtaactgatgacagcaatttctactttatcacctttttctgggattactattttttagtatgctgaattcttcaaaataaagatgctctgcagttgcagatctaggttgcgtctcagtagttttgctctccaagtgccaaagtgccctcaggtttcttcctgaggctcagatggaaccttgtccagggggttctacatcatgtatttgatctcagtcctggggaagctcatccatcttacccctgggacacccaagattttctctttggtttacaagccaattaaccagaggctggtaatcagaaggcgtattttgatggattcagggagccagtactgtgatctctgtaagaataggcaaggcacggtgctcacgcctgtaatcccagcactgtgggaggccgaggcgggtggatcacctgaggtcaggagttcgagactagcctggctaacatggcaaaaccccgtctctacttaaaaaaaaaaaaaaattagctgggtgtagtggcaggtacctataatcctggctactcaggtggcagaggttgcagtgaaccgagatcgcgctactgccctgcagcctgggcgacagagccagattctgtctcaaaaaaaaaaaaaaaaaaaaaaaaaaaaagaaaagaaaagaatagctacagccggttgcctgtctgccaaagacctctaacatgtattcctggcacagtctcctcagcatttgtgtcttctgtgacttttgtggttagaatactttggtgtacttgtcggcaggttcactgtggataagtggttctcattttttttcccaccaaaacatttctttttttgaagcggtgtctcgctgtgtcacccaggctggagtgcagtggtgcaatctccgctcactgcaacctctgtctcccgggttcaagtgactctcttgccttagtctcctgagtatctgggactataggcgtgcaccaccacggccagctaatttttgtatttttagcaaagacggggttttgccatgttggccaggttggtctcgaactcctaggctcaagtgatcctcctgccttggcctcccaaagtgctgggattgcaggcatgagccaccacgtccggccccaccaaaacatttctgaagaatgacattaacatgtttctttgtgtgcactcatgtatgcatgtgtatgacaatacatatatattttataacatttaagcattttgtggggaaataaaattgattttgatgctgtattcatgaaagtgttttacaagcacatgggtaatgaaaccagccatttagggatttcaggaacttgtcattttccaggaaaaatatataaatatgacaaacctaactttgaagtattaaacgtaattatttaaaaagtctgtagtggttgatttctgtgcagagttaggtttgctgaaactagttgtcacttccacctctttttcctgctcaggaatgtctgtcgggatgcaagtgattgggggtgatattatagggataattcagaatccgccctatcagtttatttttatttttatttttattttgagatgcagtctcgcttttgcccaggctagagtgctggagtgcagtggcacgatctcggctcactgcaggctctgccccccagggttcatgccattctcctgcctcagcctcccgagtagctgggactacaggcgcccgccacctcgcccggctttttgtatttttagtagagacggggtttcaccgtgttagccaggatggtctcaatctcctgacctcgtgatccgcccgcctcggcctcccaaagtgctgggattacaggcgtgagccaccgcgccctgcccctattagtttatttttaaaaagcaaatcattggctgagcgtggtggctcacgcctgtaatccttgcactttggaaggaagaggcgggaggattgcttgagttccggagtttgagaccagattcggcaacatagtgaaaccctgtctttacaaaaaattaaaaaaaatttagccagatgtggtggcgagtgcctgtagtccttgggaggctgaggtgggaggcttacttaagcctagtgggttgaggctacagtgagctgtgatacccccactgcactccagcttgggcaacagagtaagactccgtctcaaaacccacccccctgcccaaacagtaaatcatctacaaaaattttggtgcttaaaccgttactagcaacatattcatcagggtgcccctcacaactgctgcagagaaacttggggactaaaatcaagtataaaccacggatgggctcacggtgcacttcactgaaggtaaaattgtcatgattatcagatccagcatcctgggcctgagatgtaagcacttttcagagaggaaaaaagtgttggctgtcctctttcctcactcctctctcatcaacaatataaaggtatcagtgaagaaaacgtttttaacactagtgtccgtgtatactgacttctggttgggaaggtgcctgtgattcccacctcctctgccagatctgccgaaaaaagctaagaactggatgctgaaatggatgaacttgagcaaagcctcatactgtttctgggtggttatgatctctaggccacttactggttttgaaattactgcctcttcctactctgtccttcctatcacagacagcaggtttattgcatagactaggcggtgccctttacattgtttcctctttcaggtaaatgaagaggttgctttccagttttaaggtgcccttttacaaataattattagatgaatcgaaactcttaggagtaataattaaagaaatggaatttgaaaaagttattcagctttgtttgtactttaggttcctggcttttatagtaatgctttatatttgctgttgttcctgtaatcagaggccccaactcttggataaatgggcagtgtccttatttcgaggatatgggaactgaggaactgagcactcaggtgccttttatcagagctactcagtgattggggaaattcaattttctttttctttttttttttttttttaatgacagagtctttctctgtcactcaggctggagtgcagtggcacaatcatggctcgttgcagccccccacctcttgggctcaggtgattctcccacctcagcctccccagtagctgggactaccggtgcacaccaccatgcccagctaattttttaaaaaaattgtgtagagatgaggtctcactatgttgcccaggctgatctcgaactcctgggctcaagcgatccccccgcctcagtctcccaaagtgctgggattacaggtgtgagccaccacgccctgcctggaatgcagtctttaatcttatccctggcatcattctttcagagggaaaagttctgtttcctcccttttctcctagaggcttaggcatgagaatcacttgaaccccggaggcagaggttgcagtgagctgagattgtgccactgcactccagcctgggcaacagagcaagactctgtctcaaaaaaaaaaaaaaaaaaaaaaaaagaaagaaagaaaagaaaagaaaaaagaaaaaagattatcctggaacatgtaggcacttggttatcttaaccaatacaacagtcagcggttttcaaactgggggcttttagatttatcctgagtttgctaatcttagagctcctttacatgccctaccattgctgaagacgtgatctacaaaacttttatttgggcagaggaaataaaatttcctctgttaaaatgtttttcttttgattaaaatcagtcatcagtttcaaagaattttcatgtaaaagtgtttttttaagtgtgatctaaagcataggtattccatgcggcaaactcaggataaatctaaaagcccccagtgtgaaaactgttgactgttgtgttggttaagataaccaagtgccctacatgttccaggataaccttttttcttttttcttttcttttcttttttttgagacagtcttgctctgttgcccaggctggagtacagtggcacaatctcagctcactgcaacctctgccttgggggttcaagtgattctcatgcctaagcctcttgagtagctgggattacaggcgcccaccaccatgcctggctaattttttaatttttagtagagatggggttttgccatgttggccaggctggtctcaaactcttggcctcaaatgatccacccgcctcggcctcccaaagtgctgggattacaggtgtgagccactgtgcccggcccattttccaggataattgtaatttaaaatattttagctcattgtcaaaccacgcagaatgatttttggctcaaaaaatatgatcttgtagttagtcccacttctgagctgtgagaaaccgcaggaagataaagtggtgctttggagaaggacgtattcaccgcccttccttcttccctcccagctctcctttcttttatggtttgtagttataaccgagatttatgcttgttgctccacaaatcttctctctgccattatgagtttgtctgaacagtctagagatggggccgacactgagtgattcttgaagtaaatctatccaggggcactccttgacagtcagaggcagagaggaactaactcatagcccccagtggagcaggagtctggataaattacccctgtcaggaagaagacatgctgccacttttgtgacctcttgccttcacagtgaccctgggggcacagctctcctgtttgtgtgcagagtgtgtggggcggtgctctgggtcagcgatcattccctttacccagctgtgtctgccaagaggcctttctctctgtgttggcccagccaggcccgtggcaagtgggtctttaggaccagggccactttttgcagccgtatggtagcaaggagttgctgacaatcaagcacacaagttgattgattccttttccttttcctttcctttcctttcctttctttattttctttctttccttttccttttctcttctttccttccctcccctcccctcccctctcctctttttgtttcactctgtcaaccaggctggagtgcagtggtgccatcttggctcactgcaacctccgcctcccagggtcaagctgttctcctgcctcctcctcagtagctgagattacaggtgtgcgccaccacacccagctaagtttttgtatttttagtagagacggagtttcaacatgttggccaggctggtctcaaaactcctgacctcaagtgatttgcccaccttggcctccctcccaaagtgttggaattacaggcatgagccaccatacctggccaatgattatttctataaatggtttcatttaactagcatttaccgacagtggattttgatggagaaggagaataaagaacaggtattaaacatcttttaggctaggtatggtggctcacacctgtaatcccagcaccttgcgaggctgaggcaagagaattgcttgagcccaggagttttgagatcagcctgggcaacgtgacgaggtgccatctctataaaaaatgcaaaaattagtgggacatgtggctcgagcctgtagtcccagctactctggaggctgaggcaggaggattgcatcaacccaggagattgtgattacagtgagtctgggtgacagagcgagacctgtctcaaaaacaaaacacaatcttttttccccccctttaccatacttttcctttgctgtatcttgttgtcttgtgtgtactttgaaatttttattttatttaaattttatttaaatttttatagagacagggtcccaccgtgttggccaggctggtcacagtctcctgggctcaagtgaaccttctctttagcctcccagagtgccaagattacaggtgtgagccacccggcccagcttgtgtgtattttttttttttttgagacggagtcttgctccgttgcccaggctggagtgcagtggcatgatcatggttcactacaacctccgcctcccgggttcaagtgattcttgtgcctcagcttcctgagtagctgggatcacaggtgtgtgccaccatgcccagctaatctttgtatttttagtaaagacagggttttgccatgttggccaggctggtcttgaactcctggcctcaagtgatctgcccgcctcagcctcccaaagtgctgggattacaggcttatgtgtacttttgagagtcgtttagagtcttttgtgaaatgaagcaggggtatcaataagaacatatttttaaaactgtgtcaagagcttgcatttggcatccctgtctgaccaacttgctgtttgggtcccatggaacgtactcaccaggctcttggtgctctgaacaaggcaggtcctcagccagtctctcccacactcatctgtaccccaggagctagtttgtccctaaacctgtgtccttgtattaaacatgatgtcaacaggtgaactaagagtgtgaagagagggttctgcaaatataatgtgttctttttttgtgtgtttttttgagatggagtttcgctcttgttgctgcccaggctggagtgcaatggcatgatcttgctcactgcaacctctgcctcccaggttcaagtgattctcctgtctcagcctcctgagtagctgggattacaggcatgcgccgccatgcccggctaattttttgtatttttagagacgaggtttctgtatgttggtcaggctggtcttgaacttgcgacctcaggtgatccgcccgcctcggcctcccaaagttctgggattacaggcgtgagccaccacgcctggctataatgtgttctataaaaagaaatgtgaaaagaaagttttatgaaaactaagttaaatgctttgctaaatgtgaattgctaaaaacattgctgtcaaattaggtgtgagcgagatgacagttaaacattagaggaagatcataaacatctagaaggattctgtactttgattgctttactgatgtcttgaagttcttactttgctttagaaattgtggaggctgtgttatgggtagggtttatgcaagaaagacgtctgggaacttcagtctgtgggcccacactcaaagcaaagggcttggctttacatcaaaagatcagcagtgactgaatgtttataggttttcagttaatagaaaatgttttcagtatgtggagcaggttccatttttgattccctgctttaactgattttttgattaaccgaacaattactagctccgatcacataggccaggagggcttctactctgtaatattctggcctcgctgttggtgtctttattttggtctcgctgttggtgtctttattttggttactttgtttgattccaacaaatttgtgagaattactcattttgcagtgaggagactgagcccagagcattcaagttcctacagctaagaagtggcaggactgggattgaaagctggtgtccatgctgctgaacctgtgcagacggggagagcaggtatgggtgcggtgtggaccgcgctgtcaggcacactagcgtgcgtgcggggcgcccgctgcacaaacgtatcttcagccgatgctcagtgctgcctggtgattctgtacctcctttctgaggctgctgccttagtgtgctctccgtggttggagtcttttgtgtgcatcttagctgttgaaaaggcgcctattaatttatcacaggtgatgtgtgcctccttgtgctcagaggaggcgtctgcacccatgtacctcactaatgacaggttatgggatggagaggagataataggatcttttcatgtgatgtctatatagcaaggtgctatgcccctggtagcttctagggggcagcagccgcttgttgttctgtctcttgctggcggggagaaggttggacaattgagcaatttgctctggactccagctcttaaagtggtgcctgcaggtctccagggagtcactggaatccgcataagtaaagaaaatacaatatccaggatcttttatttctactttctctgccccctcaggtaaatcctttatctgtgtttctatcaacatccacaaattcctcattgtcagagttaaggcagcaaagttcacctgctttgaagataagagaatagagatgtctttaagagagtaaaatctttctgtcagatcttacttgttgccaagagctagacattgataacccactcaaataatgtttagaggttttgaaactttcccccatgggcacgtgtctttaattctgttgggaataccactgtcatatggttgattacctgttcttcctgtcagcatttccccccaaccccactccctccccctatccaaactagtcttacagaggtttctcttcaattctaaatgacttatttcagaaacacatgaaggggaacattgcagatgtgccatttttttgttttttgtttttgttttttttttgagacggagtctcgctctgtcacccaggctggagtacagtggtgcgatctcggctgtctgcaagctccgcctcccggattcatgccattctcctgcctcagcctcccgagtagctgggactacaggcgcccgccaccatgccctgctaatttttttgtatttttagtagagacggggtttcactgtgttagccaggatggtctcgatctcctgacctcggcctcccaaagtgctggggttacaggcgtgagctgccgcgcccggccttggatgtgccagatttttagattgggggcccaagactgacatatgggcaacttgtgccttgtcagagtgagtcccagctccctcccccccagaagtgcacctcctactgtgccctctgaatgctcctgcctgccagatcttccagctgtgtggctgaggcaggtgcccaggaggagaaaggctggttgcaggcagaaccagatggttgcagtccacacggggaagcaaattggccgtgacatttcagccatgtgaggtttatttaggattagctaagaattctcagccttgactccactgagggaggagcgggtgacctagggccactttcttgtggctttgcattctttcaggctttcatctgaagatcccagggtactggggaagggtgggagtttccatccagctccactgcagagagtggcattcctgaaagacaaaggcatgcctcctttttttttttgagacggagtctcgctctgtcgcccaggctagagtgcagtggtgcgatctcggctcactgcaaacaccgcctcctaggttcacgccattctcctgcctcagcctcccgagtagctgggactacaggcgcccgccgccacgtccggctaatttttttgtaatttttttttgttgttagtagagatggggtttcaccatgtcagccaggatggtctcaatctcctgacctcatgatccgcctgcctcggcctcccaaagtgttgggattacaggcgtgagccaccgcgcccggcaaaggcatgcctcttaacctcacctctccagctctctgttgtctgaaaaatggcagttaatagaatttgttaataaacagaagaaataacgagaaatagtggcacatcatttgacagtaaggtggtttataatttctgtttatcaaatgattctcattattattatttctattggatttttgaagaattcagcctggtccccagagccccatttgtaaggcattttatttctttataatatctagaaataacttcagttccagtgaaatccagatctgtggtcccatcccactccccagccctggttctctccccttcctctctgcttgtcttctgtgacctcagcgggctccatcaggtgggggtatcccctactgaccagactggcagagctaatgccggctggaggaacgctgccgtgtttgtttttgcagttcctggatttggtttaatgtacaattgattttttaaatgtatttaatcatttttttcttacctcttaaggattaacctgcacaaacctcattttatcctaagtgtggctttgggaggaagggaggagaaaattgagtttctccagcttattttattcttttacgctttattttccaaatggcttttcctgccgaagcagctttgtataatacaatgtattttcgtggccattacttactcattactaactggtctctcctgcttccctttgtctgtgaactaaatacagggggcctcaagataattggtagctccatcactgacccaccaattatagatcagcagggaaggcagcccagggatggtttgtggttggcacaggctgcccacctagaaatgtgagttattctctacctgccaccaagttgggcttgactagatcgatcctttcctaattttggactttggcatctctaattgcatcacacggctccctggtttacaggtttcagcctcatttcatccctacacgtgctgctggtgtctttcttagttcatgcctccttggcatgtctacaaagtattaatttgcagaggttttgtttgtattttcctttgaggttccctggtgcctagaatggttagatggcaggctgcagataaataattctgttgaaacagcaggtttctgtgcatttttgtctggtgtgtccaagtaaaggcaagtctttgtgggcaccatattaagccccctttttgagcatttatctgatttgtgttccagcttatctactttgctctggcatggagaaggaaaagtcccatttcctgctaggctgccaggcacttatgtaagacttttaggtgccaaagtaggaaaggagtccctgtgttgtatggccgtatatattttgcatgtgtgtttcctggctgtttggcacctaggcactttgctaagccctgtatgggttgggcatataccgtattgctcagctcctggcagaaaataggcactcatacatatttgtggaatgagtgagtgtgtgtgctcacttatgtgcgatggagatgatgagccaaggagttggattgcacagttgctgcctggcgtcctgctaggaacttagggtgcaacattcccactgggccacacatatgccgatgttcagtggatgactgctacgcaagcaacataaagaggccattttatgaaagggaacatcagaggaaacattataactgagacctttatagcctttccattattatggtttaaatcttgacagtctttatttgcaatgacactgggaccagtaaagacaatgctcactcccacctcctcgttctccacatcctgttccgtagctgtggtgcaccgataggcatcgttaaatgtgcaggcagcagagctgctggtttgtctagaaacagccccttttgactcagaagttggaacccagatgactcaccattctatttgttttattgcaactgtcatttcataaaatgccctgacagctttaaactgtaaatgccaaagtgaggtttttgtcttttttattttgttatctcctgttttttctaatcttttatatttctattttctcctttcttttcagacttattttctctttcattactgtctctttctctgtccctcccttccttcctgcctcccccctttgatgactctaatggcatgagtagttgaagtggtttttgctaacatcatggtgcgttctttccagctttaatgctatctgattgagcgtgtctcccctcagatttttgtgtagggtttagaaatggaaatgaccatgcacatcagagtttaaattttcctaggaaagtctgccatgaactgtaggacctataacttctagagatggagggacccctgacatctgtggactatggactcctgacttctgtggactctagaatttatgacttctgtggattgtggggcctctgacttccatagaccgtgggactgtgacttctgtggacccagggacctctgaattccatggactgtgagacctctgacttctgtggcctgtgagatctctgacctctgtggcccgtgggacctctgacttctgtggtctctgggacctgtgacctctttgacttccaagtcttctgtggactgcaggacctcatcaacacgtgtattgccagaagagaggcttgattgtgttaacctgtttctctccagaggtgtcacatactagaatttctgctcagtcttatggcttaggtggggtgttgagtctaaatatatatattttttgagacggagtcttgctctgtcacccaggctggagtgcagtggcataatcttggctcactgcacgctccgcctcccgggtttacgccattctcctgcctcagcttcccgaataactgggactacaggcgcctgcccccacgctcggctaattttggtatttttagtagagacagggtttcaccatgttagccaggatggtctcgacctcctgacctcgtgatctgccctcctcggcctcccaaagtgctgagattacagacgtgagccaccgtgcctggcccaagtctaaatttttaaggactagagctctcagaccaggactttctggatctttttttctgatacccaacactgtggcacttgactaagtcacctgattgatgacatgagcattgctgggtgttgaaacacctggccagggaaacagagacttctgtggattcatccaaaggatggcagacagattgtggaattttaatgaaggtggggtggatccctgatgttcgcctgctttgaagcatagcagaatcccagcattaacttcaggggtgttggttggaaacctgcactggcgtcggtggttatattccacatttgtcaaatccttaaatccaactgaactaattttagaagtagctagttataatgaaaaagaacaatatattcagatgcataggatcgtttttaaatgaaatgctccctgttcttttccttctttttttttttaacttttattttttatgatggagtcttgctctgtcgccaggctggagtgcagtggcgtgatgtcggctcactgcaacctccgcctcacgggttcaagcgattccctgcctcagcctcctgagtagctgggactacaggcgtgtgccaccacgcccggctaattttttgtatttttagtagagatgaggtttcatcgtgttagctgggatggtctggatctcgtgacctcgtgatccacccaccttggtctcccagaatgctgggattacaggcgtaggccaccgtgcccggcccttttccttcttttataaaaggcctttggtctcttttggccttcagggtgagccatcctttgacttatattagaatacattttttttcctgtatgcctccaatgaaggagagtgtgagagtgttttctatgatgtgagtgggagaaaatagcgtgttttcacaatagttaacaaattgatggctgtgagttttgaaagtgagttctgtatatacactggggtaggattccacatagaatgctgtttttcacccacctggctggttgtctgattctaacatagctgctatccctgattctagaaatcagaaaaccacaggctgttcacataatactctacccttctgaggctaaggtgggaacaggatggtggcggggtttgagtcaacatggtctcagttcccaccaaagaccagtgtgttcccctgttccagccgacagcttgaacaaggattctaaagtttctggccgttttaattgaactgcagtgaggggtggcccgatagcctgcttaggacatgggtaattactcctagggcctgggagccaagtgtccctcgcaggttccctcttggttctctacctaaggatatcttccccttccctgggcagggcctctgaggaacagaaggatcatttagtgctcatggcctgctcattccttggcttctctgctgagctatccagcaggggtgccaattcttccatttagctgactattatatagcccttaaaagggaagggtttattttagctggctgctatattgattgctatagggacgtttctattttcactggctgctatattgactgggaaagggaaaggggccgtattgccgggagctgtcatattgactgttacagaaaagatctgtatttaagcagtaccagtgcactgggatctcccaggcaggatattaatgctaattcatccgctcaccccctgctgtgagtgttatttgtttaaatctgtagattcccacagcgcgtttatatcctcactagagtgagctccgctccctgtaattatttaacattatatgctgatataaattgtaacagttaaagaatggtaatgagtagccaaaaaagaaaaaaagaagaaagaaaagaaggaaatagaaaaaaaggaaaaaatgtataaaataatctatgcctctgtgtgtgtgtgtgtgtgtgtgtgtgtgtgtgtgtgtgtgtgtatggtgttagaaacggcagagtcaccttctaaaacagcagtgagaaacttctgtcatcctttctcccagttcaggttgatttgtacggtgctgctcagcccacgtattgtgcatctgtatgtgtgtatgtgcgagcgcctgtgtacgcacgtggtcgtcacccgccagaaagatgccatagtgaggtgtgctatactgtgttgtttgtgcacgtgtgtaacaatatacagtgtttgttcaatgtcctggcaggaaattggtctattagcgattcaccttcttggtgagtagctaataccttattttgttcaaggttccacgttcacacaggaactttgggcctaagacgcaactcaagggaaagccattggggaatgctcagttgggattgaactaataggccattgggtgtcactgtcgctctactggctataggagaaagaggggttatctgctggggaaactggatttcaaaagaaagaagtttttctgcttgagttggaggtgttgtctctttgagatgtttgtctctcatttggagattcctttaaaaaagtagttgtttgcttgtttttgctacaccaagcttctggcatttttattgttcttgaaaattgtgtactgattgcgatctgttctgctatcacctgcagtgcatctagatgagaacttctgtgtgcagaaaactgtcccccttaaaagcctgggtaacaaggagagctgatttgggcaagaacttgaaaaaggagggagaaaatctccttgggcaaatgcttgccactcccctgccgcctgcccctgtgtaggtgggaagagagcgcagagggagagccaggctgctgcctggtcacagaagagtgggctccgtcctccagcgggctctccagcagcatggatctgtgccaggcttcaccacaattcatactgtgtcagtttaataaatgcactacttaaattatgaaattacaaaagaaaaaagagaatgcacttattcagactcttaatacattaaaaataaggcattaaaactctgacttttttttttttcttccagaatcaataatgaacaggaagggttgtagacattaacagtcatggacattcaaactcttatacataaattatcttagaaaaatgcacataagacttgaataatgtaaatacattaatgcatttaataatttaaacattaaagcgcaagcaggaatttgaggccgaggctgttctgaggtaagggattggtcctagaactcgtgtgtcccaggatcgatgggtgatttccccttgagacaccctggaaagagagtgcctggccggcttgtgtggccgaggatccctggacattcctgatctcagctgcctcccagcctcttatttttgtgtatcctgagcttcgttctcagtttcatgttctctactcctgtgcttctaattgtttgttagaaaactaaatgtttccacttcatagaacaataaactttgagaatgtcttggttgaaaaaccaaaccaaagtaaaaaatccttcacccggctctggctgcttgtctgcttgtgatttgagaaaaaggaagtggctgctccttgtgatcagcctgtcatgtctcagcctggaactccactgtgtgctgtggtcaggggatccaggttgtgacatgctgacagatttgaagactggatctaatgggagagcagaaacgatatcctatattagcctctgtgtgttgggcataacgatggcaggtagccatgccaggaaacaagacaggtgccatggagttagactcagtggtctgtgatcataccttactttgatttgagggtttaaccattgggtagactgatgctactgttttttcccctttcttccaaaattgtatttgcaatagcagaaagtcactggaaactccttttctggcagaataccgaatgatctaattcaatttttgacatctgcactgtgaaataccctgggcagaactaagaagccaggcctatgtgtcttaagttttcatttattaatgctaatgctgttctctggttgttccctagccctgttttatagtccaaatcacagatgagaaactagaagaactgtagaaactgtgttactgagtacatagtctgagaactttgtctctctttgtagaagagtgtgtctatttggtcagtaatgcaaatgttgtcccactgggtttgctgtgggacccactaggtttgccgtgggaccttgagaaacggttatcagatggcggtgactgaaccaaacctgttttcattattgccaggtccgtgggagtcttttacaggatctcaaatctcctgcctgaaactttacctgggattgtcttgatttgacccaagcctcgtctgtgctggcatctgtgactttgtttgcaaccctttctagtctttgttgtggccaaggacagtctggtctcccagctaacatgggtacaaaccagcttctagctacttgcaggagaatagctatgggttgacttggcatctgaagcagatacaaacagattaggctgagctgccccagaacagccagaaggaaaaccagtactttaaaaactggtcgtcaggtattggtttagaaagaaagtagtttggagaatgggtgaggacagcctggtgagtgatcccgaggtcacgggctgtccttgggatgtgctcagattcttctctagacctggagagcaacagccgtgcctcacaagcccttctccacatgttttgttttaagatggcagagcctttctttgcagttttagttcagccttgggatgacggtcagacctcggtttgttcttttcttttccagttttcagagcccaagcctgctccctctgttgcttgtccagccttgaccagtgactgtcttcagcctgcactctgcatttcaccccagcagtaggaagaagtgaggtcagaggagcacgtgaaccagggagaatcgaattctctttggattttgctggtcacacccagcaaagctgctttctcttcccttaagttccaagaactgtttgatggccttaactgcacaattggcttgtgccagattgagatgtgttgaactgggcagtggaggtgggggtgaggggcaactccctctcctattgggggcagagtgctggctgcatcaggcagtgatcagataggcactgatcgggtcggttcaccctctgatatagcccgtatgcagacttcctttgaagagagaggagtcaggctcattaattaaaggagcctggcttgagaggcctgtaattataggtgctagaaatctgaattttaagaggttgtgcagctgcattttgaaaaatgtagggaggcaccgagaagtactggttgtgggcaagaatgtggctgaaccagattttggaggttcaggttttggcagaattcccctccaaattcatatttattctttctttccattttgttcttttttttttttctaaatgggaagcagaacctgtgattttttttttttttaaatgaaggttacaccctgtgaccgagaggctagcattgtcagagtatatggggggcagaaaggagttgctgtgaactagaagatgcttagtttttgaggaaacggcacatctttgggccttagggattcagtatttgaaaaaaattaaataatttctttcttgaaatgagtgaggggagcagggagcagaagcccaatttgaatgcagtctagggaagtaagtcccaggcaaatggtggactctagaacctttgtcccaacttgacttccccagaagtgtctcttcctctgtcatgcgttacttttccatgtgaaccctgagttacaaacagaaaatttcagacctttatgggaagtcctgacctgtgccttttctctctcatttcctcagttatttgtaggttgaccttttgttttgggtgctttttcgctctcctctccttaaaaaaaaagtatccctctttgcttcttgtcaaaaacctttatttcggtccctgactatttgcatctctgttaattaagcatggctaatttgatatgtagatgggatggggagggttaagggttagatgaatagaggtctactccctgcctcccccgggtggtgggcaggggtgctccacagacctgcaagactgaacagctacacacggctgatggcaaacccgatgccagggggaacctcctctctgcctcagtggttttgtctccttggggatattgagagcgtcatcccgtttcacagactggaccctctgtgaagggctgaaaaaataaaatataaaggccagttctctgtgctcttttcttacattcttgtagtgtatatattgggaaatccacgggtgaacccttacactgtagaatagaacacaagtgtccaagactctcacttggtgcatttacaatatgcaaattccaattccaattagattgaaatctctatttagcagagtggttttgtgaaataaataacttttgaagaaggaggcctgctatatgtaataaatatatatttttccttcagttgcctgcatggtgcttcctgcgttcccagcccttgcccgaaatgctgattccgaagcatctttgggctctttacagaagagatgcttctccttcccttcctggcacaaggatttcatccttgatttacagtgctcagcttgttagtgccggtgaaggggagagatggtgtgaaggtcgttatgtccgttttgtcctcttggagagaaagtgagggagtgtgtttcttgccgtgtgcttgtcgtggtagtggtggagttggagaggcccccacttctgtcaaaaggagtcgagccaaactctcatcctctcttcttcaccctgtatactacacgttgtccaacagggggtgaatgatttcaaaagcggaattcagaatttcaggaagagtagcacaccaccgagtagagggcctccccctaacaccccccttttcatcattctcccctcctcagcccagccgtgacaaactgacagataattaacagatcagaccctcctattaggcgtgccctgtgctggaagctgctctggctttatgcagtcctttagcagctctgtgtgtgtgggtggtgcctcactaagtggccatagcagagggcagggagtgctttgggaaaagcaaacagaatgctctttggaagagagagtgcttaagagggagagcgggggcagtaaggtgcctggcttgaaagcacctggcgaaaagactcggactttcagggttgtgatccggaataccaccgcctgtctcagggaatggtgcgctgggttataataggatgccttattacaaaaaacattttgaaggccacttcccaggtcaggctatgcattaggtgcactcttccttcggtgtaagactgtgctggacttgcaaaattggaagtgtgcagcctgttgtgtttcagccttggcattaaatatttctacagagacactgccctatgtggctttctctcagctacctaacttttctttccctggtggaaagaagaattcattgtgagaatattcatttctacttactagtgacttttaaaaactacttttctttgtttttggacacagggacttgctgtgctgctcaggctggagtgcagtgtgcaaacacggcttactgcagccttcaccttccggccgaagtgatcctcccgcctcgacctccatgtagctgggaccatagatgtgtgccaccacacccagctcatttgaaatttttgttgttgttgttgaacagaagtggtgagagtaaaataaaaataaattaaataaataatatgttttggtagtgacagggtctcactttgttgcccaggctgggtctcaaattcctgggctcaggcgatcctctcacttcagtctcccacagtgctgggattacaggcatgagctgttgtgcctggccttcttcttcttttttttttttttgtttttttaactagagacaaggtctcactctgtcaccccaggctggagtgcagtgctgcggtcataggtcactgcagcctcaaccttctgagctcaagcgatcctcctgccccagcctcccaagtagctaggaccacaggcatatgccaacatgcccagctaatttttaaattttttgaagagacaggatttcactgtgttgtctaggctggtctcaaactcttggcctcaagtgatcctcccaccttggcctcccagagtgctggattatagtcatgaaccaccatggccggccctgaaaactacttttctacttcccttatggtggccacccttctcatcttcatgatttgaatattaacataaagataaatttagcaacatgtaggggctacacgtaggctcaggtccttaggcctggcatgttggagcagaaagaaacacctaattgcatcaaaaccactctaagttcatgtatgtggagcccatcaagctgaaagcatccagacagcatctgctgttatcaaatcactcgtgaatccagctaattaaaatagagcttcatttttctgaaccattgtttggcaggaattcgaaacgggtctaacccaatttctgcatgtttatgagcctttattatatcagaggtacttttctgtaaatgtacagggcagcgttaaatgaattgatccacacagtatcactgtagacgcactatggacttgctaatgatttctcttccagctttctggtttccagacatactcttgaaagctttatcttctctttttctatcctctgctctttgccgttgtctttttttttttttttaaacattttgaactttccttttactttttaatcttcttttttctttggaaacaggaaaactatccccttaaagaagttttcttttccatttctctttttcttcctctcttcctgtttttgtttttcttctagtggataagatttgtcttttcttcctttatttcttgctgttttctattctctccttttcttttctttttctctcttatcttttctcccttttatactttctcccattccttttctctaaccttctctttctcctttttctcttctttctatctcctcccattttccctaataaaatatccttatacctttgtctccacatgcaaatactgactagggaagatgggggtgcccgtggaggcagagctatctggctgctctaagatgatgtcagctgagtttacttctctgaatttgctttcatgctttattttaggttttaaaaagatttttcaagccacatctactctactttatagtctgtaatcctactttgaagatgaaaagtgttacataaatgctaactaattattccttataccactttgtgagtctctaagcagtattagttccagtttacagatgaggaagcaggaacgggaaaggtaagtagctctgaaagttactgaagaagttggtgactgagttagaattaaacctggctcatctttggctttgctttttgattaccaccttatgggtgttgacttttttcccccctaagaatcatacatatttaaggtgaggttgagtgaataccatccccttggccccttctcattatatacttttaaccttctgaagtttcatttgtagtctttagatgttaaatgaatttctaggtaattcctgggaaagaaggatgctgaaccacttgtgggctggtaaaaaccctgtctattagtcttaaagcagagtgctcactttctctttccaacagcttccagtaagtgggcccacgtcacacactggccccagtgatcgtagtgttgtaggaagcgctgccatatttgattgaatttagccattctggaatgacgtgttcatgaagtcggctcttgcattaccgtggcctttattattgctaatgcattctgacattacaggtgtagccttggctctcccagaaagggcaaggctgctcttaccaaacgaaagagcagaatttatgaaactgttacacagtgaggccagtgttcacctttagttactaagcagagtaagggaaataaatgcttttatagaaaagatagccagtgacagcagtctatcctgattcctcacccagcactgtttcaaaaagtggatcaattaatattgttgccagacagagaacgaggaccaatggttaggaggttcaggaaagtagatttcaactcagtttaaagaggcactcctgaaaatgagctgacagtctcttaagggagtagtttccctgctcattatgagcattcaagaggaggcttcctgatcatttgtcagggttgttggagaggggagtccctaggtcatgggtgggaccagatggctcaagatctcttttggcttgtttcctcatcttagattgctacagcacaaacagcatctttcctgcttctattttgactttacaagtggctggtgtaccgtgaggacctgtgaatgctcagtagctattcattatttaatctctggcttcctgcttcttaatctaacatgaatcaaagctgttcttgttcaattcaggaaaaccaccatctctggcacctcctagaatgaggcattctggatagttacgttttctggatggtcatcaggagccatttgaaagcagaacaaacaaaacactttaaaacttttggctgggaattatgtaaaatggattacatactttcttgctttattaagctgaatatctggaatataatttaatcgtgatgactcagtattgtcattttagatgaacgtgtttatatggtgttataagcatagctgtgttttcaaaacctgttgaaatatagatgtgttgtatatttgcccctacttgaaatgactccaccgattctaaatgaccccagactaataagctttttgaatttttttgtttgcttttcatggatgtttctctcttggcatttgctgttgggcttttttttgctgtcacatctttgtttggtgtttctgtactagctggctccttcctctctgttcttatttgcagcttttatcttctatgatttggataccagataactaagcttgtatataaaataaatagtaagtagcgtgagtaaagcttcgcagcgtataaaatatatggaatttgtaatatcttttttggctgccctgatttcttctgctattccctgtctcctccttctctgttggttttctcctttttttgaattgggtgtcagcttggagagatgaaatctggaaagactgggtcttgtccttgacctaagcccatatctctggcccaggtatcagcgactgcctcatggaatcaacttagaaattataaaatggcacaggtagggggtcctgaaggtcatctgtttaaccccttattttatagcagtgaaggaatctgaggcactgagtggggacataagaggccaggttcatgacagtatttgtgtaaggtaaaaaaaaaaaaaaatcttgtaggaaaattctctgctggcttatcagcaagttcagaattaaagtacataaaccaaaaaaaggcttctgtttgtggcagcgtttggctgtgtttgcactcaagactattatcgatattctaggagaagctttaatcctttcattcaaacttacaagaaatgctgtttccttttagttaaaaaaaaaaaaaaaaaaaaaatccaagagagcatttgatttgaggaaccaaaagtctagaaaatgtatccgggagtcctcgtcaatttggggcataatgaaatataaaaaatactcaataaaagctcctttattactttaactgtttaaatgtggagtttttagccatcaggttaatgttttggtatcatttttttatttgattgtgagcacttttccaggtagctctgccactcgagcgctaatcagattcccacagataaatggtgctagctgcagcctgacatcactgcgtttttgcttcaacattattttattttatttggttttcctgtaaaagttaataactccatgtccatgtgtttaaacaggcaagaagagagagagagaaaggacagtgagcagaaaaggatgagggatgtttcaggaagcttgtgcaaaattgaggaaatttagggatttttgtaatttccaggtatcttaccttatgaacagtatgtgaagaaccaagaaggttacaaagcaagatggtaattcataatccttcagataacaaaaagtgaacttctctgtttctcagacagagctgggaagaatttgaaaggagttaccattgatttaaaggaggaagatgctcaataaactgatttgcttaatggtgagaattgtgtaaattttgtgttattcataagtaaattacatgctcatctggcttctcctagatgaccaagatggggaagggcatcagatatagggcataaagaccctccttttcatcttcccattattggtaggacacagtgactcttggccaagatggctctggtgctcagtaggcctttgtggaatcatttgattgattgattgattgattgattgatttttagagacggggtctcactctgtcacccaggctagagtgaagcagtacaatcatagctcagtgtaacctcaaactcctgagctcaagccatcctcccacctagctccccaagtagctggagcgccactacgccaagctatttaaaaaaaacaaatttttttttgaaacaatggagtctcgttatgttgcccaggctggtcccgaactcttggcctccagccatcctcctgcctcagcctcccaaagtgctgaattataggcgtgggccaccatgcccggccggatcatttattttttaaagtgtgtgtttgtttattggtagctgtgctggctaataatagggatgtttatggtatttagtgaaaggttgctgaatggttcaaagccatgaggactacctttgggttcttcttgtgtgtgatggatttcctcactgagctgaaaatttcttaattggggtttatcagagaaggcaactggactgatgtctcttgattcagtttctcttccaaacttgtaccttgatactaaagacagtccgtgggtacaatctgatgatggctgtgataatcagtttcacagcccttatgtcattacttctgaaagatgtgtaaaaaaaaaaaaagacattttcctcatctgcgtcagcggtatagcttgtattgctttcctgtgtttcacactttgtgttgatatgttacttgtgaagtcgtctacaagggtgtgacctgtattagataccgcttttttagaaaatggaacctgaccaccaacttgtccctgtggagagcccatttctggccactctctggggctggtgtgcttggtgaggaagttgactttcctctgacagtagctgattgtatatgactgtttgaatagtaagtttccaatccttgtcattctactgtcaatttgaagatttttttttcttcaaaatggagtgtcactctgtcacccaggctggagtgcaatggcgtggtctcagctcactgcaacctccgcctcctgggttcaagcgattctctcatttcagcttcccgagtagctgggactgcaggcacatgccaccacacccggctaatttttgtatttttagtatagatggggtttcactaaattggccaggctgatctcgaactcttgaccttgtgatccgcccgccttggccccctaaagtgttgaggttgcaggcgtgagccactgcgcctggctgattttttttttttttgagacagagtctcattgtgtcttccaggctggagtgcagtggtgtgatcttggctcactgcaacctctgtctcccaggttcaagcgattctcctacctcgacctccctagtagctgggactataggtgcgtgctgccacacccggctaattttttgtatttttagtagagacgggtttcaccgtgttagccaggatggtctcgatctcctgacctcgtgatccgcccgcctcagcctcccaaagtgctgggattacaggcgtgagccactgcgcccggctgattttttttttttttttttgagacagagtcgtgctctgttgctcaggctggagtgcagtggcgtgatagctcgctgcagcctccacctcctgggttcaagtgattctcctgccttagcttcccaagtaactgggattacaagtgtgaaccaccacacccagctaagttttgtatttttattacagacggtgtttcaccatgttggtcaggctggtctcaaactcctgatctcaggtcatctgcccaccttggcctcccaaagtgcaatttgaagatttttaagtctgccagttgactgcattatgaattacacttttggaacccatactttagtttttttgtttaggccataaaagaatcaaaggtaatacaggttgagtattcttgatcccaaatgcttgggaccaaaagtgttggattttggattttttcagattttggaatatgtacataatacttactggttgagcatctcaaatctgaaaatcccaaatccgaaatgctccagtgagcatttcctttgtgcatgacctttgactgtcatgttggcactcaaaaagttctggattttggagcattttggattttggattttcagattagggatgctcatcctgtagcaggatctaggacttggtggcatcccgttagtagcagatcttgattgttgactttcttctgttttctggtgggtctaaagaaaattcttaggctggacacggtggcccacacctgtaaatcccagcactttcggaggctgaggtgggcagatcacttgaggttaggagttcgagacccgcctggccaacatggtgaaaccttgtctctactaaaaatagaaaaattagccaagcgtggtggcatgtgcctgtagtcccagctactcaggaggctgagacaggagaatcgcttgaacccaggaggcagaggttgcagtgccaagattgtaccactttactccagcctgggtgatagagtgagactctgtctcaaaaaaaaaaaaaaagaaaatttgtgggccaggcatggtggctcacgcctgtaatcccacactttgggaggccgaaactggcagatcacgagatcaggagattgagaccatccttgccaacatggtgaaaccctgtctctactaaaaatacaaaaattagctgggtgtggtggcatgtgcctatagtcccagctactcgggaggctgaggcacaagaattgcttgaacccgggaggtggagtttgcagtgagccgagatcacgccactgcactccagcctggtgacagagcgagactctgtctcaaaaaaaaaaaaaaagaaaaaatttgtttctaaatttgaactcattctaggctatgagtagttctttttttttgtattcaaatttattttttagcattaggtcattctctaattttcttatggggtgtttggtagaattgccttttatttatttatttttttgtttgtttgtttccaagacagagtctcactctgtcacccaggctggagtgcagtggtgcgatcttggttcattgcaacctctgcctcccaggttcaagtaattctcatgcctcagccaccctagtagctaagactatgcaccaccacacctggctaatttttgtattttttttagtggagatggggtttcgccatgttggccaggctcttctcaaactcctggcctcaactggtccactcgcctcggcctcccaaagtgttgggattacaagcgtgagccactgtgcttggcctagaagtgccttttaaagactccttgaaggttttagttttgtgcagagtgtgggttgatggtacacataattttttggtccagagcttatcttccttggaattcaggagcccatcttcttgcccttagggcaggtggccctaagcccttgagggggatcctgccttgcaccagctggtggtcacctattcagtagctgacccccagtgatgccttaatgtttgaggttgccattatccatgacacaacctttcttcgtctccttcctaatcatcccgcagttcaatagtgcatgactagagagcttcaccaatctccatctggccgaacttcaaaagaagtggaagctgaagcagggtttcatctgctgagcatctgaagctgctggaggttaggagaaatacctttcagaaagcatgaaattcaaccagtggtggagagaaagagactaggaaatagaggcagtgttatcattagggaggtgctggggactgtgtgccacatatttttagtgttggagtcacccgccaccgtcactgtgtgagctcacagttctctcagggagcatcttggacactgagtcattacattcctttagagtgatttaactcaacagcttgacaccttcattaattttacaacacgaagcctgggtgctctctgcttcctctttaacagtgcagggaaattagaggaatattgaaaatataaaaccaggggatactggaagaaggagcagtcaaggagctgttgaaaaacatcatgttaaggaattgaactacttgtctttccttggtatctcttgggatcgagcacccagctcttgccactcgtctctggcacataaaccttttatttccgttcctggcacgctggccaaacctccaacttgcagccagctcgtttgccttctctgctgaggtcactgctaccgtgatccgtgtataatggcattttcctcctcttttcagtatgaaggctattacagtttcttctctaaacaggacttcaaacaatttgctgccagttgcatttcaaaggcagggaaaaggcaaatgtcatccttttttcctcccctctttgggtaactgctttgttggttgcatcaaaaattagaggggctgctatctaaattcaggtggggatgcgtggggacaaggcatttaaatgtgcttttctttctccctgaaggagaaaaacgcttttccttctcaacctttcctaaaaaggaactttgatcttcccaacccacaagcaagggtttcatttcttccaggccggcgtgtactccacagctccttctgtggcgtggtgaccgtcacccgctgcatcagcagctctgcttttcaagctgtgctcctccactgcaccagcgccctttgggctggaagttggcacccagagtcctcggctggacacggacacctctccaaagtcacccttacgtccctaagatcactgtcccttgacattaaatagtgcgtggtggtttaagatgctttttatttcaatatacatttctggaagaactactttaatcaaataacaaaacaatgacattctggcaagcagttcatgcaatatttttaactaaggccaagggaaaaaaaataaatggcagagatatttcactttgaaaggtagtttttgtgcatgtgaagttgccacttttcataaaggcttttactacatatatcaatgagttttaagagagactagggtcaataatgcatgctttagaattccctaaatacagatttacacaatagccttaaaatatattctgttctatcatgtcaactcctgtgcacttctaccagcggaattttatttctttaatgtgaaaaacaaaaggacagaggaaagtaaagtaaaacaaaggaaattagggcccacaagcttaattagtatagtgttgtaacccaaatcaacaatgggaaggacacagtgacaaaacccaggaaattccaagtcgaaagagaggctctttcctttaactccttgagtgccagggcacttgctagccagctccttacccaggtgcaggaggctacctgagtacaactcactgtctttattgttgaacttcctggcttttgttgactttcccttctcctttcctcccttaatgtacatgaaacatacctttgtgtgtgcgttaattatagataaatgggctaaaattgcctcttggttttgtaaccctcagagaaggggaaagagtacaaaaaaaattcctgtcactgtcatctgttcatttttaatgagcaatttttaaaaattgaaaataaaagaggaaaatgaataggtgttgaaccagcccgtgatatgtaaatgccaactagtaattacctaaaacctcaattttcattctgtttcatcttgcaaaacatttcattttccctgagtgaaaacacttaatttgggctgtgcgagttagcggagcggccgccccggcctgcgcctccgccggctccggctagggggcactttggctctgcgcttctgccgcctgcgggctcgtccacctcaaggttattcccctcttgccattccagtggttttactccgagtgtgcaggcccctcccccctactcccactagtctggtttcggggagcctgttcctccttgtccttgcagaggcgcgtattgaattttggctgaccgagccttcctctgcatattaactttcccctcttacctggctattgggcccttggcgtccctgagttgcagtcacactctgagagcagctttctggaagctttctttctccctttgaggttgcacacagaactgcctctagtttttgtttattcctgctgcttttttagtctttcttttcattttggcagctggggaaatcctggattgaggctcacacacatttgccctcctgccacactgagaatgacaattccgacgcttgctttcttttgcatacttgtagatttttcttctactctggtttaggatatgtcaccttttggatatgttcgtggaatgtggcttgtggttgccgctgcttccttccctccccagcctgttccctagctagaaagagagcgtgtagacttgagaaagaacagggagcccggcattgtgaatggtagatcagagaggagcctgcatgtagaaaaccagaattatgttgtcctaggaccctggatccgagagtgctctgcctggaatctcaaggaacacggcctctttagtgagatatatagcttcataattagcccgttgcattttttcacgagtgctagcatcagcgttctacgatgtgtttctctgattaacagctgctttgcaactatttccctgtgccgccgatgaccatatttgtcaaggaactcctgacagagtactgatttcttactaaaatgcagcatttctgtttgaagagggttctctcattcttggcagtgcctggctttttaagtcagtccttgttaaaactcgagttggctttggtctaacgcttgttaacaggattctgggtatctactttagtgtatgaacgtaggaacctttcacaggcaatttaatcttctgagcagcgcacgtggagcagtgcggcgctggaatggggtttcgggcccgtagattatattggtcattttcttttgccctctagttgtgatctctgtgggttaaaaggacttggctttggttgttagtgtcattaatttttgaatatttttaatattttaagatggctaatgaatgctcacatcttaggagatagatgtgtatgtagtacacaggagtgctggaattggtggcattccaaataagtgtcactggagacaatgcatcaggtttacatgtcaggtgcaaagtgctaaggctccctcaaaccccaggttcattattaggcaggctctgtcctcctgtccccctcgtgcagaaaataaagtgtgtattctgaagattacaatgtgcaggtcttttgtaggagagtggaaaacacataggaagcatctctttggtgaggactgtcaggaacctcagttcttctcactggggattacttaccctacacaatgcatttaacagcacatagttcatagtagataacccctgagtatactgtattccattgatttatacagttacaaatcctgctctctcaaatacaaatctctctcaattggccagtcatcttagatctaaaggtgtttttcaacctgaagtcccccccgcttttttccaagttgctgacagtgactccagtgactccggtgtaaccattgttatgagactgcaaagacaagaatttactcctcttccttgcacctcagttttatctctaagtgacacatagtgaaaattatgaaatttccccaaaattgtggaattggtggtggcagggttgttttattttgctttgggtggagaaggggacagaaggtagggtcagagggatggggggcggggagaaactggtctgttttctttggagtttgttgtctttattttgattaaactagctattggtaattcgaggtgcactcattaagaactcagtgcaagaggaagggaaaggaacgctgattccatatttatcacaggctcaccagcaagcagcttcgacggcggcatcagcagcttagtgccagaattctccctggcttgctgcactcccacaacatgtgcaataaagttcctgtctccgttttacatctttgacattgaggcggaagatttggcctgaatttatgtaatttagttgggcacaaatataacccatgaatagtcacattcatcttctaattagaaaatcaaatgataatacaggacaggctgcaggcaccccatcatcgaatccaacaaaagcgtgttgtgtgtgttgggcctctgcagaggaaagtcagttgaattgcttcatgaaattaatgaaaagtgcccaacaataggtgggtgaaaggcacaaaccgagtgccctgtcagttatttagtgtgtgaagatgttagcattatgggtaaagagttttgcaaaatcttctcccatcgatgtatgaatcatggggctataaaattctagattggacaggtccttccccccattttgtagtgccagttccttgcggggagggagggagaagagtcaagagtaactgaagaaataattagtgaaaagaggagagaggttttcatatgttcacacttacatgtagccacttctcagggtgtctttcttattcagcacattaggttggggctatttgagtgctttatatttttgcatctagtgtagtgatgtcgatgctgttaaatatgtgatttgcctgtcgcctgcattttcagacaaagatcaagaggaacataaacaagccccaaatatactttatgtaggtgtttggcagtattattttatatgacttgaaattagtgaatggaaactttaaaagaaattgttcatatttttgcaagtttgaagtgtgccgggactttgtcaaattcccgttaaaataaatacgtcaatttcatctcccttccaaattcatttttcttgcttttttaaaaggtgttttctactttacctgatgtttaaattggattcgctcgtttatgctgttctttgctatatcccccacgttcttcttaaatgaattactaatgacagagcactccatcattccctctctgcagccactttaaggaaagcatggtgatctaaaccttttaacctattaaagatgatttttcccaattgaatcagacccaccacaggtgtaataactaatcatttaaactacacctgctattatgtatttttaagccattatgcatgttggatagatgataattcatgtttattgcattgtccgatggatccgttttgcctacactaggctgattaatgtatttaaagaaataagagatgcatttttttaaaaaaaattgatggaatgcgccaagcactgcattgagtgcaccattaaacccatcagaactttgctctctgaccagaaatgcatataccaaggactatattaaaaaagcaaggtgaaacctgtgtgttccagtggtgggattctgttttctttctctgtcatggaaaattttggaaggatgaaggaaagctttctgtttctatgggtaaatgataggagctgtactactagcatcttctgcttaagacctgttcatccacatttccgctgacacctggtacacgtgtcacacacagcatgcagactaccgcatgatacgagtagtgtaattttcttgtgtgttgaaggtgtatttttttctccaggtgaagaacaactatccccacgccatctgagctgtgcagactggcgctgaccctgggggccagtgactgggtacctgttcattctctttccagagcaggggcctcgcttccgttggtttttctgcttgtctctcatttctcctctctccttttccccctctctcctgttatagctccttgtgtactgttgccttcttctccccacctttcctacctctacccatccccttttcttttttctcttttttccttcttcccttctcctatctcttcattaaaatgcatcagtgttgtagatgtttgttagatttctcttgattttggtgtgacctgaggcgatctggttgagtatgccgtttggggtctctagaatctcgagcattcatttttctttagtccagaactggtctattactgtggttcatgacggtggttagtactgtcggcagcattggaggacagatgataatctgtgcggagctgggcttggctgtcaagggacactagtatgtcctgttggtgacaggcccagacctgaaaagtcaagatactgagttcatcctttaggggaatgtctaggtaagcctcccacggaggggttgcagggaaaatgaatacaggcttttccctggctttttttctttggtttatcctcatatcttttgttccccaaaagtctgtctggtctcaggattacattcatataaaatatggggaaggagatgatttgtaacttgtatttcacttacagtcacagtactttctgtttgactgcttcccttagtttgaaggatcttagaaaacttccttacatctagccttagaaattttttctttcaacaacttatgagtgaactcagggcctgttgactttatctgtaacatgagaccatattattcctttgattttgatgaggtgaataatagcagtcatttaaaacagcccctttcctacctggggcaggtgggcgtttcccatccatagggctggtgtctggggtggaaagtagacaagccaggcgtaaacacacacttcgcgtgtgctgagtgatgtgaaggttaatacctgcagcggtgccccttccatcccctgcccggcttatgtggagataggaagatttcattaaataatattcattaccagaggcaggtagacaatctgtcaatctgtcagcttttagccatgaaactccaaactttgccctttgaagggtcttcagaactcagctccattgcagaaggggggccagagtgaatggcagtgggtgttgtctccgacataatcccttccagccgggacgccctcaacactttgccaggctctggagagagtgtggtctctgcccttcacttgcttgcagcgtagttggggaggcaggctgaacattagaagatggtgtaattatgtcttcaattatatggtacacagtacaggcactgaagaattgaagagaatagggagatcagagatggcttgcttatttaggcaaggcttcgaggaatcagaacagactataaaagggctgtgctgatagagaacgtgtgtgtgtgtgtgtgcgtgtgtacgtgcgcgtggggtaacgtttagacaggtggaggcaggaaagggaggccttccagaaagacagcatacagggcacaagggcggcgacatgggtgcgcatggccacacctgccggggagtatgaagaatcagctcgaatggagatcaggaggaacaggaaggatcgtcgcaggcctgaagctcggcagagggattagatttgacagactcagatacaggaagccagtgaagacagggaaacaacatcgcctttcatttaggtagattttaagtttaagaaataactggttataaatttgaccacaatagtatgcttgtctctgtggagctgggaaaaactcctaggatttttaatcttgaaattcagactattgaagtgaagtttactcctctattttctctctctcaccagattgccacggcagtgaagtttctacagaattcccgggtccgccagagcccacttgcaaccaggagagcattcctaaagaagaaaggtacaggttccacagggctgtgcagcacggcctacagggggactggggctggggcagatggaagccacggtgcaaggcaggtgctgagctgccaggacttcctagagctgcccactcatggggcagtggggctgaggcgaaccccccagtggggcatgcaggtttctttcctgacaatggagcggcaagatgacacgattcgggtaattaagcacggatgacttagtccagtccatcatggcaaaggcagcattcagtagcagagtcggcccattggatgagactgtggaggacttctggtttttggtctgctctgtgtcagtgaccctggctgcaggatgactagcttaggttaggagttcagctgcttcaatagagaatgagggagaaagaaatgaagggcgagggaaacgagatgactaacaaggtcaggttaaactcaagcttggggtcagtccgatttacagattgaagcggtaaattagtggttttatggtatttctgtaaacagggataaagtggaccctgacaaattcaatattgtctgaagagacaatctattctggttctgttggacttcagggtatttttctttttttgtaaaatgaaaactacaaagaaacctgacttttcaattttttatacatgtaattttctagaaatctaggaagtcatttacacatccttatataccatgatgggcaaaagtaagctttcttcctcccaaagcaaaactctttttccttaaggagctggaatgccagccttgaaattctgagttttgagctttcagtcatttttggctggaataggtgggtgatatttcctaggtctgctctgtgatgtcccgctgaagggatgcagcatgaaccattggtcccttcatgcgatcatgtcccggggctgcactaacagggtttgggcagaagaagcccaaacatttcaccacaggcagctgcttcgcggcagccccaaggctgggtccctgcgacagagttggtaaggagcactgcacggctgctcactggctgcattgtgccagcaccccccccccccgccatcattaggagattattaaaatttggagtgtgttggctggcctcgccactccgcaagcatcatgccataaaagagtttttccttgaaatatgtgtacctatggggagtaattaatcataaaagcttagggatttcagctctctcatcaaagcattgaagctggggaaagctgagcctaaaagctgagctgattacccggggtaacctgagacaaaatctatggttgccgagagatccttagctccagtatattgtgcaatattataactgcctgatcttctcttccaccgacaatgaccagttagtcctcattttctctcaaacgcagctgggttagaatttcatttgcagaaggtatttagagcaatttagagacaaatgtctctggtgtttgctcggcacttccccaccgcaggctttgctgagcagttttagtatcaggagctccatctaatctgtttaattttaataaatccctgactgggagagggagtgaaaaaaaaaagagagagagaaactctggaccaaataatacttcttttgagttacttggctaataattactgtagagagaaaactttttgtgcaattatgattcgttgctcctttagcaaaaaaaatccaactgatcaattcatccaagagtcattgtgcaccctatgccctgtccctggactcccatcaggaatttagcagagaaccgaacagacaaaatccctgccctcgcagagcttaaattctagtggagggaaggcagacgattaacaaatgggaaaatgaaataggtcggatgtcagatgccgagcgccatggatactgatgaatgaagcagggagccggggtgaggaatgccagagttggtgtgggctggactgtgatcttaaacaacatgaatgtcagagtgtctctaagagggtggcacatgagcaaagactggaaggtgactgtttattggtacagtggacataattccttcttgacccctaatttgggttagagtttttagaattttaggcatctggcaccttgagatgctatcctgcccttcgtcctctaaagagaaccatgtgagtttatcccgtacttaaacctggaatctctgaggttaatcacccatctccattatcctctaaaatgctgcttcagtcagtaattatccatttccgagttgaatcccaatggagtaggttctggcaggaccttttctgggcagagaattccaaggtttgatcggtgtctggggaagaaaagccccttcgcagatttaagcttcacttttcaaatttcgggctgttccagggtcaggtttccgtgctcagcacggcctggcaccgtctccgatggggatgagggtgaacatctactgggtccctaacagtagttgtggcaggaaagcaaattggctcgctggccgtctggaccaggaggggcctgggttctggcacccgtgctcttggactccctgcagaagccttgcagtgctgggcttggagcatgggctctgggagggctctcagctcctggagtcttggcttttcctagcaatgtcacttcagggaattgcagtggagcactgacttgaattataatcttgactttcttttttttaataaacatctctttcctgaaaaggcaaatccaattttgtttttcttttaatattatttaatatttaatatagaaattgaggtccctgtagtgcatgtcagttcagtggaaaatgaggcgcatcagctgagtttgtttcattgtgaaaccgcagctgggagcaggggctgcatcctgtccgtgttaccgactggttaagtgttgtgctctgtgacttctggtgggggtgctgggtgagggtgagtagggaatgagtggtatagggatggaagagcattggtttgcaaaggtctttcctgttactttttttttgttttttgttttgagatctctttcggatgctttaaaatctgaacatggagccattaatgagaaacgtgaagttattagaatcatttatcattttctttgaagtttgtactgccattttgtgtaatttacaacatttcttccttttatcgggaatattttggatgaaagaaaaaagcagctgctcaccttcagagtattagaataaatgtttttgttttccttccaaccacttgattctgcagatgacacatcaactgcggagtcagccacacatcaagataattggactgtgtgtggggtttaagccctcatagaaccagtctatatatagaagcagttcttgccaggcaggcatcatatctggggctttaagcaggctgcaatccaggaggttagagtaacgtaaaaacagcaatagaatcagtccagaaagttagaggcttggaaattgtcgtcaataggcttgtgttgatttgacaccctatccagccacaaaatgtaggaggcagtctgcttccaaagatgtttggcaggctgaggatgaggtgggtaatagtgatgcttgcttgtgaggggggtgaggtgggggagggggatagagttgtctgttaacttactctaacatatctgttgcaaagcaagcttctaggaaagacaaacatcatctatttttctgtataaccctgcatagtggggcctgggtgctgttggctcacacttactgtgtccttctcaagtgtctaagtaaagggctttttcctgcctcatccaagaaatggtcctggttggggtaggcaaatgaaacaaataaaacacaccaccatactttctcattccaaaaggtgaaactagatcttatccttctactgttcctggaagtagaaaccccggtagcaaaaccgcctccttgctggaaatgaacttgaagaaacctggcggtcccaaccttggtagtgggctagaggtaaagggcttctctgtagaatatttcaagggggagtaaattcttacacagatttcaatttaactctcttttattacttttcttttttttatcatttacgtctatttcatgaggtagtttgcatgtccttgaatggaatctcgttaccatgaaagcttttttagcattgatttcataacagtcttaatttaatagctccgtcattactgagaagctctgggagtggggccctggctttccaggtcactgaccttttaattacaaaccttgttctgatggccaggttatcgactggacagctcccagcttgtgcccccaggatgaaaacgaaaataactgtgtttcctcccccatctccaggaaaaaaaaaattgtaacctcttgtgtttctaaaattaattttctccttcagctttactttataattaattctttaatgtgtcttagtgaagccagaagtcttttcacaaagcttttcttcctagagcttgggtccagcagatagcttggggggagggcacggaaatcttgccagctcccaccccttgcttgcgtgtggcccatttcctcatcctcagaaactcctgcggctgagctggaaggaatacaattggctctgtgaggggctgtctggcccttctgattttttgttaacgagacatggattgtggcatcaagatttagattcattcctctgtttgttggagtcattgaagccagtatatcctggacattttttaaagaggtccccattctgagaaaagacaggagttgaatgtcttattgattcttacctttctgttcgttatagacgaccagaggaaacaaatgcccgacacggattcgactcagtcataagtgtgaaccaaataggccgatctgggttctctcactgactgaagaggaagagaaataagagaggacagtgggcaaaatgtagggtgacaaccaagggttctggtttgcccagaattgccctgggttcaaccctgaagttcccatgttgtggacagccccgtggtcctagacaaacaggtcaccttagcggtaaaagcctttctcaggagtgagagctaccaggggagacaaaacgggtttggttttggaacctggaggaagaaggcaaaatgagaagagtccactggcagtgagtcccggagaggcccgcctgcagcagcgtggcatcttccgcacccacttcctgctctttctcccgtagccctgccctagtgtgggtccagtgcagagcctctgggggcggggccgtgccctgcaggtgagcgaggagctgctcgtgcggagcaggcagggctgtgtggcagccgcgcttgttcctgaggatgattgagcatctccatccatctgttgtgaacggaccgtcttccttccctgccagtcttgcacctgcatattcgtcacctgctgttctggcccagcctattcatcacaccgactggtcccccgcatcaattttcccgctccccctgttatccaaacttgccttgaactccacagatttttctcggcatccaggacgagacctacggcagctaggccagccgaatgttgtagaaacagagatgccctggcttccccattcagagcgggagctgatagcacttgctgccccaagaaggctgagctgaggggtttcctccacttcaccctgcgatggggaaatagtgcagaggagtttgcggggagggaacactttcagatttacccagttacttttatgttttccctgcaactgaagactgattcttttcttaaacttgcgtgcctgtaacaatactgcaatgaaaaggaaagtgacaaaatgacattggcatgtattagtaaaaaaaaattttttttactttttgaaaaggtaaggcatatacatggtcttaaaaattcaaacagtagagaagggtatacagtaaaaaataagtcttctcttctcattctctcattcctgttccccacccgttctcttttgcagaggatgctacagtttcttatgtatcattccagagataatctatccacatgaaagcatgttaatatgtattactcccccacagaaacacgaatgctttctaaatacagtggtagcatattttacactttactcgtatacttggtgttatatctcggcagtcattccacatcgatacatactgacttgcttcattcttttcagtggctgcataatattccattatatgcatgtgttatccttttaaaaactagtcccggctgggcgcggtggctcacgcctataatcccagcacttcgggaggcagaggcgggaggatcacgaggtcagaaaattgagaccatcctagctaacacggtgaaaccccgtctctactaaaaatacaaaaaattagctcggcgtggtggtatgcgcctgtagtcccagctactcgcgaggctgaggcaggagaatcgctttaacccgggagacaaaggttgcagtgagccgagatcgtgtcaccgcactccagcctgggtgacagagcaagactccatctcaaaaatagaaacaaaaacaaacaaaaaattagccccaaatttgtgagcatttaggttgattcctatcttctgctgtctcaagcaatggcccaatgaatattcttgtcgtatacattgttgaacgcgtgttggtttggcaccatgctgaagtcagagcatttttgcatatggtaagcaggataggggatatttttcttgcttaaatttcatgggattatgtttcatagtaaagaagataaaacttttttaaggtaaacatggactataggtagaaggaagttaataagaggaaaaagagtaacaaattgcggttaacacttagcacagatttggattttgaagggatggacattctggttatgtgaaaaattcttgctttctttttttgttttgagacggagtctcgctctgtcgcccagggtggagtgcaatggcacaatctcgactcactgcagcttctgcttcccaagttcaagcgattcatctgcctcagcctcccgagtaactgggattacaggggcctgccaccgcacccagctaatttttgtagtttttggtagagatggggttttaccatcttggccaggctggtcttgaactcctgatctcatgattcacctgtctcggcctctcaaagtgctggtattacaggcatgagccaccactcccggcctgctcagttttgacctagccattgagggaggcagtgggcacagagagaaaagagcaggaaggccttcgttagtgaggggaggctcaggcagagacgcatgtgccagtcgctggattggcgtgtgaggaaaaagaagggaagagaattgaggctggtgagataggaagtgagggaggagctggggttaggacccaatattatataacagtattgcctaggctggaatgtaatggcatgatcatagctcactgaagccttgaacttctgggctcaagcgatccttctgccttagcctcccgagtagctgggactacaggcacgtgccaccacacctggtgagtttttttgtagagacagggtctcactgtgtttcccaggctggtctcaaactctcggcctcaagtcatccttctgccttgccttcccaaagcattggaattacagacatgaaccacggcacctggcccatggagcacagagaaactctgtttgaggaagtttactctcggctctgtattgaaactgacttggcctggcaataataagaccagccacaaagatggtcctgctgagtccgtcttcaggtgtgggggatctgggccgggttggtagcagtagagatggaaatagaaatgacagcatatttatgtagacagttctacagtttacaaaacactatcacatagttgattttttcactatgaccctagtatgtagtgggcaggttaatgaatattagttgattttttcgctgtgaccctagtatgtagtgggcaggttaatgaatatttgttaaatgaatgaaaacattatttaatgaatctcagagtggctcttttctcccattttacatagatgaagaaattgaggtttagaaaggctaagttgagctaatacatggcagaagtagaactagaatctatgtcttctgaccaagattctttgaactataccacgtactttctggagaggaaggacagaaccacagacatggcagaagaaagagtaagccatgctcaggagggtgtgtgtggcaaagggatgggccgaagatgactctcagggttgctttttttgtgttaagcagctttattgaggtgtaattgacatacagtaaactacacatatttaatgtgtggttttaaaaagttatgacatatgtataattgggaaactatcatcacaattaagataatggacatgcccagcatccccaaaagtttcctcctaccccttggtaatcccttcctcctgtggtccccccaacccccatatcctggtttgcaagtatgcattgatctgctatcactatagattagcctttttttttttctttttctttttctgagacaggatcttactctgtcacctaggctggagtgcagtggcgtgattacggttcactgcagccttgacctccccgggatcaagtgatcctcccatcgcagcctcccaggtagctgggccacaggcacacgccaccaaacccggctaattttttttgtattttggggagatagggtttcaccatgttgcccaggctggtctcgatctcctgggctcaagtgatctgcccaccttggcctcccaaagtgctgggattacaggtgcaaactactgtgcctggccctagtttgcattttgtagaaatttatataaatggaattatacagtgtgtaattttttttgttctggcttttccactcagcataattactttgaagtttggccatgttgttgtatatactagtggttcattcctttttattgctgaatactattccattatatggctatactacctgttgatggacatttgggttgttttcagattttggatattaaaaataaaggtgctgtcaatatttataagtttttgtagggacatataatttcttttgggtacatactttaggatggaatggctggatcatataataggtgtgtgtttaacattttaagaaacttctcaactgtttttgaaagttgttataccattttacattctcaccagtcatgtatgagtgtaccagcattttgagcctggagaataggaagatgaaggtgacaaattttctagtaatgaagccacttgactttggaaatattcttaagagtgactaaataataggtcatgtttggactacttcagctttagaggcaacagtgcataaactatctgggtttgaatcctagcttcaccactctttagctgtgtggtcctgcataaaatacttaacttcgtggtacattggtttctttatctgtaaaatgggattaatgataatatttactgcaaaaaattcttgtaagaattaaatgaaaattggctgggtgcggtggctcaagcctgtaatcccaacactttgggagactgagacagaaggattgctttagatggaagggttgagaccagcctagacaacacagtgagatcctgtctctacaaaaaaaattaaaaattagctgggcgtggtggcgcatgcctgtggttccagctacttgagaggctgaggcaggaggattgcttgagccttggagtttgagcttacagggagctatgattgtgccactgcactgtagcctgggtgacagagcaagacactgtctcaaaaaaaaagattgaggagggggtagaattaaatgaaaatgatatggaaagtgcttagcagagtgtctggcaccaaaataagggcttaattgatgacaacaatcatcaatagtatatgttctcttagaagatatattcttaatgggctatagtcagtttgctgtaattgtatcataagaattcgtgcatcaggaacctctaggaattttgagcagagagggatttaatacaggcagttaggccgggtgcagtggctcaagcctgtaatcccagcactttgggaggcccaggcaggtggatgacttgaggtcaggagtttgagaccagcctgaccaacatggcgaaaccctgtctctactaaaaatacaaaattagccgggtgtggtgacgcttacctgtaaaccaagctactttggaggctgaggcaggagaattgcctgaacctggaggcagaggttgcagtgagctgagattgcgccattgcactccagcctgggtgacagagcgagactctgtttcaaaaaaaaaaaaaaaaaaaaaggctaggtgcggtggctcacgcctataatcccagcactttgggaggccaaggtgggcagatcacaaggtcaggagattgagaccatcctggccaacaccgtgaaaacctgtctctactagaaaaaaaaaaaaaaatcagccgtgcgtggtggtgggcacctatagtccccgctgctcaggaggctgaggcaggagaatggcgtgaacccgggaggcggaggttgcagtgagccgagattgcgccactgcactccagcctgggtgacagagtgagactccatctcaaaaaaaaacaaaaaacgaacaactacaacaacagcaaaaaaaccagatggttaggcacttactcacttagtgaaaaggctaggagggtagacccaaggttaggccttcaggaatgactgccagataatttgccagggtaggtgctacctctgtcctgatcaagcagtggggaatcaagaggctgtcactggagctgtggagctcaagtgcatgtccttgcagctgtgatccagggaccaagaagttgctgctgcccccactgcaagtgttgtgtgacacctggaaaagcaacgacaggacactggaatgtgggcttggcttctacttctgtgaagattggctcttgacccccatgaagctggagactggacattacaataggaaacctcagtgtttccaatatcctgcctgcccatctgctgatatttgcagcaatcaaaagcagcaagaacagcagtcctctgcctcatttccactttccaaattgtccatgagtgcacctaattggtggtacctaattcccatccagaactctagctgccatggagggaagcattttgtgcaatatggcgcaaattatgggtgcgttagtccccgccttaaccacggaggagacgttccaagacctccagtggatgcctgaaacctcggctagtaccgaactctgtatgtactatgtttttcttatgcttgcatacctttggtaaagtttaatttataagttaggtacactaagagattaacagtgttaactaataataaaattgaacagttaaaacaatatactgtcataaaagtaatgtgaatggactcaccacctctcccaaattatcttattttcaggtaactgagactgcaaaaagcaaaaccacagataaagggagacttctgtgtatatgtgacagaaggatacttttatgcttttttagtctattattatttttttagaagacttgggcctttgttagcaactgtaatgatatacttccagtttgtccaagagataaatattgatgtattctgtatcatcactggctttcgagatgattttaagaaaacttgttggctgggtgcagtggctcacgtctgtaatcccagcactttgggaggctgaggcaggcagatcacctgaggtcaggagttcgtgaccggtctggtcaacatggtgaaaccctgtctctactaaaaataaaaaaaattagccaggcgtggtggcgcatgcctgtcatcccagctacttgggaggctgaggcaggagaatcgcttgaaccctggaggcggaggttgcagtgagctgagatcgcgccactgcactccagcctgggtgacagagtgagactctgtctcaaaacaaacaaacaaaacaaaacaaaaagaaaaatttctttcttatctggcctcacttagggatggaagttcttttaatgagatttatctgctaagggtagacaagagagtttccaccaaagggactacatgatatgcgggcttattggaactgttggaaaatgttagaagcagggatttttgaaacttaacataaggtataacataaggcaatctctactgaaaaacattttatgttgattggactgtaattagaaagatttaaaaataactttggatagtattcattaatttaccaatccattgttatattcaacacttttgagctgatgtcttttaaaaatctaagtttatctgttggggggtggtgtatgaattagtgtatctgtaattgtatgaatacggagtattcttatctttgtatgtgatggtgtgcttctattttaaatttatttttaactatagataggcttgctaggttggtcattccacagcttggtcttctttccgtttttgaagtaaaggtaactcactaatggtcctcagtaaacagagtgatggggcaagctgacttatatttcaattgttctgagaattgaacaactctactaatgtttcctttccaacttcaaacatacctgttcagtttcttcaacatcctgataggagctgatctcctcagaactctcccctctcatcagacagaggacttgggcatgctctaatctcttactgttaattattctttttagttttaaagccctttaaagtaatctttctgtaattagattgttgagtagattgtctttagtaatacggtggtcttaaattttgtgtggattttcagattgttaaatggttgcagaggctttcattcatgaagttcaagtttactatatcatggtatgtcaggaaaaaaaaaatcatgaccctctgtgataaattaaatatcacaaccacgtaaatgtcatcttttcaatgaaactgaaagtgcataggaatgggactctttttcagtctgttttggctttaagctgtaagaaaaatattttaacactgacagtagtaaacctatgaagctaaagaacaaagccatactctccccagctttataagtcacacgcggaattgtgaattaaattattctaattgcaaaatttggggtcttggccgaaagaacacaggtcgaatttgaagaagaggcagctagaaaaatcggtgtaacttttacgtgaagataatttgcacagaatgtaattgaaagagaataaatatggagctccatgatgtcctctttgagtctatttctcatatttacttacatttttttttcccaatcaaaggctctcctttaggcagtcctgaaaagaggagacacagtgctgaaatagaaataaaggttaagtatctccgatccaaaatgcttgggaccagaaatgtttcagtttggattttttcagattttggaatatttgcagaatattgtgttggttgaacatccctattccaaaatcctccaatgagcatttcctttgaatgtcatgttggcactcaaaacgtttcagattttggattattttggatttcagatttttggatcagggatgctcaacctgtaacaggcagaaataatagaaaataacagaaataacataaaatagcactgttctttggaagatcttagtaccttatttggaaagatttttactattcattcatccaccacccatccatccatccatccatctttccatccaacaagtatttattgagtgcatgtatcttacaaggcatggtgctggccctgggagtgaggatgtaatgttaccatttacataaaacaaacagaggcctggggtggaagcagactccacagaaatatgaacaaacaagcaaaatacagataagcaaggtgctgtgagagagaataatggagagggtggggtaggtttgcattgggaaggttgctgagaccagaagaatgataagtggttctgtgaagaatgagaatcccgggcagaaaggacagcaagctctcaaagactccaaggcaggaaaggagcttgatttgatctaggaactcctgcagcagtgagtgaaaatgagagtgacattttatagcttccatctggagacaccatggaaaataaaagttctattctcccagtctagaattgtccatgtcagctgtgaccaagttcagctctgttcaccaagcattcctcatctgctgtttgccaagtgctatgctaagtgcactggggacataaatggtccacacccttagagaacttggtgatgaggctgtagaagctactagtaatacagatgttttaatttacaggcaagcctgagatgatacggtacagactgtataatagccactggcatgtgtattttgctttacagcttaaaagcattcacacatacatttgcccatttaattttcatggtaacctaagtcatttcctcaaaaagtgtaaacatgggcttatgagacatatggaagcccacccaatttgaggagcagggtctctgtcatcactgagttgaatttcagggtgtagtctgcgcctgtgctctccccttgaagaatcacattgtagaaaatgaaatctagaatgactacagaggttacttagttcgtctataccttttcatatacatttcagtaattattttgctacataggaagtgaatttaatttggagtttttcctgctgccttccatgagggctttcatcctaagccccattcttgtgtgtgagaagaggaagtcttgggcttgagtgtggctctaaagtaaatgccgttgactttgttgttctgtatggacgcttttatcaggacaataaagggtacatagggtgacctctgctcctgtggagaggtcgaatggttacattacacaatcttctagagcatcttgcagcaaatacatgggttatattaaaaattgcaatcatatcattttttatagtaaattgctgaccttctgcagcggaatcagctttattgaatttcgccaaaaatgtgtttataattctgccatacacacatgatattcatgtccttgctgtccatgtggaaatgtccctttttataatgttaaacaaattaaatcgactttctcctgagcttccgtgcctcacctttaagatccattctcaggagtcgaacctccatgaagccgagctcatctccattagcgtggatgtcattacacagcgcgctggaggctggtgcattaggcagctttatcccagcagcacggattcggcttggagattctttagaggtgactccagggcagtaaatgtatttcacgcatactgcctgaacactaacaaggccttaccataattactctgtttgttttggggaaatggtaggtatttgtttaaaaggattttgtggtgaaccaagaatatacatgtgtagttagttctcgctattcacttgtgaatgatgcattgtagaagttttatcttataccaatttttctttaattttctgcagctctacttcccttccaaccagtttggtatcagggatgcaaactaattttaatgttagcctaacaaaaatacaatcagaaagttatggccaggcacggtggctcatgcctgtttacagtcccagcacttagggaggctgaggcaggtgtggagttcgagaccagcttggccaacatggtgaaaccccgcctctactaaaaatacaaaaattagccgggtgtggtggcaggcacctgtagtcccagctactcaggaggctgaggcaggagaatctcttgaacccgggaggtggaggttgcagtgagctgagatcgtgctgctgcactccagcctgggcgacagaacaagactctgtctcaaaaaaaaaataagttatactgcatactgcatacttagatgaaacataaacatttaaaaactatctccgggctgggtgtggtggctcatgccagtaataccagcactttgggaggccgagacgggcaaatcacgaggtcaggagttcaagaccagcctggccaatgtggtgaaactccatctctactaaaaatacaaaaattagctgggcatggtggcggacgcctgtaatcccagttactcaggaggctgaggcaggagaatcgtttgaacctgggaggcggagtttacagtgatctgagatcacgccattgtactccagcctgggcaacagggcaagactccgtctcaaaaaaaaaatctgctttttagattcatttactctaagtttgttcatgcctgttatctatatatttatatctatgtttgtatcaattgttggttcccagtttagcacatagaggcagtatgattcactggaaaaatcatctatccatttactaattattaaatatccatttccttcatgtgccaacatttgtgctaaacataaaaatacaaaaataagatttaatatttgtagtttagtggggttccatgatatataaacagatgtggtgtgggtgataaaatattataggtgctataataggtatctgagtggaggcctggggggagagcgatcagttttgtggtaggggaggagaactagtggcgaagaggttaaaaaggtgcctccattcatggaggaggtcccctttatccgagccctgcaagaggattagttgtttttaaggtctgaagcggattggtgacttttgtccatgcagaggatgtgatggggcatagccactaaggcgagagatcgaggagacagcttggaaaggtgggcaaaggtgggatcagggaagacctggcatgtgttacctcaagagtgtggattttgttatgtggacagtggggaaaccacggaaaagttgtatgtggaataataagtttcatgctagcgttttagaaagctctctcaaaggtagggcgggcatttaggagaggggaatgatggatgaaccagggcagttattacggggatggagaggatggattagagagtgaggaagcagaatctcctgggaattggtggctgaatggatgcaagagtgaagaagagggaagagtctgggctcactgtccaaatttttggcttagggagctggtgtggaggatagcagatgaaagagtagaccaggagtgagagacgctgtgaagagagaaggcccagagggaggtgcgggggaccctgtcacgtggttagtggttggccagaggcggatgccccacagtcaggcagtggcgctggcttctgcctttcaaagtcgcttctacagggtgaccgttaagcttgttctttgacaccgacattgttaagtggtttcactgaaatttgagactctctgaagaaagggaagatggcatttatgaagcaagtgttattttatctggaaatgatttctcaggggtaagcctgtcactctgcctctggtaaagtctgcttctccctccaagaagagaaggtcccactgatttgggtcatggtcagagtgggccgctactcccaccttccactgaaaactcagcttccagaaagctcctcttcactcctttgtcatctgtttcctcatctgctcttccctgagtttgtccttctctgttatatctgcatgtgtttccactgatctgcttgtgacagtcaacctgtttgctgatctggcctcggcaattttcagggcttccctgcacacctgtgacatgacggttagttccctgaccttgcatgcacctcggttttctggtagcagatggtctttgtggtacctttactcttacaaatcagtggagtcagaagtttacaaaatgtgggccgggcgcggtggctcacgcctgtaatcccagccctttgggaggccgaggtgggcggatcatgaggtcaggagatcgagaccatcctggctaacatggtgaaaccccgtctctactaaaaatacaaaaaaaaaaaaaaaaaaaaattagccgggcatggtggtgggcacctgcagtcccagctacttgggaggctgaggcaggaggatggcgtgaacctgggaggcggagcttgtagtgagccgagatcgcaccactgcactccagcctgggtgacagagcgagactccgtctcaaaaaaaaaaaaaaaagagaagtttacaaaatgtgtggagctgaggcagaaagcctaaagggcagactccaaaagggcagactccaaaatgatcaggacattaactgacttgctgggagatcccagagcacacgcagagtcattgaactccatgatactcattccaggtcaccttgaagaggcagggagaagggcattttcgcttcttgaagcttctgctcctctgccggttcagcctgatcttagagctctcttggcattgcagctgcagtcaggttttccttttaaatgactgcagccttcagatgcccacacagtgcagtccagatctcatgcctggggctgaaggtggacctggtttggcggtaaattatgatccacagctttgaaagcatataggctgtatgcttttttttcttttttttttaaagacagagcctcacactgtcacccaggctggaatacagtggcgcgatcttggctcactgcaacctccatctcctggggctcaagtgatcttcccatctcagcctcctgagtagctgggattactgatgcgtaccaccatacacccagctaatttttgtagttttagtagagatggggttttgccatgtttcccaggctggctgtacaccttttaaaaataaagcctatctgaaagcaagttgcttctctagaggcatcttcctcagtctgcttttgtccagccttcccgtggaaagcagccttcttcttgatctggggctgcagtaaatcacatgctggccatcgcgggaacacatcccatcccttcccaaaaccacctgcaggactgaccctaccccccaataacacaccaacctgctgtgttttttactgaccattcctgtccgggatagtcactgtagcagtctactttggtgggcttttacctctcctatctgctttttttttaatttacaaattttaaattaaaaaaatttaaatgaaaggtttggacattgagtattgttacccactcacttctggtgactcttcagacactcactcgaagagccttccttcttccctacatacagagtcggggggagagatggggaaaatgacggaggaaaacatgctaaaaatgattttcaatgtaaaataagggagggaaaaacgaatgtttgaggaaacccaaaaaaagcacctctcattacagtaattaaaccgcagcgtttaacctatcagaatgtgctgcatatgtgagagacaagccagggagctctgtgtttgaaattagagctctaatcctcagggaagagaatagttaaataatttgtttttgaggtgtgagagcagagccggcaaggtgtgagtgtgtgtgtgtgtgtgtgtgtgtgcatgcacccgtgagggtgaggggccgcagtgcctgtgtttaccaagaatatcctggaggtagatatttatcagcacctgtgtgctgtcaagaagcacacaagctgctgttgcccgttcattaggttttcagaagagtccgggcctcacctgtggccgggcgttgcatcataacagcagaacttgcttcattctggccctctgggacacacaggaatagatttgagagacaggatgagacatacagagaaagacacaagcattaggggaggaagaaagccgaatgatcctggagcatgtccttggcgcaggcactgctggacaaagcagtccatctcggtgggctggcactgcggagccagcgtggacattccaccgagcacgaggcgaaaggggcagcccagaggcctgccactgaaaccgccttctgcaggcaccgtctgccagtgctcagcgctgttagcagggctcctcctctgctgggatgaggggttgggatgacaggggttcacagtgtcctgcctgccccttcagcagcataacctttgtctttctggactcctggctggagctggtgatactgtgaacatgctgcctctctggaagctgctccatgtctccctatatccccagagcatggcagctgtgatcagaattccacagggtggggctgatgaggatccatgcacatccgtccctgtacccctcattagggacttgggttggggggtgcctatctgcacgtgttctttttcctctcacgcactttgtcggtctctgtgcagggtttctattatactaataaggagcactggggacgctggcgacagtgtgataatcgtccccttggagggccagaggcagtcggtgtgcgctgacctcatcctgggggagtgctgatgaaactctggcttggccttactgcctgagcactgcgcctgatgtggagggttagggggcagggttgccgggctgtttcttctacggcttcattgttaccagccatgcttgtctttggggcatttcatcaaaacttctttagttttgcttaagaactttaaagagctgatgagcctaatggaaacttttcagtaataactcagtacaggaacacacttcacaaataccagctaattaatcctcagagcaccctggggacaggggagagtatggtaatggcactggtgatttttatccccattttatagactgagagactgaggcacctggaagaatctgtgacttgggccagagggagggcacaaatctggaagctgaggttagagtgctttgccttttggcctctcttgggactgttgagtcttaccttaaagtcatttgagtaagtcattaagtaaagccagtcaccttagattttgcctcttctctcatctttcttttttttttccctgcttgatactaggtcttggatgtaactggtatccatcaatacagatctctagcatcaattttagtaactgccttgtgttctgctgaaaatatatgccataatttattgtaacccagtccccttgattatcttcattttacacaattatagcaactcttctttaagtatccttgggaaataggtattacttttgtgattacctttgtggggtaaaaacctcagagttaggctgggtgcaatggctcacgcctgtaatcccagcactttgggaggccgaggtgggcggatcacttgaggtcaggagtttgagaccagcctggccaacatggtgaaacctcgtctctactaaaaatacaaaaaatagccagctgtggtggcgggcgcctgtaatcccagctgctcgggaggctgaggcagaagaattgcttgaaccctggaggtggagtttgcagtgacctgagatcgtgccactgcacttcaggctgggcaacagagtgagactctgtctcaaaaacaaaaagcaaaaaacctcagagctgctaatcctaggttaaagaaaatggacttgttttcattttaatgtacattgctaacctgtgctttaaaaaggtgatttcagcttacagcctcaacaccagttggccagtgccccgagcacaagtctcaaacttccacattgtcaagttcacagtttcttcctttgtctaagcatggaaaacccttcccccactgcaagggcatagaactatttgcctacctttttttttttttttaatgattttagttttcttttatggaatttgtgttgttgctagttgcgtaacagggaatataactttattttttcctgttgaccaactggatagtctcagcaccatttatagaacgatttatttctttccccactgatttgacatgtcatctttttcatctgctaaattcttaaatatactgatgtgtgatcagggacattctattctcattcattgctgtacttgtctgttgttgtgctaatgctgcaatgtttttattattatagatttgttacacactgtatttgttagtattcgttgtactcttttgtacaaaaatataaaaattttgtatttttaatagagatggggtttcttcatgttggtcaggctggtcttgaactcctgacctcaggtgatccgcccacctcggcttcccaaagtgctgcgattacacgtgtgagccaccgtgcccggcctgcttgtatatttcttaagacattttagaatcacttttatcatcttcttcttgatcccaccccacccctacccactgcgaatcaagaaagaagatccctttgaaattttgatgataattacattcaacatagaaattactttggaagctggacgctgtggctcatgcctgtaatcccagcactttgggaggccgagacaggtagatcatttgaggttaggagttcaagaccagcctgactaacatagtgaaaccccatctctctactaaaaatacaaaaattagctgggcatggtggtacacacctgtaatcccagctactcaggagcctgaggcaggagaatcacttgagcctgggaggcagagattgtggtgagctgagattgcaccactgcactccagtctgggcgacagaatgagaccctgtctcaaaaaaaaaaaaaaaaaaaagaaagaaagaaattactttggaaagaattggtgtctttgcagtatgcactctttccatccacggatgtggggtatctttcaagtaaaatatgtaatgcccctcactgatggttttgtacagttcttgcatagttcctgcacatttcctttaattctgagtacctgtatttttaatttattcttcttgctttaggatatttatttccattatattttctaattgatctttgccaatagttaggaaagctgttgatttctgtgtttttagaattattttattatttttaatagtcctaattgtttttgttggttctcttaggttttctcagtagcatatcacatgaaaataacattttccttttccaatgtcgtatgactttattattattattttgactggcccttctagaacagctttaattaaatatgagtgcacaaggaggtacattgggaggtacaatcacccccttttctttaaagcattaatttagagatgaagagcataggaatataagagacatagccatgatgattcctagacttttcaaagtccttgctttgcaggactttttcatctattttatttttagtttttcacctatttggtccagtatttattctttggccaaaaatggcttgacatgctgaaaaccaccttattttagagaagaaaatacacattatttctattttgtcaagcggaaaagctgaaaggcattggaaataactcccagtcccttggcaaacagatcagtgagtagacccctgtgtgagacaaagccactgcctggagaggatggtgcgggggctggcggtccattgccacggctgctgcagctctcaacaccacggcagcctccccccaccaccacccaacggtgtacagcctgagtggaaagggcaagtttttggccgaaagagtaaatgaaacatggacgctgtaggacatcatcagaagtgattatttattctacagaactagagacttctcttctctcagaggacaactgacagcagcttctgtgtcatcaggctgctgccctcaccctgagacagattgtggtaaaggatggaacagggggtcatttgatgatcttaggcctggggagctgcgaggctgagttcttgcgttttcagtctcgcctcccctggtccactctgcgttgctgccagatgataagattccagttctgctttcggcgtgtgtcttccctgcactcctttgggtagttcccattgctcctaggatcaagtcctgttgtctgcttgtattctttctaatctgatttttttcttccatctatttttttttttttttgagacggagtttcacttttgttgctcaggctggaatgcaatggcacgatcttggctcactgcaatctctgcctcccgggttcaagcaattctcctgcctcagcctcccgagtagctgggattacaggcgcccgccaccatgcccagctaattttgtatttttagtagagacggtgtttctccatgttggtcagactggtcttgaactcccaacatcaggtgatctgccagcctgggcttcccaaagtgctgggattacaggtgtgagccaccatgcccggccttccatcttttatatttaacagcttcaaatttccagaaaagtggaatagcgtatgaacacccaattaccttttctttctttcttttttggagatggggtctcactctgtcacccaggctggagtgcagtggtgccatctgggaccacaggtgtgcaccaccagacccagctaattttttgtttctttgttttttggtagagatggggtttcgccatgttgcccaggctggtctcaaacttctgacctcaggtgatctgcctgcctcaacctcccaaagtgttgggatcacagacatgagccaccatgcccagcctcccagataccttttattcagtttcttagttgttaacattttgccacctttttttttttttttttgagacggagtcttgctctgtcgcccaggttggagtgcagtggtgcaatcttggctcactgcaacctctgcctcccaggttcaagcaattctcctgccttagcctcccaagtagctgggattataggcgcacaccaccacgcccagctaatttttgtatttttagtagaggcggggtttcaccatattggccaggctggtctcgaactcctgaccttgtgattcgcctgccctcggcctcccaaagtgccgagattacaggggtaagccactgtgcctggcccattttgccacttttactttgtctcactctctacacacacacatatacacacacacaaaccctaatctgaccatgtgaaaataaattgtagatatcatgacacttcacctgtaattacttcagcatatacctcctcagatacggccattcttccacacataaccacaccatgttaccacatagaagaaaattaacactaattccataagatcatctgctatatatcccatatttacattttcccagttgcccccacatttcttttgtatctcagattcaggggacagtcggggcttgtgctgtgcatttcactgccatgtctctttatctagaactgccctcttgtctcttctcattttacttgtcattaacattttttgaggagttccaatcaattgttttatataatatcacacattctgcatttgtctcattgtttcctcttgataagattaagattaaacatttttggcaagaacagttagtaagtaatgttgtgtgcttattattgcattacaataaaaggtgagaaagatcagattcttccagtattggtgatgctaatttgattggttaatgaggtgactaccagaactctccatattaaaggtacattttcccttttgtaattaacaagtaatctgagaagtgcttctttgagatcatgttatctggttactcaacagcctttcattcagtggttttagtatccattggagattcttgtttcaactgactgtttctctggaactttaacagttgtgattatgtaactgtattattactcatttattacctattatttttctgtaaagagctctctcctctttcctcttctgtttctttctcttctcactttcatttgagtgttattatgtactctttagttcagagtgctataatctattattgtcatttttcttcctttttacccgagacaaggtctcactctggctatcttcctgcctcagcctcccgaatagctaggattataggtgtatgccactgcgcctggctaatttaagaataattttttattttattttattttttagagacaaggtcttactgtgttgcccaggctggtcttgaactcctggtctttagcaatcccttcatctcccctgcgcactgccccctgctgccccagtagctgggattacaggcatgagtcatgaggcccagctctttttctttttctctcttttcttgtcttcttttctccacccacccccaacacatgtgtatgtatcaaaatcaagaagataactatacaattctatgatcagatgtacagaccatattcaaatttagtcagttgtcctaataatgccctttatagaaaaagaaaaagatttttttctagcccaccatctaatccatgatcgtgagttgcatgattgtcctatctctttaccccccttaatttggaacaatgtcctgcagtcttcctttgtcttttattaccttgacatttttgtaggatagaggccagttttgtacactgtacttaatttggatttatctgatgtttcctcatgactagatttcatttgtgcatttttggtaagaatacacaggagtggtattgtgtctttccggcatcataaaaggacattgattttgatttgttctgtgatttcactttgatctgttggttgaagtggtatctgccaagtttctccactgcagagttatattttttccctttataattaataagtaccttctgaggagatacttcgatccttcgacactatatgagtagcctgtttttatcagcttcatgaacattgctaatgattcctcactgaatcaattattatgaagattgctgaatcttcatatcagttattatgaggattgctgaatggtgattttctttttttctttctttcttttctttttttttagagacagagtctctctctgtcgcccagggtggagtgcaatggcatgatctcggctcactgcaacctccatctcccgggttcaagcaattctcctgcctcagcctcctgagtagctgggattacaggtgcacaccaccatgcctggctaatttttttttttttttttttggtagaggcggggtttcaccatgttggtcaggctggtctcgaactcctgaccttgcgatccactgaccttggcctcccaaagtgttgggattacaggcgtgagccacggcgcctggccgctgaatggtgattttctaatcctcttactattgaaatgtattcttgctggtatagaactctagattggcagttatttccacactttaaaaatgttatttcaggccgggcgcggttgctcacgcctgtaatcccagcactttgggaggccgaggcaggcggatcatctgaagatgggagtttgagaccagcctgaccaacatgaagaaaccccatctctactaaaaatacaaaatttttgcatttttgtatttgtatgccaggcatgtgctgggcatagtggcacatgcctgtcagctactccggaggcggaggccggagaatcccttgaacccgggaggcggaggttgctgtgagccgagatcgtgccattgcactccagcctgggcaacaagagcgaaactccgtctcaaaaaataaaaaagttgggccgggcgcagtggctcacacctgtaatcccagcaccttgggaggccgaggcgggtgtatcacgaggtcaggagattgagaccacggtgaaaccccgtctctactaaaaatgcaaaaaattagccgggcatggtggcgggtgcctgtagttccagctactcgggaggctgaggcaggagaatggcgtgaacccaggaggcggggcttgcagtgagccaacatcacgccactgcactacagcctggcgacagagcaagactcggtctcaaaaaagaaaaaaaaaaagttatttcattattttctggcttctattgtcatctttcagtcttgttattgctcctttgaagaaggtgaaacatgtttttatcttctggcagcttttagatttttttctcaatctttggtgtttttttcaaaagtagttttcctatgtgatgttcctgaggtggttttctttgtagttatcctatgtaacatagaatctttgaatattcggcctgattgccttgttagttttacaaaattattaattattctctcttaatattgttctgtcttgttctcattctcttctttcctggactccagttgtaattgtgttagaccttctttccatgttctttatgtcttttgctctgttctacattgtccatccgcttttctttttctttactgatctttcagtttactaaccctttcttctgctatatccagtttgctgttaaacctgtctgttgagctcttaatttcaattattgcattttacaattaccttgtttgcatttgatttttttttttttttgagacaaagatttcactgtctcactctcttgcccagactggagtgtggtggcacaatcaaggctcaagccatcctcctaccttagtctcccaagtaactgggactacaggtgtgagcaaccacacctggcctgatttttctttttctttcttttttttttttttttttgtagagacagggccttgccatgttgccaaggctggtctcaaattcctgagctcaagtgatgccacctgccttggcctctcaaagtcctgagattataggcatgggccactatgcctaacctgatgccttttaagtttagttttctagtaaacttctctgttttgtcacctgtttcattgaatatattaattagttcttttaaagtctttgataaattttaacactgggctatctatgagtttgggttttttaaattcattttcccccacttggtcctattttttgtatatctttttttttttttttttgagacggagtcttactctgtcacccaggctggagtgcagtggcacgatctcagctcactgcaacctctgcctcccaggttcaagtgattcttctgcctcagcctcccaagtagttgggactacaggtgtgcaccaccacacccgactaatttttatatttttagtagagacgaggtttcaccacattggccaggctggtctcgaactcctgacctcgtgatctgcccgcctcggcctcccaaagtgctgggattacaggcatgagccactgcgcccagcctttttttgtatatcttaaaatattttattgcatgacagtgaataattgagaagctctgaaagatactattttcctctgaagtttactttatgcttgtgtaaagtgggacttatgaccttgatcaatcaggatttggcctgagtcaggttgcagggttttagaaaataagtctgtcttcccctggtcaatccatgttcctagggtatagccctctatgggtcccaacaaagaacctaaagttcttcatggctccttttccttggtggggtgaaccctaatttttgtttactgctgttgaacttttacaagctatttcatctcagttagacgcagaaagcctctcaatgctgttttgatttgaatttctcttttgaacttaagagccatttttatttccatatctacaaattgactattcatgtattttaccctttcttaggattaggagattaatgttttaaaatggatttataattttatattctcaactttggatcttaagctctagccttactcaatttaaaaattgtaactgagtgcaatggcttgagcctgtaatcccagctacttgggaggctgaggcaggaggattgcttgaggctaggagtttgagaccagcctgggcgacctcattgctacaaaaaaacacaaaaattagatgggtgtggtagcacatgcctgtagtcccagctacttgggaggctgaggtgggaagatctcttaagcccaggagttctgctttgtgaactccatttgtttatttatttacatgtctgtctatttacttacatctctctagtccatctgaagatggacaaaagctctgcctcagcatcttatagggtatttgctcacctttctgcagttcccttctcactgagatcttggactctcaagtcttggttgccttggcagctccccagtactttcaatcagtttgtttttcagttgttctcagcagtattgttgaacttttacaagctatttcatcttggttagatgcagaaagcctctcagtgctgttttgagttgaatttctcttttgaacttaagagccatttttatttccgtatctacaaattgactattcaggtattttaccctttcttgggattaggagattaatgttttaaaattgatttataattttatatactaaggaaaatagccccatgtctgggatttgtgttacaaatatatgctattagtttgaaatttgtcttgactttgtttatgatgcttttgtccaggcagaatttttttatttatctatcatttcttttatgacttccttttttttttttgacgtggaatttcactcttgttgcccaggttggagtgcaatggcatgatcttgactctctgcaacctccgcctcttgagttcaagggattctcctacctcagcctcccgagtagctaggattacaggcatgtgccatcatgcctggctaatttttttgtttgtttgtttgttttgttttgttttgttttttagtagagacggggtttcttcatgttggtcaggctgatctcaaactcccgacctcaggtgatccgcccgcctcggcctcccaaagtgctgggattacagacgtgagccaccgctcctggccaccagtattattttttaaacctcaagttgtttttttttaagtaatcaggaatttatttcagtgtatagagtataaggattcaagttcagttttttccagctaataaaataatccagcatccattattgcaagggttgacacactttttctgtaaagagccagatagtaaatactttaaggttttgcaatttgtatggtctctgaacactactcatcgccactgtggtagcacaaaagcagccgttgacagtgtataaactaatgagaaataaaactttatttatggacactgaaatttgaatttcatctaattttcatgtatcattaaattctttttttgcctcctaactttaaaaaaatgtaaaaaccattcttagcttgcaggccatccaaaaatagacaatgggctaaatttgtctccctggctgtagtttcccatctctgcagtttttctccattgatttgcaatgaagctttatcctatgttaacttcctgtatatatctggacgtactctgttcacttgaaatgtttctttgtgtccaatgtcacactatcttacatgttttattatctgttaaaattaattttgcctcagcattttttcaattatttggaattttcttggctattcttatttctatataattttcaaaattagcttgcccagtaaaaaatgaaaaataaagatttttttttagacagtcttgctgtgtcacccagattggagggcagtggcatgatctcggctcactgcaccctccacctcaggagactgaagtggttctcctgcctctgcctcccaagtggctgggattacacgcatgcaccaccacgccgggctaatttttgtatttttagtagagacggggtttcgccatgttgaccaggctggtcttgaactcctgacctcaagtgatccgcctgcctcatcctctcaaagtgctgacattacaggtgtgagccactgtacctggcctaattttcttattttttgtagagacggggtctcactatgttgcccaggctggtcgcaaactcctgggctcaagtgatcctcctgcctcagcatcacgaagtatgggattacaggcatgagccactgcacccagccatgtatctttttcgttactactttgaatgggatgtattctttcattatgtctttcagccagttctttaatttgaaggcagtttttacatactgattttgaatgttgacacctagctagatacttatattgtttatggtacgttaattcatgtcagtttttccaggtgctatatgtaaataacactctcccctcttcttttccgttgcttatatctattactacttttcttgtccagttgcatcagcaaatacctccagaacagtgataaataaaactgatgattgtgaacgtatgatgtgtttctgattttaaataatatgcttttatatctttttaataaaagatgatgtcagctttggagagtgacacacatatacacaagtagatactcttcccccccccccccccactcccactaacagataatcatattcaggaagtattcttgtattcttattgtattagagtttttactaagaatggatatcgaattatatctaatgtcctttatcacttacagaaataatcatataattattgtcttttgatctaatatgataaagtatattaatagataacagtgaatcattattatattattaatatgaattccagccagttgtagtgtagtattttttaaatgtgctagattctttgtgccattattttatccagcagttagcagaatagccgtaagtatgtgttcaagccctcagagatgatgaatttgttcatgcctttgtgttcatgccctcagacatcatgaatttgaggatatttggaaaaattaaggtagagtgttttttgttttgttttgttttgtttttgagacagagtctcactctgttgccctggctggagtgcagtggcgtgatctcggctcactgcaacctccgcctcctgggttcaagtgattctcatacctcagcctcccaagtagctgggattacagatgcacgtcaccacaccttgctaatttttgtattttttgtagagatggggtttcaccacattggccaggctggtctcgaactcctgacctcaagtgatctgcccaccttggcctcccaaagtgctgggatttacaggcatgagccactgtgcctggctttgaagtagagattgatggagatctagtttattttcgtagtattggatgcattaaatataaacagtgctaatattataaatatcaaattctaagcattatagtactaaagcaatattcatgctttagtaaaatcatgaatactaattataataaatgtgaaaagtatgtaactattttttacaagtgagccatgaagtatgtgatagttgtgctttctcttttgtaaaatttttttttcatagagttaatggactctatttggggatggggcagattgcttagctgtgtacttatcactgattaatcctcactcagctcaagctgtaaaattcccctcggcaccatcaaagacatcaggcaacttactgttttcttggtgccatttctggagccctctgcccgccctcccactgcagtctggactgcgctctctagacctgttccccagttgtcagcctttcccgatgactctgggaagacccttttctctatcctgtggttgagttcctgtcttccaacttccatgtggtctttcttggattgcttctttgggttggtagaacagatcctccagtagcttcctgagaaggtgtgcatgggaggtaagcagcttttttagatccagtatctgaaaacatctttaatgtgccttcatgatttcatctttaggttggctgggtttagaattctaggttggaaatgattttttattagaatcttgaggacattttccattgttttctacctttctgtgttgctgctgaaaagtctgaggtcattctgattcctgatcctttctatacaagctgtttatttccctctgaaagctttaccgcttgtctttattctacatattctgaaatttcacagtgatgtacatgagagggtcttttaatgtgaaatcttcttgtattatttctttaataatttcctctcctttgtgttgtatattgtttttttagaacctcgatagttggatggtagatgtcctggcttgaccctcaagtatttaagaaaatatattttctttcctatcttttatcttttttgccctactttatatgtaatttcttctaatagtttgtcttctaataatttttttttccaatgtttttcctgggtattgaatgattttctgctctcaggtgtttatgagagttctttcttttctgtgtgtgttcccttttttcccccacattccattcttgtttcattgatgcaacattacttcttttcctctgataattaatttctgtttcttccaagcttttttgtttgtttttggatggctgtttttcattttcttttttgagacgtggtcttgctctgtcgccaggctggagtgcagtggtgcgatcttggctcactgcaatctccacctcccgtgttcaagcgattctcctgcctcagcctcctgagtagctgggactacaggtgcacgccaacacgcccagctaatttttgtatttttagtagagatggggtttcaccatgttggccaggatggtcttcgatctcttgaccttgtgatccgcccgcctcagcctctcaaagtgctgggattacaggcatgagccactgcacctggctctgttttttcattgttaagttttccattttccctcaaatgtctggtgatctttggctatccagtatttatgacagaggccataagaaactgattggagcatctgtgggcatgagtccttcctaacatgtaagtgtaagatgacaaaaatcaaccagaagtatgtgttcaagctgctatgtctaactggaagtttctttagagaaaatgtcaacagggtttttttttttttttttgagatggtatcttactctgttgcccaggctggagtgcagtggcgtgatcacagctcactgcagtcttgacctccccaggctcaggtaatcctctcaccttagcctcccaaatagttggaagtacaggcacacgccaccacgcctggctagttttttttttttttttttttttgtagagacgggattttgccatgttgcccaggtgggtctcgaacatctgggctcaggcagtcctcccacctcggcctcccaaagtgttaggattacaggtgtgagccactgtgcccggccttcaacagttgttttgacatacacaattttcactttgtacacaactttagaatctaattttcagctaagatgtgattccattttatgttccagatattaacaccagttgcttctggatggtggaaatgtgtgttacttttcacttctggtgcctttaagcttttctgtattaaaaaaaaatgtgtttctaaagaatgtcatatggtatttaccagggggtgggggtgggatatagggttttcttgtttatgatgggtacagagtttcagttttgcaagatgaagagttctagagatggatggtggtgatggttggaacagtgtgaatgtacttaatattgctgaaccatacattaaaaatggctaagatgggccgggcacagtgcctcatgcctagaatcccagcactttgggaggccgaggcgggcggatcacttgagcttaggagttcgagaccagcctgggcaacaggatgaaaccccatctctactaaaaatacaaaaattagctgggtgtggtggtgggcgcctgtattcccagctactcgagaggctgaggcaggagaatcgctggaacctgggaggctgaggttgcagggagccgtgattgtgccactgcactccagcccgggcaacagagtgaggctctgtctcaaaaacaaaacaaaacaaaaaagcagtggctaagatgggacattttatgtgatgtttattttgccataatttaaaaattttcagtttttgaatgttcataatcagaaaaaataaagggagggagttttcataatcttcccttcaaccatcatcagtttgtaggatatctggaaaaatggaaacagaacacggagcttccagtttatgtagtacaatcagattgccagatactggacacaagttagagattttactcagctctttcctcagattgagaatttcctgaaattaaagggctgacagatctaacttgttaaactgcttactagattacatggcaaaagtggtatcttgtttactgacctatctccctgacgtctgacatagtaaggtctcaataattacatgttgatgaataaataaattaacaggatatgccagtactccaaaagattgtgctggagtaatcatacccttaccttaaacttatacaagtaaggaggataaatctataaagcacaagaaaaatgcaggaggatgtctccatgagcttggattaggcaaagatttcttaattaggtcacaaagcctactaaccatagaacaaaaaggatgctacatcaaaatcaagcacttctattcatgaaaactgaaagaaggcaaagggacaagccatagagaagatattcataatacagtcatgtgtcactggatgacagagatacgttcttttttatttttattttgagacggagtcttgctgtcacccaggctggagtgcggtggcgcaatctcagctcactgcaagctctgcctcctgggttcacaccattctcctgtcttagcctcccgagtagctgggactataggcgccccccccaccacgcccagctaattttttgtatttttagtacagatggggtttcactgtgttagccaggatggtctcgatctcctgacctcgtgatccgctctcctcagcctcccagagtgctgggattacaggcgtgagctaccgcgcctggccagagatatgttctaagaaacgtgtcattagacaatttcattgtacaaatgttatagactgtacctacacagacctggagggtataacctactgcatacttaggctatcaggtatagcctattgctcccagactacaaagctatacagcatgttactgaaaaggatactgtaggcaattgtaacacaatggtacatatttgtgtttctgagcacagaaaaaaggtaatgaattgtgctacaacattatgatggctgtgacagcactaaacaatgggaatttttcagctttactataatcttatgggactaccatcgcatgtgcagtccatcgttaactgaaatatcatgtggcgcgtaactatatattttattcatctgacggaggtcttgtatctaatatatagagaactcctacaaatcagtaagaaaaagccacataacctaatttttaaagtgtacaggctttttgaaagtatacaggctgggcgcagtagctcacacctgtaatctcagcactttgggaggccaaagcggaggattgtttgagaccagactgggcagcatagtaagatcccgtctctcttaaaaaagggtgtacaaaagactcaaatatttactttattaaggagcatttccagagcgttaataatcatataaaaagatgcctaatatccttcctcatcagggtaatgtagcttaaaccacagcaagtcaccattatacacacccattagaatggcgaaaatttaaaaggctgagaatagcaaatgttgtcaagaatgtggagcagcagtaaccctcatgcattgatgatgagtgtagctgcctttaaaaagctggcactttctactcaagttaagtacatgcttgttttatgacctagcaattccattattagacataaacccaagagaaatgggtggatctatccataaaaagacatgtagaagaatgtatataacagctttatttaaaacagccaaggctgggtgcggtagctcacgcctgtaatcccagcactttgggaggctgaggtgggcagatcacttgagatcaggagttcaagaccagcctggttaacatggtgaaaccccatctctactaaaagtacaaaaattaactgggtgttgtggtgcatacctgtaattccctgctactccggaggctgaggcaggataatcgcttgaacctgggaggtggaggttgcagtgagctgacatcgtgccactgcactccagcctgggtgacagagtgagattccaactctaaataaataaataaatgagccaaaacctggggggaagtgtcccatcaacagaaaagtgggtggtttatgaaacacatacaaaaggaaatattacataagaagaaaaaagaatgaattactggtcaatgggtctgcatgaatgagtcttaaagaattctgtcaaagaagccagatataaaagaatacatatatttttatgaagttcaaggacaggcaaaacaaatgctgatgatcagagttgtagtggcccctctggaggagagtgaagatgccttatggagtactgggagatgttctggatctccgagtggttgttacacaagtatatgcatatgtacaaattcttcaagctttgtgcttaggattagtgtaattttgcatattaaaccatgtatatcatctcagcttttaaaaattagtgctactcattattagactagaggaaaataggacttagaacttgcaaatcacattctgggggaagaaaagatgatcagcaaaggctaggagagaaaaaaacaggagatgctacacacaatatataatcatgggatttaggaaatcccctattaaagaacagatcccaaactcagtgaaacctgaagaaaaaaaggccagttttatgcgtcaacaagagacataactaaaataaaacaacacaggaaagttgaaaataagggatgggctggatacagtgagcaaatgctaatcaaaagaaacagaattggccgggtgtggtggctcacactagtgatcccagagcttagggggctgaggcaggaggatggcttgaggccaggagttcgagaccagcctgggcaacatggtgagacccccatctgaaaaaaattcgtaaaagataaaccaggtatggtggtgtgcacttgtagtcccagctgttcaggaggctgatgcgggagggtagcttgagctgcactcctagacaacagagcaagaacccgtctcttaaataaaaaaaaaaaaggaagaaaagaaaaaaaggaaacagaattgacaatattaatattaggcagattagaaattcaagtttaaaatattaaaaagaatgcattgtcaatttataccattgcaaagttcaatgtacctagaagatgcaataatcatgcaactttatgcactgaaaaacgttctatcaaagtatataaagcgaaagctattagaaatatagaagaatttaaaaacgcatagttgaagatactaacacactttagaagttcataaatcacaggcaaaaagtaaatgagaatatgaaatagataacagtaaacttgttatatataaataaatggcattttgtacacataaaatggaatatttaatttttcaacacccatggtacatttataaaaagttgttaattggccacaaagaaaaattccgataaagcccaaaaggcagaaatcacatagcccctgcttctctgaccatatggcaataaagctaaaatttacaataagaagccctgaaaaaaaatttggccacttggaaaatttaaaacactcttctgcataattcctttcatctactttgtttggatttttctaacgttcttctagtttcttgagatgagcacttaatttattttctttctttcttgttttttgtataaaggaattagaaaaaaaatggtgactagcattgtctgatattttctcaaaatggattcctgaaatgtggaagtgttgactcataggatatgatggttttaagactctgggcacatagtgatagttttctgaatagggcatagtagatccttcaccaggggatgagagtacctgtctcaatatgctacttgagtgtggtcactaaaaaatgaccaagtagcaacaaaacagctttctcatattgttttcatttgcatctgtttgattagtaacagttgagcttttgaaatatgtttattctcagaaatgtttattcaatccttcttcccaccattttctattgggatattagtgctttacttattgatttttaaataccctttatatattaagaatattagttcttggccatgtttgcaaacattttccccaccgttccttgccttttatattttttaatatataaaagtgattattttcacataatcagatctaccaatcttctgatatttcctctattatttttatggtaagagattccatccccataattattaaatagtaataattacagtaacagctaacatgtattgagggctgattatgtgtcaggcaataagctaagtcccttatttaatcacaaaaaccctacgaggtatgtattttttattgtcttcttacaattgagaaagaaactaaggaaagagatgaaatagtttgtccataaacactgaaccagtgatttaaatattcatccacatttcgttttagtttttatggtttacgtttttatatttaactctttaatcctgaaatttgtgaaatggtgtgaagcgaagctcctttcaaacattagtttttccctgaccttcaaatgaataaatcatttttctccccagttgtttagtatgcttcctctattataaattaaattttaatacataacaaggtctctttcagggatatctattctgtttttattgacctatacattcttacacaagtgccacaatgttttaattgctgtacttttttttttttttttagatggaattttgctcgtatcgcccaagctggagtgcgtggcgcgatctcagcacactgcaacctctgcttcccaggttcaagtgattctcctgcctctgcctcccaagtagctgggattacaggtgccaccatgcccggctaatttttgtatttttagtagagggggtttcaccaggctggtctttaacccctgacctcaggtggtccacctgcctcagcctcctaaagctctaggattacaggcgtgagccaccacacccagcctaattgctgtatctttattatcaactttaatatgtacaagagcaaggctcacttcatcattcttctctttaaaaaacattctgaggccgagcgcagtggctcacgcctgtaatgccagcattttgggaggcagaggcaggtggataacagttcaagaccagcctggccaacatggcgaaaccccatctctactaataatacaaaaattagctgggcttggtggcacatgcatgtaatcccagctacttgggaggctgaggcaggagaattgcttgaacctgggaggcatagctttcagtgagccgagattgtgccactgcactccagcctgggtgacaaagtaatactctgtctcaaaaaaaaaaaaccaaaaaaaaaaaaccaaaaaacaattctgagagttcttggctttcagtcatggtggagtagcttgtattagaataatactcccatatggcaacaacaaaaataaattttggacactatacatatatatatatatatatatatatatatatatattttttttttttttttttttttttttttttttttttttttttttttttggacagagtctcgctctgtcacccaggctggagtccagtggcgcaatctcggctcactgcaagctccgcctcctgagttgggagggttcacgccattctcctgcctcagcctcctgagtagctgggactacaggtacctgccaccatgcccggctaattttttgtattttttttagtagagacggtttcaccgtgttagccaggatggtcttgatctcctgacctggtgatctgctatacccagcctggacacagtattttaaaaatatagtttgaaggtactggagagccaccaaaagcaagcagaaattggagtgaatttgattcttgaaagaaagaccccacccaggggagccacctttataaggctttttccttgaggtattccccaatccatcaggtgctagcaaatagaactcaagcagaaagctgtgtcatattggtttgaggaatcaggggatattttgagactgtgtgtcgggaaattgaagatggcaatcatagaaaggagagaaccatgctggggatcaccccgaagtacatataaacacccctcacatgctagactaactgctgaactgcccatgcacaggggaagtgccacagattccagcagagatttcagtagctgcctgctgtgggagagagagaatttggaggtggagtcttgtcaagttagaggcgattcgataaacaccttggactttgctttgaaatcccagaagggctaccccttaggggcaaatactactccccagggctatggcattttccctaggactaagggcaaaacaaaaataaagcataaaattgtgcctacaccagatctacaggtgatttaactgtctactagaaaaaactgaattctgcagaagaaaacagaatccagagcctctacaaactatcaccttcaacatccagtataaaattaaaaaactactagatgtgagaagaaacaggaccctgtgacccttactgaaatgaaaactcagttaatagaaacaaattcacaggtgaacagtaactttaactatgaacaaatatgttaaaagaatttacatgaaaaaaatgggagaaagggtaaagaggtgaggagttgcagtggagataaggaagttgtgaaaaagaaccaaatgtaaatcttagaactgaaaaacacaaaacctgacactgaaatttccctgggtgagagacacagcagattgggcataacagaaggaagcatcagtgaacctgaagacaggtaaacagaaatcatccaaactgaagtatggagaggaaaaatagctggaataaaaataggaccagagccttaatgacctgcaggacaaaaatcaagctgtctaacatagggtgacagcagtactcccaaaaagcagagaaggatgaggcagaaaaagtatttgaagcaatattggctgagaaatttccaattttgattaaagtaaccccacacaaacagcagcccaggaagtgtggccaattacaagtaggataaataacaaagaaaattgcatcgaggtgtatcacagtgaaactgctaatattaaataaaaagggaacaatgatgagaattatggctgactcataatcagagacagtgtagcacacgggacaatggaatgatgttttcaaaatggcgaaagaaaaaagacactttatctagaattctctgtacagtgaaaataccactaaacatgaaggaaaaaaataaagacattataagataaaagctgagagaaattgtcaccagcagacatgcattgaataaatatctgtgtgagatcttcccattgaagaggagataatactgttacaagaaagagaaatctgttagggaagaggtcccaatccagaccctaagagagggttcttggatctcacacaagaaagaattctgggcgagtctgcggtgcaaagtgaaagcaaggttattaacaaagtaaaggaataaaagaatggctactccacagacagagcagccctgggagctgctggttgcccatttttatggttatttcttgatgagatgccagacggggtggattattcatgcttcccccttttagactatagaggttaacttcccgatgttgccatggcgtctgtaaactgccatggcactggtgggagtgtagcagtgaggacaaccagatgttactctcatggccattttggttttggtgggttttggccagctcctttactgcaacctgtcttatcagcaaggtctttatgacctgtattttgtgccgactttctgtctcaccctgtgacttagaatgcctcagctgtttggaaatgcatcccagtaggtttcagcctcattttacccagctcctactcaagatggagttgttctggttcacatgcctctgacaatactagatggaaatttgggtcttcaggaagggataaagagccgtgggaatgttaaatacataggaaaatatacaatactattttattttaattcttcagttctgtaaaagtcagttgactaaagcaataacaataatgtagtgttagatttatagtatactcatatatttatatgtaatgaacattttacaacaagagcacaaaggacagaaggggtgtaaatggaattaagactctttttcttttttttgagataggatctcactctgtcacccaggctggcatgcagtggcaccatctcaactcactgcaacttctgcctcccaggttcaagcgattctcctgccttggcctcccgggtagctgggattacaggtgcatgctacctcgcctggttaatttttgtatttttagtagagacagagtttcaccatgttgcccaggctggtctcgaactcctgagctcaggtgatccacctgccttgacctttcaaagtgttggggttacaggcgtgagccactgcacccaaacaggcgtgagccactgcacccggccaagattcttaataaaatgtattatcaatataaacaataatacagtatagtacatacaattatatgtatcatattaaagttcttaatatgtaacatggtgtaatattaattcagagtagactgataagaatgtatattgtaatccctagagggaccacttaaaaaaaaatactaagaaatatttaaatatccagaagaggatactgaatggactaccgaacattcctagctgttcttttttttttcagtgcattatttttattatatttttattcatcaagttcatatgctgcttatatatgccaggcattgatctataaaagtagtaccttatttaatctttataacaactttattcccattttacagatgaaggacctgactcatagctattaagtgtcagagccaggattaaaacataagccacctttttttctaatttttgcttttaaccactatgttatgcttctagtggaggaagcagctgacacataaattaacaaataagtgtcctattgatatgagcgacaaaggaaaagaacagtcttctctgtctcaggaagggttcaaccagagaagcagaaccaatgggaaatagtatgctgttgccacgtctgaggctggagcttgaagtctacatggcaggtagtcagaaaaggaaaattaagagcagtctggaatcccatgagggcagaatgaaacctgtttccattcttgttgcctctgaccttggtgttaaacgaggatctttgttatcctttttttttttttttttttgagacagagtctggctctgtcgcccaggctggagtgcagtggtgcaatctcggctcactgcaacctgtgtctcctggtttcaagcaattctctgtctcagcctcccgagtagttgggattacaggcgcccgccaccataccctgctcatttttgtatttttagtagagacaggatttcaccatcttggccaggctgatcttgaactcctgaccttatgatccacccaccttggcctcccaaagtgctgggattacaggcgtgagccaccgtgcctggctaatccttgttattcttatttgtgcattctcccagataagcttgaggaacatctgagataatttaaaataattgggattttttaattgaaattgtgttaaacttataaaataatttataagtttataataatttatattttatttaatttataatttataaatttataataatttataaaataaaaataaaataatttgaaaggctttttcgtttgtctccctttatttctctttgcaacatttctttatactgatctaacattttgtaagactatagtaattttatatttctcatggctattatgaaaggaatttctcttcattttattttttaattattgctggtacataggagtgctactgatttttaattttatgtactatatcttgccatcccactttctcatgattaaattaaattttataggtatatggtcaattgattattttgtaaacttgtctctagttcatagacattttaattttatttcctgctttattacataggatgaaactccaagaataatgttaaatgttaatgatgacagtgataatgagttttatgataaacagctttttttttttaagaggggaaaaaagggattatcatgaagtactacaaatatatcttacagctattgaaaatctgcaattcatgaagcaccagtgtgctttattcacatttattcacacattgaacaattatttggtgaatgaccactatgggttgatcagtattttaggttttggggatacagtaatgaataaggcagagaataaaagttcaacaccattaaaatcctcagaaaaccatataagataaaagaaaggttacaaagccatctatgtttgacaaccagaggagtattgtctagatagtaattgctgtagaaaagtacttctacctagggtgatcacagaggagctttggtgatggaagagataacccggaacaactgacaagctcagagtagggttgggaagaagctactctgatggctggaacatcaggggtggaagactgatgcctgactctctccagagtataaggcatatcaggggctgatgaataaactagtttgctttatttagtacagggtgaatatatggtaacaggcattttgttttgtttggtttggtttggttttgagatggagtctcactctgtagcccaggctggagtgcaatggcacgatctcagctcactgtgacctccgcctcccggattcaatcaattctgccaccccagcctcctgagtagctgggattacaggcgcctgccaccacacctggctaatttctatatttttattagggacgggggtttcaccatgttggccaggctggtcttgaactccttgacctcaagtgatctgtccctcctcggcctcccaaagtgctgggattacagccatgagccaccatacctggcctggtaacggtttttatacttacctctggggattcttggagattctgaggagatatttcaggggcaaagagggaatcaagaaggtgggactctgatttttctccgtacccctccggacctctcaaaacctgaacattacttttgtctgttttacatattggggtttccgtttatttattctttctacactttttttttttttgagatagagtcttgttttgtcacccaggctggagtgcagtggtgcagtcatggctcactgcagccttgacctcctgggctcaagcagtcctcctgcttcagcctccctagtagctgagactacaaatatacaccattgcacccagctttttttttttttttttttaaaaaggtgaggttgcactatgttgtccaggctggtcttgaactcctgtactcaagtgatcctcctgcctcagcctcccaaagtgctgagattacaggtattagctaccacgcctggctttttacacatttttattgaatacctactaggtgccagtagaacctaggtgttttaggtactaggaacatagcagtgaataaaataaccccaaatgcaatggtagagtgggagggagaagacagtaaatagaataaaatataaacatgagtaagagcaatagaggattcttcttaggaatttgctattttaaatgggatggtttggaaaggcccctctaagataacattttgagcaaaaacttgaagaaaacgaggaagcaaaccatgcagatttctgggtagaaagagtttcaggaaaagggaatgaccgatgcagaagcttgaagaggaagttgtgtctggcaaattccaggaacaagaatggtaggccaggtggatagcagtgagacacgaggtcacagcattcacagggagtaaggttgtgtagggcaacagtatcttggtaaggactttggttttattttgagtaaaatggaaaatcatcagagtgttttaagcaaggagttataccatctgatgtaaggtttaataggatcaccagggtggaagctgggagactagtctagtgttgagatgtgatcagattccctggatatttttttggaagtaaatccaatagaatagcctgatttgtgggatctggatatgaaagagaagtagaaattaaggatgactccaaggtttttggccttgtgtgactacaagtttggagttgtcattaactaggaatggagcagtttggtggggcaagattaggagttcagtgttagacgtattaagtttgagatatcagacatccaagtggaggtatcaggtgggcagagggatattatgaatcaagttcagaggaaagatctgagctacagatataaatgtaacattgttaacttcttgattttgataattattctgtggttatatacaagcatgagcttccccgactcccaccccaaattaagacatgcttactgaaatatttaaggggtagggtgtgatgtctgtaacttagtctcaaacagttcagggaaagtaatcatatagacagatcaatagagaataataaagcgagtgtgatgaatttaacatttaaagaacctgggtgaaagatatatgagaattctttgtactatgctttcagcagcttttctgtaaatcagaaattatttcataacagaatgtcttttaaaagtgaaggaaaatacagacatttccaggcaaacaaaaagagaaaattcatcaccagcacactgtactgaaagaaacactaaaggagttttcaggcagagagaaaatgatcttacatggaaacatagaaatggcaggaaagaatgaaggacaaacaaaaggacacatatcaacgaatattgactgtgtaaaataagaatgtctttcttgtggattttaacatacattataattgaaatgcatgccagtacacaaaaggaggggtggagggaaagttatatgtgcgaggatctttgggggaacagtaaaatttctcatttatatcacactatagtaagtaaaggatatattgtgatgtctagggcgttggttcgcaagtgttttagtctcaggacccctttcacccttaattgaggatctcccattaggcaaacatccagtaattactgttgcagacaaattccattgacgggtgctaaaatgagatgaaggtttcaagagaaagagcaaagtgtcttttccgagctatttattaactctgaaagaaaagatagtaactttgcagtagagaaatccatcagaaaccaccttgactacaaggtaatagagagaaaaactgaattaaaaagaagacaggagagaaaagagagcactaaacaggtcaaaaggaaaacaaattgtaatatgaaagatataaacccccaaagttcagcatttacattaaatataaatggagtaaatactccattaaaagcagttggtcaagattagatttaaaagactcaatgctgcttgcatcagacacacctttagtataaagatatttaaggattaaatgtcaagtgatggaaaaagatacaccatgcaaacactaaccacaagaaactcggtagtaataccagacaaggtggtcttaaaagtagaatcagaaggccaggcgtggtggctcacacctataatcccagcacttcgggaggccgaggtgagcagatcacctgaggtcaggagttcaagaccagcctggccaacatggcgaaaccctgtctctatgcagtggtgcatgcctgtaatcccagctactccggagtctgaggcaggagaattgcttgaatctgggagacaaagattgcggtgagtggagatcacgccactgcactctagcctgggcgacagagcgagactccgtctcaaaacaaataaaaaaaagtgagtcagagatagaaaaatttcagaataataaaatggtcaatcaccaacaagatgaacatttcaaaatagttacacacctaacaaacatagcttcaatatacgtaaagcaaaactggacagacctgaaaggaggactagacaaatctatcataatgggacgtttcaaaacttctttcaaaacttctttctccatgtttggtagtacaaacagacaaagcaatccagattctaacaacacaatgaacaaacttgccttattacgtagaacgctgtactcaatgaagatgataaacaaacaaaaagtattcagtctcggtcgttgtcagagaaatgcaaattgcaatcagaatgtgctatccttcacacccaccagaatgactaaaatggaaaagactgagaactttgctgctgggtgtgggacagctagagctcttctactctgctggtgggagtgtgaattgctgtgaccattttggacattgttggcagtatctgttaaagctgagaagatgtgcactctataatcgagcatttcccctaaaaaaatacatattaagaatgttgatagcagcattattcatagatggtccaaaactagaaatacattcttttactgtataagactacaatacaacaatttgaatgaactgtggctatgtgtaacaacaaggatgactcgcaagcataatgttgaacaaaaggagccgtttacctttttttttttttttttttttttttttttgagacggagtctcgctctgttgcccaggctggagtgcagtggcgtgatctctgctcactgcaagctccacctcctgggttcacgccattctcctgcctcagcctcccgagtagctgggactacaggtgcccaccaccatgcccagctaattttttttgtatttttagtagagacggggtttcaccatgttagccaggatggtctcaatcttctgacctcatgatccaccgcctcggcctcccaaagtgctgggattacaggtgtgaatgctttccgtattatcccacatatataaaattcaaaagcaagcaaactgaatctgtggtattagaagttaggtggtgactgggaggagacaagggatgttgctagaggctgttactctattttttgatctggatggtagttacataagtgtgttcaccgtgggaaaattcattaagctgtacacttaaaaatgtgcatgcttttctgtatatattcaatgccaacaaaagtttccttaaaattataatgaggctgtgtgtggtggctcacgcctgtaatcccagcactttgggaggccgaggcagatggatcacgtgaagccaggagtttgagaccagcctggccaacatagtgaaaccctgtatctacaaaaatacaaaaattagcagggctggtggcacactcctgtaatcccagcttctcggtaggctgaggcacgagaattgcttgaacctgggaggcggaggttacagtgagccgagatggcaccagcctgagtgacagagtgagattctgtctcaaataaataaataaataaaataacgagacaattttttaacctttcagaatggcaaagataaaaagcttaatagcatcatgtaggcaaggttgagggaatgtgagtggaaacaacctggaagaaggtttgacaggtcttattaaaattaaaactgcacacatctgagtctattcctagggatatagtttacacatgtacaagtggtatattcaaggtcctttattatggctttgtttgtagcagtaaaggttcagtaggggatgttaaataaattatagtacatccataccaaccatatagccattaaatagaatgagagagctctgtagatactaatatggagtatcctccaagataacctaattaaaaatagcaaggtatagaacagcatgtatagcgtgctatcattgtataaaaatatacggacacacatatgtatacacacatgtgctttttttttttttttttttttttttaaaaaaaaaagagatggagtcttggccaggcacagtggctcatgcctgcaatcctagcactttgggaggccgagcgagtagatcacgaggtcaggagttcaagaccagcctggccaagatagtgaaaccccatctctactaaaaatacgaaaaaattagctgggcgtggtggtgcctgtaatcccagctactcgggaggctgaggtagagaattgcttgaacccaggaggctaaggttgcagtgagccgagattgcaccacagcgctccagcctgggtgacagagcgagactccgtctcaaaaaaaaaaagacatggagtctcactatgttgcctagatttgaaatcctggactcaagcaatcctcttgcctcatcctcccaagcagctgggattataggtgtccaccactgtgcccagctacatgtatgctttttatataagaagctttagcaatagttgcccctggaggatgtaacagggtggcaggagtgggaaggagactgatttttcacgataaagtggaccccctttatccatagttctgcctcttatgctttcaggtacccgaggccaaccaaagtccaaaaatgtttaaatggaaaattccagaaataaatgattcataagttttaaattgtgtgccattctgagtagcttgatgaaacctcctgctgtcctacctgagatgtggatcatccctttgtccagcttatccatgctgtggacgcctccacctggcagtcacttagtagccctcatggtgatcagatcgatggtcatggtatccaagtgcttgtgttcaagtaagctctatgttacttaatagtgaccccacgtgcaagagtagtgatgctggcaattcagatatgtcaaagagaagccgtaaagtgcttcctttaagtgaaacagagaatgctcttgacttaataaggaaagaaaaaaaatcatatgctgaggttgctaaaatctattgtaagaacaaatctatccatgaaattgtgaaagaggaaaaaaaatttgtgcatagaatgtacagaattttgtattatctgtggtttcaggcattcgctgagtgtcttggaatgaatccccccacagataagggtgggctactgtatacccttttatatctttagaattttatacagtgcaaatattttttaaacattaattttaaaaataattgttaaaagtcccttagaaagatgttctctcagtaagttcagtagagcccacattttccgtcacactgaaacagatctttggtttaataccagacgacatagtctgcattgcatgtgagtgccaagctgtgtgggggaaaatagcctgtgacatggtgctcagattgcaagggtatatgggaatgaggtgatgagggcacagcgggttcaaacatccggtcttgtgctcactggaagatgcaacacttgtggagtgaaatggtgagcccatccccaccccaaccgggtgtagtgtaatttccctctctctccccttctgagcaagtgtaagttgaattcagagtgtaagttgaattcaagtctcaaacctcctgggctcaagcaatccccacctcagcctcccaagtagctggcactacaggtgtgcaccaccatgcccagctaatttttgtagttttgtttgtttgtttgtttgtttgtttgtttgtagagatgggggtctcactatgttgcccaggctggtctcaaactcctgggctcaagcagtctgcccgccttggcctcccaaagtgttggaattacaggcatgagccactgagcctggctttctacataagtcttttactacattattttattatttcttagaagcaaaatgattgagtcaaaggtatgaacatttttaaaactcttgcgatagagtgctgaagtgacttccaaagtttctcagtttgctcttccacagcaccctcactggcattgggcatcctcttgtttaaaagcagtttttaatttgaaaaactccagtcttaataactttgccaatacatctgaatgataggctggaagtcagagatgtcagtgttacctttcagcttgaatgggatttggaatattccacccccgccccatgctgtatagagagtagtgctgaggagcctgggcctggggtccgagcctggccctccaccctgcagcagtgagatctcagataggccggttcatgtctgtgagcctcaggctcttcccctgtaaatggggagaatcaagtgtctacttctggcactgctcggaggtgccacaaaaccgtgagcctgcaaacagaaccgtgagcctgcaaacaaaaccgtgagcctgcaaaccgtgagtcgtgcccctcggcaggcctgcacagggttagcgtggagctcaaagagttaaagatgtaaagaactaaaatgctctgctacacgtgggtttaatacacttggctgttattttgagtgaggggtggaaatatgaatgatttcttttttgttttttgtgtgcttttctttattttccatgttttctgcagttgacattttgttatcaatatataatctatattattctatatactatacctattatacattacagatagagaaacagacaaaactcattcaacgtaagaaactggggggtaggggtcctagggaggctcccatttaacaggtagggaaaatgagatcttgcactctcacattgcctagcagtaaataagcactcaaatatttatggatttggttgagtgctacatatttatctcaatactaataatgttgacagtagcaaccaataccagattcatttgagctacacagctaggtggtgacaaagtaatttatgtattgacctattaggacatagcatgttttcatgtgttaatatcagattaatgtgaggacttgcaagaacatctgatgcctgcatggcagcttaaatctttaggaagtaagctgaatgccaaataatagaccttctgatcacatatttaagattcaagatgcagaagaaaaccccaaaggaacatttatagcattcagctgggtgactaaagagtgtgccctagtgcaccaaactcttgtgacaagattttcttaaaggaacaaaaaatctccaccttgatttgtgtcttatagtggagttgtttcccaaatcaggctgtttcaaagaacatatgagacggcgtatggctagccctcccatcccaaagcaaatgtttgttttgttgcaatgatggaaacatttccattggtgaagcaaatatttagagctgaaagaaacatttgggcagccaggatgtgtcaaaacagaacagatgtctgccttttaaaaacacattaaaaaaaagccaccttgtacttggctgctgtggtcgcagccacagtgggttaagcaagaagttagaaattgtgggtgtctttctgttataatcctagctcctagacttggcttgtatcttcttctgtcttggtttttctcttccagaaaacggggtgaaccattgtgatcttgttaaggatcaagtctggttggtttgttttccccaaatattttctttgttcttaaatttatttatttgaatcagaaatctattcacagggaacaaaattcataaggctaggcagtgaaaagtgttcctcaatctctgttccccagcaactagtcctctctataaccagtgttaccagtttcctgtcctccttttctttcaggtatacacactgtgtgtgtgtgtgtgtgtgtgtgtgtgtgtgtgtgtgtgtggacttctctgtacccttcacctagttttcccccatgctcctgatgttctctttggctttcttctttcgggggtgttaattctgagagtttgcttatttaaaatatgcagactctgtcaagtggcagagggcagtaggtatgtcaggctgcccatgctccccgccccctgcccctgcctagcacagagagccccgtgtgggaatccaattctggggctcacatgggctgtgggcaagtccatgcccctctctctgtccctttttcttgatctataaaacagaaggaaaaaagaaaaagaacaggagagaggtcagataaactccaatttttcttgcagttctgaatttctttgtttggttgtcaaaggcaagttgattcctttttttaaaccacccttcatgacctcttctgaaaacaggagcaagatttaagtatcactaaaagtgtttatcaatttgacttttccatgcatgcacaaacacacgtttggcttacttggcatttaagtagcagagattcctgattacccttcccttggtctttagggacacagtttcttccctaggacttactcagtatactgtgggaagggctgacttttctacctgttgccaaagacctgctgtctgtggcagccgcaacgatatttgtcctgctattaatcctctggaatcgatcaaatatcaaaaataacttctctttgtttttgtttctaatttagcagagagggattaaaagaaaaaaaaaacctttagattatatagatctaaaaatagacatcatggatgctgattggaaaccctcccagtcgttcatatgagagatctcaatttgtgttacatagaggggcagctcacttctgtcttgttcgccagttatactactccccagagaagctcaataaattttataggaaagtttcctccttatgtggaaggagctaagctcaatgactggtgtgtctgatataatttagggctccaagggagtacgtctgccttgtggaataacctatcaaaagtaaatgtacagaaactttcgatcttggttgatttggctatgtcattgaaactgctcagcactggaccccgtgaacccagcctgtctgctttggaattaaactgctcccccaaactcacattcgattcactgttaaagcggccttttgtgtgtctcactggtagtggcttctgggctcgcctgctgttgttccacggtttccaccgctggccctttgaaacctccaaacttggacgtggttgagtttttacatccctctttgcctcttctgttgacattaggaaagcagacctgccttctctttaggcttcgagtggaacaagcctgccagtttcctcagtctttcagctagcagtgaaatacattttgcactggcttttttactcagtgatttacactgggagacgtggctgggtgatgtccagtgtccttttgtctttgtgtttatttttcttccacatttaatgtatttaaaggatatattgtctttatggttcactgggataaggagggattggtgcaagttttaatgagaggtgccccagctctctgtgttgagctgagaattatcttcttggttagatatctttctttctttccttaggtggcaggaggcagtgttttgctgctttttgaaataatgtttctgcctaacgatttctagaaggataccgagaggacattcagcttcagggcatcatcagcaactttttctcctgttgtttgaacttccctcatttaaggagaggggaaagtctcaggtcttgttcttgaatttacatatcaatattaagatgatgggaaacagccccctgccactccccatcatctgatcaattcttataaaaactcttgcattcagggtagtgacatgtggaactagttttctcagaaactgttttcactgcttgggaatagttaatcagtggaggaaaaagtgtttgacttatctgcttaatattttaaccaagtgaattagacaggttggggggctgggggaggggataagaaagtgggtgggggaggccccataaacaaggtgatatataatattttttttgttctccttttaaataaataccgatcagctttatgttcagagacaatagaagccgttggcttaaatttgcagtttactgtatttatggctgtaatatcaaggtgctgccgtcgtaatttcatgccccaatgagaagagcaaggtcgaagcaaatgcttccatcggcatctgctaacacactaactcataaacaaggcccggctggatcaggtggcacggaataatacaggctaatgaaatacagcacagctttccattactgttagtttttacagtgtcgtcattacgtgtaatttatgtttaaaaaattcaattttatacaaggcactgggaaataggggtctccaggtcatcctacgacttttagaggctctgagagtccttattgtactctactgttccaacaaaatgttcataaaataaaataaaaatacttttccccttcccctccctgaaccttttctgagagagttgatttttttcttttaatttgggaagtatttttagccagctgtcttctctgcctcatctcctcccagagtgtgccggggcagataacttagttgttctgagagaggtgaccccctctcagtgtccatgagtcccagatgaattggccaagtcctagaaatagaggggctgcagagcggggaggaagaggtcccaatgaccagcccttgactgccaccgtttgtcactggccccctggccctgttcccgtgatcccagtcagatgccacatttttataataaaactagggctgagcaggaaggcgctggcaggagttcattaccttgcttattttcaaactcttcctaacccttctgtcctggttgttgtttgacctgaaagatgaagagaacactgctgtcttctgtcatctgtctttctgcttcacctgcacagggccaagccccgtggcagtgcccagcggtcactggggacagtgctgaggttacttatcctgagaaacccttgcacggcctgtcccgcagagaaaagacagcccttccgggtccctggtttggtctgagtcgtgggaaaggaccctagggcatcacaatcgcagcctgtaccctgcagctcacagagtcaatcagtttggttttatttgcatttgaacagaaaccttgagaaaaagaaagccaatttgtttatcttctaggggataaaaataggcaagtgtggcagccctgtggccacgcaggtcagacactgcagcagtgacactggggttttattaatcaataggatgtagctcacttgttctgtccttttaaaaaaaaaagcccaccctggagaagagatgcttggcccagctcctacacaagggcagcagtcatctccggtccagggagctcttctggaggtttttgcaagtagattctagagaactgagagaacaagaagtcttccccactctgggcacatggaatcttcattcaaagagtttggtttgaattgagagctctcagttttgcatatcaggtaactatgatgtgaaaagatgaagcggcctctttacctctcagagtcagcccagaccctcttcgcctcccctcctctcagagaagctccctcgtccctttctcctccttttgactagagctagtgggtggagagagtaactgaacgggaatttcttagtgttattctctatcaataatatattttaattgtcagtgctatagactgggtggctgggggttgggagctggtggctcttgaaaatcaccaagtggcagaaaggaagttataggaagaacataaaggcttagtgccagtggtgtcaggtaatgcatattgatacctcaactaaaagaacatttggggctttattaaaattgactaattcttccaaagatagcagctaaaggaggacttagatgaatagaggagggaggaggcttgcaggacggtgaagccctttgcttccagctctctgcctgctcagccattgctccgtccctctgcagttagattattccttgcagatagcaatcaactggaaggaagtgtctgtgtctaatttgcatgagattatttaaaacaacaacaaaaaaaaggtctgcattagtcagggtgatggtaaacaacgcaaagaagatgccttttataatctagcctgtgcctcagctttcagagccaaatataattcacttacaattggcagtttcctttattattccttttaaccttttggattctgcaaggtctcaatctaagatcagcagtttgtcttggcagtagtgggaaagatggggctagggcaccgggatgtcctatgttggctccatggcagcactttgaccctgaaggcagggtcatcacagcaccaagagccaatgactgggcagataactagttgtgatctggagacaggtgggtgttcccactcagtctccctaagttccaaatgaatcacctgagtcctgtaaatgcagtcttaaagctggccagttctgcctaaggtggggacattccagaggaagatgacactcaaggaagcctatgacaggcatttggacttgatttcgggttagaatattagaacgagaacaagatgaggacattctacctttttctctctagtattgttcaaaaagttgtccaggcgtcatttacagataggagccaggggttaagttcctgtattgtttcaatgtagccccaaaacaatattcactggctccttcctgtagatgagagtggcggggtagggagaagaaaatgtagtccttctcccaagctctttaacaagtctgaagacctaggacatagtttgagtctgccatttgatgttttgtaactctggtgtagtggagagtcactgggctgaagagggagagccttgagtgcccatcacatcaccactctctacaagtaggatgtggggcatcgtttctaccctccttgggcctcaggtttcttatctgttaaatgagggcagtgactgggataatggcccggctctgaatgtgattcagtgagattgttaaaacgcttacttttaaaaagaagagaaaggattcatttactgtaactaaatcaaaatcctgcctctcccagagaaccagggatatcagaatttcagccaatataaattttgagcctcaaatgataacgtctgtgaaaaacaagagcttggaaggaagtactgatgccctttcaactgtggcctcactagtgggctcggctgcgataatgcaaggaacatgttttattaggaaaataggcttcataaaagctcagggccagagggcagaactgcgggcagggcgtcctgtccctttaaccagctccggccctcagggccacagcacagtctgtaacttactgtatatttccccagtgttaaacattattgtacttgtttatatttgaaagagccaaaagggaaaatgagaatgcaactgaatgctccttttgggaaaattatcttcatttgcagccagcggctgacaaggcacacgaaccaccaggtttataaaattccgtagtgtaccagtgaccatcagcctgtgctgacatcgcagatgctgctttcttctctaatggctgattatgaactggttaaaacaatgtctttcccaccagggctccgaaaggggttccccttcctgtttagtcggagcgatcggcagtcactacacaggctggaacctgagaggcacaaactcagggcgggggtattctctgttgttgcctggcttgcctgttggtcctgtccctgttcttcttggaaggtgaaattatgggtaaagcagtccctttgcagcaagcaccccctctctagctccactctactgaccttcagcttttgtctttggaaggtggtacgtgatgcgctgtgaaccctggaagcattttcatccagcccaccaatctgttgagagcatggtgctatcagggcaacccggtggctcttcagacttcccagtggtgaggctgtgcctgcccttggccagctccactgtgtgaagagggtaaagaggggaacagctgcagttttaaatggggatagtcctcaactcctcagcacagagaagggaaaaaagagtccagggctgtttagaaaagttcgggcattttcctttgactagctgtggtagggcatgaaaagtttgaggggtggctgcagtcaactcatatgccagtatggtgcagggcggagctgtgctttaaagcattaatgtgcaccatctattagcccctaggcatggagtatgaggcaccatccttttgaagatgctgatcctcagaacctccttgtacttcatctacccccaggggcaaatataccatgctgtgggcctctaatggagagctgccgaccagatgtggaaaagctctcggctgtagtttaaaagctctgtgttgcggctcgcttggatgttgggattcctggaacagcaagggctggccgagtggtcttttgcagactaacagtgacctcccacctgcttttcccactctcagcagctggagtgcctttgtacacacagctacttcctgagctggccccgtgtgaccgctcctttcatacttgagcgccacatttcattctgttctttgggttggatggggctctcttcctcctcccaagagtcagtgtcccaaattggctcagacccggtggaaatatcccagctgtgtccccactggaaatgcggccttcatgggttttcatttgccttttattcttctgtgggcaaatcctctccacatggcatagccactgcagatggcgccctgccacttcctgatgtcccatgtatggtgtggtttagagtgtcgggaggatttcaagaagggaaaagaaaaactagccaaaggcgatacaggcagcgtgtgataggctagaataataatcatctgaaagtttgggcctggccttgttttgatctgttttcttgttttattttcttctttacattctatatcccattcatactaatcacagtcagtcctgatttttctttttatttctgcatttgtcataaaataaagcaaattattcccgtcttcagaaacgatctagactaattagtcgtctcacccaataattagttttttgtttccctgtctgttttcgtgcattattgttagttttttcccctcttttttttttaacaccattacagattaaaatgagccacatttgcagttgatggtatctgttttcgggggaagaatggagaattgcagtaccgagcgacttcaaaagcagcaataaactcaaggataaattaaggaaattgaatgagccacatttggaagcagtgttgaggctaatattctgtcgcttaaggttaaattgcaactgagagaggttccggagaatctgaaatcggggaggcaacttactaggatgcgaggcattctgtggctgtaaaggtctttgctcagtgaagattctgttgcagctatggacactgacaaaaggtactcacctgcaatgatgtcctcttctccccagggctgacagatgaagagattgatatggccttccagcagtcgggcactgctgccgatgagccttcgtccttgggcccagccacacaggtggttcctgtccagccccctcacctcatatctcagccatacagtaagtcacccgctcaaactcctgcttaaccttgattgggattcaggactctggccaaagggcagtgttctgtatctcccagacttagcaaaccaggagaaactgggagcagcagaaagctcttgggtttttcccaaggaatgtgacacaccccagtcttctagacaaactttttaaagtatgtgacaaaggtttaagaagagacaagggatcagaataaatgattttattgttgtttcaggtattttggttacatgcagaaaacctgtacaactatttattgattctgttcccatctcctcataccagtgcttttgaatgttactgtttcactaaaaacagcgtgaccatctgactcatgggtgcattcttgtttgctcactgcaataacctgtctcccacttctatttttttaagttaatatttgtaagtttaggtcagcctccatttccctccctcccttgtcctggctatactttgtacgtttatgtagtagcggtctgttagggaatttcaggttaaaacatgaagttcctttttgaatgtttcttttaattatacgagatcatgacccatgaggggtctttcgttgtcttaaatgaaagctactataggaataaagtttcttcaaacaagttataaatgcatacctccaaaatgcagccagaagccctccttgaaatcacttataaaaagtttaaaaaggctaaaattgactacaaagttatggaaaatagctccattttgtttctttaatgaaactcagcattgggccgggcacgttggctcacgcctctaatccctgcactttgggaggctgaggcgggtggatcacctgaggtcaggagttcgagaccagcccggccaacatgatgaaaccctgtctctactaaaaatacaaaaaattagccagatgtggtggcaggcgcctgtaatccctgctactcaggaggctgaggaaggagaattgcttgaacccgggaggtggaggttgcagtgagccgagatcgtgccactgcactccagactgggcaacaagagcgaaactctgcctcaaaaaaacaaacaggcagggtgcagtggctcacatctgtaatcccaacactttgagaggccaaggcaggcggatcacttgaggtcaggagttcgagaccagcctggccaacgtggtgaaaccgtgtctctactaaaaatacaaaaaattagccgggcgtggtggcacacgcctgtaatcccagctccttagggggctgaggcaggagaatcacttaaacccaggaggtggaagttgcagtgagccgagatcacgccgctgcactccagcctaggtgacagagtgagactctgtctcaaaaaaaataaaataaaataaagaaactcaatactggatctgtgatctctcaaaatgccttttctataattgttattctcagaagttttatttttgcaaaaaatgatttaaaactgttagatatcagattttaaggccgggcgcagtggctcccgcctgtaatcccagcactttgggaggccgaggcgggtggatcatgaggtcaggagttcgagaccaccctgggcaacaagagcaaaactccatctcaaaaaaacagacaggccgggcgcggtggctcacgcctgtaatcccagcactttgggaggccaaggcgggcggatcacttgaggtcaggagttggagaccagcctggccaatgtggcaaaaccctgtctctaataaaaatacaaaaattagctgggcatggtggcgggtgcttgtaatcccagctactcaggaggctgaggcaggagaatcgcttgaaccgaggaggtggaggttgcaatgagctgagatcatgccattgcactccagcttgggtgacaagagcaagactctgtctcaaaaaaaaaaaaaaaaaaaaaagtgttagatatcagattttaaaaggcatattttaaaatgacagattcgttttgatcccccagcacctggtctgaagctgccttctttccctcacctcagcactgttttcatccagctcagctgcagctaggcaggtgtgatcttggcagtagagccaaaaaggccttctcttctccggacttgctgaagggccagccagtgggttggaatctgctgtctgtgttacggatcttatttagagatctcctcctttggctgtccacagaaggctgaatgggggaggccagggagtgtgtgctcaagtgtgtcaatctgtcagtgccttgcatgggtgacccactgcaggttgcagagcttcagtggtgagccttgtcctgtatttgggctactgggttagcacctgtgacttgtcagcttggggctcctttctccttcctggccagcattttttccaatccattgtagttgctttgggtcctaagctgactttatgtgcttctttttaaccaaaggctgagtctccacactttttctttagttgtgtccctgggcccagccgtgtaatgggatttgttgaggataggcagcggcagctggggtgcagaattttctaagatgcacatctgttctgttccagctgtttcctccagtggcttaataccgaacaggtctctcggctacttggaaacttcttactcagaacaaattgttctggttgatcacagagttggcctaaaacatcatatgttcacctactttccatagacacaaagggttaaactgttagtctttctgaaagaggcaaaagaatggggtggggaggggcaattcagttatttaaatcatactcatgtccagatcgctctgagaaaaagcaatacacgttgaggtatttaggtaggaatatttttaagagccttccagcccctaaaaataaaatacacattcttagacacagacttcttcctgctttgacactagtgtaaaaacaatggtaatgataattttaaatacctgaagtttttagttgtcatcattgagcttcattcttctcataccgttacattgctcctctcactccgggggtgactctacctcttcacttctgtacttttgccaagaggtgtcaaaactgcttaaaaaaaaaaaaagcttgattttgattaatatagagaaacaagactttgcctgactgataataaaactgataaatgacatttgaattacttgtagcggtaatttattacataaaatatcttttatttgacatgcgattagttgctggaagcatcactcaatctgactagtttaaacatgctccaaaatgaaccccagtaaaaaccagggctgtctgctgctggcattatgaaatatactaatcctggagtgagggaaaaatctgactttaaatatttaaatgattaattgggtttatatatttttttacttttctaacccccttaattacaagcaaactcaggggagtttctgaactaggtgcacaatctgcatgcttatcactgaggcattgtctgcgtcgggagggatttatggcctctattcatgtgtgttcctgccgattttacatctagatccccggcagccttttccttcccatttcttggctttttacggacattccatctctgagcccaaggctagaaaatgggatcccctgggcctagccccaaacactcaggtctcagggtagggtagcttttccaagaccaccccagggagcccagtgctcttcacctttgaacctgctggcccacctgctcagtggcaggtgtgccactgagtgcctcttttggcatctctgttctttggtgaatgtggttgaccttgagatgttagcaaatgccagtgttggcagagagaacgtagagacctgcccaaatagtaacagttcaatttctcagtatttttattaaccatctactatacggtcagtactatatcatgcgagagatccaaaacctgatctttaagcatcttgctaagctctttgggaaagataagataaactcttaagaaaaggataataatataagatgttgtgatttaatgccaaaattaattatacagacaagaaattctgaaattctgaaatatagaaaagagaagaattaatgtgggctagagtcagggaaggcttttgtgaaagtgataggaggttggcaccaaggggaagcttggtgtcacctggtgtgagcataaaccagtgctctcgggggctagaagaaagttggtacagttcaggagaagtcaggctgtgattcgagagaagatttgaaattctccatttctcattttggtttcttgtctggctttacatcgggagtcagtgcatgtgtataggtgcaggcctagcccagtcctgagcagaggtctgataaatgctggttgattgattcacgccaagctgatttgtcttcgtcctcccagagagaccaagaagctttgagatataagcaggaccagtgtaaattttgtaggataataatttcttcttagatttgaacattttccctccactgtctttgataaacaatttaaaccccttcaaagactgacctagagcttcagttgcttcttctcaaaataggatgtcagcatctgaggccggtgaaaggttttgaaccatttgattagaaatcctgagagagagtgagttattcctctgtttatttcttttgtagccctgtgtagtaacacaaacttatctgtggttatcttaattcactgagcaagcattgttattgaatgcctactgtgtgccagacccctgggctaaagagactaacaagacctggtcgctctctctggttgctcccgtctggtaggaaagacggttaggccaacatagcagtgcctgtcaggtggtcccggtgaggacggtggcacagaagaggcgacgggaagcttcagagagcagatgtctaactggatgtggcgggctgcttggttcagtgatcagacaggatagacaagagcattccaggctaacacaaaagcatatagatgtgaaactgatgaatttaagaaactccaggttgttggacgtggcgcctgtaatcccaactctttgagaggctgagacaggaggagcactttgaagctaggagttcaagaccagcctgggcaacatagtgagatgccatctctgtaaaaaaatttaaaaaacaaaactagccaggcatggtggtgcgtgtacttgggaggctgaggtgggaggattgcttgagcccaggagatcgagtctgcagtgaaccatggttgtacccctgcactccagcctgggctccagagcaaggccctgcctctaaaaaaccaaaaagaaagaaactctgagttgttcagagtggctggagcatgggatgagagtcagaggaaatggctggagaaagggtggctctgtcagctccgacagaggacagccaaaagcacagtgatgttttactttgaaatgcatcatctaattatttttgtgccatacgacctatttggccattttattcttagattaatattaaaattatttgtatcatctcagcaggtgccatgaggttagttaggggagacatgggtgggggggcatcagccggaggccattgttcttgtgccgagcctgtagtgcctaccctgtgtgctcactgttgttctccatggttgggccagcactcgctcctccagggagtctttccagtgcctccattctgacttggagggaagctcccctcaggcccctagactccccaccccgccccactgcacttaaacatttattccagtgtctcccctattaaactgtgagttctgaggcttaaaaaaatctagtggcctgaggctctgactgagcaggtgttctagaaatgcttgtggaatggattaacaggggtggaaatgtgcttgagaatggaagggctatcatgtggacgagctgccctggtggtcggtcggtgatacggtctgtgagcccagctggtgcagactgctctgggcaagctatggaagaagtaggggatgggacccaccttcaggagctgctgttcatcgtagagggaagccctccattgcttggagaaagacagggaagaccatcccacgtcaccttgcatggtgagaatgttgagagctttcagaatttgagaacaaaggaaattcccagaacgctagtcttaggcaaggctttctagaaggggcaggacttgaactggctttgaagatcagtcagccataaggtagacccaaggtgtcaaggaagacatcactgtggagagggaacagcaaaggcccggggccagggtggcctgtgcgtaagtgatactgaggtgacagtaaacagaaagcatgcatgggtggcctcggggttcccgtcagaaagcaaaatagcaaatgtcgcctccacctctctctctgtctcttccatttctctctcatgcttccatttctttctctgctggtttagcagacaaatctctctttttgctacctgaaagttactggtttgtatatgaagaaagtatttctttaattttgaggaaattgtgttttcttttgtccgtggtgccggtttggattagcaagcaccctctccattttgttgctgtgtgttctgcctggtgtggtgccacatgggggctgaataaatgccattcgcggatgttgaagagggtaagtatcacgggaaggaaccgaaatgaagtgatcctttccttaggtttcttggaccattacaagtctttggtgttgatggcagttaggattctggctgtgctgacagtgtgttagttttagaaaattctgctacaggtgacagagaactccaaacaagagtggcttaaagagagaggaatttttctctattacataaatgtaggcagcccaggctgccaggaggctctgtggtctgcaggaaccctactctgcctcactgctctgcattcctgactggctctcatccgtctcgtggtgcagtgtgaatgcttcagctccaactatcccacctgctgtccagccagcgagagcggggagaaagcgggaaaagggcaggctgccttctaaggacacctcttggaaattgcccatgtcccttccactttctccccattggctggatcttgcatggctatccttgcctgcgagtgaggctgagatgtagtcctgatctcgtcagcacatgtcctcagctttccatatcccataggaggtttgagttctgataaatactgggtttaggataatggttgcctctgggctggggaggaacacatggctagcttcagtggtatttggaaagttctagctagtaaattaggcaggtttagaattgctcattgtattcctgttcttataacttaaataaatgttatattcttttgtatgtgtcaaatattacagggtatgttttttaaagttgcattagaattctcaggtctggcttcttctcttggtcccagctgcaagctgtgcagagagaaaacttagagcctacaccactgggtagtgttcccaagcactcctgacttcctgtagctcttttttaaaaaaaattctgaatggattttttattttttaaaagtcttattgagatgtaatttacgtaaaataaaatacacccattttaattgtacaatttgagttttgataagtgtacatttccatataaccatcactacatgacagaacatttccaataccctgaaaggttcccttgggtcccatttccagtcaatccaccctccttgatcctggcttgagggcaaccactgatctgctttctattactacctattagatttctttcctagagttttttttctttttttaatataaatagaatcatacagtattgtactctcttgtttctattttttttctttccgctcagcgtagtgttgccgagattcacccaaattgctgtgcgcatccgaagccttttcctttttaccattgggtgggtggtattccattgtagggatgcaccacagtttgtttatccattcaccagttgatggactttgggttgtttccagctttgagctattacgaataaaacttttgtgaacattcgtatacaagtctttgtatgtttttatttctcttgggtgagcgcctagaagtagaattgttggtttatatgttaagtgtatgtttaactttataagaagctgctaaactgttttctggagtggttgcatcattttaccttcccaccagcaatgtttgagagttctagttgctacatatccccaacagttggtcttctcagtctttttaattttagcagttttagtgtgtatatgctggtatctcatggtggtttgggtttatatttctttgatgactgattaggttgaacctctctttgtgtgtttattgtccacttgcatatctttcttgtgaagagtgtgtttcagtattttgcccattattaacagtcttcttactgagttgaatgaggtttttaatgtattctggattcaagttgttggtcagatacatgtattatgagtatttcctcccagttggtggcttgcctttttattttcctaacattaccttttgaagagcacacaattttaattttgatgacatatatttatctttttttccttttatgattcatggttttgcatcctaaagaagactttgtctattccaaggttgaagagactttctcctatattgtcttctaggagacactgtctcactctgtcacccaggctggaatgcaatggcctgatgttggctcactgcaacctctacctcacgggctcaagtgatcctcctgcttcagcctcccaagtagtggggactacaggtgtgtgccaccacacctggctaattattgtattttgtggagagatgggttttcaccatgttgcccaggcatgagccactgcacccagtttatagcgttagtttttatgtttaggtctgtgatctattcttagttaattttcgtgaatggtgtgaggtgaaggtcaaggttcgtttctccccataaggatatccagttgtgcctataccttatgttcaaaagattatcttatccgcattgagttacatgtctataaaaaatcaactcacagccaggcttggtggctcacatctgtaatcccagcactttgggaggccaaggtgggcggattgcctgagctcaggagttcgagaccagcctggccaacatggtgaaacccggtctctactaaaagtacaaaaattagctgggtgtggtggcaggtgcctgtaatcccagctactcaggaggctgaggcaggagaatggcttgaacctgggaggtggaggttgcagtgagctgagattgtgccactgcattccagcctgggtgacaacagcgagactccgtctcaaaaaaaaaaagaaaaaaaaaaaatcaactgactatatatgaatgggtctgtttctagattcctcttttaaaaaaaaataaaaaaaaaaacaaagctatcgaagtatactttatatgtcatacaactcatccatttcaactatacaattcaatgatttttagtaactttaccgagtgatgcagctgtcaccataaatcagctttagagtacttcacctcccctgcaagatcctttgggcccatttactgttaatccctcttcccacctctagccccaggcaaccactaatctccttttcatcactataaatgtccccttttctggacatttcaggtaaatggaatcagaatatgtgatctcttgtacctggcctctttcacttaacctgatgtttttgaggttcatccatattgtagcatgtatcagtaattcattccattttatcatggaatagtattctgttgtctggttgtacctcattttgtccatcagttcagcagtcgatggacatttagattgtctccaattttggtgaagatgaataatgctgcaaagaacatttctgtgcaagttctgtgtggacatacgttttcattcctcttgggtagatatctaggagtggaattgctggatgtggtagttttatgtttctggatccttcttaattcttttctttctaattagctttttgtaagtataatttacatacaataagatacatcaattttaagtatacaattcaatgagttgtacaaacaagttgtaactcatttaactcctgtaaccaacactacaatcacaatatagaaaatttctatcaccccagaaagttgctttgtgccctttatgtcgtccttttcccctgcctctggtttctgttaaccaccaatctctgctctgtcactgtagttccttgtgccttttcaaacatttcttatagaacaggtgcagtggctcatgcctgtaattccagcactttgggaggctgaggagggcggatcacctgaggtcaggagttcgagaccagcctggccaacatggtgaaaccctgtctctactaaacgtacaaaaattagctggccgtggtggcgggcgcctgtaatcccagctactcgagaggatgaggcaggagaatcccatgaacccgggaggcggaggttgcagtgagttgagattgcaccattgtactccagcctgggtgaccgaacgaagctccatctcaaaaaataaataaataaataaaaataaaacattttgtataaatggaaccatatagtatgtagacttctgtgtctggtttctttaccgtaacataatggttttgagattgattcatgtttttatatacatatatatgtattgatatataaatacatatttatataaatacatataattttattcatatataatttatatatgcatttctatattatatgtaaatatatgtaatatatatttggaaaatacatataaaaggaatgaactgtttatgtctatatcatgattgtgattcatggtttttgcatcctaagaagcctttgtctaccccaaggttgaagagactttctcctatattgtcttctaggaagttttatagtgttagttttttggagacaccatctcactctgttgcccagagtatatttattatatatttatatatattatacacaaatatatataactttacatatatatatatatatacacacacacacacacacacacacacatatatatatacacagagagagagagatatcattctttttcattactgagttgtattccagagatcagtgggctttctttttcgtttttcttttttttttgagatggagtttcactcttgttgcccaggctggagtgcaatggcgtgatcttggctcactgtaacctctgcctcccgggtgggttcaagtgattctcctgcctcagcctcccgagtagctgggattataggcatgcgctaccacgcctggataattttgtattttcagtagagacgaggtttctccatgttggtcaggctggtctcgaactcctgaactcctgacctcaggtgatccgtccgccttggcctcccaaagtgctgggattacaggcatgagccactgcctggactttttctttaaatgggtatattttagactttgtgagccacatatctctgtcacatgttttccttctcacctttttctcttctcccttcatcctctcttctttctcctccttcttcctcttcctgttcttcttctccctttcccatgaccacaattctttaaaaatttaataaccaggctgggtgcggttgctcacgcctgtaatcccagcactttgggatgtgagttgggtggatcacttgaggtcaggagtttgaggtcaggagtttgaggtcaccatgcctggccagcatggtgaaaccctgtctgtactaaaaatataaaaattagctgagcctggtggcatgcctgtagttccagctacttgggaggctgaggcaggagaatcacttgaacccaggaggtacaggttgcagtgagctgagattgcgccactgcactccagcctgggtgacagagcaagactctgtccccccaccgaaataaaaaaaaaattaatagccattcttagctcatggctacataaaaataggctaaagtaggattggccaactggctatagtgccaacttctgttgctccatgtaccgcaatttctttatctgttgaccagttggtagtcatctggcttgctcccagtttggggctattatgagtaaagctgctgtgaacattcatgtataaatctttatgtgcacttatactttcatttcctaggagtggaatggcttagtcacatgttaggtccatgtttaactttaaaagaaactgtcaaactatttcccaaaatggttgtagcgtttgtgttcccatcagcaatatgtaagagtttcagttgctccatatctttgtcaacacccgatagtctcatttttgagtttagccattctaatgtgtatgtaatggaaccttattgtatagtacttttaatttggatttccctaatggctaatgacatcaagcatattttcatgtacttattggccattcgtatatcttttgtacagagtctcttccaatcttatgcccattttaaaagccactttgtctttttattattattgaattgtcagagctctttatgtattctagttacaagtgctttgtcagatatatgcttggcagatattttctcccagcctatggcttgtctcttcattttcttgacagtgccttttgaaaagcaaaagctttaaattttgatggtgtccatttgatcagttttttcctttttggttcatgcttcttatatcttaagatgtttttgtttaccccaaggttgcaaagattttcttctatgttttctgatttcttatagaagttttatagtttttgctttcttgtttaggtgtgacccattttgagttaatttttgtgtatggtataaggtgagagtcaaggttcatttttttttcctatggatatccagttgttcagcatggctgttgcaaaaattatcctttccccatagagctaccttggcctctatcaaaaatcagttgaccatgtaagcatgggtctatttctggactcttctgaattcttaacagcttaattagagctcatattttttaatctatggacaggggatatagatatgcctctcggtgtccttcctgcctaaagatgacactgctaatggcattgtagcccatgaaaagtggaaaagattgtctttcatgggatgtacgtgtaaatacaggctttgcattttccaacaggactactgttgggctactgtggtgccttttgccatccaggctgccaagtccttctgttcagagcagagacgatctgtttctgttgctgctctctgggcctgtctttctgcccactgccagccatccacagccatgtgcttcagggcccaccccgcccccaagctatagccagcccttctcagcccagccaggtccccgtctctctgcacttgtgctctccacctctgtgctgtagcaagcactgatttggtgggctggctttattccaggaccttactgggagtgagcctgtcttgtcatttaattttcagggtggcttctgagcgaagctgatgggctgatgtgagaagctagagacactgctgtatagagacatggctccaaccctgatgagcctggaggcgacctcaatgggctggccccgtttctaccactgccttgcccatgcttgggctgccagcctccccaaggacgtgagagttctctccctcttgtcagccagcacatcactggagtgcctgttgtctcggcaggatggttccgtgacagctctcagctctgtgttgccgatgaacctttactggattgcaggatttccatggtgtggatcggtctgtgacttgctcagcaaggtttcaggctcaacattgccgtgttgtatgcacaagtcctagtcctgtgcatgtgttcttagttgatgatgtttgttctcacctgttaggtgagaatttggttggtggaggtataaagaaacagagtcatgttggttttgttggtgttcagtgaatagttaggagctgtggggatgcacctctcctgcccccgctctaccatggttttacccaaactggagcctttgcgcaggctgacctccatggagccgggcagagcttaagctagttcgtggagtccttggaaggttgggttttgaagagctccatgccctttgctctatagcagtttatcccctgacctcattgcagcccacagcgccacagcgtagaggcagtccaggaaggcccaggtgtgcaggatgaggattgccaccacagatgcccgtctcttcagccttcacagagatgccagggctttggtactggtgaggaacccctgccacgcagctagggcgccggtccttagacagctgggctctgagtgagagtgaagatatcgcctgttcttggattctttggggctcacaaagccctgccaccttcagtcagtgcttgataagaagagaaaaatgtccttggaacccccctggctggtggtggcatgagggtttctgaccccaggcttgttgcccacttgctaccttgtctgccttgtctgcatggcaggccagtccctgcttccagagtggagactcgaagcatttaaaaagcccactcattctcttccttttcttcccagctagagaagagtgactgccccatctcctgcccttgtctttatacctccggacattcagggagcctggtggcggggaggtgtgttcccaggcgccctgctctcagttcccttgcggggtctgcaccagacttggaaaaaataggccccagggtggggaggggcaggacttgaggtggtcgtggctgggagtttgagctagtgtggactgtgctaatgtttttgcagtagcctggtctgttaccctctgagagccacacagcgggtaggagtcatctctatccgagtttttctcttttttcattttgccacaagacagaattgtatcacacatctccaaaacgagtaaaatggcatttcagcttcttgtctttatagactctctgaactttaggaaagatcattctggtcccttttcattaataatgaaaaccagggggcaataaaatgttcttaacgtgagcatggcaggaatgaggagcggtgaggggtgaagggtgaggctgcagggaccacaggtgtttcttggggctggaatagctcagaactctggaaagtgaggcagctattgggagggtcctggtcctcaacccacacagccagcgtctgctcagccttgacagcccagagggccccagagaaggctgtccttctcatggcgggatgtttgcgggtgagcagaggaatccagcaaactccaggtgctggtcaagctttcagccaagtcacagctgctttcttgcaagaggcttcatggtgtctgagaaatcagtggtgaatatggtattcgggccgtgggccccgttctgcacttgttctgcctgaggattttggctgcagggagggatgttccgggtatggatgaaggccctcctgagcagggactctgagagagcggggtggccaggttgctctgtcttcactttttcctcctgaaaatggacttgcactagatgtcaggttttgtatctggagcgccaagcaaagctggctagaagaggggagacagaagagacacctgaccaggactccaagtgcccggctccttggggtcgaggtgaaagatccgtctgcctcagtgctcttagagctccctgtataacgagaggtgatttgtgtcgggtgggggtgtccaccatcagtgaagtagcactgtccccttcccatggcagtttcttagacaccgagtgtcactgcacagcctgggaagggagtgggggaagtccttgctaaccataacacaaaccccagaacccataaaagaatagattgataaatttgtataaaaacctctgcatgcgacaaaacaccattagcagagtcaaaagaaaaataaaccagagaagatgtttgcgatgcagatcacagacagcgggctaatatccctgctatataaaaagtctctctaaagtgacaagggaaaagaaatcaagtagaaaagtggagagcatacagtacaccgaaaaggaaatgctgatgaaaacatgctcaatcctcactcaaaatgagatcaatgcaaattagaactagagtgaacttctgttttcctgctgtggtattggcaggaatctctgcgtttgaatcgtgcattgtgtgggcgcagccgtggggaagcaggcattgcgcagcggctcagggtgaattatcggccccatggaggcagggtggcagtatttctcaaaactgcaaatgcacacgccctgggaccaccctctgggggttctgaggctcacagggtgcgtgtccccatgtgggagatggcacgtgtgcacgttgttgatggcagcgtggtgtgcagtagtagaaagttggaaatgagctgggtgcccatcggagggcaggtgaagtggaatatcctgcagctgtagaaaacaagattgagagatggggaaacgtgaaggaagagaagacatcctgtgccaccttaggtgtgcacacagactcactggaaggataaatgtaagactactaatggctgttggtggtggggaagccttttttcacagactgccctgtgctattcgatgagtaaactgtatgcgtgctacctgttcaaaaagtgtaaaacagaaatgggagttggggactgagggagaggccctatgttgattacagttttgggaccgagattccagggctaggacacaccggggagtctcgcatggaatccgcaggcagggagggagtttggtggccaaggagggactccaggcccctccagccctgtcgtctctgccccctgagagtgccattcagcagccctgggggagggggtgtctccttgcccactcggaggtctttgcgacttggatccgcctggtggggctgcgtgccagcagccccttccccctcatgccacatcctgccctgagctgaaggaaagaacgggccttctcctcccctgtggtcataaaacgccaggacatggaaggtacctctgaaaacttacaggcacaggtgagaactgagggcagaagtctctcaagcagcaagtccttcagcttcactcggccgtgttgtgacgttccttcccagagttcagaacgctgctgattttccctctccccctttctcccagatgagcagcacactgtgggggcgccttccggatagctctccactggtgctgtgatcgccttccccgctggtctgtgtcccacccacgcccctcctgatgacagatccttcggggggaggcagagcacccgccacgtggcctggagatggccgctccagaaaggtgttcgcagtggagacggggctctcccgcgtgccttggaggatcagatgaggttgtggacgtgggagcactttgtgaactgggcatgggaaagagtgaaggtggaaactctccccacgtcaagtagaattgcattcaggagggcactttgctatgtgccgttctaaagagaatcggccgggcgcggtgctgctcgcctgtagtccatctgcttgggaggctgaggtgagaggattccttgagtccaggagttccgggctacggggcactgtgctgatcggggttctgcactaagttctgcatcaatatggtgacctcctggagcaggggaccacgaggtcgcctaaggaggtcagaaatggagccggtcaaaactcccattctgatcagcagtgggacatgcctgtggatcgccactgcactccagcctgggcaacataacaagagcccatctctaaaaagattacttaatacaaataaagagaagagaacggggccaggtgatcttccatgaagactggctgcccttcacagcagcagcaatgtgttctcctgagacattgccccactcccttcttgccctctgtgctggtcccagtccctctccacctcgtgaacccttgcagcaggctcgccccagctcttctgcctctgcggcccccacttctgaccaccctcagagcctccccagtgctgctgtccagggtcatggcactccctgattcacatcccccagtaattcccattgcttaggaaagaatattcggcttccttgaccacacagtccacctggtgccacctgtctacctctttcctgccccgccccagcccccactgtacctgcggcttccttggctcctctccgttctccccagcaccctgctcttggggtcctctgggccagagcagctctcctctctagtcaggcccagggtgctcacctggtctacacccacctaccgtctctcttttgtgcttgctcccctccagcccccaagggcctcagggctcctccaaggccctgctgaccccagcccctctcccctgccacccccatcccttttgataggcgttctcattctctgaagccttgctcagtcatttggagacttgtgttttctctcctctggctccaagcgagagcagggctgggaggtctagtttaccacagcccacccccgtgcccccacccagcgtaccacggtccccctctccacttcgctgaggccccgcttggttctgctgtggcccccagcttatcgccagctatagtagggcatatatgggtatatttatgctcccctaaacatactcctgttatcctctctggatcttttgttcctgaggtagagaccatgctgttggtcttcagatcacctctgccacctgactgccaactcaggtctcagctcactgctagatacctccacccacagcctgcagtcagggttgggtgactggcatcccttgtgtcccagttgaggcagtgggaacaggaggggtggagccggctgctgttgtgatgatcatgtgctgccttcctgcgttggagtgttccacttgcccattgttggaggcgaggagactgtgccactgaggcacctgtgccagcccccacccgaagaaggacgccatgtgcgtcttctaaccctcctcctcttcccgcctgtaggtcccgcaggctcccgatggcgagattacggcgccctggccatcatcatggcaggcattgcatttggctttcaccagctctacaaggtgagtcacccccagcggctgcaggtgctgtgcccctgccaccctgtggcattcagcaccctttcactggttcccctgcatggaggcactgccgtgctctgccctggagtgtgttggcagtgagaggctgtggtagaggtcggggttcacagctggatccaggcagaccctgccctgctgtggggcttggcaggctctgcccaccttttctccagtgctcagcatataccacccagatctccacttgcaggggcgtcgtgaggtctgtcccttgccagcccatgtcaggcacttacagtagtgcccgcacggggaagccgtgcgagcagttttgagacacagaataacataatggcgaagagcatggacgctgggccagctgctttgctgagccctggctctgcccctcaggagcttggtgatcacaggctctggtctgtaaaatgggaataacagtccccacttcacaaggttgtcgtgaagtccggaagagtcagtctcccttgtagaggactcagagccatgcccggcacatggaagtgctttatacaccattgttctgccacagcatttaagagcggcggtgagaacctcagtgtcatcagatgtatgggagctgttctttttgctctgtctgttgtgctgccatctatagaaatctaggatttcccaggcttctcaagtcaactttcaggatcccaggttcattgcttgcaacagaactgcaggcatgacgtgaacattgactcccttgtgaaggcccaacttggacgtgaagcaaatgagtctagagtctagaaaatgcaggccagggtaggtgcccagtccagatcttgggaccctgtagagaagcctcttttctttcgaggctgccagctcctccacccctgattggtgatttttttttttttttttttgagatggagtctcgctctgtcacctaggccggagtgcagtggcatgatctcggctcactgcaagctccgcctcctgagttcaagcaattctcctgtctcagcttcctgagtagctgggattataggcgtgctggtgcatgcctggctaatttttgtacttttagtagagatggggtttcactgttggccaggccggtctcgaactcctgacctcaggtgatccgcccacctcggcctcccaaagtgccaggattacaggcttgagccaccgtgcccggctggtgattttcttttttaaacaacctgaatgagcactcagactcgccatggtcactcttagcacatgaaacatggtcagccatggtattccagattcttcatttttgatgtaatacaaaagctaatgacagttgtagcagaatataattttttaagtgtagcatgtattcctggagctggacatttccatgttagaaattgagaaacaagggctgggcgcggtggctcacgcctgtaatcccagcactttgggaggctgaggctgaggatcctgacttgatcacgaggtcagtagatcgagaccatcctggctaacacggtgaaaccccgactctactaaaaatacaaaaaattagcccagcatggcggcgggcacctgcagtcccagctactggggaggctgaggcaggagaatggggtgaacctgggaggcggagcttgcagtaagccaagatcatgccactgcactctagcctgggtgacagagcaagactccttctcaaaaaagaaaaagaaaaagaaaaagaaattgagaaacaaaacatcctgggttggcccaggtgccgtggctcacacctctaatcccagtactttgggaggccagggcaggcagattgcttgagcccagaagtttgatattagcctggccaacatggtgaaactgtgtctctaccaaacaataaaataaaataaaataaaataaaataaaataaaataaataagctaggcatggtggtgtgagcctgtagtcccagctatactcgggaggctgagggtggtgggaggatcacttgggctcgggaggtggaggttgcagtgaactgagatcacactactgcactccagcctcggcaacagaaggagaccctgtctcaatttaaaaaacaaaataagccaggcgcagtggctcatgcctgtaatcccaggactttgggaggctgaggtgggcggatcacttgaggtcaggagtttgagaccagcctggccaacaaggtgaaaccctgtctctactgataatacaaaaattagctgggtgtcatggcgtgcacctgtaatcccagctacttgggaggctgaggcaggagaatcacttgagcctgggaggcataggttgcagtgagcctgcagtgagccgagattgtgccactgcactccagcgtgggtgaaagagcgagactttgtctcaaataaatacataaataaacagaacagaacaaaaacacctcttgggacccggttcttctccctctgaactggtgcccccttcaaatcactgactgtatacaagcaccaagaagaatgtgacacgaacgccagagtcctcagatgaatgccctggctgtaatgagcagtaggcactgtcacatggccacccatggagggcctgtggcctgacgggagcgggagggcagctcggcagcccgccttagcgtgggcactcacacggagctgccacttgtagtttctacgaagctctgggctctccgctctgttttaaaaagaaaagaaacattgcaatatcagtcacaatggtaacaagagaatttctaaagcatctgctcagtttctcgaaattaaaaaaaaaaaaaaaaagaaatggtaaaaagccctcgactggctttataagcacgtgaagactttggctagggcagcgtgtctgctcctgcccttaggacttctgatctcagaaatggggtgtttagttggttacacacacatatatgaattcttttttttttttttttttttttgagacacagtctaactctgttacccgggctggagtgcagtggcatgatctctgctcactgcagcctctgcctcccgggttcaagcgattctccagccacagcctcccgaggagctgggattacaggcatgcgccaccacactcagctaatctttatatttttagtagagacggagtttcactgtgttggccaggctggtctcgaacgcctgacctcatgatctgcccacctcagcctcccaaagtgctgggattacaagcgtgagccaccgcgcccggccaagaattctttacctttcttgctgaggacatttcatcctgaagtgtaaggctacctttgatgagttttggctcagttgtgggtaatagctcacactgtggttgaaaagcactttgcaaaatagaaaatgcgtctatacatgtgctgctgaagaatgatcttcacttaggagtcactctggaaatgagttcccacaaaccccttgtgagagagcttcttttccttccctggtacagaaaccgtaatggagaagtttccgtcctctttcctatctgggcccagatagattaagaaccaaagttatccccgggcagctcctgccaggcttgcactgcactgcctctggcagtgcccactgaagggggcagcgggtctcactcctcacctggggggctttgtctccatgtcccgagtggctggacgtcagtgcacatgttcctacacgcagctgtccctgcaggccccaccacccacctccacccctccacaccctcacctccaaggcaaccaagagcaccagttgccagccctgccctgcctgcccccttcctgaacggctccttcgggcatccctggttctaggcccctgtgaggggtggccctgccgcattcactttctttttccccagagccagtttcttctggtcctgcgccttcctctcccttctgccttgtgtttccttctggggaactcgacttcttttgactcttacgtgaaggaagtttgttctgaggattcaggcttcatttagaaaaagactgaggtgacctcttccagcagcctcagagcgcacatgttatcccctggcgagagaaccaagggtcccagaaatgtgttgttgattttcctttagtttctccagcgatgttttgtttattaatttactcgtttgtttctgaataggtgattcactcacaggttcaaaatgttcacaattcaggagaacatgccgggaagagctgccccgcctccctcgcctcctggaggctccagcattatctgttgcttgtgtgtccatccacatttatatcttacaactttgacagtagagtttataactttgtgttacagaaatagtgtagcatcactaagaaaagtaaataaaggaaccaaaaagttcccatcacagcagatccagctgactctccctgtccacgttccctcctggtccttgtccttattcaggcagaatttttacgtggttgtaatcgcagtctcataactttttcaaatatcttgttcatttatggtgtttgcttagggtttccaaaacccagggatgacagggagaaagttgggcggcagaatttgagagattgttggaggataaccccgggtccgtatgcattcctcaccctgtcccgcttcttgcagaaatacctgctccccctcatcctgggcggccgagaggacagaaagcagctggagaggatggaggccggtctctctgagctgagtggcagcgtggcccagacaggtaaagattaatgactccatcaagtcacccctcacagccttctccaagcagccccttctctgcccctcccctctccctctgtctccactctatgtggtgacttcatttatctgctctgagaatctgttcacatttgcaaatgaagccgccgtcatttcggtttaatttgaaattgcttgtttactgtcggcgcggcctcaattaattatgtttttacggaaaggctcccaacctcagaatattaataaggggaataaaatgacagcctttctaagggctgtaaagttcatttttaatttctgcttctatgaggttttcaggggggttttcagtgattttcccccttccctctaagactcgactgtggggtcaagagagtctgtaattactgtggctcccgggaccccagccacctcccctgttatcgactcaacagggctcgcgttcattacccagtgccccagcgatggcccagattagctgggacctgtcgcgccagaggtggcttctcttctttataaacttgtttactagacggcagctctgaatctaaaaaccagagcaaggccaatgagagagccacctgtcccaggcaggagtctgtgtccctctggagcacgtttgtgaagctcacagaaaccctctgacacgtccatcctgctgccgtttgctcctgcgaggctgacattggtggcaacaaggtcctgaggggtcacgggacaccagggagttgagcaggcagcttgggtcaggtggggagggtgggaaggagcagtgggaaacaggacgtgcggcttgagccactcctggatgtgaatgtggcggggacctgagatgcatctctcccagcattggagaccccaggagtttcacaaggacactgaggcccaggagatgaaggacgcaggcgccagagaagccgggagagctcagcaaatcatagccagctctaattagaggggagaggttctggacggatatactgttgaccatggacaactacacaatggaaagataaagtagaaatactagaggttagatacagtgcaggcagatcacccagagtgcagataaattagatggattgcgggggctgggggtgtctgcagataaattagatggagcgggaacacgggcagctccgaggtgtgcggaccgagcgaggggaacgtctgtgcctgtgaatttgccagcgccgtgactgctttctcctcgcagtgactcagttacagacgaccctcgcctccgtccaggagctgctgattcagcagcagcagaagatccaggagcttgcccacgagctggccgctgccaaggtacctgtctctgctgcacagggccctccaggcccaggtctgtcccatgtgcccttcactcttgtcccttgggccgggcttgccaccttcgggagctggactttgccccagtctcacagtggttacacagccgtggccgatgctgccctttctctccttgtagagacaggaggctgttgctgggcagtcagtgtgacgtttaactgtcgaggccatcctttctctctctatgtcacctcccaacaggaggaaggaaaagctaccctctgcctgtggagatctcatggcagccacatccccgcagctctggaggctttctgtgtagacatgggacggtctctacctataagttaggttgcaggtcacagcatggccaggaggggttctggaacagacaggggagaagcgagtcgcagtcagttcaccagcaccagccccatccacaccgcagtgcagcgggcaggttctctagactcaggttccatgggttctggcaatcctagggagccagaaccaactcccaaggcagtgtccttgcctcactgcccaaatgtgaagaaatcttggcgtggcagcttccaggatcaggctgaatcctggtcctgccacttgttagctgtatgaccacaggcaagttacttaacctctctgagtcttagtctcctcatctgtaaaatggagccataacggcacctaattcctggggctcttcatgggttcaagagggtgcctggctccagccagctcgcaggattgcaggcctaggttctgtgggtgggtaacagaggtcatccctgaggcggtatcagacagaccgggcccaggagacagtggcctggtagctccagaacacccactggctcctctctctgtcccttgtcccacagctctgtggccggcggacactgctccctgtctgcccccacagcctgggctctggagagtcccatcccgagttgcttacccagggaaagccactcctagcgtacgagttggcttgagccagcactcagatcttttgcatttgcaaaaaccatgaaaatgacaatctttccatggagtctggggtgtctcttgtgaagagggtcccaggaatctcccccctggatatccaaaccacacacagaggtgccacctgctcttcctcctgggatggctgtgggtactggtgaccacctccagccactgcaatgcgtgttctccacgggtggccggtccctaaagcaccaggaagcccagcgacagccctgcctgctctcctgggtcaggtcatcttttggatccatgctctgcctgtggccagaagccattccggaaattggaaaactgttttcaggccttacgcctgagattaagaccacatgttgtgtttaagaagcagtgggggcccgggatgtgcttggtggtgagaggggttgggcccctcagagtccctcgagctggctttgctgccgctgtccctggcccaccccagccttctctcccgagctgcatggggccactggcttggcatctaaacgcgtatgtgtgaggactttggttaccccataaaccaaagacccagagctgtgttttctcagctgtaatgtaagtttttatatctggcttccaaactcctactggagcactgtaaaaaattaaaaagaagagctttaagtaattaaaaaacctacataaaactgaaggctatgagttttctacaactgttttttaaagaggctggctaaaaagccccagatgtcagattttatttctaaatcctggcatctggcaccatatgcgtttggaaatctgagtcccttgtaggccagtgagtggaaattgtgcccttgttcatgggctgctgtagctttcaaggtctcagagaagccagagccgtggctcctgggtcctccctgtctggcggtctggagtaggaaccctgaggggctgtgtctgggggtggtgggtgacacgcactcactctcagactgcccgggttttccttcctgagacctacaggccctctgaaggacttctccctgctaaggtgtgccagctggactgcttgctggggtgagcccacagcagcccccgaccccacgtcagaggccaggcctctgtaagccagccagcggcccacagcacactggtagggaacagccagggaacgtcccctctgcccacctcgggggagcagtatcaggagagctggcaatattcatctgtgcacttaaagatggcctggggtggccttcagcctgggcgaggtagacctcacacggaggcctcgtggcattgtcctctgtgcacatgccacaagcaggttgccaccagcagctcgcatttggggacctctggtttggctgtcctcttccccgtctataccagcaagattttccagaagtaagatgtagttctgtgaagtttatttggaaaacagtgttaccttcaaaggggaaaggtgtgcatggaaggatggggtttgtcagagatggtggctgtttcctctttccaccccggaccatcttaaatcccagacatcatcccacttcataccgcacccgcacgcctccgcatgtctctaaaagacgcccacgataccattatgtcacctaaaaacacgtaatgattccttacgtcatcagatgtccaaacagagctgtgggaatgtttaaggatgttgtcatccagagacgtggcaggcagtgggcagtggcagaaccttcccccgggttccccagaacagacccagaaggccccacctgctgcccccacccaggtcctcctgcagccgcaggccccgcccgtgccgcaaggcgcccgccctgagcctccctgtgctctgctttcaggccaccacatccaccaactggatcctggagtcccagaatatcaacgaactcaagtccgaaattaactccttgaaagggcttcttttaaatcggtaggagggaggaatggggaccctgttctggtcgggcctggaaaggaggactgggagctctggggcatgggaggggcatgacgcccacccccacccccaaggaccccatctgtctgggcgactcaggcactgagtctggggccttttgagcttctctcttcattccccagttgacaccctctccactccagaggtgacggtctgtggcacacaagttttgaaatacagttcccaggcctgtgaagacctggtcagggacagcttgagccaaaaagcagggcccttggagcagaggagaacttcctggtttggctcctccttcctgagctccaggtgaccactcagtgacagctttgtcccagggaaagcccctgcgggagagtctttgtgttttgtacttggaagggttccacaactgaagacgtgggcagaagcaggccctgccccccggcttcttggttgtccccctgttgtccctctgtagcgacagcacattgtcaccaatgcagcctcagaggtagggtgaccaacttgtcctgctttgcctgggactgtcctggttttatttatttttatttttatttttttttgagatggagtctcgctctgttgcccaggctgcagtgcagtggcacgatctcggctcactgcaacctctgcctcccgggttcacgccattctcctgcctcagcctcccgagtagctgggattacaggcgcccgccaccactcccggctaatttttgtatttttagtagaggtgggattttgctatgttggccaggctggtcttgaattcccgacctcaggtcatctgcccatggcctcccaaagtgctgggattacaggtgtgagccactgtgcctggactgttctggttttttaaaactgaaagtccagtgtccaggagccactctgtcctgggagccgcaactgtgggccatcctcctgggctgatgccctagtgggccttgcatggggtgtccttgtttccctgctgggctggatttgttgggagctgggtgagtgggagggtgcaggtgggcttttcactagggtccaggatggggtgcagaggggtcttgcggctccagccagaagaccccattttccaagccacccaacttcccggttttccctgaggaaaagaacatgtcctggaaagagatgtggcgctggcagaggccagagcattgtcattaggagacagcctccattttccctaaccgagaccagtgccttggaggctggggatggaggccaggccatcgggtgaccgtgggggccaagaaaactgcacatggaatttcttgttagcgtttaggatgctggtgaataaagcaggccgtggtgtgtgccccactcaagtggggtctgtggtgggagagttgtgtctaaggcccctgctgggggacagccctgcgggcagggctttgtcctcttggctcaggcagagatgggcctgcctgttggagagctctgtctctgagccgttgccaagtggacctgacctcccaggtccctcctggaattggctttggtttgggctggctgctggcccaggaacggagtacggagcagaagggagagctgcctcttctgcgttgaaagtgttgagctcagaagttttctagcaaagggcataaccaccgcccttttggttctgatgtgtctgaccccctgccagtggccagggctccctgcctccaccttttgctcaggccatagacaaatgaggactgtggctcaggtgtctggagtccccagtcatagcccttttggactcctcaccaacctgtctctctcctggccactgggttggaggcagggatggtgctgaggatcagaaggaagcaggctcccgcatggcaggcaggccccacttggcttccagcagctgcccaggcagatgggccttgcccagggtgggggcccggggggaccctgggctgtctgtgggggcacaggacccgcttggcatctatctcagctgtaggatctttgctcctgaaaggaggggtggaagggctccatcctgtcccttgcccagtgtccctgggggagcagctcaccatcgccgagcccttgcgggtcagggaaggcgtggcccttcgaaggggggcgtcctgaatgccgccaccaacctcctccccttcttctccctctaggaggcagttccctccatccccatcagccccgaagatcccctcctggcagatcccagtcaagtcaccgtcaccctccagccctgcggccgtgaaccaccacagcagcagcgacatctcacctgtcagcaacgagtccacgtcgtcctcgcctgggaaggagggccacagccccgagggctccacggtcacctaccacttgctgggcccccaggaggaaggcgagggggtggtggacgtcaagggccaggtgcggatggaggtgcaaggcgaggaggagaagagggaggacaaggaggacgaggaggatgaggaggatgatgatgtgagccatgtggacgaggaggactgcctgggggtgcagagggaggaccgccggggcggggatgggcagatcaacgagcaggtggagaagctgcggcggcccgagggcgccagcaacgagagtgagcgggactagggctgcgcctgctgcctccagccctgaggatggcatctagtgtgcccgtgcgtggccataccctgcctccctctctggccctgggagggcagcttggagcccaggtagggggcagagctgtcctcagctgcactgcggcctggtggcagtgtggggagtcacacttctgtccacctggcctcctctcgcctggccgccagccccagccccagccccagccccaggcccagctgcctttggctttgatctcaagtcaggctgaaggcagcgaagcctcggggcccaagcccctccccagccccctctcccggacagacgccttgcccagggtgtgtttgctgagtgtcttgactaccgtgacaccacgcatggccagagctagcgtccctactgcctcccgactcctcagtggaggaggagctgcggtccctctggtgtctgccatccccctccctccctgggcccggccctggacccgtcaggtgcctgtccccagccccaaccccactcatgccccgtcgtcctcccagacaaatgaaaccacgctgcgcttccgatgcccccgcttgccgtgtaatggttcagctaatcccatggcgagatgggggctcactccggaggaggagccaggcagcagggccttcctgaccaacagccagctctgtccttccccccaggaaacacatgttcatttgtgtgatcatgtatagacctcagaacggaagataggactgtatataattgtaataaataccagttgccactatttaa

SEQ ID NO: 37 - DNA, 37857 bp, Homo sapiens
cgaggatccgctcgggagcctcccctggccaggagcaggggattagtctgccccgcgaccggccccagccacgacgcggacatcgccccctctgtctgggccgctgtcactcacgcgccaaagggccacggagaaagaaggggcgggccggggcgggccgggcgagcggaggcggggacttgcgccgtcctgaggctgcctcctagggtccggccggcgctggagctgcggatttagattgtcactgccacctcggtcggtgcttacttcgctgccagctggtcgtcgccatgaacccggacctgcgcagggagcgggattccgccagcttcaacccggagctgcttacacacatcctggacggcagccccgagaaaacccggcgccgccgagagatcggtgagggcggcgggcgagacctccctcctttcccgagaaaagctggagactccctcgatgcggagtcaggggcgctgtggggcctaggccctctggcccagcgttaggggagccgggacccccacttcgaggaacagcctgtgtccctggtggggggatatcgccattccccaggtgtgtccgcgactctgaagcctattgtgattcagggagggtggaacggaggcccgagtgtctgtctgccttttaatgccctttaaccccctttcagagaacatgatcctgaacgacccagacttccagcatgaggacttgaacttcctcactcgcagccagcgttatgaggtggctgtcaggaaaagtgccatcatggtgaagaagatgagggagtttggcatcgctgaccctgatgaaattatgtggtttaaaaagtaggtatgccttagaacagagcaagtgttgttaagcctaaactttacagctgcggtctatggtggcctttcatcaccgtgcttggtgtttgaagatgcaaactggcatattttcatgcaactttataaagttatatgtgtggccgggcgcggtggctcacgcctgtaatcccagcactttgggaggccgaggcgggcggatcaccaagtcaggagatcgagaccattctggctaacacggtgaaaccccatctctactgaaaatacaaaaattagccgggcgtggtggcgggcgcctgtagttccagctactcgggaggctgaggcaggagaatagcgtgaactagggaggcggagcttgcagtgagccgagatcgcgccactgcactccagcctgggcaagagtgcgagactccatctcaaaaaataaataaataaataaataaataaagttatatgtgtgaaaaataatgtgatcacttttgtatccaagccttttcgtgggatgacgtgtttgtagaatgctgataataaatggaaatgcaggagtttttgttctcaagagtacagtttcaaggatgttgtaaaagcattgttctgcccaagcaactcaaatttgactgatttaaatgcagaatcattttgctctttgtaaggaggactgctaaaattctgaatctgggagcatttttttttttagttgcacgaccatttaaatattttggagcaatagcagattatattatatggtagtgtggacctggatgaagaatgatctgtgacgcctctgaatgaatagaaagtctaagaacccagtagttctgaatccatgacagtgcttgaatggttgtcttgtgcatatgagagagacgtcataaaaacctgccttggttctagtgtggaagagagtatatccttttttcagaccatgtgttttgttgtgttttttgtttttgtttttgttttttgagacggagtctcgctctgtcgcccaggctgcagtgcagtggcacgatctcggctcactccagcctccacctcccggattcaagcgattctcctgcttcagcctcctgagtagctgggattacaggcgcccgccaccacacccggctaatttttgtatttttagtagagatggggtttcgccatgttgccaggctggtctcaaactcctcacctcgtgatccaccctgctccacaaggaacggtaaaaataaataaaaataaggacttcgggccgggcacagtggctcatgcctgtaatctcagcactttgggaagccaaggcaggtggatcacttgaggccaggagctcgagaccagcctggccaaaatggtgaaactctctctactaaaaatacaaaaattagccgggcctggtggtgcgcttctggggtcccagctattcaggaggctgaggcaggagaatcccttgaacctgggaggcaaaggctgcactgagccgagatcacgccactgcactccagactgggcaacaaagagagactctgtctcaaaaaaaaaaaaaaaaaaaaaaaagacttttttgccttaacctaaacaaacactattacatgatcctagtacaagattattttggcctatagcatttttttctcatttattcctgggcattttctcttttaggtttctccattttaaaggaactccagtattttcatcggtaaagactaaatcgtatgagtggtgtatagactagaaccaagctaaatagaacatgttgcacgttctgcctttatggtaataatggtcactgcctctagtgcctttggtatcgattttcagcttgacttgggttatttttgtgaagatgaaatggtttactctggcactttggactttcctcagagctccactcagttttaaacgaaaaaattttgtttatttatttttggtagttcaaatcagcatacttccaaatggtctgttttgtttttgaagtttgtaactcatggctgtggggatattgagatagagtaactcctcctagaagattatgttactgatacctgtgttgtgtttgtaaatttgaaaaaattagtaagattttattccttcttgaaacgtcaggaaaaaagtgggttgagtgtgtgtgtgtgtgtttgaatgggtggtgcagtgcatttcaaagctgatagagatgatttcataacctgtgacctgttgataatgtgaaccagactcgagtgaggtcacaatgaaatagaacaaagtcttttatgcgggttaaagattcatggacaccgggaagttgttttgtgtatcatttttcatgtgaagtattaaagtacaaactttaacacaccctttgacacacttccaatgtccttaggatatgacaaggagatcagtttttaagtaagagaaggggtttgtaaatgagtcctggaaattatcgcatgctatcgagttaaagcctcggttatataatctcatcgattataactcacaccagtgttttgtgtaccactaagaaagaaagaatgctgccagttaaccgtgacatgctattaattgtgaaatacatcacctttctttcttttcttttctttctttctttcttttcttttctttcttttcctttctttttctttctctttctcttcctctttctttttctttctctctctttctttctctctctctctctctctctgcatttccatttatttccattatcagcaggtgaagaggcatctgccacctcacccagctaacttttgtatttttagtagaaatggggtttcaccatgttggccaggctggtctcgaactcctggccttgtgatccacccgccccttcctcccaaaatgctgggattacaggcataagccactgcgcctggctgagaaaacatttttaactgatgttaatgagcagcttctaaacacatgattaggacgcagaagtcgttccctctggtggaatctataatgattacattaattcattttgattaattagaaatattcgtatctaagagcatccatgttgagagttttttgtttctaagtggattatgatttatgtaagatagaaaagacaatgggactggggcatggtggctcacgcctgtaatcccagcactttgggtggctgaggtgggcagatcacttgaggccaggccacttcatgaccagcctggccaacatggcaaaacgccttctctactaaaatacaaaattaaccgggcttggtggcacacgcctataatcccagctacttgggaggctgaggcatgagaatcacttgaacctaggaggcagaggttgccgtgagctgggatcacaccactgtactccagcctgggcaacagagggagactgtctccaaaaaagaaaaaaaaagaaatggcggggataaccgtgtagtacttatttaggaaatagaaaaataagggtatattgtgtttactattatttctttctttctttctttttttttttttttttttttttggagacagagtctcgctctgtcgcccaggctggagtgcagtggtgcgatctcggctcactacaagctccgcctcccgggttcacgccattctcccgcctcagcctcctgagtagctgggactacaggagcccaccaccacacccggctaattttttttttgtatttttcgtagagacggggtttcaccatgttagccaggatggtctcgatctgatggtctcgatctcctgacctcgtgatccacccgccttggcctcccaacgtgctgggattacaggcgtgagccaccgcgcccggctactattatttcttttaaggtggtagtttggtttcagggtcccccagcactgcaatggcagcctatcccttctgtcctttagttcatgctctgctcattgcacaggttaggataaactggtagtaacattgcttcctaatcatgtgttgagaagtcgtgaagatcagttagatgagatgtattttgtactttaaactttttagatacgagctttgtcaaagtacaaaattgatccctataaaatctatgacacagcacagccaaggccaactactgtggattctgttttgtaagaagagagttgaggactaaatttcaatgtgatgtagagttaatccgtagtaatgttcattgaccattggggataaatttttacatgcccacattacttattgtaaaccctgaagacctttagcgatgtatgattctgccctggaatatgtatttactcttttggatatttgcttatattatctagggaaacatagttgaaattatttcttccttggagctcttgttaacagcgctataaataagtgttctatggagttatttttgctctttgaaacaaacaggtaaaacctaaataaagcaaaaaaaaaaaaccacacacattctaaaaaattcaaccaatcaaaccagcaaataacaccaacaacctccccttccaaaaattagagaagtttttatgctaaaacttaggtagaatttgcttagtggattaaatgtaaatacgaaatgaactgtgggaactgtggccttgaaataattagaagaagagagatcatcaggttctgctgctggctttttaggtagtaaaatggtaaatcttatatttaatttcataagaagggggtttacattttcctgaccttctccttgaaggccaaagctgtttggcaagaaggggttgtaggatgcagtttctaaaggaaggctgagatccttttctcttctctcctgtagactacatttggtcaattttgtggaacctgtgggcctcaattactccatgtttattcctaccttgctgaatcagggcaccactgctcagaaagagaaatggctgctttcatccaaaggactccagataattggcacctacgcccagacggaaatgggccacggttagtccacattgagggtctgtgggtaacccacctcaggacatcagttaacagtgattgctggcatttgacttttttctgctgctacctgtttgggattctatttttaagttgttaagtcaaaattcaacttcttgttttctcctagacattttccctggaaactggtccagggctctggcctataaacgtcattcactgttatttcctaaagccttttattattgaacagcttgaaaagatggggtttacagtgcagcggggaaccccattatgttactctgggtctaatgagtaaagactttgttggaaattcttcagagggttagtgcctcagcaatatctggaaagcgcctctctgctctaatgcagttaaagctgtggattttaatgggggcagcaggcagtggcagctacctgtctcatctcattgcccactagcagggttataaggcagtttggaaaaaagtccatgattctcttcatctgacttcagtctttttagacattttttcccctacatgtctgggaactcttgtgttgccagtaattctttgttaaattgttcctaaatatctggcttccttcaaaaagttttgcttttgatcttaatgtgaaataggtttgttttcatagacaaggccattggcaggtttgagtgtttggaatttgaactgcccagcctcatgtctaattatcaaaatggcaggagtaaagaaagggaaagaaaaagggatgcagatatcagggaaacatcattttgtgtttgattgctgatttcagtgtgtgaattggtttaaggaaaatgttatttattgtcatctccatgggtactgcagctttctggtcatggtttgatgttccagacactttactaaacactcaagacttcaacttcaagatggtcagtactgaaattataagcctgaaagaaaggtttgtaaaggaagataagattcttttttttttttttttttttgagacagagttttgctttttttgcccaggctggagtgcaatggcatgatctcagctcactgcaacctccgcctctgggttcaagtgactctcctgcccgagcctcccgagtagctggaattacaggtgctcaccaccacgcccggctgattttgtatttttagtagagacgtggtttctccatgttggccaggctggtctttaactcctgacctcaggtgatctgtccaccttggcttcccaaagtgctgggattacaggctacaggcgtgagccaccgcgcctggctgacagatccttcctttttttttttttttttggagacagagtctcactctgtcgcccaggctggagtgcagttgtgccatctcggctcggtgcaagctccgcctcctgggttcacgccattctcctgcctcagctcctcagtagctgggactacaggtgcccgccaccacgcccggctaattttttgtattttagtagagacggggtttcaccgtgtaagccaggatggtcttgatctcctgacctcgtgatctgccctcccaaagtcctgggattacaaggcatgagccactgcacccggcctgagagataagattctttatgtagtcctcctcgcttggagtatctgtgtgtttgtgtacatgcatgcgtggtgtgtgtgtgtgttgtaattttgaagtagctttgtggtacagaactctgtttcagtattcatcattatagaatttattcgacttaacagtcatgctgttcataggaggcataagatgtgaaatagtctgaggctaatggatttgttaagtatacctcttacctcttgttggtctaatgcttctgcctcatttataaagtaatatcacaaatatatatttgccctaatttttttttttttttttgagtcagagtctcatcctgtgccccaggctgaagtgcagtggagtgatctcagctcactgcaacctccacctcctgggttcaagggattctcctgcctcagcctcctgagtagctgggattacaggcacctgccaccatgcccggctaattttgttatttttagtagagatggggtttggccattttggccaggctggtctcaaactccttacctcaggtgatccacctgtctcagcctcccaaagtgctgggattacaggtgtgagtcaccacgcccggcctgccctaatttttgaaaggagagaggaagaaaggaagacttgaactatactggtttgaggcaaacagaagttggacagagatcctatatggctgtgggcaagtttgcatttgttagagttttcgttcccttattgcttttagttttgggtatttttttttttttttttgagacagagttttgctcttgttgcccaggctggagtgcaatggcgcgatctcggctccccgcaacctccgcctcccaggttcaagtgattctcctgcctctccctccctagtagctgggattagaggcgtgtgccaccatgcccggctaattttgtattttcagtagagacggggtttctccatgttggtcaggctggtctcgaactcccgaccttaggtgatctgcccgcctcggcctcccaaagtgctgggattataggcgtgagccatcatgcccagctagttttgggtattttcttgtatttaaaccaacgttgtcttaatctctgtggtttagagaacagtgtcctaagattagtcttttttcttgctggaattttgctaattcatattgctgttcttggttgatgactgatcttttccttggaaataagtcaggttggttaatttgcatcacgtgacggttttatcttatatggaatacacaaaaagtcaacgtccaggagatcggcaatagagcagcttatatagaatgagatctaactatttaaattctgagactttggaaaatggatcaacagtgaacagtgattatctaacgcggtctcacagaagtagctgtaactttgggtttgggattctttcacttctgggtagctgctgagaagtgaaggggctcagaagtattcaggttcactccatgttccttccaaatcctaaaattcagtcacctacagaaagtctcagtcaccagcattatccttctttctagagtgtgtcttctttcctctaaggacacgaagaaactcggatatacacctgccctgtgggtctgggagccataatcaaaggcagaggcctgaacctgggtgataggctcacctccctggagttctgggatcaaaggaacagcctggggaactgggtccatgttatcatcctgaccatatgtttctttaggccacaaaacaggtcgtttgtttgctcttcacagatatgtaatcatttcaagatgtggccatttctggagattcttcttgctttgttttccttgtttgcttgcttgctcacttccttccttccttcctctttttttttttttttttgaaggagtctcatgttgcccaagctggagtggtgcaatggtacaatctcggctcactgcaacctccacctccccctggttgaagtgattctcctgcctcagcctcctgagtagctgggatcacaggtgtgcaccaccatacctggctaatatttatatttttagtagagacagggtttcaccatgttggccaggctggtcttgaactcctgacctcaggcgatctgcccacctcggcctcccaaagtgctgggattagaagtgtaagccactgcacccggcctctttctcgctctctttctgtcttcttcccttcctccattcctttcgttcctttctttctttattcctcacccatggactggggtcacattgccttgtttcgtattaccatctatttaggaatatagagattgtatgatacatagttatccttgaagctgatgcagtatcctggcaaattgccatcattaacacttaaatatgaaataatgcacctttctttgaaactggaaagaggtagtaaacttgatttttaagtcatcagtctttaccgcactccgttgccctctctccctaggcttaacagtctcctcttccctctgcccaagtgattctcttccctgttggacttctcatgagacttgcttccctggggatttgggctaaatttcaccaatattagtgataataatataaactttatgaaagctgtgttctggccaggcacggtggctcacgcctgtaatcccagcactttgggaggccagcgtgggtggatcacctgaggtcgggagttcgagaccagcctgaccaacatggagaaaccccgtccgtactaaaaatacaaaattacctgggtgtgatggtgcgtgcctgtaatcccagctactagggaggctgaggcaggagaagcttttgaacctgggaggtggaagttgtggtgagctgagattgcgccattgcgctctagcctgggtaacaacagtgagactccgtctcaaaaaataaataaataaataaataaataagacgctgtattctttggggtcatacttctggaatacctctcagaaatgaattactatattgagggacatgagcattttagagcttttgctgcatagtttgaggcttttcctgaaacacagaaccagttgacaatatattgagcaagctctgtacctgtatttccacagctccatcaacgtggtcactttaatttattttgctactttaacatatttctttttttttttttttgagacggagttttgctcttgttgctcaggctggagtgcagtggcgtgatctcggctcaccgcaacttccgcctcccgcattcaagcgattctcctccctcggcctcctgagtagctgggattacaggcatgcgccaccacgcccggctacttttgtatttttagtagagacggggtttctccatgttggtcaggctggtcttgaactcctgacctcaggtgatccgcccgcttcagcctcccaaagtgctgggattacaggcatgagccactgcacatggcctactttaatatatttctttttttttttttttttttcaggcggagtctcgctttgtcgcccaggctggagtgcagtggcatgatctccgctcgctgcaagctccgcctcctgggttcacgctattctcctgcctcagccccctgagtagctggtactactggcaccctccaccatgcccggctaacttttttttttttttttttttgagacggagtctcgctctgtcgcccaggctggagtgcagtggcgggatctcggctcactgcaagctccacctcccgggttcacgccattctcctgcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccactgcacttggcctactttaatatatttctaacacttaatgttttaatttcccattactagtaagcctggatgttattacgtgttttgatttactgtttgtgttttctatgtataaaatacggttttttggctgggtgcaatggctctcgcctgtaatcccagcactttgggaggccgaagtgggtggatcacttgagatcaggagtttgagaccagtctggccaacatggtgaaacctgtctgtactaaaaatctaaaaattagctgggagtggtggcggcacctgtaattctagctactcggaaggctgaagcaggagaatcgcttgaacctgggaggtggaggttgcagtgagccgagatcgtgccactgcactccagcctgggtgacagagtgacatgctgtctcaaaaaatatatatatatatacgtgtatatatatatatgtgtatatatatatgtatatatatgtatgtatatatatacgtatatatatgtatatatatgtatgtatatatatacgtatatatatgtatgtatatatatatgtatgtatatatatatatatttcgattttttaaattattttctgctttgctaaacgtttttgctttatatatttaacacatccttctctgcataggtataaattttatcttttccataacttggatagttttcttctgggtttttttttttgagacatagtcttcctctgtcaccaggctggagtgcagtggcatcatcttggctcactgtaacctctgcctcctgggttcaaagccattctcctggctcagcctcccgagtagctgggatcacaggtgcccaccaccacacccagctaatttttgtatttttagtagagatggggtttcaccatgttggtcaggatggtctcgatctcctgaccttgtgatccacccgcctcggtctcccaaagtgctaggattacaggcgtgagccaccacgcccggcctcttctgttttcttctaatatttttgtttggtttctgtttaatgatttgacttgtatatgatacagagtgagaatgaatctcatggttttctagattttttttttttgtacttcttttttcttttttttgagagacaagagtctcactctgtcacccaggctggggtgcagtggcgcagcttccgagatttctaatgttcattgttaactagtggctttttcccattattatcttattcccattatgtcctttctggtttgtcttagagttttataataggttaaatttatttctggaaccttaaatatattacattgataggtttatttctttctttgtttttcttctaacataaattttgaccactggtgctttataaaatttttttgagacagaatctcgcactgtcacctgggctggagtgcagtggcgcagtcatggctcactgcaacctctgcctcctggattcaagcgattctacctcagcctccccagtagctggaattacaggtgcctgccaccacgcccagctaattttttgtatttttagtagagacgaggtttcaccatgttggccaggctggtctcaaactcctgacctcgtgattcacccacctcggcctcccagaatgctgggattacaggcgtgagccaccgtgcccagccaagactttttactctatttttatttttattttttatttttttattttaattttttatttatttttaagacggagtcttgctctgttgcccaggctggagtgcaatggtgtgatttcagctgcctgcaacctccgcctcccgggttcaagcgattctcctgcctcagccccctgagtagctgggattacaggcgtgcaccaccatgctcagctaatgtttatatttttagtagaaacggagtttcaccatgttggtcaggctggtctcaaactcctgaccccgtgatccacccacctcagcctcccaaagtgctgggattacaggcacgagccaccgcacctggcctttattttttattttattatttttatttattattttttttctttttcgagatggagtcttgctctgtcacccagcctggagtgcagtggcatgatctcagctccctgcaacctctgcctcccaggttcaagcaattcttctgccttagcctcccgagtagctgggattacaggcatgtgctaccatgcccatctaatttttgtatttttagtagagatggggtttcaccatgttggccaggctggtctcgaactcttgacctcaggtgatctgcctgcctcagcctcccgaagtgctgggattacaggagtgagccactgggcctggcatatttttatttttgaaagacgggttcttgctctgctgcccaggctggagtgcagaggtttgatcatagctcactgcagccttgatctcctagactgaagggatcctcctgcctcagtctcccgagtagttgagagtatgggctcgtgacaccgcgcccagttgattttttaaatttttagtagagataggatcttgctgtgttgcccaggcttgtaaggtatttaaaaatctgataggataagcctactgttgttacatttcaagatacgtgtatttggtatttaagcttgcttattctagatgaattctgatctgaatctgtcaggttctaaaaaaaaattctacaggaattaaatgtgtttttctccttctctatctggaattttaagttagttttatattgaagccttgtcttttcttgggaagctatttctttcctgttatttttatctttttttcccaccctattaggtatttatcttttttctgggttttttttttttttttttgagacagagtctcgctctgtcgcccaggctggagtgcagtggggcgatctcggctcactgccagctccgcctcctgggttcacgccattctcctgcctcagcctcccgagtagctgggactacaggcgcccgccaccacacccggctaattttcttgtatttttagtagagatggggtttcgccgtgttagccaggatggtctcaatctcctgacctcgtgatgcgccctcctcggcctctcaaagtgctggtattaacaggtgtgagccaccacgcctgagtgctgttaattttttttcccttatagcctgcagcttttctcaattcacttattgtggtattttgttgacattattgatttcctaggatgatactcatgctttctacagagctgctttttatttcttcctttctcatatatgattagtctaattggtttttcctcagtattgattgtcagcctttccagccttgtatcatgtggaaagagaggctggggatgccttttgatgttttggttttaaaagagctgactctagcccttcactaagtataatgttggtgcttcgtaattttacgataaattatttaaaaataatatctttatcatgcataagcagcttttaaaacaaatacttggcttaagtcaaaaaactatgcagttcactttctccttgtaacatttctaaatttcatccacatctgaataatccttgtcttatttggaagaaatatttttttcctgaaaacattctttagtgtcagaaccatttgtgattatagtggttttacccctgccctactgagcgcatttgttgtaacccttagcgtgcatcttcactctgtggtacactcagatgtaaatcttccagaggctgatgggtgcttgatagtggcctttccttcaccaggaattgctctgatttctagtgaagtaaaataaccttccataaaagcatgaaaagtgtctggtcccaggtttcagtcctaactcagttttcaccttccaggttctaagtgcacattgaattttcttcctagacagtactcaaaaggctggggacagttgacatttctgtttgagtgaaaggcactctcatcccatgaatgtgtttttcttgggatttccgctattaatttttttttttttttttttttgagatggagtcttgtcccccaggctagaatgcagtggtgcgatcttggctcactgcaacctctgcctcccaggttcaagcaattctcgtgcctcaccctcctgagtagctgggataaccagcgcctgccaccatgcccagctaatttttgtatttttagtagagatggggtttcaccatgttgcccaggctggtctcgaactcctgacctcaagtgatccgcccaccttggccccccaaagtactgggattataggcatgagccaccgtgcctggcctttttttttttttaattttgaaatgattgtagagtcataggaagttacaaaaatagtaccaggaaaccctgtgaacccgtcacggagtctctaccagtggtgacaccttgtgggatttccatttttgaggcttctaaggacagccctggctttttcagcatgtctttttagcatcttcattacagtcacagtctttttttttttttagatagagtcttgctctgttgccaggctggagttcagtggcacgatctccgttcactgcagcctccgcctcccgggttcaaggattcttctaccccagcctcccgagtagctgggattagaggctggcgctgccacacctggctaatttttgtatttttagtagagaggggtttcaccttgttggccaggatggtctcgatctcctgatctcatgatccgcccaccttggcctcccaaagtgctgggattacaggtgtgagccaccgcgcccggcctgcagtcacagtctttagtccatgctatgcttgtgcagtaatttccccagctaggagacaggacgaggtgacaaggtggttctttttttaaaaaataggtttagggggtacaagtgccatttccttacatgtatatattatgtaatggtgaagtctgggattttgcagtacccattgcccaaatagtgaacatagtacccagtaggtaacttttcaggcctcatacccctcccatccttccacattctggagcctccagtgtctgttttgttcgttgttgttttttgtttttcgagacagagtctctgtcgcccaggctggagtgcagtggtgccatcgtggctcactgcaacctttgcctcctgggttcaagtgattctcctgcctcagcctcccaagtagctgggattacaggtacccaccaccacgcccagctagtttttgtatttttagtagagatggggtttcaccctgttgaccaggctggtcttgaactccaacctcaggtgatccccctgcctcggcctcccaaagtgctgggattacaggcgtgagccaccgcgcctggcccctgtgtctgttactccattctgcatgtccatgttttaccccttgctcagctcccatggtgacgagattcttgtccttgttttgccattttcttttttccctgagcaaggcatttaattcatctcagccttaatttctcctctgtaaaatgagggattcagtcacacatactttgatttttctttttctaaagtgtgattgcttagctgaaagcctagccactagattggaagaagtcattgattagcacttgtctgagcagtgtgccctggttcttttcctccctaccttgcaaggaacaaacagcaatttaaaaactgaactgtcatttatgctcatttcaaagacacatagaatgataagagcaatatggagttgacggatttggagctggcaattacacagaataccagtaatgtggaaaaatgcaaaggcctatagaacgacttcctatccctagcaaaaattcacacagaatcctgtcccctgcacgttttaagtggaaaagaatgaccccagaaagttgatttaaaactaataaagctgtttattatcattaatgataatttctgtataattgtcacggagagcttatgcatgaatctgtaacttgtcgttattatggtcttcactagaaattgcatgtcttttttaatttctgaaataaattattgggatgaagagcactgtcagtttttgtattaaagtgtttcagtagagcgtggccgaatatttgacatgatgaatctgaatgaaatgatcagagctatgtgaggaatatggttctacgctggatgttttgtggacaaaacagaaaaaaaatcccagcctagaagcattattgaaattgcatcgaggaaaaactataatctgggggtcatactgtcactctgagagaactactatgttctgtctcgctttctcatcagaggaaatccttgtaccagtaccactcaaattctctgttctccgactcctggcttcaagcgattctgcctcagcatcccaagtagctgggattacaggcacatgccaccacacccagcaaattctccattctatacaactttttttttttttttttttttttgagacagagtctcgctctgttgcccaggctggagtgcagtggtgtgatctcggctcactgcaaccaccgcctcccaggttctcctgcctcagtctcccaagtagcttggattacaggcatgtgccaccacacctggctgattttgtatatttagtagagatggggtctcaccatgttggtcaggctggtcttgaactcctgacctcaggtgatccgcccaccttggcctctcaaagtgctgggattacaggcatgagccacggtgcccggccttttttttttttttttttttttgtatttttagtagaaacgggatttcactatgttggccaggctggtctcaaactcctgacctcaagtgatccgcctgcgtcagcctcccaaagtgctaggattacaggcatgagccaccatgcctggccctatacaacttttcaaattctctctctctttttttttttttttttgagatggagtctcactgtgtcgcccaggctagaatgcagtggtgttatcttagctcactgcaacctctgcctcctgggttggagcaattctcctgcctcagcctcctgagtagctgggattacaggtgtgcaccaccatgcctgcttaatttttgtatttttagtagagacagggtttcgccatgttggccaggctggtcttgaactcctgacctcaggtgatccacccacctcggcctctcagagtgctgagattataggtgggagccactgcacctggccaattctctcttatttatttatttattttttttgagacagagtctcactctgtcacccaggctggaatgcagtgggcatgatctcggctcactgcaacctccgcctcctaggttcaagcgattttcctgcctcaggctcccaaatagctgggactactggctggcgccaccacgttcagctgatttttgtatttttagtagagtcagggctttgccatgttggccaggctggtctcgaactcctgacttaaggtgatctgaccgccttggcctcccaaagtgctgagattgtaggcatgatccactgcactggcctctcaaattttctttatttcctttgatttaattcctgggcgaggatcctctgccttgcacgtgtggttttgtgctgcattggctttggaatcagtaaccaatccctgtcctcgtactccttgccgactcaggaaaaatggaaattaacaagagctataaagtaatacagaaagggacagtgctcccatctatgattaagtgcacgcaactaattcatacttaaggtttttttgtctccttcccttgctctatttaaattgctgattctctcacacctgatgactcttctctcaaatgcccatccttgatatttcctcgaagttttgtgcaccgagggcggcctgagcctctggatcttcacttgggcatgttcctgcccaccttgcttcaccaggcaactgcggagcagcaggagcgcttcttcatgcccgcctggaacttggagatcattggcacttatgcccagacagagatgggtcatggtatggagtattcagtctaccttctgggttgggcgggcccctgtgagcttaccatgtgtggagtgcccaccatgtgccatcgatggtgtgtcgatgttctatggtctgtttaaatgagctctttctgcagagtccaggttttggtataaacactgctttggtgagtgggaattaaagaccatgatactgataaaatgattgtcctttttataccatagttccccttcagagggtcaagaattgcaaatcaggccttatttaccaagtggtttttcaatgttactgaggttgtatagaatctgtgtgcatatacaacccgaagctgtttttttcttcattactatctgattacctttactactgataccttaatgagtacaaattccagaagaaatacaaataatagtttgtgtactcttggatttgcttgagggaaatgagtagcttataactgacgtgtgtgacattttggagttatttgtactttgagtcaatcagtagttctgcaagtgacttggctggagagtgaaaaaaccaagataagccgaacttgcaggcatttggtttcagactctgtatctccacctttcattgatctttccaccccccacctgctttcttcatgcacctgggtgggctggaggtggccgctgttcctctttgtatcttctctgaattgggtccgtgtttgccattcatttgcttatggcttctctttttctgctctgacgtttcagaaaaactggtctagtgtgtatttgccacttgctccttatttctatacagctgctgctttttatttggtgttgaatagtattttacaggattttcatgagactccaagtggaatactatttgtttcagttgtgcttttgaaaacattttgtccttatctgttctgtttaatgttatctgcttttctgtaaaagctgcttctttgatgaaagatgtctgtgtctgatttgttgactcccactcgggaaagttgtggattgcacataagttggttattcaacttggaagcttctaaatgtttcaaagtgtgtttaatgaggtctaagcgttatgaaagcagattggtaaaaggttcccaacgtttgctttagtacagtatttttgtagagactgccacctagaacatttttctatgactcttttcaaataattttgatatatttgtgttaagatttaaaacataagatcctgtctatcccagtacacataagaaactggaaactcttccttgccacattaatgaaccagcaggactaagttaggcctgccattggaaatctctagggtcaactgagaccttattattggacctttaggaatttttaaaagtcacatttcaggtcatttccccaataacagttatacttttatactttttttttttttttttttgagacggagtcgtgctctgtcgcccaggctggagtgcagtggcgcgatctcagctcactgcaagctccaccttccgggttcacgccattctcctgcctcagcctcccgagtagctgggactacaggcacccaccaccatgcccagctaattttttgtatttttagtagagacggggtttcgccgtgttaaccaggatggtctcgatctcctgactttgtgatccgcccgccttggccccccaaagtgctgggattacaggcgtgagccaccgtgcccagctttaatttttttgttgtttttttagtagagacggggtttcaccactttagccaggatggtctcaatctcctgacctcgtgatccccccacctcggcctcccaaagtgctgggattacaggcttgagccactgtgcctggcctttttctttttctttttcttttttttttttttttgagatggagtcttgctctgccacccaggctggagtgcggtggcacaatcttggctcactgcaacctccacctcccgggttcaagcaattctcctgcctcagcctccttagtagctgggactacaggcgcatgccacaatgcctggctaattttttgtatttttagtagagacgggtttcaccatgttagccaggatggactcgatctcctgacctcgtgatccacccgcctcggcctcctaaagtgctgggattacaggcatgagccaccacgcacagccatacatttttaatttatacgaattttggctgaaatgtcttcctctcacatgttatctcattcttctcattagtacagaattcaagaatgttgaattggtgtggttaacacaatacatatgacttgaaattggcatacttgcaactcagagatgggtttaaaaagacagttaacatccctgttaaattcatatattgtgatcttaaaaatgtgattctaagttgcctttatattttctttcagttgctgtaaataaatgtaacaaatcaaatacagaaatggaacatgcatgacacttagattttcaacttaataggaaaccatcagatagtgtgggaaattcagtgtcttggttatcaaccagttgtagctcatctacaggtgttttttgttagattttgtttttctctgagatatgagagtttaaaggactgtgcaggaaatttttccttgtgcctatttttttccccatctcttaactgaagtcaatgtaatttatctccttaggaactcaccttcgaggcttggaaaccacagccacgtatgaccctgaaacccaggagttcattctcaacagtcctactgtgacctccattaaatggtggcctggtgggcgtaagtgaatttttcagcatttattggatgttttgaaggtttgtcatgagattttgcttagaatgtagagcttttatgataatgtcggccagacttggtggtgaaatcctaacactttgggaggctgaggtgggcagatcacttgaggtcaggaattcaagaccagcctggttaatatgctgaaaccccatctctactaaaaatacaaaaattagccgggtgtggtggcgcacacctgtagtcccagctacttgggaggctgaggcaggagaatcacttgaacccgggaaggttgcaatgagccaagattgcaccattgcactccagcctgggcatcacagcaagactttgtctcaaaaacaacccaacaaacaaatatatgtgtgtgtggtgtgtgtacatagaggggtgtgtgtgtgtgtatatagacagagagaggtgtgtgtgtgtatatatatatatatatatatatatatatatatatatagagagagagagagagagagagagagagagagagagagagagagagagagagagagagagaggaaagccaggcatagcggcacatacctatagacctatagtcctggctactcaggaggctgaggtgggaggaccacttgagcccaagagttcaagcctgcagtgagctactatctgtgatcatgccactgcactccagcctgggtgacagagtgaaaccctgtctcttaaaaaaaaaaaagaaaaaaatttaaatagttttaacacaaacttttttttttttttgagatggagtctcactgtgtcacccaggttggagtacagtggtgtgatctccgctcactgcaacctccaccttctgggttcaagcgattctcctgcctcagcctcctgagtagctgggactacaggagcgtgccaccacacccaactaatttttgtatttttagtagagatgggatttcatcatgttggccaggctggtctcaaactcctgacctctggtctgcccgcctcggcctcccaaagtgctggaattacaggcgcgagccaccgtgcccggctgacccgaaacttttatatcttcttattccattctgagttattatcttggaatatatatttccaatacagttagtggttgaaggattttgttattcacattatatattttatttatttataatttatatgtaagaagccacatgtagctagtgattactgttttggacagcactgccttaagggataacaaggaagtagtttaaattaatattcttatttttatcctaaaattttctctacgtaaatgtatgagaaataagtagaaaagaaagtaataactattagcttaagggaatttctttctgaaagctaggtgtgatgctgtcagcagaaaggctttctggacacatactattggtttagtctagtgttagatttaacatattctttcttcttttttctaccctttaaaaatgtatgaacgtttgcccacccctcccttgttctctttgatattacagttggaaagacttcaaatcatgcaatagttcttgcccagctcatcactaaggggaaatgctatggattacatgcctttatcgtacctattcgtgaaatcgggacccataagcctttgccaggtaagaactgttcatctgatgttgagatgaaaatgaaactgagcactttcttctgcaaaaggtagaatgcccaactgaagaggcggagcaaaagccagaaattccagagcataaacatctcgtgactgtcctttcatctgtggtaggaattaccgttggtgacatcggccccaaatttggttatgatgagatagacaatggctacctcaaaatggacaaccatcgtattcccagagaaaacatgctgatgaagtatgcccaggtatgttttgatagaaaataaagcagaggcatcaaacagtggagttgagtggctgttactcacaatagggttagaatggtctgttcttttagaaggtaataacagcagggcacactggcatattcctgttatcccagcactttgggaggctgagtgcgtggatgacttgagcccaggagctcaagatcagtctgggcaacatagtgagaacccatctctacaaaaagtaaaaaaatctagctgggtatggtggcacacgtgtgtagtcccagctacttgggagactggggtgggaggatcacttgagcctgggaggccgaggctacagtgagctgtgattatgccaccgtactccagcctagatgacagtgagaccttgtctcaaaaaaaaaaaggaggctgggcgcagtggctcacacctgtaattccagcacttttgggaggctgaggcgggaagatcatgaggtcaagagatggagaccatcctggccaacatggtgaaaccccatctctactaaaaataccaaaaaattagctgggcgtggtggtgcgcacctgtagtcccagctactcaggaggctgaggcaggagaatagcttgaacccgggaggcggaggttgcagtgagcagagatcatgacactgcactccagcttggcaacagagtgagactccgtctcataaaaggagggaataaggctgggcgcggtggctcatgcctgtagtcccagcactttgggaggccaaggaggatggatcataaggtcaggaattcaagaccagcctgaccaatatggtgaaaacctgtctctactaaaaatacaaagattagccgggtgtgatggcacacgcctgtaatctcagctactcaggaggctgaggcaggagaatcgcttgaacccaggaggcagaggttgcagtaagtcgagatcacaccactgcactccagcctaggcaatacagcgagactctgtctcaaaaaaaaaaaaaaaaaaaaaggagctaataatgcatttttccttctgatgccccttttttttttttttgagagagagagtctctgtcacccatgctggagtgcagtggcgtgatcttggctcactgcaacctccgcctcctgggttcaagcgattctcctgcctcagcctcccaagtagctgggattacaggcatgcgccaccacacccagctaattgttttgtatttttagtagaggtggggtttcaccctgttggccaggctggtctcaaactcctgacctcaggggaccctcttgcctcggcctcccaaagtgctaggattacaggcatgagccaccgcacccagcattttttggtttttttttttttttgagacagagtcttgctctgtcacccaggctggagtgcagtggcgcaatctcagctcactgaaacctccgcctcccaggttcaagcgattctcctgtctcagctcctgagtagctgggattacaggcacgtgccaccacacgcagctaatttttgtatttttagtagagatggggtttcaccatgttggtcaggctggtctcgaattcctgacctcttgatctgtctgccttggcctcccaaagtgctgggattacaggcgtgagccatcacgcccactctgatgcttcttttactgcgacagtgaaatcagaaacagttgtcagggttgaaggacatattttgatttgctaaaccaatgattctcaaacttttgcatgcgttagaatcacctggaaggccagttaaagcccaggttgctaggccctaccctggagtttctgattcagttggtcagggtggggactaagatgtagtatttcatgcaagttgccaggtgatgctgatgctgctattccagggaccacactttgagaaccactgaactgcctcttgggcttaaaagaaggaagtatcagttccacgttcttcttccaggtgaagcctgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatcaagccagggtaaggatagggtcctagatgggctcagtaccaaaggcctagtttttaccccattcagatcccagaattcccaaatgtcaatacagaagatgcattagcactgcaaaattggctagggtgataactgggcctgtaatttcatatctaggcttccttttcttaagaggaaagacagaaataaccacccttgctataatcagtgactgccaaaaaagaaaaaaagagaatacccaccttattatttttaactttttaagaaaaatagtaataatattacttgaactttataagtgaaatgttcaacacactaaaggcagtttgaaagttctgattactactagcaactgtaaattgtgcatggtgaaagtgacattaaatttgtttcccttttgcattcatagccacagtttattcctacaactgcctttcactgatactccctgatactctttttactcctaaggaataaagaaactggccaggtgtggtagctgacacctgtaatcccagcactttgggaggctaaggcaagaagattacttgagcctaggagtttgaggccaacttgagcaacatagtgagaccctgtctctattttcttttcttttttttttttttttgagatggattctcactctgttgcccagactggagtgcagtggcgcgatctcagcttgctgcagtctctgccaccctgggttcaagtgattctcctgtctcagcctcctgagtagctgggattacaggtgcacgccaccatgcccagctaatttttgtatttttagtagagacggaatttcgccatgttggccaggctggtctattttcaaaaaaattaaaagttaattaaattttaaggccaggcgcagtggctcacgcctgtaatctcagcactttgggaggccaaagcgggtggatcacttgaagtcaggagttcaagaccagcctggccaacatggagaaaccccacgtctactaaaatacaaaaattagctgggtgtggtggcgggtgcctgtaattccagctactcgggagactgaggcaggagaatcacttgaacccaggaagtggaggttgtagtgagccgaaatcacaacactgcactccatcctgggtgttagagacttcatctcaaaaaataataataataattacatttttaaaaaggaataaaggaattgatacaatgagacccttgctaattcttacacttcaaaatatttaacaccatccattgggtcttctccaagattgtggtcaaaatacaatgtattcagccatctggtgagtagagctttttggcattgccttcttattaggttgactagcgttggttttgtatgttgctatgagctacggttttcttagtcatactggaaagactaggacagatatggactttgcagccagaaaattctgtcagcctacgcagtacaaggtaattacagcatggtcttagggagccaaatagcctaggcaccgtggctcatgcctgtaatcccaccactgtgggaggctgaggcaagagaatcgcttgaacttgggaggcggagcttgcagtgagccaagatcgcaccactgcactaaagcctgggtgacagagggagactccatcacaaaaaaaaaaaaaaaaaaaaaaaagcctcaatttaaatctaagacctgccacatacgagctgtgtgacctcaggcagattcttaacctctcagtttcccatttgtaaaatggagatagtaatagtaactacctcacagtgcccttaagaggactaaataagttaaaataccaagtgcttagattagaacctggcatatagaaagttctgtataaacatttacttactactttttttctttttctatgtcacgtagtgaaccagaaccacagattttggattttcaaacccagcagtataaactctttccactcctggccactgcctatgccttccagtttgtgggcgcatacatgaaggagacctatcaccggattaacgaaggcattggtcaaggggacctgagtgaactgcctgaggtatgagtttggtctcattcactcatgggcacccttctgtttcgtggttgcctgttggatgaggtccagagataactaaatgttggtatttcctgaaaagaagtatgtattctgagaacttcttctggttgaaagtagatcagatatgaagatctgtggggtttgttgttcagtatttttagtgttatcagaaatactgtaccatgttgattatttgtcaatcaaggaaatgtaagtggtgaatgtttagccaagtagaacagcttagatgggcatgggtagtgttctgtattcttctggccagtcggacagctgtgcttcttcagtttgcatgtgtggcagctgtgttttgacagtggccaagatgttagaggaggggtgtgttttctcattggttctcgggctctcagcaccacagatgtcctgacagatctgtgcttgtcctctcagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggtgagagtcaaatcctcgattcctcccatctgttcataagaatgttctagtccttttcctaggttcttgttcccatggtttttcttcaccgtatatatatatttgttcctgaaaggtatacttttgccttccatcctgactcacggtttttatttcgtggtgaggctagagagtatgaagcacctgttacatagcttgcagttgtatcaaggatagagttactgggctgggcacagtggctcatgactgtaatcccagcactttgggaagctgaggtgggcagatcatgaggtaaggagttcaagaccagcttgatcaacatggtgaaaccgtgtctctactaaaaaaatacaaaaaaattagccgggcatgatggcacattgcctgtaatcccggcctacttgggaggctgaggcagaagaatcgcttgaacctgggaagcggaggttgcagtgagccaagattgcgctattgcactccatcctgggcaacaagagcgaaaactccatcaaaaaaaaaaaggccaggtgtggtggcttactcctgtaatcccagcactttgggacgccaagccgggtagatcacttgaggtcaggagttaagagaccagcctggccaacatggtaaaaccctgtctctactaaaaaaacaaaatattaaaaattagccaggaatggtggcaggtgcctgtagtcccagctacttgggaggctgaggcaggagaatcattcatttgaacccaagaggaggaggttgcagtgagctgagatctggccattgcactccatccagcctaggcaacaagaatgaaactccatctcaaaagaaacaaaagaaagtagagttactaaaagcatgtttactggtgacttttaggttcctgatgaaaagttatgatcaggtgcactcaggaaagttggtgtgtggcatggtgtcctatttgaacgacctgcccagtcagcgcatccagccacagcaggtagcagtctggccaaccatggtggatatcaacagccccgaaagcctaaccgaagcatataaactccgtgcagccaggtgagctctccctcaagagctagaatacgcagcagtggggctggggccctgacagatggcaagaaggcatgagtactgttgatcatttcctcagacctccaatctatgtcttaacagattagtagaaattgctgcaaaaaaccttcaaaaagaagtgattcacagaaaaagcaaggaggtagcttggaacctaacttctgttgaccttgttcgagcaagtgaggtcagtggtagttctctctttttccccttccctgccctcagcatcccgcattttctggtacagaaaccctagtcactgtatattgaatctttttccaaggttctcaaactctggtgttttctttttaatcttaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggtcagtattttctaagtataagtcttttttgttgttgttttaagaaaaataattgttggctgggcacggtggctcatgcctgtaatcccagcactttgggagcccaaggcgggtacggtgatcacttgaggtcaggagttcaagaccagcctggcctggtgaaaccctgtctctactaaaaatacaaaaattagccaggtgcagtggcacatgcctgtaatcccagctactagggaggctgaggcacgagaatcatttgaaccctggaggcagaggttgcagtgagccaagatgaaaccactgcattccagcctgggtgacagagcaatactctgtctcaaaaaaaaaaaaaaagaaaaagaaaaatagccaggcacagtggctcatgcctgtaatcccaacactttggccaaggcgggcagatcacctgaggtcgggagttcgagaccagcctgaccaacatggagaaaccccatctctactaaaaatacaaaattagccaggtgtgctggcgcatgcctgtaattccagctatttgggaggccaagggaggagaattgcttgaacctgggaggcggagattgcggtgagccaagatcacaccattgtactccagcctgggcaacaagagtgaaactcagtctcaaaaaaaaaaaaagaaaaaaataattgtcatccgctttatagctgtatatgcatataattatgtctatctatatacatatatatgttttatttacttattttggtctcttttaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagaggtaaaaatccagtgtctctgcacctttttaaaagtcttcacttaaatattgaagcaggaaaggcctctcgaaggggatttatctgtgaaagctctgaaagtaccatggccacttctgacagtcactttatttgagcaacaggttcagaagggaactgggttgttcccacagtaaccagggtcttaatcaatttcaatttttgataacgaattgaacatttaaaaatatatacaggccgggtgcgttggctcacacctgtaatcccagcactgtgggaggccgagtgggcagatcacctgaggtcaggagttcgagactagcctggctaaaatggcgaaacccaatctctactaaaaatacaaaaaaagcagccaggcagtaatggtgcacggctgtagtcccagctactcgggaattctcctgcctcagcttgaacccaggagaacccaggaggcggaggttgcagtgagccacgttcgtgccattgcactccagcctgggtgacaagagcaaaactctgtctcaaaaaaaaaaaaaaagtatacacacacacacacacacacaaatagaataaaatatacaaaaagagaattccgtagtgctctttggtacaccctttgtctagcagcaatgactatcaactcgtggctagttgtgtttcatctgaaccttcatccccctcctcctggggactattttgaaataaatctaagacatcagggccaggctcagtgatgcacacctgggaggccgaggcaggtggatcacctgaggtcgggagtttgagaccagcctgaccaacatggagaaaccttgtttctactaaaaatacaaaattagccaggcgtggtggcgcatgcctgtaatcccagctacttgggaggctgagacaggagaattgcttgagcctgggaggcggaggttgcggtgagccgagaccatgccattgcactccagcctgggcaacaagagcgaggctccgtttcaaaaaaaaaaaaaaaactaagacatcagataattttatccataaataattcaatgcatagctctaaaagataaggactcttcagaaacaaccacaggctgggcacagtggctcacgcctgtaatcctagcactttgggaggctgaggtgggtggatcacttgaattgaggagttctagaccagcctggccaacatggtaaacccccatctctacaaaaaaatacaaatagcagccaggtgtcatggcacacacctgtagttctagcaactcgggaggctaaggtgggaagatcgctggagtctgggaggcagaggctgtagtgagccaagattgtgccactgcactccagcctgagcaacagagcaggactcagtctcaaaaaaaaaacaaaaacaaaaacaaaaaacagtatactatttaacatggcaaactctttattagtagttcttctctctcctttccccacaggtccacgaatcttacaagcacctgaagtcactgcagtccaagctctgaagtgtcacaaggacaagtttaatctgcttcagaaagcgcctgtgtgcaactcaaattttgtggaatctttttcgaattcaaatagctatagagcaaatgataaattgacccctttttataaatggagggaaaaaatgaacagatttcagagattaaatgaaaaaaagcagatgttttaagtgcaattaacactgaaagagacctgttaaaccattcagaaaaagcttaagaaatgcgatatgacttccttttgtaatgctgctgatcccagtagactatgacttttgataattagcagaatttaactactgagtagttgattattttcacattttaattgctaatcactggctatataagtgtttttaagcaaaggtatttttgaagtggtgtagaacccttccaagctttcctgctcagtgttctaccagacttaccctggggcctggcttaaaagcaggattgaagaaaagggactgggggaaggaaacttattggaaaacttgatgcgaatgagtttctgcttggcacagtctctgcctgcttgctctcctttgctgatggattgcatttatcaaactattcatgctagcatttttccaacgagggaacttattccgcacgggcctactgtaggaccattgtctcgtgtaattaggaattttccatttgaaggattgctaaattgtcacagtagtaggaagtatagggaaacctctcagctgtggcactgttgtagctttggagtgcagagtgtaactctgggacaatcagatttcacatattctgtcatcttggcataagccattaaaagcttggagattactgtatttggcattaaaaaaaaatgtcacttaggtcagcactcccagacgtagcacagaaaaaccctttgacacaaaccatgtgttctgatttttggttcagaaaatattgaaactgtgagttgttttttttttaacaactgggaaaaaacaaaaacaaaaaactatagttagaaaaatggaagttccataggttctatttcttactctatgtatggctttgttttcagtctatttctaggagctttctctgaatcgctaattgtcctttcagttgaaatctaatttatacaatcattctatacttaaaggttaaatacatcttaattaattttttcttaaagtcaatgtaagtcactttgttttgtttttttttaatctacgccatatgcctcatgaaaccagctgttctagaatcagtcctgagaatatggcttaattccatggaaacataactcctatcttgggacctgacataatatctatctatcctggggaactggtaatatgagacttataggttacagcagaaatgctacatgttgacaaaagccttaatcgttccactgggagaactaattgataattgtgttaagattgaagattaaccctgtgttaatctcacttgagtctatcctgacagtagttcagattctggaaaatgataaactgacctgctagatgtagaattgtttcaaaattagtgttgaaataccttgttcacagatgaatatctgggcaggatctgagggtgtttggaatgacaccccccaatccagttgcatagatgggatgtctttgcaggtttgaggagatcatcgacctgcagagccccctttgacccagtacctcacgttttatttaaaatctaaatctggggccaggcgtggtggctcacgcctgtaatccaagcactttgggaggccgaagcgggtggatcacctgaggtcaggagtttgagaccatcctggccaacatggtgaaaccccgtctctactgaaaaaaatacaaaaattagctgggcatggtggtagcacgcgcctgtagtcccagctactcgggaggctgaggcaggataatcgcttgaacttggcgggtagaggttgcagtgagccaagatggtgccactacactgcagcctgggtggctgagcgagactccgtctcaaaaaaaaaatctaaatctgacatttgatgctatttttattaatattggaatgttctgtcttgaactttattcaatataatcaagaataaagatagagtaaacgtcactgatttgtactattaagagagaaaaaatatgccacacaactaaacataggtttaaattatgaagaaatttagaatagaggtttattagatttagggaacactaagaacaaaaaaggaaggagtgatacctgcctgagtggacagctgtaaatcagctgtaattactgcagttgtaccaatagttgtgagtggctccagtcactttaggagtccttggaagtacttggtacacatttgttggctgtaccttaaaggaagtggcaagtccagtttgttctctctaccacactagactgccactgacaagtttgggtctgttggattcaaaattttgtaagccattttcacaagtacaaagatacattttaaccttgtcttctccaaaattactgagtaggaattttatttttatctttttgagacagggtatcactgtcacccagactggagtgcagtggtgggatcttggcttactgtgacctctgcctcccgggttcaaatggtcctccctcctcagtctcctgagtagctgggacgacaggcacgtgccaccatgcccagctaatttgttctattttttctgtagagacggggttttgccatgttgcccaggctggtctcagactcctgggctcaagcgatcatttcgcctcagcctcccaaagtgctgagattataggtgtgagccacagcatctggcccagagtgaggagaattaatgagattttttgtgtgtgttagataatattgatttaagcctttttttaaaaagtactctcaaccaaatacaaaattgaaaatgtgaggtttaatagaaatgtgttggctatttgcaatggattttcttcttgcccaagtgtttggagttctactttatgctctgtatttaaaaattagtgacctcaaagcagagttgatgacacaggctttggggccctcatgttcttgtctttagaacatatcactactaagtatcagcttatcttcagaacattacaacattcaccgtgttcatatgctttctgagaagtcaccacttgtaatttcagatcacatacacctgaaggcattttatagttcctaaagttaacatgttagatcttttttttccaccccatgagggtctcactctcacccaggctggaatgcagtggtgtgattgtagcacactttggccaccaactcctgggctcaagtgatcctcctgctttggcctcctctgagaagctgggattactggtgcacaccaccacacctggctaattttttatttttttttatttttggaaatagggtatggctatgttgccttgggcccgtcatgaactcctagcctcaggtgaccctcccacctcaggcctcccaaagggttgggattacaggagtgagctactgcactgggccaacatgttaatttttttttttttttttttgagatggagtctcccaggcgggaatgcaatggtgcgatctcgacttcactgcaatcttcacctcccgggttcgagcgattctcccacctcagcctcctgagtagctgggattacaggcacctgccatcacgctcggctaatttttgtattttgagcagagatggagtttcaccatgttggccaggtgatctgcactcccactccccccacacttcccaaagtgctgggattacaggcataagccacaagccacctcacccagccaacatgttacatcttaattcttggattttcttcactgcagggctttgggtggagaaataaaactcttcaaatgcatgatcttggagatccctgtgaatcaataattctttagacaactgcggctcaaaatccctcctttcccttttccgagttattccatccatcttattagaaaggaagtgaattaggtgtaggtggtctgtaacacctgcacatctttttatacgtgtagagggtatgcctgggatatataggttgtcttcaagcagtagctgctactacagctagagagaggaggagtgccaggaaactgatgacctgagaccaagagtcttgttgatgttctgacttagataaaggttttgatcattttcatgaaataatgcagggaagtcatttctgctgtttctttactactccattcttggaggattagaacaagtcacactgtaattgactaaaacgactttttattttaaaatattgatggtggggttttgcttttttttttttttttttttttgagacgttgtcttgctctttcacccagggtagagtgcagtggcgaaatcttggctcactgcaacctctgcctcccgggttcaagcaattctctgcctcagcctcctgagaagctgggattacagcgcctgccaccatgcctgtctagtttttttgtatttttagtagagacaggggtttcaccaagttggccaggctggtcttgaactcctgacctcgtgatccacccacctcggcctcccaaagtgctgggattacaggcgtgagccaccgtgccgggccagtgtttttaactgtccacacttactaaattttccagtacttcttcctatggttcatgatagtaaacacagaaacatataaggaacattattagagttaccagatgttagctgttgcatatgtgcacattcctagattcaagggtgtttttgccttaaatttaagtgggtcattggttgtcttgggaagatcatggaaaattcgggattttttagaattctgaaccaaaatatgttttgagtgtttcttagtaaatgtgtgatcttccaccttccacattcagactgcggactacacttcataaatgcctttttatttccagttatggattcaactaaatgactgccttgggagcacataattactttgctacctttttccccctttgctgttgtggctcgagtttggttctcacctgagaagatgcattgagcatatgttgttacccagccctggcttaatggtgtcctgtggggtaggggtgggaggacgaggggcacggggccagagcatgtgaatggatcatggttggacagctgtgacctgccagcactgcgggtaagcaaaactacaaaccgttctttcctctgtgacattgaataaaccttaataaaattcataattagcacatactagaaaaaa

SEQ ID NO: 38 - DNA, 18755 bp, Homo sapiens
gggcgccctaacgaacccgggatacggtctgttcctagtccgctccggaaatgcaactgcgtacgggctggccgcgtaatcgtgacgacagcgcgccagcgccggctagccggacgccctaggcttccgcgagatcttcggtgggggtacgggtgttttacgccaggacgctgatgcgtttgggttctcgtctgcagaccctctggacctggtcacgattccataatgtaccacaacagtagtcagaagcggcactggaccttctccagcgaggagcagctggcaagactgcgggctgacgccaaccgcaaattcagatgcaaagccgtggccaacgggaaggtgaggttttcccaacggttgcccagttgcccggtcactaaattctgagcagctgcgggagctcttctggctcccaggacaatctcgctccgtcgtttctctgcctctgcggcgcggagtgcgtttttctatcaaaataagcgagcaccttgccaggttccgtgggtacaaagacgaacaacgccatccccgtcgtcgaatggcagacaagtaaccagtctttgtaacgtagtgaagaagagagtaagtagtgtgctaaggtagtgcgtggcaagagccgttcacttgtcaagagatgatgttggggaaggtttttcccagtagccaatgcggagaaaatgggaaaggaagttccaggcagtcagaaccaccgttcagagtgggagggaggtcagaagttacagagatggtgcgtggacgtgtttgtggtcgtatgtggccgaagttgagtacctgtgcaggaatggctggggagggtaggaagggaacttgtaagtggaagtgaggcgtttaacatttccactgaaaggatgaggaacctttgaaatatttaaaatgggaagctaaccttatcagatttccgttctggaaacagcgctctagcaacctcgtggtgaatgggttggatgagggagggagaccagagaccaagtacaaaccaagtgactgaagatggtttggactatggcccgctagccaagttccttctgttacagctctcggactggtttaatctttcctgcaagctccactccagcaagtgttcagtgcctccaaattaccgatactgagttactttactttctacctttaattcacatctatttcatatcactgattttagcacctgaattagtttcctaagggctgccttaaaaaaatcaccacaaactgggtagcttaaaataacagaaatttattgaaacatttgctgtttttttacaacttgtgacgtaatgactgaccgagaaacggatgttggaagctttccaatcatattttaaaaagtctgtctactttttaatttataaataatgatatcacaactgtgagcatgtgcacacagcctgtcatgattgtttatactttaatgaagcaaaggtctagctgacattccgaaaagtcgtgaaatgatggtacagttttagtttattaaatattttcctacagctattttgtgtaatgattagcgaatctataaagaaaatgaggcgtgatatatacccttcgttggatatataaactaaatttaatctagatagagaaaaatgttttacaattgtttaattcattgaattcattgaacttgtgttgtaattgttgatctaaaggttcttccgaatgatccagtctttcttgagcctcatgaagaaatgacactctgcaaatactatgagaaaaggttattggaattctgttcggtgtttaagccagcaatgccaagatctgttgtggtaagttacagtggtgatgaaatataatgtcctttagttggcttgtgaaatttgacctcttctaaattccctgtccactcaagtcttaaaaattcaccttagttacaattaattagtttttggcacattatatatttttcaatacaggccttaaatcatgagttgctgtatcatatcttcaaaagtatttcaagtctcactttgtggtcagaaaaaaatttgaggtcaggtaatgtcataaagaaagaaaaaaaataaattactttcctctaagttctcaactaatgagccataggactgggactagaacatagactactgcttttccaactctgtgacacccaataaatgtttgaaataatgcattcattcatcattggtaatcatatgccccagctgaaactgataccataagatttttttaagccttgattagtagaagctggagttttatctttggtgaaaaagattgccttattgtttcagatgtatggttctgaggacctatttgttttttgctggggtgggcaaccgtgaggagaaacaggtagctgagattaaaaagcagaaagataaaaaaggtagagtgggagggtgttcaaaatgttgttacgttattctctcactggtttgttgtgaagaccaaatataaaagtatatcttaagtaaaagtctgttaagttttaaagttatacagcgtgactagcttacgacccagtagagaataattttctaggaaattatctccatttttatagttgaaaaaaaaattgaagtatgttgaaaatattaagtccatagaatttacaattttttttcatctgagatgtcaaagattcagagagagttttaggtatacttgattagtttatatcttcagatttggcttgttcttacaaaagaactgtaaaatgaggcagtaaatttaagtgatcttatcaaatgaagaaaaaatcctttaatgaacttctttatggaatttatttttaaataacatgtttatcattggtgaataattttttgttttacataatgacaaaactaaacttttaaaatacttaaaaggaaatattcttttttctatcataaaatagataagtggttatttcattggttccagccaaatgatataatggttaaaagtacaggcaggtcttacttgaattcattcctgttccttattagctgtgtgacctagataagtcagttaacctcattgatactcagtttccttctctgtagagatagtaatacttcaccaagctgttgtaaggattaaaacatgatgatagtttcgtgtttagcacagagtctggcacatggtatacattcaataaatggtagtgctgcttctgccattcagttggcagcagtgatcacaaatcatggaatggatacatggttatatcacaaatatggagtggctttagagagaaggcttattgccttgcccatgtttttttgtcagtatttttataagattggttaatctgtgaacgtttgtatttttcttcctgaatttatctaattcagaacatttttgatagtctgatttctaatacacacacacacacacacacacacacacacacacgtatttttaaatccagtgaccataggaaggattagccagagtaggctggggatagacaagcaaaggatgggaaagaatcttttggctatggcatttctgtagtaattcatcacaatttgttttgattaaagaagaattaatgagtattagtatttttctgggtaatctctacaaagaaacctttccataaataagttctgtttcacaaaatttaacatttaacatttgtgactagatcctgatgatatattttttttaacccttagggtacggcttgtatgtatttcaaacgtttttatcttaataactcagtaatggaatatcaccccaggataataatgtgagtatgtctgtctaatatattgttttcatttaagaagacctttataatcttttgagtattttttgggaggagagaattgtgagagagagagagagagaactgacttcctaatacagggtaatttagacttgaattctatttttttttttttattcagaacttgagatctctgtttacctgtacttcagtaattctgatggtatgtgaacttcagcttgtccagattcaaattttgtttttctcaaattagctacttctctaacatctcttcctattagacacctttgttcttccagttgttcagactgagaatcatttatagtggcccctcccacatccagtcagtttacggatcctatagcttcatactcatttcagttgaacaaaggtctgttgttgctgctctctgctgagcgctgtgtctatcattaaaaatgaaattagtatgaaactcatcaaagagtttgctctcaatgacattgtacctgttttctcttttttgattcccatttccaccagtcaagattaggcccttgatctcactgccaactgttttttacagtagctttcttactgttttctcatactgaacagcatgaagtggccaggtgaatttcacaagtttgtcccttaaataatagtcccttattcagatgcccttagagacttctgccgatggccttccacaatgttcctttaacctacttttcttcccatacttacatggtacatatgtgggtactgctttatttttaactcttccatctacattatacaaagtactcttattcctcagttaatttgtttttccagatatttaggttgtactgcataacactgtcattgagtcagtgatgtttgaatgccatggcaatattggtttgacctaattttatagttgtcttacgtctcctaatgaagtgtgaacaggaagtgtcttttaaaaaacaattcttgcaatgtctagcagtcgcttttgaatattaggcaattatagaatatacttttagaaataaattatttagatacttctcaaagtatatgcatgttcttccaccccacccaccccctgcctcctgcctccttattttttcctctaggctcacttgtgcatttttggcctgcaaagtagatgaattcaatgtatctagtcctcagtttgttggaaacctccgggagagtcctcttggacaggagaaggcacttgaacagatactggaatatgaactacttcttatacagcaacttaatttccaccttattgtccacaatccttacagaccatttgagggcttcctcatcgacttaaaggtaaacttgatgtaaaataaactaatactacattctcctttcctattctttaacaaaagaatccaaaattttaaaactcataatcatcctcgttgttatagcatggatacaacctgtgggtctggcctggtcatctagggcagttgttttcaaacttcagtgggcatcatcagtcatctggagaaattgttaactgagattgttgggtgggacttacagagtttctgatttaagtgatctgcaatctcatttaagtgatcttcattacatccagggatgtaatgaagaccattgagagtttagaacggtgcttactataaaggcttaagataactcttctaactttgaattatattgtcatggatctgggcctgatttaaaccataaaaaattcttaaactagaagattgctaagtgacttatatttttagaggtttgtgaacttaagtcactatgtaggcatcaataatatacgtaaacaaacattgacaaaagcaacttttttaagttgttttgtttggctctaaaagagaagttggatagtctgagtcgaatcaaatcaggaattggttcattcatgttagatcagtggctcaatttgggtaccttctatgtgccaaactttgtgcttgaggatgtaaccagaaataggacaggaacagtctcaacttttgtgaaccttacaatctaaaggttttagacaatcatatatccagtgtgctcaatgatacagaggggaaaatatattttagagggagataacagattaaggggtaaggaaaacattctgagaacgtatcatttaaaataaaattcagagtaggaataggagagagaagaacattccaatcagagacttccctggtaaaaagctcaaattcaagaaaccattccgtgctgaagagcctgaacagagcctagcaatgcagggggaagagatcacagacagctgctgccagagtggaaggcagagtctagactgtggagacaatgttacagattttgaatacagcaaagagaagctagtgaaaggtttaaatttagagagtggcatgattagatttgcagctttaaaagatcatgttggcaaccttatggatcaggtatttatcgcgcatctgtatgtgtcaggcataacgtggagaatggattagaatagattaagtcaataacagggtaccgttaaaggagtccaagcaaaagatagtgctgggcttcactcgtatgaaggttgtggatacagaaagagcttcctgggcttcagagatacaggatgagtatcccttatctaaaaaatttgggactaaaagtacttgggattacactttttttttttttgattttgcaatatttgcattgtgcttactggttgagcatcccaaatccaaaatctgaaatgctccaatgagaatttcctgagtgtcatgtcagtgctcagaaactttcagattttggagcatttcggattttgaattttttggatttgtgatgcttagcctgtagttaggtagaatcaatagaacatgaggattgattgcatatagagatgaagacagaggaagaacccccaggtttctgactgggtgagagtttttttgttgttgtgttttgttttatggaagagactgatgcacatttaaatactgaggcaaagagctagtagtgagagcaagatgaaatacaaaatagtctctttggagtaagatggaagggggttggcatgggatttggaagcaaggtataagaactggccttagagggaataatagctctttctcttaacagtggaaaaggggaaatcatgggttaggatactgttatgcctcaggatttggtgttgacaggaaatagcgcctttctttggtaagagatagttttctgagagtgatggagtttctgagaattatcaaagacattaagacagatggaaaatatttatgcagtcactgaaaaataggagagtcaattgtctgtggaaatactatggttgcttggcagtgtttaagagccttgctgaggtcaatgaacatgagtttatagtaacattaccagacttctgcttgtatggttttctctggcagccctcagaaatcttggtatagttgcaaagcgaaagtttgttggattcaaccactgttcagtttctggttttgccagaaatttgttggcagcatattggggcagggaattcaggagagaaatgaggaccagaggacactggtgagtgggagcaagtagagggataagtgagcaaaggttcagaggagggagaacagctgtgaagtaaatgagtaaatatattagaaagggaggcattgtggtcagagtagtgggtctgaatttgtcatatcacaggtgaggcatttttgcataattgactctgaatattttgtttcagagtgtagaaaagctttcttagtgctttaggtgttgcatatggatatctgaggacttaggatttatagtttattttatagggtatgaagaactgtcaggaaataggaggtcttccacatctcttgggcatactctaaaactttttctgtgggaattcgaagtctagtgtgttctaatcaaatcgagattcatttttatttacttcttcctgaaagcaaattttaaatagaaggaatttcatataaaaataaggtgtattcctacatgtggccttacatttgaatcacctgggttgcctgagagaagcatttacctgggaatatgtatttcttggccctactttagactcaatggaatctctaagagcttcccttccctccccttcctactcaggtggaaaaggaccaagagaagggattaatgtaaattgaggacagtgtcaattactgtgctaggaactttagatatgttatagcatatatttcttaataggagttgtgtaatttttaaactgttgttatactccatttaaaccctcagaaatggtaacatttgcaaactttctttgtagacccgctatcccatattggagaatccagagattttgaggaaaacagctgatgactttcttaatagaattgcattgacggatgcttaccttttatacacaccttcccaaattgccctgactgccattttatctagtgcctccagggctggaattactatggaaaggtattaattagttttttaacttaggtcaaattcagtcactgggtttatttattcatagaatcatttctgactgtaatctttaatattctttgtggctgggatggttggtgagaagaagaaatgaaattgccttttgaggaaatctttaaacatcatgaaaaatactgttaaactaagaggatacatttaggattaaagtagaagtaaaccaggtgatccttgaaagactgatatagctatcagtatatgacaaatttagaagttcctgtgaactggtgagcaacttgagtgcagcaaatgtctgccttgttttatctttattccccttctgtagagcatgtatgacacgcggaagttaaatattgttaactaactgaagcacaagctagcagccaattagacatttttagtttctatattaagtttctcaatttatgacctttgaggttctgcttgatttcattcctagaaatagctgaggaagaaagatgataaaacttcctaaagttaattaaaactattttacatgattataatcccttatccataatttcagaatccattgataaggtggcagcaaatagagcagattgtatttagtttttatttcacttaataggaatatttgtgttcccttgcagaaatcttaatattcctgattacagacatcacttgggtatttcacatttcataatatatacaccagataacttttctaagacatgaatacttattaataagaatttcgcaacacatctgcatctaggataagggattgtaggtttatattttatttatgatatgcctgttctctgcaaacgcagctcaccaactgtatataaatgtatacgtttaatcccaaagtgatttatatctccacttatttactaagcaaacatttattagataccttctatgtactactatgcactgtactacactttaggagtatgaataagataaatctctgtgttaggaaagatagtcatgtaaattactgatgtatatggagttaagatgtggacttccattaattttgtgggggttgggtggttattttttttgagacagcatctcactctcacccaggctggaatgcagtggcacagtcaaagctcattgcagcctcaacctcccagcctcaagcgatcctcctacttcagcttgctgagtagctggaaccacaggcacacaccgccacaccttggctaatctttttgttttttttgtagagttggggtttccctatgctgcctaggctcatctcagtcactcctagactcgagtagtctcctgcctaggcctcccaaagtgctggggtgacaggtgcacaccaccatacctggcctgcagacttcattctgtaagggaacaaaagtcctcttttccacaattcaaataaccaaaagtttgattaatcttgaagcattgtatatagtgcatctataaattcttcagtgaaggtccaaatgaatttatttcatcttagaagtttagttcattataattccaggaaggcaaaattgaaattgccatacctttggctccttgcaaatttaataggctttcgtaacattcccagagactagacattgggccttttttttttttttttcctttagggaaatgctttccaaacgtttttaacttacagctgatttacaggcaaatttttgggatatgtggaaatgagctttacatttattgctgatttcaaaagggaaagcccctgtgctgttgtcatagtctggataatgcctcagattattaatcataggattattaccgttatttctggattttcttctctttcttgcagatttagagctttatttttcatctgctactttaggtattcttattgcctgtggattttattaaaacaccacaatattataagttcaaattcaaaattgaggttaagagttgctaacttcacagagataatgagtctagtcagccaactcttagcaccaaacctatgacccttatgcttaagaaatcaaaaggaaatgaagagtaaaaataaaggaagatgacaaaaatgggaggaattttaggtaggagagggaaaggaaaaaactagttattttgaattactggtagccagaaatggattagttgtcaggagatttcctgattttcagatccaaaatttattcccacagtagatgatgatgatgtaatatcaaacagttaccaaactttataataaaatttaaataaatctggataaagacagcaacaagagttcttaaagcattgctttctatttttctaactattacccccaagagaaaaataagttttttgcatttgtgtttgaaaaactatttaacattttgagaatctgttcatttcgccttttatcaatcataggtcaagttcaggtatgtaaaacttcagagtaactgaaattttaatatagaaattatattttcatactgtcagtggctctgagaaaaacaggtaatttgggttttatatcacattgataagtaagtttaacacctttgatttggacttgatgcaaataagatgcaatagatttataaagcattaggtggtagtcttgttggtttgaatgtctgttactccacagaagtgcaactatagataaaatggctttcatattaagggaatagagaatccttactagtgccagattccagttttgctgcttcctagctttattactttgggcaagttacaagatcatgacttgttcatccctgtaactcagattcctcatctgtaaaataaggttagccttattgggcttctatattaaaagatataaatgttataagtactggctattactgttgctttcatactattttccctctgaaaggttgtacctgaatgtcactaaacttaaaggaacaataaacatcttttaatgtaagtggtaataaatccttaaaatataggagttacagattatacattcataaatttaaaaattttttaattgcctttgatgaggatggaggaaaataatttatgatgtcatgttttctcaatgtgctgtatgttttcaatagatttttttttcttttctttactagttatttatcagagagtctgatgctgaaagagaacagaacttgcctgtcacagttactagatataatgaaaagtaagtaaaagagaacactttacaaaatgtttcttccaatacaaagctcctttctaaataaatctcttggtgtttaactagaaatataacagatttttgtttagatttcttttcattgaattactgtattatggaagcatgaaagacacattggtctagaacaaatagaaggtatatagaaggaagtagtgttcatttatatagaacttatgcaaagagtgaaaatagagtcagatttagaaaggatttagagattgacaacaggatccttttaaagaataaagaaacatactaggcactgaaaaagatgtaatgggaaataacttaaggataatgtttaaatttggaacttctattttgtagataaattatttttttaagagaaaggtagaaggagatttgacacactcagagaaggcactgttaagacagcagagaaagaattaaagatgcttgccttgaaaattggagtgatgtggctgcaagccaaaggaagctggcagccatcggaagctggaacaggcaaggaatggattcatccctggagcctccagagagagtatggcccttctagcaccttaattttggcacagtgaaacatttcagacttttgggctccagaactatgagagaatacacttccgttgttttaagccaccacttttgtgataattttaatagcaatgtcaggaaactaatacagccctgcgtaatcaagacttatccagcccaaaaagtcattagtgctggtgttgagaaaccctgtcattagtgccggtgttgagagttgagtagaatctctactttacttattggctggattagccagcattctccattcttgaccgtggcacacttggtcatggctgctaagctactctttggggttaaaagtcgatcatgtttgtttccaaaccttcttgtgtaaattgttcttgttaattaaatgtgtattgtaattaaatattaaaccagtagaatataagattgaaatcttgattttcgatgacagtaaatgggcatacattttatatattttgtgttttaaaatttaagatgcttcagggcatctatgtatcatttcctgattctctgctcgaagtgatcctgagggcttcctttgagaatgatggctgtgatttatgaattataaactgtaggtctttagttataccactagggggtacactttaaaagctaattgtgatttgactgtagctgttaggatcatagaatttagtaggtaaaggtcttattccactgtactcatttcatagcttagttttattactgatttcttctcaatacctttattttgctccacttgttttaaaatgaaataaaaacagctcttcataaaacactcagaagtttaatgctactaagatatttgtaatttttggaacatagatactgtcctaagggtgttgagttacaagtattaattcagttaaaaatactgctttgtttgcattatgaaataggtcagtagtgtagtcatttggatcacatggctggctaatagtaataataagcccattggatctctcatcattcccctaatcttgaaatttgtattctttggtttattatagttgaataacaagatcagctagaggatgtttttgcaattataaagttactgatacagtagtttgcttttaacctaaagtggacatttttgtatagggtttgcgttttgttaaagcaaaggattattaacaaatttttactgagcatcctccctttattgcatgttgtgtaataacagtttcctttgaaaacaggaagtatatgcttggcccactgtctatggaatagaatactacgaagatggttggtgatagagaacaaaacatgttcactaaatcatttagggattttttttttaagtcttaaaactgaacaagaagtgaccccagtaggatttgccaaaaattaatgctagattatagtgtgctttatgctgtatatgatatgggctaaacagcagagagccataattacttgaactaaacatacagtgcttattggattttaatgtagaatgaaatgcagaatgatgcaaatcctgagaataaccatgtcatttgaagagtgttgtttcctatgacaaaatggaaaagtaaccagctcccttactatgagaaggaggtttgcttattcagtttaaattctttttttgtatccacataggcatgagaaacttagtaaagaagtatgaaccacccagatctgaagaagttgctgttctgaaacagaagttggagcgatgtcattctgctgagcttgcacttaacgtaatcacgtaagttaatgtgacagtgttaatcaatagacataactgttatccagtccagctggttcgtaaatcattttattggtgtttgctcattagaggaaagctgactgatccataaaatcagattttctttattgaatggacatttctaatgagattaaggtaatagttcggcattcactgtgcagttctgatcctgctgtgactcatatgttctttggcttgcaggccctgtcctgttctgttacttctcatgggatttcaggggtcagggtcttcctaaggaatccttttaccttttcctgtccttttaatcttttgtctctttgaagttgtgatatctggtctgaggaacaaatatgctcttccagacttctgttagctagagtagagaaagttggcatacttcttttttttttttttctttgagatggagtctcgctctattgcccagactggagtgcagtggcgcgatctcagctcactgcaagctctgccttccaggttcaggtcattctcctgcctcagcctcctgagtagctgggactacaggcgccctccaccacgcccagctaattttttgtatttttagtagagacggggtttcatcgtgttagccaggatggtctcaatctcctgacctcatgatccgcccaccttggcctcccggcatacttctttcagtgacaaactttatagtgaccacaaagccaataggaaaagaggccatgtaatttcttcttgtggctagccataagaacacctttaatgtctcttaattgatttgtaagctgaatgtgaaaatcaccataaaattggcaatttgtgctttgcaaattgaaagatccactgaaactttcttttttaggtgtttaagcagttgggaatttggacaggtactaggattaatgaaactgccattttctatttcctgtgggatgcattttgttacttaaagttataccttatttgttaaaatttaatgggagttatctgtggcatcttatatttaagatgtatttgaggtattatttctgtaattggtgaatatgtgctgctggataactatgaaaagccagaacagcaattccaaggcctttatgtcaaatacacatgactcaaattccttacctatacagttgtagttggggaatatctacggacttaggaagtgtgcagaatatgaggttgttttattatagttataggtataacgacaaagcatgttttagcatagaacttgaaattggtggatttcattcactcctcggtttcagtggtaacaggaatttttcagagtggttacagagaagtaatgttgactttaatgaataaaagtattgcagcactgattatgtcctttttgcattgattttgaaatgggattagaccaggggttggcaaactgttacctaccaggcatatccagcccattagcgtttttagaacacagtttcttggaatgtagcacacctattcgtttatatatcacctatggctattttcatgatacagcagaaaagttaggtagttgcaacagaaactggttatagggcctgcaaggccgaaaatatttactgtctctttaaagaaaaagtttatccacccctggattagaccactgaactactaatcctaccctttctagctaagtaactgaatggaccataatccaaaattcttaactgccatagcttacattgtattccagattgccatctgccttgtactgggccaaattctgaatatctatgagtacttgaggggtgcttctcaaactgcgaaggacttttttaaaaaaaaatcactagatgtatacttttgtaaaattcaataaaaaatgaattactagaaaagtgaagacaaaaacataagctcaagttttattagattcagcagtcataaaattattatatcaaattgctattaaaaatttctagggccgggcacagtggctcatgcctgtaatctcagcagtttgggaggctaaggcgggcggatcacctgaggtcgggagttcgagaccagcctggccaacatggcgaaaccccgtctctactaaaaatacaataatcagctggacgtggtggtgggtgcctgtaatcccagctacttgtaagactgaggcagggagaactgcttgaaccctggaggggtcacagtgagccaagatcacgccattgcactccagcctgggcaacagagcaagactctgtctcaaaaaaaaaaacaaaaaaaaaattatgaaacacaattcctgtacttaactcactgcaaactggaaactgttcatggaccagctctggtacttgctaccatgagtagtgctactttaggactaaatatttgttttccttgatcttcaaaattattttacctttagttttcatgacacaaaaactgttttgtcattgtcagtcaatacaagtgaaaccaaagttccctttgatcaaaacccaaatctgtcatgacctcagaagttacttagcagttgtttacctttgccagccttttctctgcacgtatatccatatatttatgaaataagcagcgtttttttcttctttgcatttttcatacatattgtacaatgggtgattatcaatgcttagcttttgctagtctgggtgaaaaagtatcacattggtattttaatttgcattttcttgattatgggacattgaactttccatacttaacagtcacttatatttcatctgtattgcttatttatcccctttgcccaattttctggcttttttgtttgtttgtttgtttttgagatggagtcttgctgtgtcacccaggcttgagtgcagtggcgtgatctcactgcaacctctgcctcccgggttcaagcagttctcctgcctcagccttccaagtagctgggacgacaggtgcatgccaacatgcccagctaatttttttttgtatttttagtagagacgggattttaccgtgttagccaaggatggtctcaagctcctgacgtcgtgatccgcccgcctcagcctcccaaagtgctgggattacaggcgtgagccactgcacctggccacatttttgtggtttgtagtgctttatagattctatatacagtcatccttcagtatccatgggggattggtttcaggactttctgctcataaccacaatccacagatgccctaatacaaaatggcgtatttgcatataacctatacacatcctcccatatactttaaatcatctctagattacttataatacctaaatacaatgtaaatgttatgtaaatagttatactgtattcttgagggaataataagaaaaaattctgtacatgttcagtacagatagaatttttttccttattttcaatccgcagttggtttagtccacagatgtggaacccacaggatacagaaggctgattgtacttatttatatatgatatattatttatatatgatatattctattgtttttcacaacttttttccaaatactaatttttgccccagctcccacaccccgcttttttgagaaaaagtcttctctctgtcatccaggtgtgatggagtgcagtggcttgatcttggctcactgcaccctctgccttctgggctcaagtgatcttcctacctgagcctctcagcagctgggactacaggtgctcaaccacattggttaattttttaatttttttgtagagacgaggtttcgccacattgctcaggctggcctcaaactcttgggctcaggcgatctgacgcctcggcctcctaaagagctgggattacaattgtgagcccctgtgcccagcaggtcccagctcattttttatttcatgttttcctagttacttgaaacacttcttatcacacattaaattcatccttctgcatagtcattactttgcttatctagtctgatcattgatctgtttaatatctcacttttaattaccgtagcttttgtagtgtgctttaaagataactgggacaaggtcctccaacactgttcttttttatattcgctcctattttttcacactctttcctaggtcagtgttagatttgacaattccatgaaaaattttattagggttttaattagaattgcatttaatttaaagattgattgtaaaagtatcattttccctaccccatagctgtttatctttttccatttatcctggccttgttgttcagtagatacatgatattgcctatagccttgctagtttattttacattttatagtttctgtggctggtattggattgcttattgatagttgcttaattataggaagaagaggaaaggctatgaagatgatgattacgtctcaaagaaatccaaacatgaggaggtatgttttactccaaagatgaactctaagttatttttgttatacattctggtgtgactatactgttaagatttattctccaagagtacaggcattatagagttgtgggttttttcattttttgcatacttccttacgtacagtactgttgtccattattaaagggatttttctctcttctgtctttatttaatgaagaatccttcctgtgttcatagaaagcagaagcaatatgtatacatactacatttttgctttttttcttattctccaaggatttttcccttacccccttttaaaaaaaattttctatctgtcaagtcaaataagtgaataatcagaggcaaaaggtcacagccataacctttattcctcactggaggagtctggtgagaccatgccaacattactaacagtgaactattacaaaatttcctggtttatcttttgtaatccacatgggtaaaaggaggagaacattttcttaaagggaggtaagaggtaaacaatactggttatgcttcagtgttatccttaccacactttttttccttcttaggaagaatggactgatgacgacctggtagaatctctctaaccatttgaagttgatttctcaatgctaactaatcaagagaagtaggaagcatatcaaacgtttaactttatttaaaaagtataatgtgaaaacataaaatatattaaaacttttctattgttttctttccctttcacagtaactttatgtaaaataaaccatcttcaaaagagctagaata

SEQ ID NO: 39 - DNA, 10010 bp, Homo sapiens
gtcctgccaaagaaagcagcagcgaataagtacgtggcagatggtgctgtcgaccagtgtcaagaccaagtttcatgggttcctggacgctcagccaggggtagtctctgaagggccgcctggcaattgggagcagaagccagtttcccgccatctgctctccgtggaggcagtgctctcgcggctgctgcccgttggggtccagctgaggaaggagcgcggatcccaggctcgttctttgcctgggctgcccctgcggcccctggggcgggtgctgctgcggcgccagctccaagggcggatccaggcgggaggggcctcctcggagaagcggggcgcggtcccaactacgcagaggctggcacgccgaccctccacacctcaccacgcccccatctccgtccgtgtacacacactcacacaaggacgccaaccccacctagatgcaaagcaggattcaaaagaacatctttgcgttttctaccggctccccatcatcgtactagggaggaagaagcgggtgagaaacaaaacttctttccattgtcctgcccgtttctgcggacttgttctgaggccgaggtaggttcacactcctgctcctcctcctcctctctggtagcttcataaggggcgtttaggccggggagtcctttcctagtagaggcagcttgggactccttggggaggagtttgcgggacggggctggagagggaggaatggggagggacgtgaaagtcccgtatttgtatgagttaacgactttacattcccactcaggtttactttgcgcagctgggcacagatgccagcttctattgattagtaggcttggagggggaccacagaatcgccgaacctaagggaagccctaggaggcctgcacttgcccacaactaagaaagctttgctagttattcaggctaatcaccagctttttgaagcaggccttagttttttgcaagcgtaactaacatttggggatcggtgttttctgtttactctcctctgcctcctcacccttaacccaccctcagccagtgttgtgcaattcttagagacacttgccaacagcctcttctctaagccttcctactggaaggttgggatcctccgttttctcgctctgagacagcacgtcaaatgctaatagcagcacatgagtaaagcgcaacatctttattaaaacaatttcagcaccactcagggggctagggaaatctcagatgagccaagaccctccctcgtgacagtaaaaatcttataatcaagtcataatgtaatcagtagaaacccaagggacatcattatctgtggcacaggaccaccttcccagaagcagcctcaggtattcaagacttacttaaccacagagccactaacaagttttgcaagaggataggtttattacatacgcttcaattcaagcaattcttttactgatgacaagcagagtaaaataatttttgaatttatggtaatagtcaatgtaggtttccttcgaacagcaactttcagtggcccctttaaagttagctctgattgtctagaaagtactagtatggaatataaaagttgtgtgggcccggcacggtggctcatgcctgtaatcccagcactttgggaggccgaggtgggtgcatcacaagatcaggagttcgagaccagcctggccaagatggtgaaacctcgtctctactaaaaatacaaaaattagccgggcacggtggtgagcacctgtaaccccagctactcgggaggctgagacaggagactctcttgaacctgggaggcggaggttacagtgaacagagattgcgtcactgcactctagcctgggtgacagagcaagactccgtcttaaaaaaaaaaaaaaaaaaaattgtgtggtgcattggaaagcttccaggccggcgaatgcaatgagttccttgggcaatacatgtctctttctctgttcctcagttggctcttctttaatatgaggggtggacagagtctcagaggcccctcccactcttgttctatgactccatggagtggtacgatgttagtaacaggacatgaggcactctagtaatgtggagatgaactatcgtttggcagagaggatggaaaaaatcattccaggaaaagaggaatggctttagctattgttgaaaacagataatcaggttataagcaggcaagagtaagaggtttgtcaagttattgttggaagcattggtcactgtgactcaaattaaagtagctggataaaaaagtggaccaatgaaggtcagtgaaacctttctttaggagtttttattgaatctgtatttaagcagattctctgtaattctctgtaaacagttattcccggaagaatgccatgaaatacttgggaaagagggaatgggaacaaagagtgagtgggcacaaagcccagagttggttgaaaagcaaatgtttaatttttgtctttgtttggaaatacaggcatgtcagcaggactttgtccccactgtccttcaatcagtagtgttgcctcttcctggagacgtggttcttcttgccacgtgtgcttttccttctttacctgttacttccgttattgaataagttcatgcttatagacctaaagtgttagaataataaagaaatatagaaattatttagtccattcttcccatcatctaattttataattagtcctaagacagaatgatacatatatactctgtatgaaggaggaaagtgctctaacactagggtccttggaaacaggacccgtgcatcccgtgtctgtgtgcagggacattattggcttgagggagagagagaaaaaaatctccaggaaaggggaatgactttcaagttaaagctgtctgaacatttaaaaaatatatgaggttttttgcaattggcgattccttcatttgtattaaaattactgacaaagatgtgatgttccttaatcatagaatataattccttgttgtattttaaacacaaatgactaagtgcttagatgcattctaatgaaatagtaatttttcccccaaaccctacttttcatttcaacaaaacttccttgtgccaagtttaaaagaaaaacataaaactgtctttttgcattgtgggcagattgtgtatcctccaaaggttgtccagtgaaggcccagaggcagagaagggacctaactatattcagaggctgctggttgccccacctcagcactactgcagaactctaaaatcagaggctgctctgtttgtgtgagtcggtgcttgaattggtgcttcaggccatggggctgtgtgtgtgcaggcgcatatgggttgtatgctgtggcagggtaccgcttttcgggactcagaggtggtgttgcttgagctaagcctggaaagacaggtcagttttctccttgcttatgaagggttcaaagtctgactccaccattcatctgctgtttgttcttggagtttcctcatgagcagagcatatttacataatgcctacctcacacagtcctggtgttggttgaatgtagtcatgtatgtgagagcttcacaaaatgaaagattgcactgaatattataattattgtgatttcaagtgcatttgttttactagcaggcagcctgtcttttcttgacaccttctcaagtgcagccagactgaatacttggcagctaggtgggtgacaacagaggattgaggatttttaaaaagataacactgtcctagatccaacaccactgtgggcaaatgctgggggtctgtgaaacagttggtaccctgctgctgtctgatattggaaactatgagatctataaggtgatcctggtgacctttggcccactgtttttacgcaagcaatggatctacagccctgctttgatgatggagataagcaattttgcaactacattacaaggatcagaagattgaatgttcagggttagtctcttgtggacaggtaaagatggaagaaggagaaacccaggaaacatggcaagcctgcttctgggggttagaagctgagaagttgagtgtagggggaggggcagtgtactaatagctgtcacacaaccttctctggaagtgctttcctggctgtatgaaatcgatggaataacgtgcttagcatccgttcatgaaaccaaatgatgtgatacgataaataggatgtgatatgataaatgataaatagtacagtggaaaagcatcctactggaagaccatatcttactctgtgacatcttccaaggcagttcttggagttggcccagggagatcagagatgctatcttatggatccagactattatgtgtgaatagggaaacctcagtcctgccatgaacaagagtaagcaccacagacagcagaaaagggcaacttttggacagaaggccatgtttctcaaactttgtcttccagaacaaatctctaatccattcaggtgggttaatatctaacccaatcatgcccagcgaaaaggtgaatgaccctcctcgtttgttcaagagcagtgtccttggttttcatgtccctgccaggactgggacactatatattaggaacactatataatcagaacctggagaggcctccaggttcacacaactggaacccatctccaggaacaaacagctggaacccatctcccgttgaagggaaactgccagatttttgtaagattcttcctcctgggtaaactattgttcaatttgttttatatattatttctagccatccatccattttaatgaaaccattttcctccctttaaagcctccaggctcaagctcatgaattaaaaagaaaatggatcagattctaaagtttaaaatgaaaacaggtttcttttgggatggcctatgtgtggataaagagaaattagtgagactgggaggaagtggaagtttaggagggatttctaaattgtgataaaatccccaaaggcctgggggagccatttgctgaaggccatcgggagtcctcccccgtcgtccacccctgttacaggcattacacgtggcttaacaaggaaagaaacagtatgtttttagcattgtttccttctaaccttccctgctaatttctcttcttagaaaagttttggatgctctttcaaacaaagtggaacacatcccaagatcaaaagaaggctcactggcaggttgaagggaagaaggaaggaaaagcaataaagggatgaatatgccttgggtgttaggctcttactttgggggattttgccctaggatgtataaaagtgtgaagccacattgatgaaaatgataactatagttactcatcataaactgtcaagttaactccctggtgtgtaaaatttgatgaatcttttgaatactgaacattgcctgtggggagagggagagaataattcttgtgaatactaacagattcatttgatacagaagataaagttactctaaagaacagttggggccaggtgtggtggctcacacctgtaatccccgcactttgggaagccgaggtagccggatcaactgaggtcaggagttcgagaccagcctggccgacatggcgaaaccccgtctctaccaaatacacaaaattagccaagcgtggtggtggccgcctgtaatcccagctacttgggaggctgaggcaggagaattgcctgaacctgggaggtggaggttgcagtgagccaagatagcaccactgcgatctagcctgggcgatagaacaagactctgtctcaaaaaaaaaaaaaaaacaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtctcaaaaaaaaaaaaaaaaaaaaaaaaaaagaaaagaaaagaaaaaaaggacagagaacagctgggactaattccactgacaaaaagctgacagacagttacgtgtttgggtacagaaggatatatctataggacttttgccaccagatgtgaggctttgcacccttggcttaggcagattcacttttacaccacaaacgatctgtctcttactggttttctcccaattccattttaccttgctttttgaggaatttagagttgaatatattgagaaagttttgagtgagggagcagatgttagatattggtggttttggtgtacgcttgctgagatttggttcctggatgtcttagggaatcaagattacaggcccccaactaaacttatacaaaatttgtctctgtaactgagggtcactggacctttgctattgaaactagcaaagcctctattatgtttaatgagaaccatgaaacttcagatttttagagctagcaactcttttattttcttgatgaacaaacctaggcctggagagaaaaatgaagtcaattacttaaaaaatattaagggttataataaggcaagcatgttgattcaaggtgaataatatgagttctgtggaatatacaccagtaagaaacactaacaagtaaatacttcattgttcatccacgatcacgtgggtaatggcatgtttggaaatggcacccgtgaaacctgacaacaggtcggtctttattttgtgatatccttatgggtagattctgaactttgtggcttttactttggcacttatatctaatgaggtgtccttggtcttaatatctaatgcagagcgagtttggacagagattctaaacaggttcaccagctcatactcccttctgtgaacagcaatatccccacaagttatacagcattggcacctcctgcaagtacggtatttcctagagaagacattagtaacattcctatccaccactgccacctaacgactcttttaggtactagcagctctggttccgtttcctgatttctgatttctgggattctggcaccaggcagaagaatgttgactgtgtaaggcagacctttgacattagaagtcagtatttgttcattacagagcaagagacttaattgattacaaatcaataaaactttaataagatcttccaaaaaactagaaacaggaaacacacccaggagactgaaaagcatgatgtaaatgtgaagaacgtggcaagtgggtggcttggcagcccagcagctatactggagcagctgcatgagtgaatacttgttactcctttagggctggctctccattctacaatcatgtacctctttcttgataaactcccaagaacacactttcagcatggaatttcagacttttagagatagcaactctctcaagtatggacaaatgtcggtgcggacaaatttgatgcactgctgaagaataccaaataatatgctaaggaattttttcattccacaataatggagtaaatagcagctggaaatgtttgcattaagttcatagattataatttgtaatggaatcaacaccaaatgcaaattagaaagagagcccactttgctcacccagtcacgtcttcccatgtaaccatagaacattggggtcctgtgtctttctagatccacagtcttgctctcagaacaggctagccacaccacaggcctagtgccaggacccatggcctttttttaagctcagactcccttctgtgaacagcaatatccccacaacttgtacaacattggtgcttcctgcaagggctacagaactatttgatacgaaaatgttcattgacttacacacaagagaagcacaaaataaaaaattaataattaatttaatgtctttgaaaatgtaccatttatttttacatttggggtcataagaattgtattacacttaagaatgcaatacaatttgaagatcagatttttctccctttgtgagaatttctcagtatgtgtgatgactaccaagaaatcatagccagtcataaattcagtgagttactcataaacgaacaagaaccacctacttcttggggaggtaggtctgcttcccttcaactcaggatacaactgctttcaactgctttcttcacattagctgactaattagctagaagcctgtcgtaaacaattttatggttgactccttccctgggctcagggttccctagaacagaggtccccaaatcccggtctgtggcctgtccgcctaagctctgcctcctgccagatcagcaggcagcattagattctcataggagctggacgcctattgtgaactgcgcatgtgcgggatccagattgtgcactctttatgagaatctaactaatgcttgatgatctatctgaaccagaacaatttcatcctgaaaccatcccccaccaatccatagaaatactgtcttccacaaaaatgatccctggtgccaaaaatgttagagaccactcccctaaaactctcttcttagctctcacctcctgtattactatctcatctcagtacattgaagcccccatcttttccccatggatgcctcatttcctattagggaggcatttttttattttttgtttttatttttttccgagacggagtctcgctctgtcgccaaggctggagtgcagtggcgcgatctcggctcactgcaagctccgcctcccgggttcacgccattctcctgcctcagcctcccgagtagctgggactacaggcgcccgccactacgcccggctaattttttgtatttttagtagagacggggtttcaccgtggtagccaggatggtctcgatctcctgacctcgtgatccgcccgccttggcctcccaaagtgctgggattacaggcgtgagccaccgcgcccggccgtcatttggtatgtcttaatgtgcctcaggacctagcacagtccctggtacccagtagagacctatgtaatgttcattattcaattaataaatacatgaattaaagagtgagagtggattttgtaatgttacgactgatagagaaatactcagtgattctaagggatggggaagaacggttggagctagaggttgtgctcaggaaactattaaatagacgttccgcaggaagggattgacgaagtgtgaggttaatgaggaagggaaaatagaatataaaatttggtggtggaaaagatctgattcatgatgccgtgtcagagagcaaagctcctgtccttttggcctaatttggtgatgctgttcttgggtctaccacacctccttttgccctccgcaggagcctgtgttggaagagatggtgatgggcctgggcgttttgttgttggtcttcgtgctgggtctgggtctgaccccaccgaccctggctcaggataactccaggtacacacacttcctgacccagcactatgatgccaaaccacagggccgggatgacagatactgtgaaagcatcatgaggagacggggcctgacctcaccctgcaaagacatcaacacatttattcatggcaacaagcgcagcatcaaggccatctgtgaaaacaagaatggaaaccctcacagagaaaacctaagaataagcaagtcttctttccaggtcaccacttgcaagctacatggaggttccccctggcctccatgccagtaccgagccacagcggggttcagaaacgttgttgttgcttgtgaaaatggcttacctgtccacttggatcagtcaattttccgtcgtccgtaaccagcgggcccctggtcaagtgctggctctgctgtccttgccttccatttcccctctgcacccagaacagtggtggcaacattcattgccaagggcccaaagaaagagctacctggaccttttgttttctgtttgacaacatgtttaataaataaaaatgtcttgatatcagtaagaa

SEQ ID NO: 40 - DNA, 49714 bp, Homo sapiens
agtccctatttggaactgctctcgcggcagttcagacctcgtgctcgtccccttcgcctgtctgtgtgtggtatccgtaggtccggggcacttttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacctgctggggagccgacgatgtccgcgcagtcccaggcattgacgcgctcgacgcagcccagggaaggcggccggccgctgcccgccgagccctaggcgcacaaagcccgcgcccgccgcccggccccggcgcccgccgacgactttgccgcctgctccgcggctctttgtctccacttggggcgggcgcccgactctgggatttcgctgcgagaacgagctgggggggccgggggcgagctctcggtttcccggccgccccccgctcgggctcggctcccccctcccccgcacctccccggcccgggctctcggcgcttccacgctctcggaatcacgacccctccctgccatgtatccgcagggcagacatccggtgagtaattgcaactcggtttatttaagcatctatcatggcagggtaaacgaggcagtttatctggcacctccattttgcttgttgctacctttatggtgtgtgtgtttgtgtgtgtgctctcacacaaagggggatgcggccggggggcgccgttgagagaggaggttaattccgcgcgagtggcgcggggggctgcttgtgttccagggggagctgttcacgcggtccccggccccgctctgaagtctcccaactcacccggcttgtctcccgcccccgccttactggggagagggaggcccttggtgaaaggcatgggagccccgctgccgacggggagagatggggcgccccccctccgccccgtcggagagctgagaaacttgctgggaaggttctgggctgagggtggcctcttttggttgggcgccgttggggaggggccggggccgctctgagcgcggtctcatgcccccgccccctcccctgtcttgtcttcgcgggctccaggctccccatcaacccgggcagccgggatttaaattcacggtggctgagtcttgtgacaggatcaaagacgaattccagttcctgcaagctcagtatcacaggtaaggccggtgggggccgccccggggctggcggggaggggtgggtcccctgcgcggctcctgccatcccccgcggggacggagggggctcccgacctaggggcggcggggcagcccgggcctccgccttttgtttcccctttccgagcgcgccgccttaaccctttactgcccgcagcagcccggctcccagcgccgcccgtggggtccccgaatgagggtctaggtcgcggcgagcgggttcactccgggttctgggtgtcgggagccagcgtcagggtcctactcccctgctgccgtgataagtcctttggctcgcgggaagtttcgaattgtttcacatccccctccccacggcggggacccaaatccccccgcgtccccaggctgtgggataatgggggcgcccccgggggggtgtcaggaaagtggaaaagtggctctagaggcccttgggtcggggcctcagaggaggctgtccaggcgccacgcctgagccggctcctcctgccctcgcagcctcaaagtggagtacgacaagctggcaaacgagaagacggagatgcagcgccattatgtgatggtgagatgcggccgcgggcctggggggcggttggggcgccgaccccggccgggggcgcggcgtggatctggggagatgagcgccaggtccccaccaccgcccagccgcagggcggccctgagagagggcataatctggtcttgccctccccttccccagcttccattgccggggccacttggaggagggtgagtgaggggaggggcagaaagagaaaccccgattccaggccggagacttctgtactatctttatgtgcctttaatttgtgttttgaaagtttcccaggggctgattgccattgccctatcttggctagtaagataggattggaccagcccatgtgaaattagggttggtaaaaatctctcttagtgacctcctgggagtgtttggaaacttttctgctttgcagctgggatctagccagagtaggacagaagccctccttccccagggtgttgtgaggagtggagaggccttgtaaagctctctctgcctccactcccctcctcagggatcccccagctgggtatcttctccacgctggggcagtaggcagactgtcttccttttgcccagcaagttttaatcttcatttgtgagagggcacggctccctgcactgctttccacataagaggccttcgacacagtgctaaataactctcagaggacaagagggtcccagtgtacacacgattccctgttgaacctgaaccttgtataaacaggatatagggcacatgtggtgcttgtgggagggaaggcccagctccccttactaccacataatataacgttctgttgagatgagaggaacgctcgcccttgtcagctcttaaaccgctctgtaagctggctttggggtttgatttaaacttctttagcaaatgtatcgtaaaagtatgatttggccaaaacctttccaagaaaaaactgattttgaaaaatgaccagatttctgtgttgtctgttaatagccattctttttacttttagtactatgagatgtcctatggcttgaacattgaaatgcacaagcaggtaagtgcttttctcttttaaaaatatatttcattttttaaaaacttatatatgtggacttcttatgttctctcttgtttgaaagtgagcctgcttcttcgattcctcccccttctccttgaagagtgaatggatccagtccttgaaatgcaaggtctgaggctttgctgatttttttttagacatgttgagcttttagcatttgagcttgtgaaattagtcctggtcttggatctcggtggaggataaaggaccaaagggaaagttgtacctccaggatctgctttacaaactcctgaaagcccagaggtggctggctgcttttatctgttttaatgtaaaattctcaagaggaaatgcaggaggattttttttttctttctccttttttttttctttttgcagaaatgtgatgttctgccttgataagattaaacttcaagaaccttaaaagccaggctgagctgtcgaaatttaagggaacgaagccactaactgcttaaaaatatgaagccagaatgaaatacaacttcagtgccttgcattgacaaggtggctttctcatccctgtcttgatttgaaggcagccgagttcccattttacagagaaggaagctgaagctcctgggtgaagtaacttgcccaggggcagcctagccaggactttcgagatggctgggggttgagctcagctttgaaatcctgaagtcaaaccagtttagctagtgtggtgtcgtttgatggatatgtaaactacctggtattgtcactcttctaataacagtatacctcaaaccgagcaaatacaaacaccctttatctcagtgcatatcagtaactagtcccagtgctaggctgggctgtgggagaggcctgtttgtgtatttgtgttctgaggaaaggctgcctataatttggcttggccaacgtttagagttgacttggcacgtataaatggagcaggcaggccggttgttctttttaacaattggtgttcatgaaatctcagaaggctgttgactcattctagcctttggtgaccgtgacttgaatggattttctgctctaaattaacagtcgtttacaaggtttcaattttgctctttaaggaggcaggacccagggcaggtgagaagggcaggtgaccctggaaagtgggcagattcctacccactcgggtggcttcctatagagcctttgggatctgtagtttcctttcccctcctggagggagcccccagtgttgggtgaagggaagccagaaaggggcctgagtttattgagcaatgtgtgggaagccagcttgtggcttcctgagggattagttagtcccttaggaaggcacatgaaggctaccatgtttttacttcttgacacacagaaataatagacagggctttatacgtaaagatatttctccttggaaaaatagaatagagacaggttctgcaactggaaggggccaggtcccggaagaatgcttgaaatggaactgggggcccaggtgtttcaaggaccttggggtgtatgcagggtgccacttcctccctttgtctgccctgtcttaattttttttttctcaaatagtatcttgggtgtgtttaaagagggtaattgcacccaggtttaaaatttatagcagcagttattggaagagcttggtaattaaggtgtaatgtctcgttgcatgttgaggtctgcatgggtggtgttccgcatgtctgtgaatgaatggtgctttggcactaagaatccaccttggctcgcagcagatctgttctgtgagtcctggggatgctgtgaacgcaggaagagttaaatatcttaacgcatttggtggtggggtttatataaagagcagctgtgtacatctgggatttctggccattccccaaacaaggttcttaaggggagaatgcctggggtttggctacgttgtctcatttaatcctctcagctgccagtggtggatagaggcattctttgccccctgtttataggtgaggaaactgaggcttcagggaggccaggagggcagagctgggattcaaatccagccctctggcttccccactgggcactttaccttgcttgccactcacctttgccctctagcctgagttcccagcctgaacatgtgtgctctgaatgcagtggctttgcaagcttatggcagtctctgagttgggtgaaatcaccctgtggctgtggaggaacaaagaggcaaggaggtgaagaaacctgtgccgtgaaatgcaaccctgatctaatggagctggccactccctaggtttgcaagggttctgtagaagaaagccctgccactaattgtagtgtgggtcttgggtgcatttggcgaatggtggttaggcctgagcaaacaagtttatcagctgacctgtttagcggttgactggtgttttatcggcacacacaatcaagtgactggagtgcttgaattattcatgcagtgtcctgccctctagacttgactgttcgtgtgattacatctgcctggaacaaacaggctggattcttcatctttaagctggggtgggggtggggactgtctgtacttttatataatagatgatctatagagctagcaccttgggaagtgtggcagtcctcagcctgcgcgcatacacgcacacgcactccaccatcaccaccacatattttttttaaaagctctcctttgctggctctatgggaaatgccaattagctgggaacctcgagtcctgccagatgggcccgggtattgacagagggcagctgatgaggtgcgtccagcccatttttattttactgagaggttaaactcactgtggctggctccttctctggctgtttctctgtctctctctttttccaagctgtcaaaatcccagagaagtaataaatggtttctcctcctgctcttctgcctccctccctaattatggtaaagcaaagattacagaatcacaggcctggcccgggacttcaagaggtcacccacctccaccaagccccctgcttccaggcagaatgtcaagggtggttcagagagtctgggaaggcagtgatgactgaccggctcatcacttgccatcttgtttgtgcagaggctttccagtgtcagccacaaataacaaagccagcttaaaaccaggggccccagagcaattgccatgcattggatttgaggcactggctctctgagaagctgggtcaggcagccttttcacccactgttggtgagcactgacatttttgaaagtggacttgagccattttgattttggggcagtgtcgtgccgacacaatacagtcacctttttctgtgaactgaacaacctttcctgtaagtttctctttgaatcttggaactggaagagccctttggcttctcatgcaaacttttcaagttacagatgaggaaacggtggcccagagaagggaagcttatgtactcagtcatacagtcccacgttagtggtaaagctgctactgctgcttcccttccaacccaggactcttttctgtaagactcaagaaatgaagagtgctccttttctagtgtattctgtgtctttaattactattgcttctttctgtgttattatccaaacaggctaaggctacaaaactggccccaccaaagtccaaagtgccccatttcgggttgtataatcatatcactgaacccttattgtccacagtcctgttttgaattgccagctatttgcacaactaatgatttgatgtgtgtaataataatacataatgcataactagcaatcccagaggaaagattcacagaccgggaaaggtggtatatataacctgtgaactttttaccctagccatggggtgccataaacacagggctgaggtaggaaatggaaaatccccatttgtcactcccctcccctccccgctctggatcttctcatctaaatgataaggggctcacctggaagatcttgaggcacacagaagttttgtgaccacggtgaaggtgcaaggtacaggtggccagagggagctaccaggcaatgaggttacaaaggactctgccaaggagttgagcctatcttgataggagaatgtgggaccacttgcaaagtagaaggggtcaaaggtccttagactagggaagtgcctatttgtgtggcatctgagttgagctgtgaaattttttttttcttttttgccagagtgctagcatccaagaaccctcccacccggccccatgccctggtatctgtcttgacttttcctgctatattgatcttccctggaacagactgtaatcacgagtcctctcactgagtgggtgcctgcctcgctcagctttggggtctgctgggctccaagctccctgcatgctgtctagctagagggaggttgccccacccctcaagactgcctttggaccccttttctctagttgccagtgggagtggtagagtgggggtttcagtgcttttggggtcttttccttcttgtgcatttgtcattgaaatgaccctgggagatgagcaaatggccccttgtccttactttacagatcaacgggtgggaacctggctcctaattcgggactcattctctgaactctcttggaccaggagcccgtggcagacacggagttcttcctttccttgaactcctccttcccacctaggctgtttgtttccattttgttgaaggagtgagtcagtcaaggaataaatctccttttgctttctacgtgggagaatgtcattctgtctcattgtttgtacaaaatactgggacaccaggggcaaaaacgtgacaaagacctaagcttggcagtgttttcccctgtgatctggcactcattcctcgtctcatttttgtaggtatgaaggaagcccctctgctgaggtctctatagcacttagtatgtaataggtgctcagtaaacatcttggtttttcttcaaaatttactcaggttatctgagagtagagttccgattccctgagccctgtgagtaggaagtggggattttagttgtgggctggccgcccgctctgcaggcttcctcctatggcccagcatccagtttcttcatcagtgaaatgagggggttggattcattcccaaagcagttattaggggactgggatgtgctgggtgtgggctggggttggttacacagccgaataagacaccattccctctgcgggggagtcggatgtctaaagaagtaattgcaatgcagtgaggtaagtgctaatgtggcccaagtgtcataggaggagcacccagcacagaacagcttattcttcttgggtgagagcagacttcactgagggctttgcttggcgcgagtctgaaagggagggtagggtttatgaggcagaagtcggcagccgaggcccctccagggtggcaacagctcgcggcaaggcagtgagatatgttctagaagccacacgtcttcggaatgatgtggggcggggactgcacttgggaagtgaggcgaggtggtgacattttgcagcagagcgatctccaaggcccctctgcccttgcagtcgcggctccccacccggtggctccctgcatccctgcatggctggctctccagggctggcctgagtccatctgccgcggggtgggggtgggggcgggggcgggggcccgctctgggccgtttgtggcctgctctgcctgctttcctaccgtaatatgctgctttgaactttattccccaaagtggcattgtctcctttctcatattggtaattctgtaatgactggttatgacccgccccctcccccatatttaattctcatcagcccagctctccactttgctattaatgatagcagccagcaaaatagctttcaacatgccattgacagtctggtttaagagagcacttgaagtagtgctagacagctgaaagcacccataattgtgtaccagagtgagaactgcgtgctcaagggccttgtttttatatgcttaaagggacaatatcttgttttcaacaaatgctctctgagactcacagccaagatgctttcttcctttttccttttcctttcttcttttggctttctcttctccttcaaaatacatatttaaaaaaaattctttataaaataattgttcccttcaagttggggttaaggagaaacttaaggaagggggaaacgtcctgccgccatgtaagcggggaatatttggtgggtttgttgttttgaagcatcgtcctttgcaggcagcaagctgtgggtcagccttgccctactgagggtccttaggaccttgcgtttctcaaggaggtaatgggagagtctgaattcgcatcagcattgattttgaattcttttctttgctaaggatgttgcacaatcagtgggctgcagagctgtcactgtgaatgtttaggcagaggccaccttttgggggagggctggaggagaggggtcaccgtgttggagagtcaggccatgaccgctaaggaatcagattctaggaggctgtttgctgcagagttgatggcccaagaggcccgtctggaaatcaacagggtgggtggggcaaggacttgtattcttaagtacaggttcacaccaggcttggagggttaaccagggggcccggctagtccacccggcagattttatctgagaacaaatacttttctccccttcacaccagccgacttcattattgctttgaaaatgcagtcctttggaagaggtttcctttgcctctctgtcaccaaagcctcccattgccaatgtgtcctgtgaagggagaagagagaagcaacttcccatctgtggggcctgagaggccagggaaaccctgttggggcctgaagtctatgttgtcctgttctctcccaggctggctgctcttggtaaagggtaggagcatggatgggcttggctcgtgtgtcttaggtggttccttccatcacccactgtgtgaaggataggatccagtgttctggctgctgccaccaccaaataatcccaggggaagtactttccagaggacaaactgtttgaaaaatttgatcttccagatattatagattataatgctacggcctcttagaatttctgtagcacttgattgcaaagcagattcgacattttcatcttagcagctaaaataatgggtatttgggtccaggacagacagacaccaggataaaagcatcagagcataccctgaaagcttggggtgtgaagatgacctgtgtactagagggctgtgttctcaaattggggttggggaggtgaggcctgtgctgtgacaggactgtgagttccgtgagggacaggaccattttgtatttgttttcactaagggtcctgaaccctgagcagtgcctggcccatactggatacacagtgtgcattttgtggggactcaaggaaggaaggtaatattccagctcagggttctctctgaccctgaatagtgttatggactctttgggaaggatagaagctttcttagttttctgacagaggcctgtaggctgcaaacgttgtgtttgtagaaagagttgtaaaggtgtcatgagcctttatttaaaagtgtctttaatgtatcttaggcatctttttcttttcatctaacactatggacagtttaagtgcaaaaggggaagaaggcagggtgggggtgcgaagagataactgggaggaagagatgacaaagcagagatgcggaagagacaagtgctgagtgggtgaattggtaaactcggcttgccatgccttggctgtttgggcatggagttccaagtgttgtggccttatctcatgagccttttaagtttgactattgttcacagttcttctactgctttttttgtttgttaattttgaatgaaaactaccgcaggccgatagaagtttctttttcgtttgcgctggaaggctgaccctttcctcaagtggagacccaaatgcagaagagctcttcccactagtgttttagcactgaataccaaatgcaatttgggtacaggagagggctctcccttcctggtcagccatgaagacttgaggtttagactccaccaccctgccagctatatgaccaaaaggttggaggaggcggcctttcacccacttcccaaatctttcccttgggctagccctcgacaggtctttgctgagtttggatctgaaactgattaattctgataatactggcaggggcatgctttggaaccggtgatgctttgtgatttctgctggggaaaatgagaagaggaaggcagttcagtgcagactagtggacaagggatgggagtccattctagctctctggtgggggtgaggtacaagaacttctattaaccttcctggcctctgtccaggaagaagtaggacactcagagggctcagaagcagcaggtgatgccagatggtctggagtgagggtctaactggtcgggtgggatagaggaaggaggagcaggggagacagaggaagtgagcctgttggcactgattggtcaataggtcttcagctcatccttaaacccttacctgcttcttttcctagaaggaggccccttcctctgatctctctctccagtgaagaaagctgaagtccagttcttattttgctttgcctaacaacagaagtcctggggaaagacaggaagaattgagattgatggtacaatccctgtctcccatccctcaatcgctgggttttcatactttatcccagagaaatgggggatctccatgaagccagacttgaaatgggggagaagcagcctggtttagagctcgaaagacatgcccctctcctgcagggtcctgctgctgttggcctggtgtcggtctccatgtcacccagtccttgtgtgtggcaggcacccacaggcctggtctgcaggaacttgagaagtgtctagatacccctttctcttagccttttgggttttctcactattcttttacctggttttttaccttacttctcaagagacccctacccagctcttcctcactatccatttgcccagggatattgggcaaactccctttttaaactcccaggatgttgaatgcccattgggcctactggatgatggatggggtgggttcccagcaagccagtttttcttggccagtggattccctttctccctcagaagatcacaagttcttgccgggtgatcctggagagttaggtatagagcaccagaagctgggagatttgtcttcatggctaagaggttggctttggagtcagacaaatgtgggtttgagtcccagatcagttcatgttggtgtgtgactttgagcagactgtttgacctctgtgatcttcagtttgcagtggagataataataacacctgcctgttgcggcagtgctgtccagtagaactttcttcagtgatggaaatgctgtatgtctgcactcttcagtaaggcagccaccagccacgtgtggctcttaagcacttgaaatatggctactgcgactgaggaactgagtttgaaatttaattttaattaaatttagctagccacgggtggctggtggcttcataaattgtacagttacagttatagggagtgccatgaaggatgcatatagcctgcttagcacaaaaccttgcacatggaaaggccgaagcaaggtattctcacaaggggacagagtccccaaattgtcaaggcctcagacatagaggacaagatccttggtgttgcatatgttgtaagatttctcagagccctttcccatatgtgacttgttggctctacggtcctgcagtgtaggcaccgtgggcgccacgcatcagatagcagcactgacggttaaagaggttgagtaacttgctcattgttgcacagcagaccagtggccaattcagaactggaaaccaggcctgcttccctcgtggacctcagtgatctttatccataggctatatcaagatgaggtcttctgtggtcttcccacatgtctacccccagaccaccatactacaggcatcagttccagtgctgggaagaaaccagatgaaacctttcagaattcagtaaaacatgagcatcagccacatgtggatcagggattgccaccctgggcgctgtttacatttgggactggataattttttgtggtgggattgtcctctgtgtttaggatgtttaacagcatttctaatctctacccactagttgttgttatcagtgcccaagttgtaacatccaaaaatgtctctagacattgccagaatcccttgggggaaacaattactattggttgagaggccttgttatagaggaaggagtctggctctaacctgggagatttgcttaccacctggtcttcctgtgtggtcttcctgtgtgacagcttcttgccctctctgggcctcatttgactcatctgtaaaatgagagatcaaatggtgtggcttgggaggaggtcagtttgagaaggagcatatcatataaaataagtttctaaatgaccgatcttgatttttatagcctaagaaatgccatcactcctgccttccttatttggagaaagaagaccctctaaccctttttattttaatttacggaacaggtatgctctttggttgtgaataagatggtaggtagatagaatggggctctgtctctgcccctcaccttgttcttccctcatgccacttgggttttccaaagagtccctgcccttaagaagtcctagccagcatttcatttgtagtgctgacctgatggggggagacccccaaaatttaatgagctgtctctgcaagggtaatgtgacttttacagcctgttgaggggcaaggggagatttgcataatgttccaagggggattaggtggctgggggttgccatggcaaccccacagggatgaattgagaatttttcctcctggcaggagttggccaatggagtctgggaaggtgggggagggggcagggggttatctgaggggagggaggagggggaaggagagagggaagggtgggggcggtgtgcctgggatgaatgggcagtgttgggggaaggtataatctgaaaaagcactccctgttctgtctgtacaagcaagctctttgagagccatctccccccacaagtaggggtgggaggcaagcagagtttagtgtgtttgggaaccaagaaattaaagtgaacaaatatttaaagattattggatcttgttaacaggaagcccggtagatggaaactgaaagtctgaggaatgaaactctttagagtcctaaagccaggagggacttgagctgtcatctgggccctgtggtgtctgcctccaagtctctgttgggtctccatggaatgctcccaagggcagggcactcacacagcacctaattcatttttgagagctccgattattacactggactcagattggacttctttattcggaaactgaggcccaagtgcaggatggatctgggctaggaatgcaggactctagactgtatgttgctacctgtttctggggttgggttgcctggatgcatgctagcttggcctaaccatccccagttcccttacactgtagacccctggaagaaaagaggaggtgggattcctttcagggaagtgtgcagaagggtcgtcccaaccccagcaaccccagagtcccttgccgttgatcggtcctagctggggaagggtgagtgtgtttcctcctccctgccctggctcctcactgtcatcctcacccgcctgtgaagggtacaggggctggtgcccagagtgtcctcacaggccggctcaggccagcatccccttcccttccggaggagacagatcctcagggtcacgctgaggggggctgggcctttcttgtaccaagtcctcccagcataaagaattcagcaggcttcctcggagggcataaatatttaatggcgttgtagttatatataatttgatcaatatgtcagtgctaaaagggcctttaagaaggctcacctgtcattgagtgatctgtgatgtgaaccttcaccagcccctccagtagcgggaggggctacatttcccaaggctgctgcatagatcatttgttgaccctcctccccttcttacattgtagcactgcttcccctcagagcccatggcgtggatggagcagggcctgagaaccccaccccagcttttgttggctgtcccccggcccccccatggatttcttcctctgttgataaaacacccacttgttttatttcagtgttctctgagctcggcctaaggagaaactacctggcaaggactatcctcttttagtcacatcattgagaggctatccatttagtattgcctaggaaatgcaatgggatattttaagttaaaattgcccagacgtggtattctgaatctgggtgattggcgcctggctgctgggaggctgctgggaaggttggggccagggccacctctttctgcacagcctcccaccccagcctttccctgcagctctgggatttaaatcaagatgaagcagactctcttcaaactccaaggactcagtcagagaagtaggtaaaacctgattaaaatttaagaacctcagagctgactgagatgacacccccaaacacacacattttctagaggagtaacctgagacccagaggcctgctgggatgaaaatcgtcacttccccatggctttgcaatgtaattcacctttcaaatgggcaggtcccttcctcatctcatctttcacacacatccgcaaactggtctcagactcacagtaccatgctctttgcatgacactgccctgattttccgaagaagaaatcctcatttcacaaatgtaactagaagcctagtagcatgggatggccgcttgcctgtctcacagacgtggaattacttcccgctgaatgcaacaacttggagaaccctggcctggttgtcttagcctcaccaaccagtcttcccttttgaatcacagaaactgcacagtaggggcttgacacttagaagtatgatatcattgttcttgcctagaggctcttccacagtgaagcgcagttttgctgatggacagatttgaatggctcgtgctctgaagactggtccttgggacccagcccaggtcagccagctgcccagcaaccagccagcatccatccacatctcaaggtggcttggctcttctctgctggtcttttgtaaattcatgtgatgctctgttttatggaggaaatgataagctgcacgccaattcgggaatatttagggttctaaaactctaaattagggctcctggatcttatacgttatctagttaatcccttcattttgcagacaacgaaattaatgcctagagaagggaagtgatttgcccaaagccacacaactaaatggaggcagaattggaggtagaagccagctcatctctgcgtggcgttggagcataacacactctttgaaggggcagttttctcttctccttgcctttatttggctgaggttaaaaggaattgtgcattcagagtccacaggtacacacgacagggcagtttaaaactaactagcagacagactctctggtggaagtagctctcgacggtgtgttggacacagtcacctaaattaaaaataagggcaaggactggctgggtgctgcaagcccaggagcaggaggttgctggggggtacagatcaagagcaggctccgtttcccttaatttagtgtcttgggtcaagggccaaggatagtctgaagtagcagcaaacgtgaatactagactgtggttagagaaatagacttttagaatgctcaagtaccctcggtttacagcaagatgttcagaggtcctgctttaatgaggagatgatcatgcaaatgggagctactaaggcgcatggaacagattgctgtttgggaaattacacttgccccccactatcttgttttctgtcatttatttgcctaacaatcttgacagagatgcagggcagatgttactcccagcgcccagttggtagtgcagattccggatgtagcaggacctctgtccccatttctctgaactgcttctctgtctgtatctagtagattagttccttctgaggaacaatgtttttccaccaacaaagcgcctgctttgaaccatacttgaaaagaaactttcaaaggcggcaccagcctccctgaacaccttttccaaagtgctttccaaagggagccatcttcccacctcccaccacctctcagattcgcttctgaagacctggctcaaaagcagtggctttgtgggaccgagatggagggaaggatggaggtcggcctctggaaactacagccgccttatcgataacggattgcgccaagttgccaaaaggagttttccaacatacgatcgagttccagtttgtgatttgtgacctgtcccaattgttgaagtcacacttgatttttttttttttttttccttttttggaactgatgtttagagcttgtttgagttggatccaatgctgttttaacagctgttctaatcagaagtgctgtcaattattaaccttaatggtggtttttctttcaaaaatatttctctaagctctcttgaaatgtcaaaatttggcttcttggtaggaagtcatttagtgaaatcacttaatggctgggcatcagtttccccatctgaaaagtggagatgttgacaagcgccttctccgcggggttattgtggatgcacacatggcgagttgggtgggtgatatcagcggtcattactgttgttaggagggcttctgttaagccagctttccatttccaggaacttcccctcccccaagcgccaccctccaaaaaataaacatttctttaaaatgttgagcgaacagctttcctgttcatgctttgactctgcagagtgcacgcagcccattctcagggttgggcagcctttgtagagatgggggaggcccaatccctgcttccactttgtggggagaccccaagagggtactagcagatgatggcacagtgacagctgggagggatgggatgtgcttgcttcatgtccctttcccaggggaggggctgggtttacgttgggagaacttttacggtgaaccaggaggttctcccaacgtaagcccagcccctcccctctgcctgcctcaaccctacacagtcctgtctggtgacgtgccaaagtccttcctgccttgcagagaggcctctcttcgtcgaacatgggcctcaggaaagacagcctgaatgccactaccccaggcttgtggaaggttctgcatctgtgtggcattgttgcgatagccctcagttgatgcttgtttgtggtgttgggaggcaggaactactttaggagggtggaggggtgagaatgagagaggacttgccctgagccacccagctgtggtcacctgatggcccggatggctacataaatcctgggagatccgttgtcctcataaccagagtgagctgggctccagaccagccctatgggaagatcctgtctgtgggaagcctttggccacgtgtttgctgaagggtgtggggaagggcaaggtcagctacgtttcttttttgtcaactcccgagaccctgacccttggcctgtttaccagtggaaggaggccatagccagaacccttttataatcaccctgcctccctgctctcccagagactgtgagagttaatagttgctgaggaggccagaatgactggggatgttctgaccttgcccctgccttcctggctgtggggaggagtagtggccagggacccatctaggtggcttgcgattggcctggcttggaggtgccaccccaccccgttggtgaagggcttgggccactggccaccaagtgtatgtcaacactccatccaccacggcccctcccacagatgctgcccatgctggggcaggcccagatccacagcaaggggtcactgcaatatgaagtctcaataaatgcagagatgccagtgatactattctttgggccaaacatttacggagcagctactgtgtgccagacactgctctattgttgtttaagataacaggccttggacctgtgagcttcctaaacagtaaggttggttttttttgtttatttttgtttgctttttgttttttacatatctttctattcttatttggtgcatgaactcaaaggtgagagaacttgttactctgccggtttggagtgagctgcagcctatgcttgtttctagaactcctgccctatccaacccggacttttttgcttcattccccattcctactatcagttgatttaggcgaggaaaaaataagcagagtgaggaaggaccctgtttgggagagctcttcccacttaactagattaacaatttatataatgattatttagtaatcctcctgggttccttagagtatgaatgacgggtgtctagtgggtggagaggccagggatgcttttaaaagccctgcagtgcacagaacgggctccacacagcagtgaattatctgacctcagatgtcaatagcatggtgtttgagaaaccctgatgtatggtgtcctggctagagtgccccacacatgtgtcaatgtggagtcccagtgggtctgagctgggcagtttggaagtgggggccattgttgacacagttggcctgggatatgagcgacagtcctttataacaggaattgtctctccccaaatgccaacagtggtgctggctgggaaacactgactctgttcctgaggagctagagtgttctaggcagaaagctgacagcagtgattcctgatcctctccctgccaggaacccccactgtagcggacaggctccgtaggttggcgagccctgccaccgtggctggcagcccaggacacaggcctgcaaaaacccataaggctctttagttgatggcctgcctttccacaaaccagaggcgtcctctttagtggccaagggtggagggggtggagggtgttagcccaaggaattctcccgaggtccagggtctatttatgcgccttcagattgtttttattttaagtgcacaaggatttctcatccagaatcatttgacatgcagatgatcacagatttttaaaggctgttgtcatggttttgtctctgaaagattgctatgtgctgatgaaagctttgaagccagctttgggacctcagtcctggcgggctcaggattcagaatgagataagaaaagcaattctgagagtcgtctgtcagtggttctaggcctttctatctggactcagttaacccgtatagcaccactcttgatctgagatctaaagtttacataggatactggtggaaactgttgactttctaaatgcagtcttttctagggtgttgggagatgaggcagagaattgatctacctttctaagattgacttctgtgagggattagggatctaatgaattacatctctgagcagcttcttagacaaggcaatgctatatcctaaaaaatgaagtgttggctgggcatggtggctcctgtctgtagtcccagccctttgggaggccaaggtgggcagatcacttgagcccaggagtttgaaaccagcctggacaacgtggcgaaacccagtctctacaaaaatacaaaaattagctgggagtggcagtgcacctatagtcacagatatttgggaggctgaggcaggagaatcacctgagcccaggaagtcgaggctgcagtgagccaaaatcataccactgtacaccagcctgggtgacagtgagaccctgtcttaatgggaaagaaaaaaaaagaaagaaggcttaatggtaggattttagcctggtagcatatatgtgggggagggattgatcttggtgagggagaggctagtcccagggaaccctttgccacataggaccgcttatcagcttagtcccatttatctgagagctcatgtcctattggcactgggcaccagtgggcagagcaattcctctctcactaaactgtgtttcactcttacagtgggttttgctgggttgttgggggtgatttttatttcgttttgctttaattagggattccatccagaggatgcaaactatattctgaaccagacatgtagactacctctgatggaaattggagctccctaaaatgtaggcagcctggctgcaagggagttgaaagagatttcttcatgctgtggatttagctagagcctcctggtaggaggctgactgagggcagaaaggatggagccccgtggagaggggctgtggtctggggggagtttgcatttccacttgcctatgacatttcagtgacttgatttatttgcctgagcttcatgtggtctccttgcctttgcagacagagattgcgaagagactgaacacaattttagcacagatcatgcctttcctgtcacaagaggtaagaccttcttttattatttcttccttttctttccaaatcagcccagtggctggtggggtctcactggagcctgagccccagccccagccccagcctcagcccctgtccattcatactgactgagctgacaacctggagatttccagagccttctccggccagtctggaggcagggggccatatcagagggaccatttgctccttcttctcatagaattgtttctctgccatcacctgagtccagagattggagtgctggcatgcgacctaaccatcagtgggcagtgggtgcctctttcccatccaaactagcatccccagcccaaagtggacctcagttcctggtacagagtgcccttgctgggagcatgacccaggtggtcatgtcactttctacgcctaccttccaagggacctccatttgggacagcggctggactagtgggtgatttgagataaatgcctgcaaagaagccccctggtgccgaccagacagacgggccgactttagtgggctctgtttctgtcctctgatttcactccagccagggcaggccctgccctctactcccactcagtggctgggaccatgtcagctccctcagggactcctaatggtgacctgagtaaatgattgaattaatatataagaatcagatatggcaatgccctcggagcttgcagcccagtaggagagaaagctgtgtatgtggctggtactacctcaaggccaaagggaattaatgcaaccactttttaaaatagactttatttttttaagagcagttttaggttcacagagatttcccatatcctccccactatcaacatcctcaccagagtggtacatttgttgaaactgatgaatctacattgacacatcatcacccaaagtccgtagtttacattagggttcattttaccactttttctttctctatctgttcatctggaaacatactttgttttctctctatttagacaggtatggataaggtatatgtagacatactttttccccaaatcctttgacggtaaattgcagatatcctgacaattcaccactaactactataactgcatctcctaaaaacggataccatccttcatgattacagtattgttaccatgtttagagaattaataatcatcctgtaatatcatctgatatccagctcatacgcaaattgcatggaaaaatttgtgtgtgtgtggttgactaatagccatcttttggcatgctctttgttttagaacttaaaaggaagtttcaattacaaaactaatacatgctcattgaaaaaggtctaaaagagaaagtaaaatcgcctgtcaccctcccccctacttgtgccctgtgcctgttcagtgggactcctctgtctgctctgggcctctccgagaggccctgccagtgctgcacagcctgtgacctcctctgtccaggaaagtggctgcatctaacgcacaccctcttccctccagcaccagcagcaggtggcgcaggcagtggagcgcgccaagcaggtcaccatgacggagctgaacgccatcatcggggtacgtggactccccaatctgcctcttaccgtgtgtatagcccttttattcctctcatttatcataaccagagattgaccctgaccttagctggcctcaaagaatggcggccccagggctccggcttctacaagcaccccaagggcttggacccatgtagggctgtttcccccttggctcccagttgcctcctagtcctcaaactaaaggggagccagacacgcctcaaatccacctcttcagccatctgcctcatcttccactggcttttggtgtccttgccattgaggagggtgggggcctagggtcaccttcaaggccaggccagctggccagtacctggccacctcctcacacttaccccggggcctgtctgcctcctccctggcagaagtctgcccttctttggccacctgggatcagaacagtctctgctgtactgttgatgtgcatcgtgctgtggaatttgggtttacgtcttgctgtcccatgcgcgaagctgcctggctgagcattcatcatgtacgcttgtgaactccagctggggagctgagactggttttcctgactttctagaagtcccgtctcccctttacacaggaagacatacccaagagtgctctgtgaggcccacttccggactggccccttagtggaaaagggaagctgggtctacctggcttgtatctttaatgcatttcttaggttcaagtggcatctttctcctgcttgctgctttggtgtgaggctagtgacatttaagataagcacctgaggaagaagagtctttttagtgtgactttgggcaaggctcttacccttggggtgtacctgtccacctttcatctctgaaatgaagagggtggacaggatcactgcttcccagtccacggaggagcttctggacggtacagatacaggggcacttgccccagaggtcttttccataggtctggggatgggactggaaatctgtgttcctaacgatttctagatcattctgaagtgtagttaggcttgggaagcagtagactgattcaactctaacattctgggaacctggttggtcttctttcctctttctgttctcgtgggaagtcactatttcaaggtggaactgaaggccccacaattttcctctgcttggtaggatacatgatgactcttgacttttccgcctggggcagagacctggaggtctgtgttttagtcatggttctcccccgatgtgacctttggcaagtcccttctcttccttgggcctcagtttctgtatctgtaaagggagaacgtacaccggctcatctctttgggcactcctgactcctaccaggaatgctgggaggctggaatcacagaatgacacttatggacaccggcccttccatcacactgtcaggacccgtgatggttgcagagtcctttgatgaaggcagcacagtgggtttgtccttctgggctgagcccatagggacacttctcagtgctgcttgggcaggtgggggatgcaagcattggcctggtttgaatcctggcctactgtgtggaatgggcagagaggagtcttgaaactggaacgtgaagaagtgttcagtgctggaaggcagcaccccaagaggggaaatcatgatattttaatgtttaaagtatcatcagagatcatctagcccggggatcgtcaaccttgacactgttgaaatttggggccagatcattctttgccatcctgtgcattgtgggatgttcagcagcatccttggcctgtagccactagatgtcaataacaccctgacaccctgatattcataggaggcaaaatggcccttggttaagaacctctgatctagctcaatgcccttgttttacagagaggggaagtgattatgatgtttaggaggaaagccaggccagaggcccaggtggctgactcgcagcccagggctcttcccctggccctggtgcagccctggagggtggcctgtgtcatctgtctcagtgaccagctctcagcttggtggtggttctgctagtggtagcagggggctgcagggttgggacataccttgtgaattctgttttccgacatttctcctcttccagctcctcaccccatcccctttcaaccatcttcttgaggtttccaggccaactcctcctacccctgcggtggccacagcagggtcccctctcaccctctgcccccctctttggaattaaaatcctcttatgaaaataattttttttaagttttaagaaaggagtaaaactgggggagaagcactgcttggattagctgtatttcccttaagtagtattcaggaagctacaagttaggtcgaggcagctcgaggcagacattggaattcaattaaagccaacgagtggggcctgtgacccccattttcaaggtaattgcttctccagctccaagtgaatgcagccatcgccctgtcattaagcaggcagccgtctaatcgctgcgcctgacagagcctcacaaggcaggaattacggacagccgagtcgtgctcgcactggggagccgtgcttgactgcactcccgcgaaggagtccgctaatctagtcagggcgttctttatctcctcctcgaggagagcagagagcgagcctgcagctgagctgcctctgggaagcaaggtgaagaaggataacggggtgcagagccatgggctgagcaaaagggcaggcatcctggccccagcaggaaagggcaggagagagagggtcccaagaggctcttggcagctttcagtggctacccccactgcactgttggatttgctgctctggaaggagacacagcctggcatcctggtcttggacttagaggagggctttgggcaagtcactttgttcctccaggcctcagtttctccatctgccctaattgtttagtggctctcttgctcattggatttgaaagattctgaggttgtggctcggctcaactcaactcaaagagaaatcagatacctccggcatgggcagggaggtagctggtggcatatttatcatgaggattagagtattcctggggtcttccttcctggtgagaaagggcaggatccaaggtcagggtggcatgtgtgaaaaggggaaggaaagacagacagagggaaccaggctctcaagccaagcctacccactcccctgctggaccacagggaactcaagtgtctaccgagggaagagaagtggaagattgtctctcttctagctggggcctggcaagacttggttacagtagccctgtttctgttacatgcttcttggatccaattaacaggaggggctttagaaggacaagattcctgagcacgaggagggaaatttgacacttggtcagcaacctgcagaaggcagcatctatatttcccaagcagatttaagaccctttgagccgatatatcacccatttctggaaccctcttgttacattgctatatcatggcccaagatctttggactggaaagtggaggaggtctcatctgcttacctactgacaatttggtcttcattcccttggaaattaacagtaggggagatgtcacagagcattgacttgattttttttttaagtgggagggaggagaggaagagggacgttgtagcttgtcacaaaatacacaggatattttgaagccatacctaaggtattcactccaggatgtggatgagctgcattcagttgactgaattttgtgtgaggggaaaggatggccaagagaatgtgccttaggatccgtctttcagccaggcagccatggtggaaggaggtaacgctgagtttgagtctgggctctggttgctgatggcttcatggagctgttcagcctcccgagcctgttcaccatctctgaagtggggatcacaagggttgttgtgagcactaaaagctattaccaaccccagaagctcaatgcgtgtggagctatggtgcccactgagtgatgtgaaagagaaggagcagtcggaggcctggagctgttctcgctgtccttggagggcaggaagtgttcattttacgctgtcaggaccctgtctgactcctctggtgggagcccttggcgggtcttggctctggaaatgcttagacaacttcactacgttcaacccaaatcatgaacctgagaaacgcagcattaaatcacctagcgaaggcctaaggcgtgatgtgcataatccaattacacgtactctgcaagcaagatcttcccttcaacctctcctggaagtgactgcaccttctgagccaggccatgggtgcttatcacttgtgtggagtacatgttcgttgtcctatttgtgctctggcaggaaatgttcaaggagggaaaagtgaacgcccatgcatgggcttggttccaggctcctagcgcctctttggggttagggatgcaagagggaattattgacttcctttcatattgtggatggaggagttcccatattggaaggaatggtataagctggagacaggcggtctctgattgtggaattgattccatttctctgccatggggaaagctacccagttgaaaacagtatcagcctcccactcagacatcactgtgtttgagcacattgtgctctgaagccagcagacgtgttgcaggggataggaatacagcctgaggatagctgtgcccgcctgcctgcagaggtgctgagctgtgatagggacgggggtcaggtggggctttgcccactggcccccacacctgtcagggaaaaatcttcgtttcactctctgttgtacccaagattgttgttagcggaccctccgtctgacaagccctggcatctgctcttgcactgaggaaggagccttggaggttggctctcctgtccctgcttcccagagtctgctggaccggtccttgctgtgccttcaaaccaccccaaggagacctcgagggagtttctggctctttgcagcaggttgctcttgcactcagagatgaggaacgcttcagttttgcatgggagattccttttctcttttgcaaagaggacgctcctacctgacaacactaaggcagaaaaccagcctctcagccttggaagcttaacagctttgaaagccactgtctgccaaacagccgctgctgcctttgttccaagtttctgacgtcggttcactggttcatgttttgggcaagcaggacacctcatgaccccattgatgcttcctgtcccaactaactgttctagctgcgtctaattgggccttggaaggaaggcatggagctgggaggcggttggcacctgtggacaccatttctcagcctcttcatataccttttccaaaattttcactaatttacccacaagacatgtactgagcaaacatgccaggcactgttagaggtgctaggatggagaagacacagtctctgtttctggaactcacaggttgccaagcagtgcacaaaggcaaaagaaacagtgtacacctgggatctgtctgtttgctaagattgagcacctgctccatttttacctgtagtcacacatgtgatcctggcacaacacagagaggtcggctgacttgtccaaggactcatagctgataaaggatagagctggaagtctgccttattctgcctggctccattgtctgtgccgttagagctcttagaacagagaaatccattctgacctgaagtgggagggcattcagaggatatggcctttgaactgggcaaagctgagcctagaaggttgggtaggagaagagacctttcctggtaagataagagtcagggtgcgtggagctattcaactccatcttgccttgggtacaaatgttcagtgcacattttctctagaaacagacttgttcatgaaaggagttagctgtgtctgcaggcagcaaagctacttctttgaagccttctttcccctcctcttctttgtctcttcctcaagggatcttattggctctgcactataaaatgtggattaaataccttgctttcagtccttgctttctgggattttactaaatagttatcaccagcagaattaacgggcctaccaacaatttgtctaaacaaaggggccctactggagactcattttaaaaccaggtatccagataaagttgtattgtccgaccacaccagggaatactaggtagccattaaaaaggacaagaaaatttcttcagaacattcctaaattaaaatcaagctgtatagcagtatggttcacaggagtccatttctgtataaatacatttgaaatgtgtagattttcataaagaaaaacctaggcagatttaacagtagaatcttccgagggtaggattgaagggtaattttaaaaactttttaatgtctacttatttttagtattttcttaaaatgggcatgtattagttttgtaataagatattaaaaattacattttcttaaaaaagaaaaagtggaggagctcagagtaagcgcccatcctagaggagctggagtttcttagctgggaggggttggatctccgcattggactctgtgatgctggctccaggggcccccatagctttgtgtctgccatagtgtctcagtgcagatgtggggtcagaccaccctgggacagtgcccatgaactgcctagcaacagacgtcacagaagtgctctgacagctttgaacaacggccgcagtgccagcctttcacccagaactgacaaagggagccctctggggccaggagtgccatggcttctgtggctgccgttaactttgggatgaggccaggtgggcagtttgcagcttagctgggggagagtagggccctttatccataacctgaaatgcttactgcctcctcctgccagagccatgggccttcactgtgttctgttatctgttcgcggttgccagaaaaccatctcatattgacaggcgagctcccttagtaaggtgtgagatctggaagcttctcagatctattctctatggcactttccaccaacccctcttgctttggggatcttcttaggaatgagcattctttggatgaggggtggtggttgacagatttactagtggtgggatttggccaattactagctacctactccagccccctaagcatctattaaatggccacaacccctcccttgccaggtggttggaaggtgcccaggcattcattcaggcattcagtaaatgttagttttcttctcttgcactagttgagaagaaagatgtgtgcataggtggataccagcatacctaacttctctttcagtagtggagaagaagttgggtggggcgaagggagaggaaagagaagcccaagcccctgaggctagtgttgagtggggaagttgggcctctggagccagggcagcggagtccttgactggggaggagacagggagaattgcattgttgttgataatactgacttgctgcatggcaagtttttagaagggttcagcaatccattttaaactctttgtaaatgttagctactgccatgaggcttagtagctgtgcgccatgagctgctgcaaacattatcttacaataatcctctggggtctgctgctttccccctttacagataaggaaatttgaggctccaggacttgaagtaacctgccccaggccacacagctaggaagtgccagagctgggatttcaatcctgttctgtctagttccaaagcctccactcttccagttaccccgttttccaccactgatgtccggtgacgttagctctcattccactggcccccagctcatctggctctggggcctttgctgtgatgacctgccctgcccctgctctgtaaggcaggcttggagttcctaagaaataaggagccttccccagggtccagcctcagggtggaagatgctggcagctaatgctgaaggcatgtatgcatgagcaaacactgccagggctgtgagcttaaaaatggatccctctctactcagagggaaccccatgactctgcggttttttaaatgcatgcattctttatctcaggcttggaaacaaacattgagaaattatttgtgaaacgggggtgcagggagttggggggtgcttgaagacataaatctttacattacagtctattaacagacttccttcagcgagacattcatgtgaactgagctgggggcaaaggttttgggggtgcttccccctgccacccacccagtgaaggagcaagaggaatgggaagagccactccctccctccctcctgaggtggccacgcctcccctgccctccccaactcagctgtactcaccaccgacttcattgcagcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagaggtgcggctgggctggggcagagggtggggcggggcaggggtgggcatgggcgctcataggcctcacagtgagtggacccagcaagtgctgtcgtcctaagaccaggagttaccaaggatttggagtcatctgttgatacctggtgcagggaagccaatgccatccgcatcccatgcaccttttcctactccttggtgtggacctggtattctctgtcctgaagaccctgtctgttcatctggagctcgctcccatcttcctacaacacccttgcctgtccttcaggggccagccccagtccaacccttcaggatgccttcctggtcagactaggggctttttcaagttcctgtaagagtttaagagttgggatgccaaagttgagtccttgttactgtcgtcttacatcctacccctggaaaatgtcttgtgctcaccacgatcattagttccctaggacaggtgccaagttcttgggtgttttccttacatctatgtctcaccaatgcagaaacctgggaaaggtgcacagtcagtgctcaggtaaaggtttgttagctgactgcctgtaagtgggggtagtgcacaccccagcaagagatcacatagacttggagtcagaacttgttctctgaccctctctgcagcccctaccatgaggacccatgaagctgcaccgagcttggcctcaggagtggttcattggatcagaaaagagaaaagcctggctccctgggaggcccttttcaaaaattggtgccaaatgcactctgcccttagatacggtatttactggggcacgtagccaacaccttctgagcactagggacctggaatgtcaccatcctgccttggcccaggccacagggtggtagccggtccagggaactggaggctacatttttttgtcttacagtaggatggtccttttggcagaggaagaggggcctctccatagcagacaggagaactggggagctagtgcttagctgggcacagtttcagaggcttcagcttttaggggcatcctgacaaagaatcacagaatggtgttaatttcaaaaacaaaattaaaccactgttaaattcctttttttttttttttttttaacaataaagttcttaactcccaggtcctactggtattttatatggcatgatccttctcaagcttgtgatcttaagacccctagcctgctaaagagtaaacttggtgccctctggcatgacagggagaactgggtcaaaggcctaccctccccaccctggggactgggcctcccttgcccaccctggggactagaggggtgggggcagcattggaatttgggtggcaaatttccaaaccgagaaacgccacctaatggccctgccttggctgatccacggagacagcaatccaggccttctgctcattttaaaaccagtgcactagcaaatcacaaaagccagctggacttagactgacctttttcctttcttttttgtctttttgttttggggtgcctgaccttcctcctgtcctggccttctttccccaaagagagagaatccagtgcggtaagtgttggcactctggaacccggaggggtgtttgggtgctgggaggaggtgggactcggggctcccagaatcgcgggcctgagaccagtcagtcggtatccaaagctggcttctgggttcccgcttctgctctgtgggttgtaactagggattttgttgtttgtttactcttgctgagctgggagcttcagtgctgatgtcttagtccagagccagtggcagggtgaggggtagctactgtcataaaatgggagctgctgtcgtcacctgttgagagtgaccttcagttgtggaagcccttcctctctccaggctttaggtctgccatttgtcaaatgaagagcttgggctaaatgagctctaactccgtttcatatgagaggtgatactctgagaggtcagctgaccagccctggatcttccattgcgaggggctttgtggagtctctgggctaaacccagggctaaggacccaggtgtcccatgttcagggccaaggtttttaccacccccctgctaggatgcctcctgtatgatcttgcatcctcctcattcccttcaaacgcctgcagtttctccctgctctgggctttcactcgatttaagaaagtgctagcaggcgagcattaaggccaggccgcctgcgtgtctgccagctctgagatttgttgtaaatctttctgatcacactgaggctccgaggttctgtttcaagtgaataagccttctgaataagcgcagtggagtctggataaaaaaaatcctccagcgattagcaaagctattttattcctcatcgctgtccttgtatctggggccatctaatctgttaggatggctttggttattacctcgtgttaagtaggacttggaaggtcaggcagttaactaaccatctagacagcagcttccttgcgcagctctctccaatccagccctccttcccttcctggccctccccctacccaggctgactttttaaacctcccattagcagtgaggctggcgtccgtggcctcttgacccgcctacatgctcagaaatccaggaccacatttgggctgaggaatggctaggtacctaagagaggagtcattgaagctgaaaatccatgttcactgcctcggtactgatcctctaacagtggcattttttcggagaggcagtttgcctagataggcggaggcctggattggacattttaaggctgaggtctggtcccagctttatgaggccctgtgtagttctcttggcctctctgagcctcagtttccttatccataccatgggaataattcctgcttgaccaacctctcagctttgtttcggaagaccctttataacctgactgaggatccagattacctggctagcagggacccacttcagtggaattggagggggagtgggaagcccagcactctctaaagagcatgagtctttacctcatcctcatccctattggcttctggctttgtgccccatctgtgaaagttttctgctaaaagaccccccctgggaacccccaagagctgggctgtttaccatgctcgctgaggtccatgcatggcacacatgggcctcaggaaactccagtgggaatgaatcaagatgctgggcagaggcagcagtgggcagggccgaggctgtgcgcatggcatgtggcgtggtgacggtgtcagcggcggtgtagactgaaataatcaggctttggaaaccaggttgtcaacagatgaggcctacggcaggaaggacagggctgtgtcagagtgggaggggggatggggggacgggctggaagctgtcccagaggggttagtctggagtccaattagtggtagcttcattcatatttccttgcctagccgaagcaataaaaaatacttagttttttggccgcctgccagccagaggcgggctggatcgatgccgctaaatgcctgacatgactctccggtagcggcgagggttttcagcctgactgcatgagaagaaagagctcgctgttctcccgagccgagcaccgggtcgcgaggagaaacacgagcagccgcacgccccctcccctgcccgcccgcctgcaaggggcagccagtgcgaggggctggaagcatttctgcttagcacagggtggccaccaccgtcagaggaaatgaaatgaaatgacggtgatttttctgccggcgattgcagcagctaattgaattgtggctgtgcgcgcatcgccaccgctcctgcacggctgtggggaaggttgagctgcagttccattataacctccattttttcttcaaggcttgataactctgccattttaatttgcttcgggcagaaacttggccgggtagggctgcccagaacccggcttaggaaaggaaattaagttctgaggctggttgccgcactattcccaccgaatactgcccagccccgttccctccaagtggcccttgcccctgagccacgcttggcctctgggaaagtggagaagagaagggaagcctcattccacttgccttctgatgctcttctcttctgaacagatgtccctctgggtctccatatgacctcctgtgttgcatggggactgggacctgggatggcctgtccttttcttccagctccatcatagctggaccatgagctcctggagggcagggattgtatctcattcattctgccactcctggcctgcagcaccagggctgacccagggcagctgctcggaaattggtgggtgggtgaaggtaaagtttggactcttagaaaggagtaaacctcaccaatatcatagaggggcattggtcctgatattagtctctgggcacagaggtttgctggcaggtgcccttgccagttgcacttccctccctgctccccagctcggtggtaacagccacatggtgatttctgaccactatcaacccctaggactactccgtcatcttccctcttcccaggcctcccatcccaaaggcttctcatcctcatttgctttatagttgagggagaactcacgaaattttggggttccctttgtgccaccttctgctaggggagcttgggcacattcaccaacctcttggggtctccacttggtgatggctacagaggcagtgactgtccctgcccttgctcctttccctgtctgtcagagggaaaggcttcatgacgtggcatttttgttttttttacaaccctggtgtttctccagagttgctgacagcctcaccgtggaggcgggggtgttcacacagaacgcttggctgctcatctccactgggaagttggtggctgcctgacgccctccttccctatcaatctccccattcctgtcgggctcagcaaatgaagtattgctcatggcccctgcctgtcagctcagatccatcttacaagactcagtgcaaattccacttatccctcctttgagcaaatgagtgtggcaagcgcgagatgggtggtgaatgagacccaggtgaccctcgccctcacagagcgtagtcccacaggccagaaggcagacggcttactgcagggttaattatttaatagcagtgcagagctgcaaaagagaattggggatgcgcccagggcatctccccggggactcagtctcaggggagtggggaaggcttccctggcaaggctctgatggagccacgatctgcagggcagagaggagttcagcttctcttccctcccctgacctccgtgtcacctgcacttagctgtgtgcggatgtgtgaattgttacacgcagcagaaagttttaaccccgaaccctctttttccttccagaataactctgtgtcaccctcggaaagcctccgggccagtgagaagcaccggggctctgcggactacagcatggaagccaagaagcggaaggcggaggagaaggacagcttgagccgatacgtacgtccaaggcgccatggcaccactggggtttctgttgggtagggcagggggtgtctgcagggcccaagctgtggccagggtcttcttgtggttggcagtgagtcagagaagcacaggttggcgataggggaccctattgaggagagcagggtgggaacagggctagggtgaagttcacacacgctatgagcatgcgagccactgtggggcggaggtggatggggaggtcgtcctagcctccatggggtctcttcccacagacaggccaacaaccccatgctgctgtcatggtgctgccggaatcccacttggctctaaggggctgctcccagtgacccccaaaatgtggaccctatagtcctctcagttggcctgaggcatgcactcacttggccacccagtcatggcttttactagccttttaatgggatgcccccggcacgtgagaccctagtggaagcatggctgttgtgtttcccctgtgtcaggctgtgcagggctgagagctgggacagagggaaggggaggatatggtgcagggcctcagcggtcttgcacccagccctcttcagccacatggctgctgtgtggctttggacacattgagcacccaaaggacactcagctgtgtttctgtgagaggaggcaagttactatcccacacagatgggtgggaatgaccaggtgagagcagcacactgactgtgaaggatggtggatgtaaaaccagctgggaagaaggttctggcttcagagagaagcagaagggcaggctgtgggggcaggggcttagaactgctatgatggagcgggtgtcagtgcggctgcccagtgggtacaggagtggagtaacccggggcctgggctaggggacagcctcacggggagaccgtgttgagctggagtggagcctgttgaagggcagggctggagtagaaagcatggactttggggtttggcctggcttcaggtcctggccagtagaaggacagggtggtttgggctcagtcaggggtggggaaagtgtggcctcttactgaccagttggcttctctcttggttgcaggacagtgatggagacaagagtgatgatctggtggtggatgtttccaatgaggtatgggcaggcccggtcgcaagggggctcttggtttggcatggtttggaattattcctccccagggtgggatctattctgtctgttctagtattactggcagcctgagcagggagacaaggcctccagtcttggggtctcagggggtcaagaggagcagggcagggctttgctgcatggtgtctgggcatttatgggcctggagggcctcctgcaatgggtctccagagagacacccccaaagatcccaggtaggggccatcttctattccccgtgatcctccgtccccccagggtctcagcctcaggggcctgaggaggagctggagagcatctacatttggccaaacccagccatgctgattgaagtcctgaacttgtgtttgacattgggaagaccatccttccaccctccctaggcctcagtcagaccagatggttaagagctagtttttcctcactgtggggcccccagtctttcagccaagctcgtcttcccatcgcccatgccctctctcttcccactcccagagcagggaagcctcgaggctggctgttgctttcagtgcatctctgcatcacttgtgttttcaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcatgtatgtggggtctgggtggaagggagtgggaagggagcggcagggactggagctggggtggtgccgattggcaggcagaggggtggagtgggagaagctgggtgggtgattggccccggtttaccttctgtgcctgctgggcctgtgctaatgagttaacgtttctgagcctcggttgctacgtctgtaaaatgggagtgatcaccccagtccctgccaaacaaggttgggcaaggattgagaggctgttcggcagaagcttcataagggtctggctctgggcttcacgttgggaccggcaccagttgtgcccggctcctaggagaatggaagcctcatggcctcccttgttctgcatctcccctcttcagaacgacaaatcctccacccctgggctcaagtccaacacaccaaccccaaggaacgacgccccaactccaggcaccagcacgaccccagggctcaggtcgatgccgggtaaacctccgggcatggacccgataggtataatgggtaggcaccatgggctgggttaatctgattggggggagggggtctgctcttggccagggcaggggtgacacacacgcatgggatagagcacaggcagtgtctcccagggcctgcccctggggacttcacggtcagatttgaggaggtgacaccagggtttctgggacccctgctgggccagacatgaaagcagcatcagacgggtcagggctcccaaaatctgttcccacccctgtcattagtccagtgaggctctaagcaagcccatttgggcctccatatcctgctctgtaaaaagaggtgggtgcatctgccaagctctaagcttctttggctctgaaggcagggatcccacttgggtgggttcagtctgagaggactgcctggagcaggcagcttaagaatgcagggagggttattgctgggtgaggcggccatggccatgtcccaatccacctaaggcccacctccctgacgcccacccctcgcagcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggtgagctttggagctgtacgtagaccttttggctcctttcttggggactgggcgtggtgtggggagccagtggttggacgggtgctccccacatgctaaaggggcccctcagggtctcaaggccaggcagctgcccctgtgggaaggtgtatcggaaacaattgagacttggctggaagggtacactctttggggccagcagacctgagttccatcccccactggcctgtgagccgccctgtgacctcatgcaaggcagcctcccttttagtctgcaaaacggggctgacacctggctttcccagctctggggggtaggaatcccagggcaagtcaggtgatgtccatggagcaggggtctcgtagatgggactggttgtacaagactttctattgtggtgaataaataataagagttaggggtcgagcgcagtggctcacgcctgtaatcccagcactttgggaggccaaggcgggtggatcacctggggtcaggaaatcgagaccagcctggccagccaacgtggtgaaacctcatctctactaaaaatacaaaaattagccgggcgtggtggcaggcgctattcgggaggtgaaggcaggagactcacttgaacctgggaggcagaggttgcagtgagccaagattgcaccaccgcgctccagcttgggcggcagagcgagactccatctcaaaaaaataaaaataaaaagaagagttagggttggcggggagaggggccctttttcaggagacagttttcctttttacctcctggacctggggtggcctcctctccactggcaggcccactaggaccacaggagaggaaagaagtagggcagggccagctctgccttgcagaacagggaggatgctggttcacagtggggtctgcactgtcaccccttccctgccacgggctgtcctgggcctgtgtctcctctgaatcaatgggctctgctctgctcagcttgtctcttgggttacaaagtggcagagccgtgcaggtaggaccccgggtgggtggtggaggaggcaggggtgggggtgtgtggcagcacggctgatggagggctgtcttgccttgctttacaggttggttttgaccctcaccccccgatgcgggccacaggcctcccctcaagcctggcctccattcctggaggaaaaccgtaagctttggctatacttactgcatgctttgtagggtgggcaggagagagcactctacccccaattccaacaacgcccctcatcccctgaccaagggtttgccctggtgcacctccctttggaaaggtatctgtccctctagaggcaccgagggctggttgcaaccccaggaaactgtagccaagccacacttctgagcacccacagaagctccctccgacagaggagccatggagttagctaagtacatggccactgggctgggagagaaggaacactcctcaccgagtcacctggagctgtggtgggccttgccgactcctttgggttcgacctgctgggaaggccccagtgccgctggtcgcaggcccttccctgtcagcagtgcttccctcccctggagggcacactctccccggcccttcacttccttgggttgctaggaaactaaaagattgagcctacagataatgccgagacactgcctgacacagtcctctaattgtcaacgagaatctagatgctgattgagagggcacccaccagagcctgaaacagcaggcaggccaggctggctcaccacaggctctgacatggactttcccatttgctattgcaggggcaagcagatcccttccctaataccaccggctcctaaagcaagaggtggcatttcagccaggccctttccagggttggcatgttgggggaatgtatggatcgtgggaaagggcattccaggacacctgtgggtttctggtctgatttgaagcaaggatatataactgggtgtaaaaatcaaagctggtctgttaatcatgtctacctcgatggagccatcccagtacatggggttactgggttcgaatggtttcagagcagagggggctagaggcagggcagccagtcgggggcagtgcagatgacctgggccaggcctatgggaactctgaggggccggggtggatggcagcagtgacggtttctcaccttttcagagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctggtgagaatcccagggctgctgcgccgcctccagctggtgtaggaggatggggcagcctgggccacaggggagagccccagggcctggctcagcatcgtattggctgagcaactttaggcaagctgactaacctctctgagcctcagttgtgccttctgtgtgtggggctgattctgacctcctggtattcatgaaagatcaaagggttgtgaatttgaggaatggggacagcctggcagctgctgggtatagggggaggctgtaagcaggactggtgagggtgctcggtgttgctggacaggactctcctggtgcccaggaggggaagtaggcagcactcagccctgccccttctccctccagaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggtgagccggcaggagggagcattagtgcctcgtcctggggaagtttttacccatcctgcctggtcttgtttgctgtgaccttggccctgtctgaggcactgtggggtggccagaaccgttgggatgagggatgcacaggtgaaaagacagctccgcctgccttatgcgagggacagaggagggagggccattgggcccaggagttggagagggctctgggaagaaagtggagctggagcatgtctggggaagtggaggtcagattagtggagcaagcagagagtctgggagcagagccccagagaccagattagggagacccgactgggaagccacatcacgtggtagctaaacaagcctcaggacaaaactgctggctttgaatcctgcctccactatgacctagtgcaagtcgctgaacccctgcggctcagtttcttcctgtgtaaaacagtgacagtggagcatcttcctctgactgtgccgcagcgcaaaggcagacgggtgcctggcccagctgactcttgtatacatgggctgtgtgtgttattcagcgtgttcatggatggcctcagccccatagttcatgcaggatgaagagatagattaagagggcaaattgagggcgtgtggagtgcgagttaaggagctgtgtcctaaaggcagtggggccctgcattctctttatcagtcatctcacacgtagcttccccagggccttcctgccttcctcaccttcctgagcctccagctccacctcctccagaggcccaccctggagggactcagtctcagaaggctagtgcaaggtccctttttcacctcccccccccatttcccaggggacttgtccctgggcaaacccttccgtggaactggaaagaggcctggaactggaaagaggccggggctagctttgctgcaagctcgctaagggaccatgcgcatagtgcactcttctgggcctcagttttctcttctgctcagactgcccctgggatggccgccacctggcagtctgtggttcccgggactcaccctcctccctgcttggctttcgtaggcagttccagggccacacagatggggccagctgcatagacatctcccatgatggcaccaaactgtggacagggggcctggacaacacggtgcgctcctgggacctgcgggagggccgacagctacagcagcatgacttcacttcccaggtgtgcggcccaagactcctcccttcccaaagagcagtgtgttccctccctccggggccccagtggctgggtcagggacaaagggaccctcacagagtggccacggccaagagacttgggaccaacctgagccatctgggaaggcttcctggaggaagcagcagtgaaacagatggagatgaccttggggttggacacatttggcccaactgtggaaattcgattcattctctgctgctattgagcactttgtcctcggcgtcctcattcacaagatggaaataatagtagcaccctcctaggtctgatgtgggcacctgaaatgatccctctaaaaggcgtagccataaacccgactcacagaaagcattcagtaaatgccagggattattatttcttatttgcattcctcactttaatattttaatcttaaatttttaatattttagttttttttttttaactcacttttttcttaaggaaagatgaaagtctcagagacagagtaactgaatgcaaaatgtctgtgctttctcacctataaaatggggatggaaaatgacctcccatactcctgggttattgggtgggtggggagggaccctgagcctcagaggacctgagcagcacctttgggagccgccctcctcttgagggcagagaatgctgagctcagtccatctgccctcccaccacctgcagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggtgagccttggatgggcccaggcctgatggagtggggtggggaacccagggcagcctggcccaacaggacagaagaggggcccaaagcttatagaataagctaggccctggaaccaggcctcctgacccctgagctggtgccccttcaacacccttaagtgatcttgttccacatccttgtttctcggatgcagatgtcaccatgagttattgaactctcaggacactaggccagagccagttcttgcaggcttggggcaaaggaacaggacagtagcagtgcaggcagttcctctccatggttacaaccacttgctttggcatctgagagccttggatgggaatgtctgctcctccactgacaagctgtgcagtcttgaacatctcaccctctctgaactctagtggatttttctctctggtcgggaatagcatggtgctcatggctttcagggagcataagggctttaacacttgtagagccctggccgagttcctgcttggaggaaggtcgcccactgactgctgtcttcagccaggtctccagactcccagggcttggatattttcagtatttcctgttgccttccagtagtagaatttagaaaggccagtcaaccttagtggctttaacaagaatcttttgaggcagcgttatcactgcaatgaacttcaaatcctaccttttcccatcctagccccgcccagccctccccctggatttcagagaaaggccttctccaggtgtccgcatgtcccatttgcaaaatgcctctcgaaattggagagttatactagttagcagttctcactgcttttctatggcagctggccatgtctagggcaggtcttgctttagagggcagtgagctacaacctgatcatgcctttgcctcccacctgcaggcaagtggttcgtgagcactgggaaagataaccttctcaacgcctggaggacgccttatggagccagcatattccaggtactgcccaccgtctgagtcctcctctgggttctacccagagttgaaacttggtgatggtgatgggagtgaggatagcagcaggaagaacaggaggagcctggagccaggatcagacctgccctggtcccctccccacccctacctgataggggagcaagattgggttctcccaaggacctggggacttcagcaggacacacaatctgctactgatggcttctgacccccgagggcaagggcttctaagccggggcgcttgtcggatttggagagtgaggaatagcataagtgtttttgctctgggctggatgctgagcacctgcgggaggtgcgctgggcacctgggcacccggcagccttgcccagagcagtgttgcctcctcaagtgagtgagtgtttccacctgcattcagcaccagcagggacatggacaggaaagagaggaggaaaggaagaggctttttataatctaccaggatctggggcctgccatactgcactgattggcacacacacgtgtgcacacacacacgtgcactctttcccatacacgatcaaactcacactcatttactcacgcacacttggtctcccccacacactttcttcctctctctctcttgcgcttccacacacacacttgcattctctctcactccctcagccaacatgccgctttctggacccaggctgaaatgtctggtgtgcagcgtgtcaaacctcattgttagggtctctagttacagcacatgcttcaaacatcaggtggcaatccttttcctaactcatcaggctgtgggcctgagctgctgacgccagctcctagcttggaaatgcttcttcctatttgtaaactcggaggagaagctcttgctaaagcgtcctgttctgatcattatgacttactgtaaagatcacgtgggagactgttactgagcttttccttatggaaaagcaggtgggaggggagctctacctgaaaatgcttcatgggtgctttaaagcctcccccacctcctcttcaccgcactgtgctccaggtcggagcatcagagaggggcagaggagggcaattgttgccgagagaaccgagatggtgttgagcactggaaaatgaattcctgtcttttttctccctgcaccccacgccttcctgctgcttctcctcgtcttcctcctccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacagacccgctcatgagtctctgtttgttcttcccttttcttttgccctgtccctcaccttgggtcgggggtgctggagtggaccacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggcttttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatcttgggacacagcctaaaaaggacaaaaagttagaagacagcatagcaactcagctcagggagctaccagagaaaaatagcaactgatgtgggtgctttttttttttttttaatttgaataaaaagaattagaagtgatgtccttttataaaatgccttctcccccttcccgcctacagtctcttcctctccccttagaggggggaaagtgtataaacctacagggttgtgagtctgaaaagaggatccccctcacccccaccctgggcagagcagtgggggttggggggtgggagagggggacacagatcctggcacactgtggatatttcttgcagattgcagtctcttgtggcccaaacaggttaggtagactatcgcctctggcaggtgccaccttttggtaccaacatgttctgaggtgttaggatttgggttgggttttttttgtttgttttttttttccttttggtctttttttttttctccttttaaagaaaagctaaaggccgctgtgagtcctggtggcaggctctccatggatgtagcatatcgaagataatttttatactgcatttttatggattattttgtaatgtgtgattccgtctgctgaggaggtgggaggggctccagggaaagccacccaccttcagtgaggttgctccccagctgagcgcaccgggcatgggatgtggaggctggcgacacaccctgtgcctctccaaggctgggcgcgtggggcgtccagagtctctctgggtctcagatgtccatctgccacctcttgttaaggctctagccagaagggagggtgagggtagaagaaagttattcccgaagaaaaaaagaatgaaaagtcattgtactgaactgtttttatatttttaaaagttactatttaaaggtt

SEQ ID NO: 41 - DNA, 41881 bp, Homo sapiens
caggcagcgctgcgtcctgctgcgcacgtgggaagccctggccccggccacccccgcgatgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgggcctccccggggtcggcgtccggctggggttgagggcggccggggggaaccagcgacatgcggagagcagcgcaggcgactcagggcgcttcccccgcaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgctgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcgggactgcgcttggctgcgcaggagcccaggtgaggaggtggtggccgtcgagggcccaggccccagagctgaatgcagtaggggctcagaaaagggggcaggcagagccctggtcctcctgtctccatcgtcacgtgggcacacgtggcttttcgctcaggacgtcgagtggacacggtgatctctgcctctgctctccctcctgtccagtttgcataaacttacgaggttcaccttcacgttttgatggacacgcggtttccaggcgccgaggccagagcagtgaacagaggaggctgggcgcggcagtggagccgggttgccggcaatggggagaagtgtctggaagcacagacgctctggcgagggtgcctgcaggttacctataatcctcttcgcaatttcaagggtgggaatgagaggtggggacgagaaccccctcttcctgggggtgggaggtaagggttttgcaggtgcacgtggtcagccaatatgcaggtttgtgtttaagatttaattgtgtgttgacggccaggtgcggtggctcacgccggtaatcccagcactttgggaagctgaggcaggtggatcacctgaggtcaggagtttgagaccagcctgaccaacatggtgaaaccctatctgtactaaaaatacaaaaattagctgggcatggtggtgtgtgcctgtaatcccagctacttgggaggctgaggcaggagaatcacttgaacccaggaggcggaggctgcagtgagctgagattgtgccattgtactccagcctgggcgacaagagtgaaactctgtctttaaaaaaaaaaagtgttcgttgattgtgccaggacagggtagagggagggagataagactgttctccagcacagatcctggtcccatctttaggtatgaagagggccacatgggagcagaggacagcagatggctccacctgctgaggaagggacagtgtttgtgggtgttcaggggatggtgctgctgggccctgccgtgtccccaccctgtttttctggatttgatgttgaggaacctccgctccagcccccttttggctcccagtgctcccaggccctaccgtggcagctagaagaagtcccgatttcaccccctccccacaaactcccaagacatgtaagacttccggccatgcagacaaggagggtgaccttcttggggctcttttttttctttttttctttttatggtggcaaaagtcatataacatgagattggcactcctaacaccgttttctgtgtacagtgcagaattgctaactcggcggtgtttacagcaggttgcttgaaatgctgcgtcttgcgtgactggaagtccctacccatcgaacggcagctgcctcacacctgctgcggctcaggtggaccacgccgagtcagataagcgtcatgcaacccagttttgctttttgtgctccagcttccttcgttgaggagagtttgagttctctgatcaggactctgcctgtcattgctgttctctgacttcagatgaggtcacaatctgcccctggcttatgcagggagtgaggcgtggtccccgggtgtccctgtcacgtgcagggtgagtgaggcgttgcccccaggtgtccctgtcacgtgtagggtgagtgaggcgcggcccccgggtgtccctgtcccgtgcagcgtgattgaggtgtggcccccgggtgtccctgtcccgtgcagggtgagtgaggcactgtccccgggtgtccctgtcacgtgcagggtgagtgaggcgcggtccccgggtgtccctgtcacgtgtagggtgagtgaggcactgtccccgggtgtccctctcaggtgtagggtgagtgaggcgccgtccccgggtgtccctgtcacgtgtagggtgagtgaggcgtggtccccgggtgtccctgtcccgtgcagggtgagtgaggcgctgtccccgggtgtccctgtcacgtgcagggtgagtgaggcgcggtccccgggtgtccctgtcacgtgtagggtgagtgaggcaccgtccctgggtgtccctcccaggtgtagggtgagtgaggcgctgtccccgggtgtccctctcaggtgtagggtgagtgaggcgcggccccaggtgtccctgtcacgtgtagggtgagtgaggcaccgtccctgggtgtccctcccaggtatagggtgagtgaggcactgtccccgggtgtccctgtcacgtgcagggtgagtgaggcgcggtccccaggtgtccctgtcacgtgtagggtgagtgaggcactgtccccgggtgtccctgtcccgtgcagggtgagtgaggcgcggtccccaggtgtccctgtcccgtgcagggtgagtgaggcgccgtccccgggtgtccctgtcacgtgcagggtgagtgaggcacggcccccgggtgtccctgtcacgtgcagggtgagtgaggcgcggcccccgggtgtccctgtcacgtgcagggtgagtgaggcgcggcccccgggtgtccctgtcacgtgcagggtgagtgaggcgcggtccccgggtgtccctgtcacgtgcagggtgagtgaggcgcggtccccgggtgtccctgtcacgtgcagggtgagtgaggcgcggtccccgggtgtccctgtcacgtgcagggtgagtgaggcacggtccccgggtgtccctgtcccgtgtagggtgagtgaggcactgtccccgggtgtccctgtcacgttcagggtgagtgaggcgcggtccccgggtgtccctgtcacgtgtagggtgagtgaggcaccgtccccgggtgtccctgtcacgtgcagggtgagtgaggcgctgtccccgggtgtccctgtcacgtgcagggtgattgacgcgaggcccccgggtgtccctgtcacgtgcagggtgagtgaggcgccgtccccgcgtgtccctgtcacgtgcagggtgagtgaggcgccgtccccgggtgtccctgtcacgtgtagggtgagtgaggtgccgtccccgggtgtccctgtcacgtgtagggtgagtgaggcgccgtccccgggtgtccctgtcacgttcagggtgagtgaggcacggcccccgggtgtccctgtcacgtgtagggtgagtgaggcgcggtccccgggtgtcactgtcacgtgtagggtgagtgaggcactgtccccgggtgtccctgtcacgtgtagggtgagtgaggcgcggcccccgggtgtccctgtcacgtgcagggtgagtgaggcgcggcccccgggtgtccctgtcacgtgtagggtgagtgaggcgcggcccccgggtgtccctgtcacgtgcagggtgagtgaggcgcggcccccgggtgtccctgtcacgtgcagggtgagtgaggcgcggcccccgggtgtccctgtcacgtgcagggtgagtgaggcacggcccccgggtgtccctgtcacgtgcagggtgagtgaggcgcggcccccgggtgtccctgtcacttgcagggtgagtgaggcactgtccccgggtgtccctgtcacgttcagggtgagtgaggcgcggtccccgggtgtccctgtcacgtgtagggtgaatgaggcactgtccccgggtgtccctgtcacgtgcagggtgagtgaggcgccgtccccgggtgtccctgtcacgtgcagggtgattgacgcgaggcccccgggtgtccctgtcacgtgcagggtgagtgaggcgccgtccccgcgtgtccctgtcacgtgcagggtgagtgaggcgccgtccccgggtgtccctgtcacgtgtagggtgagtgaggcgccgtccccgggtgtccctgtcacgtgtagggtgagtgaggcgccgtccccgggtgtccctgtcacgtgtagggtgagtgaggcgccgtccccgggtgtccctgtcacgtgtagggtgagtgaggcgccgtccccgggtgtccctgtcacgtgcagggtgagtgaggccccgtccccgggtgtccctgtcacgtgtagggtgagtgaggcactgtccccgggtgtctctgtcacgtgtagggtgagtgaggcgccgtccctgggtgtccctctcaggtgtagggtgagtgaggcgccatccccgggtgtccctgtcacgtgtagggtgagtgaggcgccgtccccgggtgtccctgtcacgtgtagggtgagtgagttgcggcccccgggtgtccctctcaggtgcagggtgagtgaggcgctgtccctgggtgtccctgtctcgtgtagggtgagtgaggctctgtccccaggtgtccttggcgtttgctcacttgagcttgctcctgaatgtttgctctttctatagccacagctgcgccggttgcccattgcctgggtagatggtgcaggcgcagtgctggtccccaagcctatcttttctgatgctcggctcttcttggtcacctctccgttccattttgctacggggacacgggactgcaggctctcgcctcccgcgtgccaggcactgcagccacagcttcaggtccgcttgcctctgttgggcctggcttgctcaccacgtgcccgccacatgcatgctgccaatactcctctcccagcttgtctcatgccgaggctggactctgggctgcctgtgtctgctgccacgtgttgctggagacatcccagaaagggttctctgtgccctgaaggaaagcaagtcaccccagccccctcacttgtcctgttttctcccaagctgcccctctgcttggcccccttgggtgggtggcaacgcttgtcaccttattctgggcacctgccgctcattgcttaggctgggctctgcctccagtcgccccctcacatggattgacgtccagccacaggttggagtgtctctgtctgtctcctgctctgagacccacgtggagggccggtgtctccgccagccttcgtcagacttccctcttgggtcttagttttgaatttcactgatttacctctgacgtttctatctctccattgtatgctttttcttggtttattctttcattccttttctagcttcttagtttagtcatgcctttccctctaagtgctgccttacctgcaccctgtgttttgatgtgaagtaatctcaacatcagccactttcaagtgttcttaaaatacttcaaagtgttaatacttcttttaagtattcttattctgtgatttttttctttgtgcacgctgtgttttgacgtgaaatcattttgatatcagtgacttttaagtattctttagcttattctgtgatttctttgagcagtgagttatttgaacactgtttatgttcaagatatgtagagtatcaagatacgtagagtattttaagttatcattttattattgatttctaactcagttgtgtagtggtctgtataataccaattatttgaagtttgcggagccttgctttgtgatctagtgtgtgcatggtttccagaactgtccattgtaaatttgacatcctgtcaatagtgggcatgcatgttcactatatccagcttattaaggtccagtgcaaagcttctgtctccttctagatgcatgaaattccaagaaggaggccatagtccctcacctgggggatgggtctgttcatttcttctcgtttggtagcatttatgtgaggcattgttaggtgcatgcacgtggtagaatttttatcttcctgatgagtgaatcttttggagacttctatgtctctagtaatctagtaattctttttttaaattgctcttagtactgccacactgggcttcttttgattagtattttcctgctgtgtctgttttctgcctttaatttatatatatatatatatattttttttttttgagacagagtcttggtctgtcgcccagggtgagtgcagtggtgtgatcacaggtcagtgtaacttttaccttctggcctgagccgtcctctcacctcagcctcctgaatagctggaactgcagacacgcaccgctacacctggctaatttttaaattttttctggagacagggtcttgctgtgttgcccaggctggtctcaaactcttggactcaagggatccatctacctcggcttcccaaagtgctgaattacaggcatgagccaccatgtctggcctaattttcaacacttttatattcttatagtgtgggtatgtcctgttaacagcatgtaggtgaatttccaatccagtctgacagtcgttgtttaactggataacctgatttattttcatttttttgtcactagagacccgcctggtgcactctgattctccacttgcctgttgcatgtcctcgttcccttgtttctcaccacctcttgggttgccatgtgcgtttcctgccgagtgtgtgttgatcctctcgttgcctcctggtcactgggcatttgcttttatttctctttgcttagtgttaccccctgatctttttattgtcgttgtttgcttttgtttattgagacagtctcactctgtcacccaggctggagtgtaatggcacaatctcggctcactgcaacctctgcctcctcggttcaagcagttctcattcctcaacctcatgagtagctgggattacaggcgcccaccaccacgcctggctaatttttgtatttttagtagagataggctttcaccatgttggccaggctggtctcaaactcctgacctcaagtgatctgcccgccttggcctcccacagtgctgggattacaggtgcaagccaccgtgcccggcataccttgatcttttaaaatgaagtctgaaacattgctacccttgtcctgagcaataagacccttagtgtattttagctctggccaccccccagcctgtgtgctgttttccctgctgacttagttctatctcaggcatcttgacacccccacaagctaagcattattaatattgttttccgtgttgagtgtttctgtagctttgcccccgccctgcttttcctcctttgttccccgtctgtcttctgtctcaggcccgccgtctggggtccccttccttgtcctttgcgtggttcttctgtcttgttattgctggtaaaccccagctttacctgtgctggcctccatggcatctagcgacgtccggggacctctgcttatgatgcacagatgaagatgtggagactcacgaggagggcggtcatcttggcccgtgagtgtctggagcaccacgtggccagcgttccttagccagtgagtgacagcaacgtccgctcggcctgggttcagcctggaaaaccccaggcatgtcggggtctggtggctccgcggtgtcgagtttgaaatcgcgcaaacctgcggtgtggcgccagctctgacggtgctgcctggcgggggagtgtctgcttcctcccttctgcttgggaaccaggacaaaggatgaggctccgagccgttgtcgcccaacaggagcatgacgtgagccatgtggataattttaaaatttctaggctgggcgcggtggctcacgcctgtaatcccagcactttgggaggccaaggcgggtggatcacgaggtcaggaggtcgagaccatcctggccaacatgatgaaaccccatctgtactaaaaacacaaaaattagctgggcgtggtggcgggtgcctgtaatcccagctactcgggaggctgaggcaggagaattgcttgaacctgggagttggaagttgcagtgagccgacattgcaccactgcactccagcctggcaacacagcgagactctgtctcaaaaaaaaaaaaaaaaaaaaaaattctagtagccacattaaaaaagtaaaaaagaaaaggtgaaattaatgtaataatagattttactgaagcccagcatgtccacacctcatcattttagggtgttattggtgggagcatcactcacaggacatttgacattttttgagctttgtctgcgggatcccgtgtgtaggtcccgtgcgtggccatctcggcctggacctgctgggcttcccatggccatggctgttgtaccagatggtgcaggtccgggatgaggtcgccaggccctcagtgagctggatgtgcagtgtccggatggtgcacgtctgggatgaggtcgccaggccctgctgtgagctggatgtgtggtgtctggatggtgcaggtcaggggtgaggtctccaggccctcggtgagctggaggtatggagtccggatgatgcaggtccggggtgaggtcgccaggccctgctgtgagctggatgtgtggtgtctggatggtgcaggtcaggggtgaggtctccaggccctcggtgagctggaggtatggagtccggatgatgcaggtccggggtgaggtcgccaggccctgctgtgagctggatgtgtggtgtctggatggtgcaggtctggggtgaggtcaccaggccctgcggtgagctgggtgtgcggtgtctggatggtgcaggtctggagtgaggtcgccagacggtgccagaccgtgcggtgagctggatatgcggtgtccggatggtgcaggtctggggtgaggttgccaggccctgctgtgagttggatgtggggtgtccggatgctgcaggtccggtgtgaggtcaccaggccctgctgtgagctggatgtgtggtgtctggatggtgcaggtctggggtgaggtcgccaggccctgctgtgagctggatgtgtggtgtctggatggtgcaggtctggagtgaggtcgccaggccctcggtgagctggatgtgcagtgtccagatggtgcaggtccggggtgaggtcgccagaccctgcggtgagctggatgtgcggtgtctggatggtgcaggtctggagtgaggtcgccaggccctcggtgagctggatgtatggagtccggatggtgccggtccggggtgaggtcgccagaccctgctgtgagctggatatgcggtgtccggatggtgcaggtcaggggtgaggtctccaggccctcggtgagctggaggtatggagtccggatgatgcaggtccggggtgaggtcgccaggccctgctgtgagctggatgtgcggcgtctggatggtgcaggtctggggtgtggtcgccaggccctcggtgagctggaggtatggagtccggatgatgcaggtccggggtgaggtcgccaggccctgctgtgagctggatgtgcggcgtctggatggtgcaggtctggggtgtggtcgccaggccctcggtgagctggaggtatggagtccggatgatgcaggtccggggtgaggttgccaggccctgctgtgagctggatgtgctgtatccggatggtgcaggtccggggtgaggtcgccaggccctgctgtgagctggatgtgctgtatccggatggtgcaggtctggggtgaggtcaccaggccctgcggtgagctggttgtgcagtgtccggttgctgcaggtccggggtgagttcgccaggccctcggtgagctggatgtgcggtgtccccgtgtccggatggtgcaggtccagggtgaggtcgctaggcccttggtgggctggatgtgccgtgtccggatggtgcaggtctggggtgaggtcgccaggcctttggtgagctggatgtgcggtgtctgcatggtgcatgtctggggtgaggtcgccaggcccttggtgggctggatgtgtggtgtccggatggtgcaggtccggcgtgaggtcgccaggccctgctgtgagctggatgtgcggtgtctggatggtgcaggtccggggtgaggtagccaaggccttcggtgagctggatgtggggtgtccggatggtgcaggtccggggtgaggtcgccaggccctgcggttagctggatatgcggtgtccggatggtgcaggtccggggtgaggtcaccaggccctgcggttagctggatgtgcggtgtctggatggtgcaggtccggggtgaggtcgccaggccctgctgtgagctggatgtgctgtatccagatggtgcaggtccggggtgaggtcgccaggccctgcagtgagctggatgtgctgtatccggatggtgcaggtctggcgtgaggtcgccaggccctgcggttagctggatatgcggtgtcggatggtgcaggtccggggtgaggtcaccaggccctgcggttagctggatgtgtggtgtccggatggtgcaggtctggggtgaggtcgccaggccctgctgtgagctggatgtgctgtatccggatggtgcaggtccggggtgaggtcgccaggccctgcggtgagctggatgtgctgtatccggatggtgcaggtctggcgtgaggtcgccaggccctgcggtgagctggatgtgcagtgtacggatggtgcaggtccggagtgaggtcgccaggccctgcggtgggctgtatgtgtgttgtctggatggtgcaggtccggggtgagttcgccaggccctgcggtgagctggatgtgtggtgtctggatgctgcaggtccggggtgagttcgccaggccctcggtgagctggatatgcggtgtccccgtgtccgaatggtgcaggtccagggtgaggtcgccaggcccttggtgggctggatgtgccgtgtccggatggtgcaggtctggggtgaggtcgccaggcccttggtgagctggatgtgcggtgtccggatggtgcaggtccggggtgaggtcaccaggccctcggtgatctggatgtggcatgtccttctcgtttaaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcaggtactgtatccccacgccaggcctctgcttctcgaagtcctggaacaccagcccggcctcagcatgcgcctgtctccacttgcctgtgcttccctggctgtgcagctctgggctgggagccaggggccccgtcacaggcctggtccaagtggattctgtgcaaggctctgactgcctggagctcacgttctcttacttgtaaaatcaggagtttgtgccaagtggtctctagggtttgtaaagcagaagggatttaaattagatggaaacactaccactagcctccttgcctttccctgggatgtgggtctgattctctctctcttttttttttcttttttgagatggagtctcactctgttgcccaggctggagtgcagtggcataatcttggctcactgcaacctccacctcctgggtttaagcgattcaccagcctcagcctcctaagtagctgggattacaggcacctgccaccacgcctggctaatttttgtacttttaggagagacggggtttcaccatgttggccaggctggtctcgaactcatgacctcaggtgatccacccaccttggcctcccaaagtgctgggtttacaggctaagccaccgtgcccagcccccgattctcttttaattcatgctgttctgtatgaatcttcaatctattggatttaggtcatgagaggataaaatcccacccacttggcgactcactgcagggagcacctgtgcagggagcacctggggataggagagttccaccatgagctaacttctaggtggctgcatttgaatggctgtgagattttgtctgcaatgttcggctgatgagagtgtgagattgtgacagattcaagctggatttgcatcagtgagggacgggagcgctggtctgggagatgccagcctggctgagcccaggccatggtattagcttctccgtgtcccgcccaggctgactgtggagggctttagtcagaagatcagggcttccccagctcccctgcacactcgagtccctggggggccttgtgacaccccatgccccaaatcaggatgtctgcagagggagctggcagcagacctcgtcagaggtaacacagcctctgggctggggaccccgacgtggtgctggggccatttccttgcatctgggggagggtcagggctttccctgtgggaacaagttaatacacaatgcaccttacttagactttacacgtatttaatggtgtgcgacccaacatggtcatttgaccagtattttggaaagaatttaattggggtgaccggaaggagcagacagacgtggtggtccccaagatgctccttgtcactactgggactgttgttctgcctggggggccttggaggcccctcctccctggacagggtaccgtgccttttctactctgctgggcctgcggcctgcggtcagggcaccagctccggagcacccgcggccccagtgtccacggagtgccaggctgtcagccacagatgcccaggtccaggtgtggccgctccagcccccgtgcccccatgggtggttttgggggaaaaggccaaagggcagaggtgtcaggagactggtgggctcatgagagctgattctgctccttggctgagctgccctgagcagcctctcccgccctctccatctgaagggatgtggctctttctacctgggggtcctgcctggggccagccttgggctaccccagtggctgtaccagagggacaggcatcctgtgtggaggggcatgggttcacgtggccccagatgcagcctgggaccaggctccctggtgctgatggtgggacagtcaccctgggggttgaccgccggactgggcgtccccagggttgactataggaccaggtgtccaggtgccctgcaagtagaggggctctcagaggcgtctggctggcatgggtggacgtggccccgggcatggccttcagcgtgtgctgccgtgggtgccctgagccctcactgagtcggtgggggcttgtggcttcccgtgagcttccccctagtctgttgtctggctgagcaagcctcctgaggggctctctattgcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggtggctgtgctttggtttaacttcctttttaaacagaagtgcgtttgagccccacatttggtatcagcttagatgaagggcccggaggaggggccacgggacacagccagggccatggcacggcgccaacccatttgtgcgcacagtgaggtggccgaggtgccggtgcctccagaaaagcagcgtgggggtgtagggggagctcctggggcagggacaggctctgaggaccacaagaagcagccgggccagggcctggatgcagcacggcccgaggtcctggatccgtgtcctgctgtggtgcgcagcctccgtgcgcttccgcttacggggcccggggaccaggccacgactgccaggagcccaccgggctctgaggatcctggaccttgccccacggctcctgcaccccacccctgtggctgcggtggctgcggtgaccccgtcatctgaggagagtgtggggtgaggtggacagaggtgtggcatgaggatcccgtgtgcaacacacatgcggccaggaacccgtttcaaacagggtctgaggaagctgggaggggttctaggtcccgggtctgggtggctggggacactggggaggggctgcttctcccctgggtccctatggtggggtgggcacttggccggatccactttcctgactgtctcccatgctgtccccgccaggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtgggtgccggggacccccgtgagcagccctgctggaccttgggagtggctgcctgattggcacctcatgttgggtggaggaggtactcctgggtgggccgcagggagtgcaggtgaccctgtcactgttgaggacacacctggcacctagggtggaggccttcagcctttcctgcagcacatggggccgactgtgcaccctgactgcccgggctcctattcccaaggagggtcccactggattccagtttccgtcagagaaggaaccgcaacggctcagccaccaggccccggtgccttgcaccccagtcctgagccaggggtctcctgtcctgaggctcagagaggggacacagcccgccctgcccttggggtctggagtggtgggggtcagagagagagtgggggacaccgccaggccaggccctgagggcagaggtgatgtctgagtttctgcgtggccactgtcagtctcctcgcctccactcacacaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtaaggttcacgtgtgatagtcgtgtccaggatgtgtgtctctgggatatgaatgtgtctagaatgcagtcgtgtctgtgatgcgtttctgtggtggaggtacttccatgatttacacatctgtgatatgcgtgtgtggcacgtgtgtgtcgtggtgcatgtatctgtggcgtgcatatttgtggtgtgtgtgtgtgtggcacgtgtgtgtccatggtgtgtgtgcctgtggtgtgcatgtgtgtgtgtctgtgacacgtgcatgttcatgctgtgtgctgcatgtctgtgatgtgcctatttgtggtgtgtgtgtgtgcatgtgtccgtgacatatgcgtgtctatggcatgggtgtgtgtggccccttggccttactccttcctcctccaggcatggtccgcaccattgtcctcacgctctcgggtgctggtttggggagctccacattcagggtcctcacttctagcatgggtgcccctgtcctgtcacagggctgggccttggagactgtaagccaggtttgagaggagagtagggatgctggtggtaccttcctggacccctggcacccccaggaccccagtctggcctatgccggctccatgagatataggaaggctgattcaggcctcgctccccgggacacactcctcccagagcggccgggggccttggggctcggcaggggtgaaaggggccctgggcttgggttcccacccagtggtcatgagcacgctggaggggtaagccctcaaagtcgtgccaggccggggtgcagaggtgaagaagtatccctggagcttcggtctggggagaggcacatgtggaaacccacaaggacctctttctctgacttcttgagctatcgcagctacttgcaaatctcagcagaattttaccctcatggaaagctgatggccaccacctgtgcccaggtgtagaaagtcactagagcccaggagacccccccgtccccaccgcccacctgtgcccgggtgtagaaagtcaccagagcccaggagacccccccccacatccccgctgcagcggaagctaccgcccccaccgtgaccctcgttccgacctcgacctccatggtctccctctcccggtctccatgtgagtgagatcaggcaggaggtgggttttggggttcgagcctcagctatgctgaacgcctcagctgtgcgttctgtccatgaatggcatccgttgtggaactcgccacgtggatgtatccttcccgctgctgtggaggctcctgggtgcggactgcacggctgcgcctgctgtgagcctgctgggttctgggagtgtcccaggggtcagaggccctcgcctctgggtgaattccaggggtggggttgctgggtcacagacgtgctttagggatgttgtgggagtttccaggggggtgacagtgacaccccggctggctgcttgtgagggcgatgcctccggtggccgctggcctgaaggtgtcgaagccgcctcgtgggattgtgcagggggctctcttgatgcccacgtgcccacagtgttcccgtgctggccgccccggggctcttgcgggaggtggctgtccgtcctgccccgctctgtatggggcgcctgcctgccatcatcggcttgcaggagctctttgtgtgttctgctgcaagtgtggcatcacatgcgtgcactgtgaatctctgtgccgtgtgtgtcttgcttttgtgctctcaagtcaagccttttgaggactggaagattgtacttctatcgcagtccactaacacagtccagtaacgcagtccactttatcagctgtttgtggctaaagctgtttgtgttctctgcaggaactcaaggtattgaggttgtggtgacgttgcttctgcgcctccttttagaacagtctttactgtgtcagcttgcaaacctgggtggggattggtggaattggttttcatgtgtggggtaggtggggatctgtgggattggttttcatgtgtggtgtaggtggagatctgtgaattggttttcatccgtggggtaggtggggatctgtgggattggtttttatgtgtggggtaggtgggattggttttcatgtgcggggtaggtggggatctgtgggattggttttcttgtgtggggtaggtggggatctgtgggattggtttttatgtgtggggtaggtggggatatgtgaattggttttcatccgtggggtaggtggggatctgtgggattggtttttatgcgtggggtaggtggggatctgtgaattggttttcatccgtggggtaggtggggatctgtgggattggttttcatgtgtgggataggtggggatctgtggagttggttttcatgtgtggtgtaggtggagatctgtgaattggttttcatccgtggggtaggtggggatctgtgggattggtttctatgtgtggggtaggtggggacctgtgggattggtttttatgtgtggggtaggtggggatctgtgaattggttttcatccgtggggtaggtggggatctgtgggattggttttcatgtgtggggtaggtggggatctgtgggattggttttcatgtgtggggtaggtggggatctgtgggattggttttcatgtgtggggtaggtggggatctgtggagttggtttttatgtgtgggggtaggtggggatctgtggagttggttttcatgtgtagggtaggtggagatctgtgggattggttttcatgtgtggggtaggtggggatctgtgggattggttttcatgtgtggggtaggtggggatctgtgggattggttttcatgtgtggggtaggtggggatctgtggagttggttttcatgtgtggggtaggtggagatctgtgggattggttttcatgtgtgggataggtggggatctgtgggattggtttttatgagtggggtaacacagagttcaaggcgagctttcttcctgtagtgggtctgcaggtgctccaacagctttattgaggagaccatatcttcctttgaactatggtcgggtttatagtaagtcaggggtgtggaggcctcccctgggctccctgttctgtttcttccactctggggtcgtgtggtgcctgctgtggtgtgtggccggtgggcagggcttccaggcctccttgtgttcattggcctggatgtggccctggctacgctccgtccttggaattcccctgcgagttggaggcttgctttctttctttttttctttctttttttttttttttgataacagagtctcgctcttttttgcccaggctggagtggtttggcgtgatcttggctcactgcaacctgtgcttcctgagttcaagcaattctcttgcctcagcctcccaagtagctggaattataggcgcccaccaccatgctgactaatttttgtaattttagtagagacgaggtttctccatgttggccaggctggtctcgaactcctgacctcaggtgatcctcccacctcggcctcccaaagtgctgggatgacaggtgtgaaccgccgcgcccggccgagactcgcttcctgcagcttccgtgagatctgcagcgatagctgcctgcagccttggtgctgacaacctccgttttccttctccaggtctcgctaggggtctttccatttcatgactctcttcacagaagagtttcacgtgtgctgatttcccggctgtttcctgcgtaattggtgtctgctgtttatcgatggcctccttccatttcctttaggctttgtttattgttgtttttccggctccttgaaggaaaagtttcgattatggatgtttgaactttcttttctaaacaagcatctgaagttgccgttttccctctaaagcagggatcccgaggcccctggctgtggagtggcaccggtctggggcctgttaggaacccggcgcacagcgggaggctaggtggggtgtggggagccagcgttcccgcctgagccccgcccctctcagatcagcagtggcatgcggtgctcagaggcgcacacaccctactgagaactgtgcgtgagaggggtctagattctgtgctccttatgggaatctaatgcctgatgatctgaggtggaaccgtttgctcccaaaaccatccccttccccactgctgtcctgtggaaaaatcgtcttccacgaaaccagtccctggtaccacaatggttggggaccctgtgctaaagacctgcttcagcagcctctcgtcagtgttgatatattggcttttctgtgttgagtccagaataattacggatttctgtgatgctttccgccgacctcagacccatgggctatttgtgggcgtgttgcctgctcctgggttgggaagggtgcaggccccatgtaccttcctgttactgccttccaggttggttctcagggttgaatcgtactcgatgtggttttagcccacggccctgccgccagctcctgggggctggggaacatgctgaagcacagagtcaccgtgcgcgtcttttgatgcctcacaagctcgaggcctcctgtgtccgtgttagtgtgtgtcacgtgcctgctcacatcctgtcttggggacgcaggggcttagcaggtcccgtagtaaatgacaagcgtcctgggggagtctgcagaataggaggtgggggtgccggtctctctcccgcgtcttcagactcttctcctgcctgtgctgtggctgcacctgcatccctgcaatccctccagcactgggctggagaggcccgggagctcgagtgccacttgtgccacgtgactgtggatggcagtcggtcacgggggtctgatgtgtggtgactgtggatggcggttggtcacaggggtctgatgtgtggtgactgtggatggcggtcgtggggtctgatgtggtgactgtggatggcggtcgtggggtctgatgtggtgactgtggatggcggtcgtggggtctgatgtgtggtgactgtggatggcggttggtcccgggggtctgatgtgtggtgactgtggatggcggtcgtggggtctgatgtggtgactgtggatggcggtcgtggggtctgatgtggtgactgtggatggcggtcgtggggtctgatgtgtggtgactgtggatggcggttggtcccgggggtctgatgtgtggtgactgtggatggcgatcggtcacaggggtctgatgtgtggtgactgtggatggcggtcgtggggtctgatgtgtggtgactgtggatggcggtcgtggggtctgatgtggtgactgtggatggcggtcgtggggtctgatgtgtggtgactgtggatggcggtcgtggggtctgatgtggtgactgtggatggcggtcgtggggtctgatgtgtggtgactgtggatggcggtcgtggggtctgatgtgtggtgactgtggatggcggtcgtggggtctgatgtgtggtgactgtggatggcggtcgtggggtctgatgtggtgactgtggatggcggtcgtggggtctgatgtgtggtgactgtggatggcggttgtggggtctgatgtgtggtgactgtggatggtgatcggtcacaggggtctgatgtgtggtgactgtggatggcggtcgtggggtctgatgtgtggtgactgtggatggcggttggtcccgggggtctgatgtgtggtgactggatggcgatcggtcacaggggtctgatgtgtggtgactgtggatggcggtcgtggggtctgatgtgtggtgactgtggatggcggtcgtggggtctgatgtggtgactgtggatggcggtcgtggggtctgatgtgtggtgactgtggatggcggtcgtggggtctgatgtggtgactgtggatggcggtcgtggggtctgatgtgtggtgactgtggatggcggtcgtggggtctgatgtgtggtgactgtggatggcggtcgtggggtctgatgtgtggtgactgtggatggcggtcgtggggtctgatgtgtggtgactgtggatggcggtcgtggggtctgatgtggtgactgtggatggcggtcgtagggtctgatgtggtgactgtggatggcggtcgtggggtctgatgtggtgactgtggatggtgatcggtcacaggggtctgatgtgtggtagctgcaggtggagtcccaggtgtgtctgtagctactttgcgtcctcggccccccggcccccgtttcccaaacagaagcttcccaggcgctctctgggcttcatcccgccatcgggcttggccgcaggtccacacgtcctgatcggaagaaacaagtgcccagctctggccggggcaggccacatttgtggctcatgccctctcctctgccggcaggtctctaccttgacagacctccagccgtacatgcgacagttcgtggctcacctgcaggagaccagcccgctgagggatgccgtcgtcatcgagcaggtctgggcactgccctgcagggttgggcacggactcccagcagtgggtcctcccctgggcaatcactgggctcatgaccggacagactgttggccctggggggcagtggggggaatgagctgtgatgggggcatgatgagctgtgtgccttggcgaaatctgagctgggccatgccaggctgcgacagctgctgcattcaggcacctgctcacgtttgactgcgcggcctctctccagttccgcagtgcctttgttcatgatttgctaaatgtcttctctgccagttttgatcttgaggccaaaggaaaggtgtccccctcctttaggagggcaggccatgtttgagccgtgtcctgcccagctggcccctcagtgctgggtctgaggccaaaggaaacgtgtcccccttcttaggaggacgggccgtgtttgagccacgccccgctgagcgggcctctcagtgctgggtctgtccacgtggccctgtggccctttgcagatgtggtctgtccacgtggccctgtggctctttgcagatgcctgttagcacttgctcggctctaggggacagtcgtgtccaccgcatgaggctcagagacctctgggcgaatttccttggctcccagggtgggggtggaggtggcctgggctgctgggacccagaccctgtgcccggcagctgggcagcaactcctggatcacatatgccatccgggccacggtgggctgtgtgggtgtgagcccagctggacccacaggtggcccagaggagacattctgtgtcacacactctgcctaagcccatgtgtgtctgcagagactcggcccggccagcccacgatggccctgcattccagcccagccccgcacttcatcacaaacactgaccccaaaagggacggagggtcttggccacgtggtcctgcctgtctcagcacccaccggctcactcccatgtgtctcccgtctgctttcgcagagctcctccctgaatgaggccagcagtggcctcttcgacgtcttcctacgcttcatgtgccaccacgccgtgcgcatcaggggcaagtgagtcaggtggccaggtgccattgccctgcgggtggctgggcgggctggcagggcttctgctcacctctctcctgccccttccccactgcccttctgcccggggccaccagagtctccttttctggcccccgccccctccggctcctgggctgcaggctcccgaggccccggaaacatggctcggcttgcggcagccggagcggagcaggtgccacacgaggcctggaaatggcaagcggggtgtggagttgctcctgcgtggaggacgaggggcggggggtgtgtctgggtcaggtgtgcgccgagcgtttgagcctgcagcttgtcagctccaagttactactgacgctggacacccggctctcacacgcttgtatctctctctcccgatacaaaaggattttatccgattctcattcctgtccctgtcgtgtgacccccgcgagggcgcgggctcttctctctgtgactagatttcccatctggaaagtgcggggttgaccgtgtagtttgctcctctcggggggcctgtggtggccatggggcaggcggcctgggagagctgccgtcacacagccactgggtgagccacactcacggtggtagagccacagtgcctggtgccacatcacgtcctctggattttaagtaaaaccacacacctcccggcaggcatctgcctgcgaccctgtgtgtgcctggggagagtggtagcacggaggaaattcgtgcacactcaaggtcatcagcaaggtcatccgcagtcaggtggaacgtggaggcctctctctgggatcgtctccagcggataaaggactgtgcacagcttcggaagcttttatttaaaaatataactattaattattgcattataagtaatcactaatggtatcagcaattataatatttattaaagtataattagaaatattaagtagtacacacgttctggaaaaacacaaattgcacatggcagcagagtgaattttggccgagggacacgtgtgcacatgtgtgtaagcggcccccaggcccacagaattcgctgacaaagtcacctccccagagaagccaccacgggcctccttcgtggtcgtgaattttattaagatggatcaagtcacgtaccgtccacgtgtggcagggctttggggaatgtgaggtgatgactgcgtcctcatgccctgacagacaggaggtgactgtgtctgtcctgtccctaggacacggacaggcccgaagctctagtccccatcgtggtccagtttggcctctgaataaaaacgtcttcaaaacctgttgccccaaaaactaagaacagagagagtttcccatcccatgtgctcacaggggcgtatctgcttgcgttgactcgctgggctggccggactcctagagttggtgcgtgtgcttctgtgcaaaaagtgcagtcctcttgcccatcactgtgatatctgcaccagcaaggaaagcctcttttcttttctttctttttttttttttgagacggaacgtcactgttgtctgcctgggcttgagtgcagtggcgcgatctcaactcactgcaacctccgcctcccgggttccagcatttctcctgcctcagcctcccgagcagctgagattacaggcacccaccccctgcgcctggctaatttttgtatttttagtagagaggggtttttgccatgttggccaggctggtctcgaactcctgacctcaggtgatccacccacctcggcctcccaaagtgctgggattacaggtgtgagccatcacgcccagccggaaagcctctttttaaggtgaccacctatagcgcttcccgaaaataacaggtcttgtttttgcagtaggctgcaagcgtctcttagcaacaggagtggcgtcctgtgggctctggggatggctgagggtcgcgtggcagccatgccttctgtgtgcacctttaggttccacggggctattctgctctcactgtttgtctgaaaacgcacccttggcatccttgtttggagagtttctgcttctcgttggtcatgctgaaactaggggcaaggttgtatccgttggcgcgcagcggctacatgtagggtcatgagtctttcaccgtggacaaattccttgaaaaaaaaaaaaggagtccggttaagcattcattccgggtcaagtgtctggttctgtgaataaactctaagatttaagaaaccttaatgaaagaaaaccttgatgattcagagcaaggatgtggtcacacctgtggctggatctgtttcagccgccccagtgcatggtgagagtggggagcagggattgtttgttcagaggtctcatctggtatgtttctgaggtgtttgccggctgaatggtagacgtgtcgtttgtgtgtatgaggttctgtgtctgtgtgtggctcggtttgagtgtacgcatgtccagcacatgccctgcccgtctctcacctgtgtcttcccgccccaggtcctacgtccagtgccaggggatcccgcagggctccatcctctccacgctgctctgcagcctgtgctacggcgacatggagaacaagctgtttgcggggattcggcgggacgggtgaggcctcctcttccccaggggggcttgggtgggggttgatttgcttttgatgcattcagtgttaatattcctggtgctctggagaccatgactgctctgtcttgaggaaccagacaaggttgcagccccttcttggtatgaagccgcacgggaggggttgcacagcctgaggactgcgggctccacgcaggctctgtccagcggccatgtccagaggcctcagggctcagcaggcgggagggccgctgccctgcatgatgagcatgtgaattcaacaccgaggaagcacaccagcttctgtcacgtcacccaggttccgttagggtccttggggagatggggctggtgcagcctgaggccccacatctcccagcaggccctcgacaggtggcctggactgggcgcctcttcagcccattgcccatcccacttgcatggggtctacacccaaggacgcacacacctaaatatcgtgccaacctaatgtggttcaactcagctggcttttattgacagcagttacttttttttttttaatactttaagttctagggtacatgtgcacgacgtgcaggttagttacatatgtatacatgtgccatgttggtgtgctgcacccattaactcatcatttacattaggtatatctcctaatgctatccctccccactccccccatcccatgacaggccctggtgtgtgatgttccccaccctgtgtccaagtgttctcattgttcagttcccacctgtgagtgagaacatgtggtgtttggttttctttccttgcaatagtttgctcagagtgatggtttccagcttcgtccatgtccctacaaaggacatgaactcatccttttttatgactgcatagtattccgtggtgtatatgtgccacattttcttaatccagtctatcatcgatggacatttgggttggttgcaagtctttgctactgtgaatagtgccgcaataaacatacgtgtgcatgtgtctttatagcagcatgatttataatcctttgggtatatacccagtaatgggatggctgggtcaaatggtatttctagttctagatccttgaggaatcaccacactgtcttccacaatggttgaactagtttacactcccaccaacagtgtaaaagtgttctggtgctggagaggatgtggacagcagttatttttttatgaaaatagtatcactgaacaagcagacagttagtgaaggatgcgtcaggaagcctgcaggccacacagccatttctctcgaagactccgggtttttcctgtgcatcttttgaaactctagctccaattatagcatgtacagtggatcaaggttcttcttcattaaggttcaagttctagattgaaataagtttatgtaacagaaacaaaaatttcttgtacacacaacttgctctgggatttggaggaaagtgtcctcgagctggcggcacactggtcagccctctgggacaggatacctctggcccatggtcatggggcgctgggcttgggcctgagggtcacacagtgcaccatgcccagcttcctgtggataggatctgggtctcggatcatgctgaggaccacagctgccatgctggtaaagggcaccacgtggctcagagggggcgaggttcccagccccagctttcttaccgtcttcagttatttttccctaagagtctgagaagtggggccgcgcctgatggccttcgttcgtcttcagctggcacagaattgcacaagctgatggtaaacactgagtacttataatgaatgaggaattgctgtagcagttaactgtagagagctcgtctgttggaaagaaatttaagtttttcatttaaccgctttggagaatgttactttatttatggctgtgtaaattgtttgacattcagtccctcgtagacagatactacgtaaaaagtgtaaagttaaccttgctgtgtattttcccttattttaggctgctcctgcgtttggtggatgatttcttgttggtgacacctcacctcacccacgcgaaaaccttcctcaggtgaggcccgtgccgtgtgtctgtggggacctccacagcctgtgggctttgcagttgagccccccgtgtcctgcccctggcaccgcagcgttgtctctgccaagtcctctctctctgccggtgctggatccgcaagagcagaggcgcttggccgtgcacccaggcctgggggcgcaggggcaccttcgggagggagtgggtaccgtgcaggccctggtcctgcagagacgcacccaggttacacacgtggtgagtgcaggcggtgacctggctcctgctgctctttggaaagtcaagagtggcggctcctggggccccagtgagacccccaggagctgtgcacagggcctgcagggccgaggcggcagcctcctccccagggtgcacctgagcctgcggagagcaggagctgctgagtgagctggcccacagcgttcgctgcggtcacgttcctgcgtggggttgtttgggatcggtgggagaatttggatttgctgagtgctgctgtcttgaaccacggagatggctaggagtgggtttcagagttgatttttgtgaatcaaactaaaatcaggcacaggggacctggcctcagcacaggggattgtccaatgtggtccccctcaagggcgccccacagagccggtgggcttgttttaaagtgcgatttgacgagggacgagaaaccttgaaagctgtaaagggaaccctcagaaaatgtggccgccaggggtggtttcaggtgctttgctgggctgtgtttgtgaaaacccatttggacccgccctccaagtccaccctccaggtccaccctccagggccgccctgggctgggggtatgcctggcgttccttgtgccgcagcccggagcacagcaggctgtgcacatttaaatccactaagattcactcggggggagcccaggtcccaagcaactgagggctcaggagtcctgaggctgctgaggggacagagcagacggggaacgctgcttctgtgtggcaagttcctgagggtgctggccagggaggtggctcagagtgtatgttggggtcccaccgggggcagaactctgtctctgatgagtcggcagccatgtaacaggaaggggtggccacagggagctgggaatgcaccaggggagctgcgcagctggccgaggtcccagggccaggccacaggaagggcagggggacgcccggggccacagcagaggccgcaggaagggaaggggatgcccaggccagagcagaggctaccgggcacaggggggctccctgagctgggtgagcgaggctcatgactcggcgagggaacctccttgacgtgaagctgacgactggtgttgcccagctcacagcccagccaggtcccgcgcctgagcaggaactcagaaccctcccctttgtctaaagcacagcagatgccttcagggcatctaggagaaaacaggcaaagtcgttgagaaacgtcttaaaagaaggtgggatggtggcaatttcttgtccagattttagtctgccccggaccacagatgagtctataacgggattgtggtgttgccatggggacacatgagatggaccatcacagaggccactggggctgcacctcccatctgagtcctggctgtcccgggtccaggccaggttcttgcatgctcacctacctgtcctgcccgggagacagggaaagcaccccgaagtctggagcagggctgggtccaggctcctcagagctcctgccaggcccagcaccctgctccaaatcaccacttctctggggttttccaaagcatttaacaagggtgtcaggttacctcctgggtgacggccccgcatcctggggctgacattgcccctctgccttaggaccctggtccgaggtgtccctgagtatggctgcgtggtgaacttgcggaagacagtggtgaacttccctgtagaagacgaggccctgggtggcacggcttttgttcagatgccggcccacggcctattcccctggtgcggcctgctgctggatacccggaccctggaggtgcagagcgactactccaggtgagcgcacctggccggaagtggagcctgtgcccggctggggcaggtgctgctgcagggccgttgcgtccacctctgcttccgtgtggggcaggcgactgccaatcccaaagggtcagaggccacagggtgcccctcgtcccatctggggctgagcagaaatgcatctttctgtgggagtgagggtgctcacaacgggagcagttttctgtgctattttggtaaaaggaaatggtgcaccagacctgggtgcactgaggtgtcttcagaaagcagtctggatccgaacccaagacgcccgggccctgctgggcgtgagtctctccaaacccgaaacacaggggccctgctgggcatgagtccctctgaacccgagaccctggggccctgctgggcgtgagtctctccgaacccagagacttcagggcccttttgggcgtgagtctctccgctgtgagccccacactccaaggctcatccacagtctacaggatgccatgagttcatgatcacgtgtgacccatcaggggacagggccatggtgtggggggggtctctacaaaattctggggtcttgtttccccagagcccgagagctcaaggccccgtctcaggctcagacacaaatgaattgaagatggacacagatgcagaaatctgtgctgtttcttttatgaataaaaagtatcaacattccaggcagggcaaggtggctcacacctataatcccagcactttgggaggccgaggtgggtggatcacttgaggccaggagtttgaggccaacctaaccaacatagtgaaattccatttctacttaaaaaatacaaaaattagcctggcctggtggcacacgcctgtagtccccgctatgcgggaggctgaggcaggagaatcatttgaacccaggaggcagaggttgcagtgagccgagatcacaccactgcactccagcctgggcaacagagtgagacttcatcttaaaaaaaaaaaaaaaagtatcagcattccaaaaccatagtggacaggtgtttttttattctgtccttcgataatatttactggtgctgtgctagaggccggaactgggggtgccttcctctgaaaggcacaccttcatgggaagagaaataagtggtggatggttgttaaaccagaggtttaaactggggtcctgtcgttctgagttaacagtccagatctggactttgcctctttccagaatgctccctggggtttgcttcatgggggagcagcaggtgtggacaccctcgtgatgggggagcagcaggtgcagacgccctcatgatgggggagtggcaggtgcagacacccttgtgcatggtgcccagcatgtccctgttgcagctccctccccacaaggatgccggtctcctgtgctccccacagtccctgcttccctctcacagccttacctggtcctggcctccactggctttgtctgcatgatttccacatttcctgggctcccagcacctcttcgcctctcccaggcacctctgcagtgctggccataccagtcagctgtgaactgtccactgcttattttgctccccatgaaatgtattttttaggacaggcacccctggttccagcctctggcacagcatcagtgaatgttattgaaggacaaaggacagacaaacaaatcaggaaaatgggttctctctaaacacattgcaaagccacagaggctagtgcaggatgggtgggcatcaggtcatcagatgtgggtccaatgccagaatattctgtgctcccaaaggccacttggtcagagtgtgtgcttgcagaggtggctctaaaagctcagcagtggaggcagtggttcgccatactcagggtgaactcacatcctctgtgtctgaagtatacagcagaggcttgaagggcatctgggagaagaaaacaggcaaaatgattaagaaaagtgaaaaaggaaaagtggtaagatgggaattttcttgtccagattttagtctcccaaaccacagctcagatggtagaatgtggtcagaactgatggacagaacaatagaacaaaacggaagccctatctctcagaaacgtgtgttaatgtggtatgtggcacagctgatggaaaagagagtgtgtgtgtaatttttttttctgagaaaactgactggaagcaaataagttgtgtctttacagcatataccagagcagattctaggtagaagaggagacacatgcaaacaacaccagcaacagaaataaaacaaaagactcaaagggaagggaggtgaacgttccctggtttggtgttggggaaggacacacagggaggcggatgaaaccagtgaggcaacgggcattgctttcactgcagagaaactcagcttgcctgagccacagtgaaaatggccattccctggagcgtttgtgcacgtgatttatttaaggcgccctgtgaggtcctgcacattcatcctctcactttgttctcctaaccacctgagaggtagaggaggaaaggctccaggggagcagccgcccttggtcacccagctggcaaagggcatgcatgattgcagcctggcctcctgctccggggcccttgctctgcccgaggaccccacacaagtcagacccataggctcagggtgagccggagcccaaggtcgtgttggggatggctgtgaaagaagaaatggacgtctgatgcacacttgggaaggtcctaccagcagcgtcaaagaaatgcatgtgaaactgacagcgagacccatccctcaaagaaacgcacgtgaaactgatggcgagacctgtccccatccctcatgctggctccttttctgggcttgccaagagccagcatcaggttgaggcaagctggaaagacttttctggaaagcagcttgtttgcatggaagtcctcacaatgtcctgtgtcttcccagtaattccacttctgaagtgaccagacattatcacgggtcttatttaccatttccagtgttccaggcagggggacttgccacagcaagtcacgaacctgcccaaatacagggctaaggagatattatgcatcacaaaacttgctctgccattaaacatttttcaaagaatttttgaagaatgtttaatggcacaaaacgtttatttcaatgtagcagtgttcaaagctggatgtaaaagaacacaccccaggagcctgccgtggatgtcatgtgtgttcatctttggacatggacatacatgggcagtgagtggtggtgaggccctggaggacatcggtgggatgcctccatcctgcccctctggagacaccatgtgtgccacgtgcactcactggagccctgtttagctggtgccacctggctcttccatccctgagattcaaacacagtgagattccccacgcccaactcagtgttctcccacaaaaaacctgagtcacacctgtgttcactcgagggacgcccgggagccagggctccacagtttattatgtgtttttggctgagttatgtgcagatctcatcagggcagatgatgagtgcacaaacacggccgtgcgaggtttggatacactcaacatcactagccaggtcctggtggagtttggtcatgcagagtctggatggcatgtagcatttggagtccatggagtgagcacccagccccctcgggctgcagcgcatgccccaggcaggacaaggaagcgggaggaaggcaggaggctctttggagcaagctttgcaggagggggctgggtgtggggcaggcacctgtgtctgacattcccccctgtgtctcagctatgcccggacctccatcagagccagtctcaccttcaaccgcggcttcaaggctgggaggaacatgcgtcgcaaactctttggggtcttgcggctgaagtgtcacagcctgtttctggatttgcaggtgagcaggctgatggtcagcacagagttcagagttcaggaggtgtgtgcgcaagtatgtgtgtgtgtgtgtgcgcgcgtgcctgcaaggctgatggtgactggctgcacgtaagagtgcacatgtacgcatatacacgtgagcacatacatgtgtgcatgtgtgtacatgaaggcatggcagtgtgtgcacaggtgtgcaagggcacaagtgtgtgcacatgcgaatgcacacctgacatgcatgtgtgttcgtgcacagtcgtgtgggcattcacgtgaggtgcatgcgtgtgggtgtgcagtgtgagtagcatgtgtgcacataacatgtattgaggggtcctcgtgttcaccccgctaggtcctcagcaccagtgccactccttacaggatgagacggggtcccaggccttggtgggctgaggctctgaagctgcagccctgagggcattgtcccatctgggcatccgcgtccactccctctcctgtgggcttctgtgtccactccccctctcctgtgggcgtccacaccccctctcctgtgggcatccgcatccactccctctcctgtgggcatctgtgtccactccctctctcctgtggttgtccgtgtccactcccccctcctgtgggcgtccgcgtccactccctctcctgtgggcatctgcatccactccctctctcctgtgggcgtctgtgtccactccccctctcctgtgggcatccgcgtccactccctcttctgtgggcatctgcatccactcgtctctcctgtgggcgtccgtgtccactccccctctcctgtgggcatctgcgtccactccctctctcctgtgggcatccgtgtccactccccctctcctgtgggcatccatgtccactccctctcctgtgggcatctgcgtccactccctctcctgtgggcatctgcgtctgctccctctctcctgtgggcgtccgtgtccactcccccctcctgtgggcgtccgcgtccactccctctcctgtgggcatctgcgtccgctccctctctcctgtgggcgtccgtgtccactcccccctcctgtgggcgtccgcatccactccctctcctgtgggcatctgcgtctgctccctctctcctgtgggcgtccatgtccactccctctcctgtgggcatctgcgtccactccctctcctgtgggcatccgcgtccactccctctcctgtgggcatctgcatccactccatctcctgtgggcatccacgtccactccctctcctgtgtgcatctgcatccactccactccccctctcctgtgggcatccgcgtccactccctctcctgtgggcatctgcatccactccctctctcctgtgggcgtccgtgtccactccccctctcctgtgggcatttacatccactccattccctctctcctgtgggcgtctgtgtccactccccctctcctgtgggcatttacatccactccactccctctctcctgtgggcatccgcgtccactccccctctctgtgggcatctgcgtccacctcccctctctgtgggcatttgcgtccactccctctcctggttccttcctgtcttggccgagcctcgggggcaggcagatgacacagagtcttgactcgcccagggtggttcgcagctgccgggtgagggccaggccggatttcactgggaagagggatagtttcttgtcaaaatgttcctctttcttgttccatctgaatggatgataaagcaaaaagtaaaaacttaaaatcccagagaggtttctaccgtttctcactctttcttggcgactctaggtgaacagcctccagacggtgtgcaccaacatctacaagatcctcctgctgcaggcgtacaggtgagccgccaccaaggggtgcaggcccagcctccagggaccctccgcgctctgctcacctctgacccggggcttcaccttggaactcctgggttttaggggcaaggaatgtcttacgttttcagtggtgctgctgcctgtgcacagttctgttcgcgtggctctgtgcaaagcacctgttctccatctctgggtagtggtaggagccggtgtggccccaggtgtccccactgtgcctgtgcactggccgtgggacgtcatggaggccatcccagggcagcaggggcatggggtaaagagatgtttatggggagtcttagcagaggaggctgggaaggtgtctgaacagtagatgggagatcagatgcccggaggatttggggtctcagcaaagagggccgaggtgggtgcaggtgagggtcgctggccccacccccgggaaggtgcagcagagctgtggctccccacacagcccggccagcacctgtgctctgggcatggctgtgctcctggaacgttccctgtcctggctggtcagggggtgcccctgccaagaatcgacaactttatcacagagggaagggccaatctgtggaggccacagggccagcttctgcctggagtcagggcaggtggtggcacaagcctcggggctgtaccaaagggcagtcgggcaccacaggcccgggcctccacctcaacaggcctcccgagccactgggagctgaatgccaggaggccgaagccctcgccccatgagggctgagaaggagtgtgagcatttgtgttacccagggccgaggctgcgcgaattaccgtgcacacttgatgtgaaatgaggtcgtcgtctatcgtggaaacccagcaagggctcacgggagagttttccattacaaggtcgtaccatgaaaatggtttttaacccgagtgcttgcgccttcatgctctggcagggagggcagagccacagctgcatgttaccgcctttgcaccagctccagaggcttgggaccaggctgtctcagttccagggtgcgtccggctcagaccgccctcctctctgccttctctctctgcctcaaatcttccctcgtttgcatctccctgacgcgtgcctgggccctcgtgcaagctgcttgactcctttccggaaacccttggggtgtgctggatacaggtgccactgaggactggaggtgtctgacactgtggttgaccccagggtccagctggcgtgcttggggcctccttgggccatgatgaggtcagaggagttttcccaggtgaaaactcctgggaaactcccagggccatgtgacctgccacctgctcctcccatattcagctcagtcttgtcctcatttccccaccagggtctctagctccgaggagctcccgtagagggcctgggctcagggcagggcggctgagtttccccacccatgtggggacccttgggtagtcgcttgattgggtagccctgaggaggccgagatgcgatgggccacgggccgtttccaaacacagagtcaggcacgtggaaggcccaggaatccccttccctcgaggcaggagtgggagaacggagagctgggccccgatttcacggcagccaggctgcagtgggcgaggctgtggtggtccacgtggcgctgggggcggggtctgattcaaatccgctggggctcggccttcctggcccgtgctggccgcgcctccacacgggcttggggtggacgccccgacctctagcaggtggctatttctccctttggaagagagcccctcacccatgctaggtgtttccctcctgggtcaggagcgtggccgtgtggcaaccccgggaccttaggcttatttatttgtttaaaaacattctgggcctggcttccgttgttgctaaatggggaaaagacatcccacctcagcagagttactgagaggctgaaaccggggtgctggcttgactggtgtgatctcaggtcattccagaagtggctcaggaagtcagtgagaccaggtacatggggggctcaggcagtgggtgagatgaggtacacggggggctcaggcagtgggtgaggccaggtacatggggggctcaggcactgggtgagatgaggtacacggggggctcaggcagagggtcagaccaggtacacgggggctctgatcacacgcacatatgagcacatgtgcacatgtgctgtttcatggtagccaggtctgtgcacacctgccccaaagtcccaggaagctgagaggccaaagatggaggctgacagggctggcgcggtggctcacacctgtagtcccagcactttgggaggccgaggcgagaggatcccttgagcccaggagtttaagaccagcctgagcaacatagtagaaccccatctctatgaaaaataaaaacaaaaattagctgagcatggtggtgtgcgcctgtagttccaatacttgggaggctgaagtgggaggatcacttgagcccaggaggtggaagctgcagtgagctgagattgcaccactgtactgcagcctgggtgacagagtgagagcccatctcaacaacaacaaagaagactgacaaatgcagtttcttggaaagaaacatttagtaggaacttaacctacacacagaagccaagtcggtgtctcggtgtcagtgagatgagatgatgggtcctcacaccatcaccccagacccagggtttatgcaccacaggggcgggtggctcagaagggatgcgcaggacgttgatatacgatgacatcaaggttgtctgacgaagggcaggattcatgataagtacctgctggtacacaaggaacaatggataaactggaaaccttagaggccttcccggaacaggggctaatcagaagccagcatggggggctggcatccaggatggagctgcttcagcctccacatgcgtgttcatacagatggtgcacagaaacgcagtgtacctgtgcacacacagacacgcagctactcgcacacacaagcacacacacagacatgcatgcatgcatccgtgtgtgtgcacctgtgcccatgaggaaacccatgcatgtgcattcatgcacgcacacaggcaccggtgggcccatgcccacacccacgagcaccgtctgattaggaggcctttcctctgacgctgtccgccatcctctcaggtttcacgcatgtgtgctgcagctcccatttcatcagcaagtttggaagaaccccacatttttcctgcgcgtcatctctgacacggcctccctctgctactccatcctgaaagccaagaacgcaggtatgtgcaggtgcctggcctcagtggcagcagtgcctgcctgctggtgttagtgtgtcaggagactgagtgaatctgggcttaggaagttcttaccccttttcgcatcaggaagtggtttaacccaaccactgtcaggctcgtctgcccgccctctcgtggggtgagcagagcacctgatggaagggacaggagctgtctgggagctgccatccttcccaccttgctctgcctggggaagcgctggggggcctggtctctcctgtttgccccatggtgggatttggggggcctggcctctcctgtttgccctgtggtgggattgggctgtctcccgtccatggcacttagggcccttgtgcaaacccaggccaagggcttaggaggaggccaggcccaggctaccccacccctctcaggagcagaggccgcgtatcaccacgacagagccccgcgccgtcctctgcttcccagtcaccgtcctctgcccctggacactttgtccagcatcagggaggtttctgatccgtctgaaattcaagccatgtcgaacctgcggtcctgagcttaacagcttctactttctgttctttctgtgttgtggaaatttcacctggagaagccgaagaaaacatttctgtcgtgactcctgcggtgcttgggtcgggacagccagagatggagccaccccgcagaccgtcgggtgtgggcagctttccggtgtctcctgggaggggagctgggctgggcctgtgactcctcagcctctgttttcccccagggatgtcgctgggggccaagggcgccgccggccctctgccctccgaggccgtgcagtggctgtgccaccaagcattcctgctcaagctgactcgacaccgtgtcacctacgtgccactcctggggtcactcaggacaggcaagtgtgggtggaggccagtgcgggccccacctgcccaggggtcatccttgaacgccctgtgtggggcgagcagcctcagatgctgctgaagtgcagacgcccccgggcctgaccctgggggcctggagccacgctggcagccctatgtgattaaacgctggtgtccccaggccacggagcctggcagggtccacaacttcttgaacccctgcttcccatctcaggggcgatggctccccacgcttgggagccttctgacccctgacctgtgtcctctcacagcctcttccctggctgctgccctgagctcctggggtcctgagcaagttctctccccgccccgccgctccagcgtcactgggctgcctgtctgctcgccccggtggaggggtgtctgtcccttcactgaggttcccaccagccagggccacgaggtgcaggccctgcctgcccggccacccacacgtcctaggagggttggaggatgccacctctggcctcttctggaacggagtctgattttggccccgcagcccagacgcagctgagtcggaagctcccggggacgacgctgactgccctggaggccgcagccaacccggcactgccctcagacttcaagaccatcctggactgatggccacccgcccacagccaggccgagagcagacaccagcagccctgtcacgccgggctctacgtcccagggagggaggggcggcccacacccaggcccgcaccgctgggagtctgaggcctgagtgagtgtttggccgaggcctgcatgtccggctgaaggctgagtgtccggctgaggcctgagcgagtgtccagccaagggctgagtgtccagcacacctgccgtcttcacttccccacaggctggcgctcggctccaccccagggccagcttttcctcaccaggagcccggcttccactccccacataggaatagtccatccccagattcgccattgttcacccctcgccctgccctcctttgccttccacccccaccatccaggtggagaccctgagaaggaccctgggagctctgggaatttggagtgaccaaaggtgtgccctgtacacaggcgaggaccctgcacctggatgggggtccctgtgggtcaaattggggggaggtgctgtgggagtaaaatactgaatatatgagtttttcagttttgaaaaaaa

SEQ ID NO: 42 - DNA, 16585 bp, Homo sapiens
gactaatggccctaactaagtattaacccctgccaagaaaagagctacttcctcttgaagtaaatgaagatagtgatgctttctcttaaactttacttataaaaagcatcaaaggggggaatgaagcaggaaatataaaaggaaaaacaagtaaagggaaaacaagtcctttcctgaccagtctgactcactccaaagtcctgctggagctatgataattatctgcaaggccaggcaggggctccgaaggagtgggctccaggagcagggatgagaaaaacaagttctccttatcagtttccctgtttgaaattctctccccataacattattctttgttctgctctcacaactatttttgtaactatttctgcaagtctgtaaagattttgtaagttcttgtttttctttctgtagcatggcaaggtcacaagacatgtttaagtaaggtaggctcatgttgcaaatcctgttgtaaaacctgtcacggtatgattaactgcctttgttctgcttctgtaagactgctttctcacctcgcaggttttgcgccaaaaacccgacttgcccctgcctgatgcatgtataaaagtcaagccctgtctttgttcagggctcagcctttggatgttaatccgctgggccagtggccacctaaataaaaccttcctgttgcacccagtgatctctccggcctcctgattcccacaacatataagcattcctttttctctgcaacctagcccgcatctgtcattgactttttaacaataggcattctgactggatgagatggtatctcactgtggtttttctctgcatttttctaataattaacaacgtgaattttgttttcatatgcttgtcagccacatgtatgtcttcttttgaaaagtatctgttcatgtttttgcttactttttaattaggtttttggttttctttttgttgttgttgttgttttctgagatggagtcttgctgtgtcaccaggatggagtgcagtggcatgatctcgactcactgcaacctccacctcccaggttcagatgattcttctgcttcagtctcctgagtagctgggatcacaggtgcgtgacacaaaacccagctaatttttgtatttttattagagatggggtttcaccatgttggccaggatggtctggatctcttgacctcatgatccatctgcctcagcttcccaaagtgctgggattacaagcatgagccacagatcctggcttattcttcttcttctttttttttaaaataaatttgtttaagtttcttatggatgctagattttagacctttgtcagaagcatagtttgcaaatattttcttctagtctgtaggttgtctgtttattcagttgattgtttccattgctgcaaaatagctctttagtttaattaggtcccatttgtcaatttttgcttctgttgcaattgcttttggtatcttcatcataaaatctttgccagtttttatgtcttagaattttctaggttattttctagattattttcaggttttatatatatatatatatatatatatatatatatatatatatatatatatatatataattttaagttctacatttaagtctttaattcatcttgaattgatttttatatatcatgtaagaaaggcatccagtttcaatcttctgcatagtgctagctagttattccaacctcatttattaaatagggaattcttcctgcattgctcttgtaagctttgttgaagatcagatggttgcaggtgtgtggcattgtggcattatttattggctatctattctgtttcttgttctatgagtcgtttatatatatgtgtgtgtgtgtgtatatgtgtatatatgtgtgtgtgtgtgtgtatacattgccttgggtattcgggctctttgttagttctatatgaattttaaaatagttgtttttagttctgttaagaatgtttttggtagtttgataggaattacattagatctgtaaatttcttttggcagtatggccattttaatgatattgatcttttttatccatgagcataaaataaatctccatttatttgtgtcatatatgatttatttaagcagtgttttgtaattcttgttgtagaggtctttcacctccctggttagctgtatctctagatgttttattctttttgtggcagttgtgaaggggattgtgtttttgatttggctttcggcttggatgttattaatgtacagggatgctactaatttttgtacatttgctttgtattgtgaagtttggttcagtttttcagtttaaggagcttttctgtggagactatagggttttctatatatagaattacatctgcaaaaaatgggaagtttgacttcctttcttcctatttggatgccttttattttgtctcttgtctgattgctctggtgagggctgccaattctatgttgaataggagtggtgagagaaaacatccttgtcttgtgccagttttcatggagaaatgcttccagcttttgtccactcagtatgtttgttgtgggtttgtcatacagaattcattattttgaagtatgtatcttctatgcctagtttgttgcaggtttttaacgtgaaagatgttaaattttcttgaaagctttttctgcatctattgagataatctggtggtttttatccttatttttgtttttgtaatgaatcacatatattaatttgtgtatgttgaaccagcctcatatcccagggataaagcctacttgatcataatggatttgctttttgatgtgctgttgaatttaatttgccaatattttgttgaagatttttgcatcaatggtcatcaaggatattggcctaaagttttctttttttgttatacctatgtcaggttttggtgtcagaatgatgacattcttatataatgagttgaaggggagtgtttttttctcaattttttggaatagttttagaaggaatggtaccagctcttctttgtacatctggtagaattcagttgtgaatctctctcgtcctgggctttttttggttgctaggctattcattactaattcagttttggagtttgttattggtctactcagagattcgatttcttttttgttcagtcttgggaggatatatttgtccacgactttactatttctatttttttggtcttttttttttttttttcctttttgtggagaacggggtctcactatattgcccaggcaggtctcaaactcctgggctcaagctatcctcccaccttttgcctccctgagagctgggactacagatgtgagccaccgcacccagctgaatttactatttctttcagattttttagtttgtgttcatagaagtgtttatagtagacttcaacagttatttgtattcttgtggggtcagggttaatgttccttttgtcatttctaattctctttatttgaatcttctttctttatgaatctggctcgtggtttatttagcttattaattttttccaaagatttaactcctggatttcttgatcttttgtatagtttttcacatctaaatctccttcagtacagatcagattagttactttttgccctctgctagttagggattggttttgtcttgcatctctcattttatttatgatattacattgttaaattgagatctttttaacttttttatgtgagcatttagtgctataaattcttcttttaacactgccttagctgtgttgcagagattctggtatgttgtactttgttctcatttgtttcaaagaacttttttatttctgccttaattttattatttacccaaaagttattcagatgcaggttgtttaatttccacataattgtatggtttcaagtggttttctttgttttgatttatatttgtatcaagttgtggtcagagtgtgtggttggtataatttggggatgtttgaatttggtgaggattgttttatttctgattgtgtggtcaattttagagtatgggccacttggtgatgagaagaatgtatattatattgcttttagatggagacttttgtagatgtctattatgattatttggtcaagtattgagtttaggtcctaatatctttgttaattttctgcctcaaaaatgtgtctaatagtgtctgtggggtgttgtagtctcccaaaattattctgtcagaatctaaatataaatctcttagaactggtcttattcatgtgtacctgtgaaaggaaatgaaatcttcagagcccaaactcattaaaccaaaaagaaaagttaggctgggaactgggtcacacaaacccacctatccttttggttcttaaataagatggctacaagatgaaaagttacatgactccctcatattttgcccacaagaaaatttctagtgagctgcaagatctttaccctaaggtgtttctgttaaaattataccatggaaatataaattgatggcttatctttacacgttccaccagacataaatgcatatctgattgttcccctgcccctttttgtctatgttatcttatgtaaaaatgcagattacctgcattttttgtctgtgccatttgtctgcatcatcttatgttaaaaaaaatgcagattcactgacagacaatgacatgaatgactgtttttccctacctccctcttacataacagttttgtacttctcagtatctcattctttctcctttaaatttggagcccccaaaattttcttgggagaaagacataggcctttttcctagctgtgcattcttaactttgggaaataaatctcctaaaatgattgagacttttcttgtcatttttcttgattgatacacccatggattttttttttataacacctttctttcttctgcttttttcccataaacatttctcaagtgcacatggcatgcaaaattaagatgtccagtagttcaaaaacatgtccagagacctggctgttatagtggaaaatacaaattagaaataagaagccttattctccacatgaaaaaagggaggatattttctttctttcttttttttttttttttttttgagatggagtctcacctggttgcccaggctggagtgcaatggcatgatctggctcactgcaacctccacctcctgggttcaagtgtactcagcctcccgagtagctggggttacaggcacacaccaccacacctggctaattttttgtatcttcagtagagatgaggtttcaccatgttggctaggctggcctcaaactcctgacctcatgattcaccagcctcagcctcccaaagtgctgggattacaggtgtgagccactgcaccctgccaggagtatattttcttaatttatttttccttaaagcatttaaattttatgtatattttttctctgttgtttgaaagatatgtaaatcatattaacagttaaaccttttgtcactgtttttgacttgggattgtctttgtctaggacctcaggttcattgctttggcaaagatttattttctccatttgttgtcttttaaggtagacacagatttgtttagattaaagtttgttttaagagcacacaaaagttgagcatgaagataggattaaatttagcaataaaaaatgctaaagactaaaagatactaagttcctttgatagaatacagattatccaaggtaatcaggtaatatttgcaggccgaagtacttttattgcaaaagcatggttcagtgtatgaactgaacagtggagtctgtagttgtgctttggtttatatttattacttgagtacaattagcatagttatatgtagtgtttgtagacaaactgcattcatataaacagtattttatatactagtgtgaatataacactacaatatttactttgaatcccttagtcattttaataatgttatattcggccgggcgtggtggctcatgcctgtaatccctgcactttgggatgccaaggtgggtggatcacctgaggtcaggagttcaagaccagccttgccgacatggcaaaactccatctctactaaaaaatacaaaaattagccgggcgtggtggcgcgtgcctgtaatcccagctactcaggaggctgaggcatgtgaatcgcttgaacctgggaggcagaggttgcagtgggctgagattgcaccactgcactccagcctgggcaatagagcgagactgtttcaaaacaaaaaaacaaacaaaaaataatgttatattcatacttttgaaatataaactgttttaattgaattatggttgtagacaatttttaaaaatcctatgtacattatgactagtacattatttatacttagatatttatatctaatattcaaaggaaatttactaccaaactattacagtaatattagtatgacatgcttactaatttatccagtagagttaattataggtaagcatgattttagtgtctatcatttcactaaattggaatggtgctattacgggaaaagtaaacaagaatgatttggccacccaaaaaccataatagctctacagttcaccatgatgcaaactcaaatgtattccactatatgaataaagtaatattctaattcttcatcggaaagttatggtggtgggaggtccaggcaggcgggtcacttgaggtcaggagttcaagaccaacctggccaacatggtgaaaccctgtctctactaaaaatacaaaaattagttgggcgtgatggcacatgcctgtaatcccagctactctggacgctgaggcatgagaatcccttgaaccctggaggtggaggctgcagtgagctgagattgtaccactacactccagcctggatgacagagcaagactccgtctcaaaaaaaaaaagtgttctttggaaattgtcaaatatattccattatagatctctcatttaatggctaggagaagagagagcagcagagatggaagagaatccttataaaattctgctgagaatatgacccctttcttcataatgctcacgtttctcatgctgagagtagctgtgcaatttgggtgtttagaaaaattgattagcagaatattttctggctgacttgatcaaacttatatctagcttgtgtttttaaaagatgcttttaactgtttttctctcaatacaatttttctcagagtgagagctgtttttctcttgaatgcttttggtttctgttttagaggccccattactatcccatggtgtctgtgaatgaggtgggctgtcacagagctcttagagctatctctgtctatctctgtgggtgtggtggtagcaggtaaacaggtggtgctgacacttttaaaagcatattctcagcatgcaggtgtaatttgtccatagaatctcatcttaaaaggaatcccagagaaacaggagaaagaggaagacatgacctttttttaagcttaatatgtctcagatagagagctgtgtccactctgcctcctggaatgccatgcatttagttcttgcaaacctttacttctctaattgtgttgtttctccctaatgagtttgtttcaactactttttaaaattcttatgatagtcaagggtctctgaaaaatattttttcctacataccagaggcttctctacatctctacatcacggctctttatatgccacgtagaaatctcattatgaatttataatctgcaacatgaaaaatgttccctctgtggctgttgaacatgggaaggtgtgactactcaagattcctattggggaaaagctagggtctttagtaaagaaggagaacatgtaacgttgaggtaccatctctgttctccattagctctatgcagaacacgattaataaaatgctttttcaaacagaatggcatttattacccagaaagttctgaaacaaattattaggagatagatacctgctctttagggtgctgaagaaaaactacttaaaatcactattaaaaattacagaacatatgaattatctgtatcttgaagtttccataaaactgattttttatggttaaattcaaactctaatttacttttgagatcaatatcgcagcagtgaagctgcatttttctgtgtgcatcagcacattacaaaaatttgtcctagtgcagttgatgttaatgattcaattggttaaagagctcttggacagatttctttactataattatttttctcttcattattaagtatctttatgctgctgatgtgcatgtaaaccatcacatttaatctggcagctgcctttctttcttaggttttctgtgcgtatatctgccttaggaaaatgaaagctgtcatccctttttacaggccagaaaaactgggaaaaacacaggctcacccacctactagatgtttgacaaaatactcttcttgggccaaaaacattgacattattggtgagctttttagaaatttagaatatcagactgttccagatcttctgaaaaaataatctgcattaacgagatctgaagtttatcatacacattaaaacttgcgaggtaccttttaactcaacatgtctttttcatctcaaaaatacacacaactcattctgtatgatgcagatatagcatttaaaaatagacatgttggcgtttatgccctaatttatactttattatccagaaaagtaccatatatacacagatgttgtggatcttcttataccactttcttttctcagggttagataatacattagaaaatatttctgtgttaaaaattcttttatggatagtttcattcactcctataagtcagaaccagttttctttactgttttattttaccttgaaatttaaaattatgcccatggccacttggtaaatgtatgtgattttgtgtatgtgtgtgtttttgtgtttttcagggaccattgacatttatggatgtggccatagaattctctttggaggagtggcaatgcctggacactgcacagcagaatttatataggcatgtgatgtgagagaactacagaaacctggttttcttgggtgaaggtaacttcaatacacattttctaatataccctaaaggttttaattctcttttttgtagaatgtttttggtgatttatgctttgcataaattgagtttcagatccctgttttcaaaaaaatcttttagatttgtcattgtagaaaatagtttattcaagatgtttcatctttaccataactttccacattcctgagatgatctttatcattcagtcttgattagtggtaattttagaaatttattggcataaaatattgttgcccacaccttaaaatctaactcccaacaacaattgttttgattcagtagtaccaggtagtgaaattaagaaactacaaatttaaaatattttctaaatctttagaaatttttgttataaattagcatttggggattaatttactagaatattctattgcattctctttactgagcacattaccaagttggtaattggagaatatgtgcaagatttatgttatttattttcaataaaacaggtattgctgtctctaagccagacctgattacctgtctggagcaaggaaaagagccctggaatatgaagagacatgagatggtagctaaacatttaggtaagtgagagtgaatacacagatggcacagagaagaggtcaaaggccaaggagaaggccacagcttaaaatgtgatttggtaagctgtgttccaaaggaaatagtttctggaaagcccgagtttttttttatttttctctcacatagaacatattttgtattgtttttcaattctctaaggattcctctttccctttagtgatctgtcttcaatttcacagtgaaagccaacatcctcttcatgggatataaaagactgcacaatctgactggtttttttttgttgttgttttgggggacacacaaatatgcataattttgagaaactctatgttaaacagttttttaaattctctttttgcatcaagtctgaaatgtgtgagtagtgatttctgttccattggtttttttgttgttgtttatttttctgtatattccattctgtttttactactatagctttgaaatatagttacatatgtaaggcatatgcagtgccaatataccttttcaggatttggctattttggattggctttttctttttatttggcaggacagatttgctgctggtattattctcacttgacagctattttcttcaggacttggacaatgtcacacagttagttcccttctggcctgcaaattttcttgagaaattcactcattacctcataagactatgcttataaataacatatcacttttatcttgcaactcacaatattctcttgtctgtgacttttaaaattgtgcttatatatgttcttgttgtaaatatctttgtgtgtattctagtttctttgttaacctttttaatttttacatcagtttttcttataatttttcagttccttttttatattttttacctccacaatatctgttttttgatatttttaatatttttgttatcccaatttttatgatttttaatagttgtctgtgtttctatttcattcatggagtattattcaatttatgttaactttttaaaattaattttttaatggttgctttctgaaaattttataatatctgatagagctatgttgccctaaaattttgtatgcattgtaatctttaattgaaatttgaacattaaaaacaagctacctgtcacagtgtctataatgtagctttgtcctggcaaagtctgaaaccatttgtcttagctagagatcctgagagtctttcaaacatgttcttaggatgtgtcttgtctgaaatgttctagttgttttttagttaaaagactttattcatgtttcttcttaatagtcatcacttgccacaactgttccctgtctgtagtacagtctctttcctgctgtaacatttacctttgatctcagcagactcaaaatgtcattccaaagtataccactgttaatttcagcactttatgtcattggagacagaaaccagtgtccgccaaagcacctaataaagccagaaataaagatgtgggtgtgttatttttcttgtctgttgaaaaagaaagcaaaagttggtaatgtacttctaaagacactatgttatactgaggagcagaaagagctgtgttgggtaaatgtaaccaacttttctcttccttccatgtggcttttggaattgtgataacctggaacactgcacacacgtaactcatttataaattttctataaatgcattttggtcaatatgctcttgttacatttatatgtctatgaaggaattagaacctgtggtattttgctatgccatcttgcttatgtagtttctgtaactttatgggttagatttgtaaagtatattcatctgagtcgagcaagtgaagtagtttgttacttttatttctttcagttatgttttattattttgcccaacacctttggccagagcagaacataagagattctttccagaaagtgaccctaagaagatatagaaaatgtggatatgagaatttacagttaagaaaaggctgtaaaagtgtggttgagtgtaaacagcacaaaggagattatagtggacttaaccaatgtttgaaaactaccttgagcaaaatatttcaatgtaataaatatgtagaagttttccataaaatttcaaattcaaatagacacaagatgagacatactgaaaataaacattttaaatgtaaagaatgtcgcaaaacattttgcatgctttcacacctaactcaacataaaagaatccaaactagagtgaatttctacaaatgtgaagcatatggaagagcctttaactggtcctcaacccttaataaacataagagaattcatactggagaaaaaccttacaaatgtaaagaatgtggcaaagcctttaaccagacctcacaccttattagacataagagaattcatactgaagagaaaccctacaaatgtgaagaatgtggcaaagcctttaaccagtcatcgacccttactacacataatataattcatactggggaaattccctacaaatgtgagaaatgtgttagagcttttaaccaagcctcaaagcttactgaacataagttaattcataccggagagaaacgttatgaatgtgaagaatgcggcaaagcttttaaccgatcctcaaaacttactgaacataagtacattcatactggagagaagctgtacaaatgtgaagaatgtggtaaagcctttaaccagtcctcaacccttactacacataagagaattcatagtggagagaagccctacaaatgtgaagaatgtggcaaagcttttaaacaattttcaaatcttactgaccataaaaaaattcatactggagagaaaccctacaaatgtgaggaatgtggcaaagcttttaaccaactctcaaaccttactagacataaggtaattcatactggagagaaaccctacaaatgtggagaatgtggcaaagcctttaaccagtcctcagcccttaatacacataagataatccatactggagagaatccccacaaatgtagagaatctggcaaagttttccacctatcctcaaaacttagtacatgtaagaaaattcatactggagagaaactctacaaatgtgaagaatgtggcaaagcctttaaccgatcttcaacccttattggacataagagaattcatactggagagaaaccctacaaatgtgaagaatgtggcaaagcttttaaccaatcttcaacacttactacacataagataattcatactgaagagaaacagtacaaatgtgatgaatgtggcaaagcttctacctgatcctcaaaactcattgaacacaagaaaattcatactggagagaaaccttacaagtgtgaagaatgtggcaaaacttctaaccatttctcaacccttactaaacataagatgattcatactggagagaagttacacaaatgtgatgaatgtgacaaagcttttaaccaatcttcaaccctttctacacataaaagaattcatactggagagaaaccctacaaatgtgaagaatgtggcagagcttttaattgatcatcaaaccttattaaacataagaaaattcatattggagagaaaccctacaaatgtgaagaatgtggaaaagcttttaaccagttctcaactcttactacacataaaataattcatactggagagaaaccatataaatgtgaagaatgtggcaaagctttcaacctatacgtaaaccttactacacataagaaaattcatactggagagaaaccctacaagtgtgaagaatgtggcaaagcttttagccaagtgtcaactcttactatacataaaagaattcatactggagagaaaccctacaagtgtgaagaatgtggcaaagcttttaaccaagtgtcaactcttactatacataaaagaattcatactggagagaaaccttacaaatgtgaggaatgtggcaaaactttcagtcgatgctcaaaacttactacacataagaaaattcatacaggagagaaaccttacaaatgtgaaaaatgtgctaaagcttttagccagtcttcaaccctttctacatataagataattcacactggagagaaatgctacaaatgtgaagaatgtggcaaagtttttaaccgatcttcaaaccttacagaccataaaaaaattcatacaggagagaaatcctacaaatgtgaagaatgtgacaaggcctttaacctgtcctcaacgcttactaaacataaggtaattcatactggagagaaactgtacaaatgtaaagaatgtggtaaagcttttaaacagttctcacaccttgctatacataatataattcatactggagagaaactctacaaatgtgaagaatgtggcaaagcttttaacttatcctcaaaccttactgcacataagaaaaatcgtactggagagaaaccctacaaatgtgaagaatgtggcaaagctaacctatcatcaacccttactccacataagacaattcatatttgagagaaaccctgcaaatgtgaagaatgtggcaatgcttgtaactaaatctcaaactttactaaacataagaaaattaatactggaaactttacaaacctgaaagatgtgacaatgattttgacaacaccttcaaacttttctaaacataaaataaatcatactggtgagaaatcttaaaaatatgaagaatggtacaaagcctttaaatggttgtcacacttgattgtaggtaagataatttatactggaggaaactcccagaagtgtgaagaatgtggcaaaacttttaatttttcacaccttatagcacaggaaagcacttcagaaaaattgtacaaatataaatgtggaaaagccattaatatctgcttacatcttactcaacattagagagttagtgcttaataaaagcattataaaagcaattagtgtaaaatcagaaaatgaaagttttttttttttttttagatggagtcttgctctgtcacccaggctggagtgcagtggtgtgatcttggctcactgcaacctctgcctcccaggttcaagcaattctcctgccttagcctccagagtagctgagactacaggcacacaccaccacatttggctaatttttttatttttagtagagactggctatcaccatgttggccaggctgatcttgaactcctgacctcaagtgatccacatgcctctgcctcccaaagtgctgggattataggtgtgagtcactgtgcctgacaaatataagcctttaaagagaagaaggttttcattttgaagacaaacattaggtacataaagagggttgtagtgtctttatttgtatcacagattttattgtacacattatgtactaaaggaaaatcctgaagcagtgctcaaactttgatcaacatcagggagtttatattggagaaaaactgcaaatgtaatatatttggaaaaacatttttcaaaaactactgcttagaaaacaccaggggatttatactaaaatatatttttgcagatgcagtaagtataaaagaaatttaatccaaaattaagtgtgtgtaaatatcagagaattcacagtagaaatatctaaggcactgacattttagacattgaactaatcagtgtgctgagtacagaaaataatccaaaattaaagttggtagataaattatttatatataactttaaaagaggtagaaatatttttagttataattacatttaaagtatacttttttctttgaaaaaattacaaaatttttaaaaagtgaatgatgtaattcaactcaaattacttcatgcttttcattctattgtattcacatgtgaaagcatgtgatcaattgctgcttcatcaaagatatgagacattcttttttgttaggtgggcaatattttttaccttttctatggaagagtaaagacattacaatgtaggatgcatgataaaaatctaagtggagaggctctttgtgtttaatttataatattgaatgatgtatgagggaagtgttcagaggaatattctgcattctagtgaaaatatcttttattttagttaaaattaaattaaaattagtagtatatcattttactaactgtacttttatgtaataaaatgcagcacatttaaaaaattttagattattgtgaacttaattttttaattaaactttttttttaacatgttaagaccaattgtgcattcagtgaagtattatcatgccactaacttcaacctatcccaccttactcaagggtgttggtaaaagatagtaacaatgtactatttaataacagagtggactaacatctctaataatttctcttgccagtgactttaaactaaagaacttaattaaagaacattgttcccataggttaaatttttattctttttcttatttaaacatatttttcttaacttttgtgggtacatagtgtgtgtatatatttatgccatatatggcatattttgatacaggcatatgaataggtattaatcacatcagggcaaatgaaatatccatcaactccagcatttatcatttgtattacaaaccgattctacacttttagttactttaaaatgtacaagtaaattgctattgactatagggtcattttcatgggtataataaaaattatatacaagtataaataaaatcctgagtcttaaaattctgagtcctgcttaaacattttaaaaattttgttatgtatttttctttgaacatgtctctctgcctgcaaacataacagaattttagtattggtttacatagagttaactatacccatatattactctaaaaataaatgttaagtgcaagaaagttatggactgtttttgtgtgagtgtgagtttgtacctattttcaaaagaaaagagcaatattggagcaaaacaaatattttaataaagtaatgtactagacaactgaaaacttc

SEQ ID NO: 43 - DNA, 267 bp, Homo sapiens
gtcatttgtaaagcacgttaggtggttaaatcagttattgcggttttctcttactgcaagcctttttagtcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttaaaaaaaaaa

SEQ ID NO: 44 - DNA, 220963 bp, Homo sapiens
gtgcagttgagtcgcgagtacggctgagctgcgtaccggcctccctggctctcacactccctctctgctcccgctctcctaatctcctctggcatgcggtcagccccctgcccagggaccacaggagagttcttgtaaggactgttagtccctgcttacctgaaagccaagcgctctagcagagctttaaagttggagccgccaccctccctaccgccccatgccccttcaccccactccgaaattcaccgacctttgcatgcactgcctaaggatttcagagtgaggcaaagcagtcggcaaatctaccctggcttttcgtataaaaatcctctcgtctaggtaccctggctcactgaagactctgcagatatacccttataagagggagggtgggggagggaaaagaacgagagagggaggaaagaatgaaaaggagaggatgccaggaggtccgtgcttctgccaagagtcccaattagatgcgacggcttcagcctggtcaaggtgaaggaaagttgcttccgcgcctaggaagtgggtttgcctgataagagaaggaggaggggactcggctgggaagagctcccctcccctccgcggaagaccactgggtcccctctttccccaacctcctccctctcttctactccacccctccgttttcccactccccactgactcggatgcctggatgttctgccaccgggcagtggtccagcgtgcagccgggagggggcaggggcagggggcactgtgacaggaagctgcgcgcacaagttggccatttcgagggcaaaataagttctcccttggatttggaaaggacaaagccagtaagctacctcttttgtgtcggatgaggaggaccaaccatgagccagagcccgggtgcaggctcaccgccgccgctgccaccgcggtcagctccagttcctgccaggagttgtcggtgcgaggtaagggtcccagaggaggacgtgtccctctggagggcgcccagccagggcgcggaagctcgggtgccgcgtggggcaggcgcagccgggaaagttgaggtagagcatggaccagtccctacagtcctgactggagtgggaagggtggagggcagaggcgatgtgggtgtgcatgagtgagagtttgtgtgtgtgcgcccacgtctgtgtctgggaggagggagatttcagggcatagatctgcggccagggtgcgagaggtgaagggacgaactagcactcgcagaccccagagagaccagtctcatcagccaaccacctccatctcagctctgggctcagaatttgtttctatttgggggctccctaaggctttgtgcacaggaatccgtggatacgggcggtttcatgtgggtgtggaggttgcaggcagaggtgggcaacggtcagcgagacctggtccatgcagcccagataagctccgaagccggaggcggccagaggtttgccctcccgcaagcagggttggaaaggagccttaactcactgccctttgctccttttggcttgagtgaaaaatcgaaaagccagacagggagcatatcttttcatcgaccctgttccattttcttatctgacagtgagataactcagagagggcgggagatttgcgatccaaaaatagactaggtgatatatccaataagcttgtttcttaaggatttcatttaaatttctttctagttattccttgggttatcaaaggtggacaattctctaaggtacaacacttttaggtaaatatattaaggaaggattctcccactttaagtattttagatattgtaaattttgaaaaacaaaactatacacctctaaagatctttggttaaggactcaactaatttgcttataaaaatatttctactatttgaatagtaatagatatgtttggggtctatatgtaggtacatattggaatattcaaagttgaggttaatgtgagttgaggtaggtgtgagttaagtaccaacaatagttccttagagtttctttgcttgaatttcttagaactgtccagcacagctacagtatgtttctttgtggtgggcgggggggtgggggtgggggggtgggggggggtgggagggagtttagggggtggagtctgctttggtttatctgatcacacactttaagattcctctctgaattctaattgtttgcagaagtatattcaatataggcattactaaagtaatctagattgccactatgctaaactatggataacagttcctaacaaagatgcttaggacactctaatgaataaatatgattctatattcctacgtaccttgtttctaaaatcagcccaatagaatttgaatatatttggaagctattgtatgccagaaattattgtaatacttttcctttcacaatgggtagtgttttatatttacaaagatttcttacacctgtagactttagctgtcaatcttattgggttttgatcacccagcaggagtacatagatattttgaatatacatgcccaaaggctatcttatgttcagagtaacacaggagctcaggatggaaaatgaggaaaggaagtcttgaaacctataccttaacaaataaaacaatgaaattccagaatatctacctttattagatgaaaaagaatatggcaacaataccttttagcattgaaacccctcctgcccctagatactatatatctaggtataaaactgtggttttatgagttaggcccttaccagtgaaatgtgaaacctaaatcatagaaaattatgccagtacaatgaataggccacactttggagcttgaaacagatgtctttctatttatttaaattgaatggtatttttcaaacttcaggaatatatgatcagtaacaagaaaatgtgtggaaagccacacacacaaaaaaatcttataattaaaatatactctgtgacctacttatttttgcacaatgggctttttaaaaagttgtggtatacatgtgaaaaggagtataaatccgatgatttaacccacaactacacatatcaaaatgatgagctcatctttaattttatatcactgtaattaaaattggtaagttgaacaaatgcaaatataacgaaattgattgagctttatgtttaagttgaaattaatatttgtattgaataaaagaatggggataattgtcaaaagctcactgcttcacttctctatgacaggtgattagctggaatcacacaattgaagatgttcttattttgaaagattctcagcaataacattttacaacttccctgggtacattttcctcacttttatttcatgtcgaactatctttttgccaaataaaactgttgtctttcttgtccattcttctaatagtgatcagtcgcaaaatgaagcatgaggtttttccaggatactagctacctcctgccaaaatgtagcacattggcttgggggtgaattttccaattgttttcctgcactaaacatcatcccaatattctactaaacaaaagaaatgaaaatgaatacctaatcactattgtaaaacaaggagggcaggattcagttacgcacactggaatgtggccaaagttccagcgtgagacttgttttctccaggagtaattctcaaaaaaaggagtacgtgtttactcacagttgtctcactttgctattttaaactgagtttattgtgcattctcacatcttttgagactccactaaatggatccaatactgcattagatgaatttgttgaaattgctcccaaggaggagcataaaatgatagaagattatctaccaagtctgaacacataaaatgagtatcatcatagtaatcactgagacggcaaaaactattagctcatacccctccttctacttctaatgtaggcttggtccccatagcctactgtattttggagtacttcagtccagtctgactttaaatggatcacgtaatgacttcttccagagtctttgaaagactatttcagtctaatggttctccctattaagaactttgttgtgatattcagcttaattttctcctgattatattttatcttgttacttaattcctattataaaccttctggactagttcatcctcttgtctgattcagattcttcatccaacatttctctaggacttataaaatacaaaagcttcacacagttacaggagagaatacaaagatggcaattctatgtccagacatctttgctaaatgtttaagacattttttgcacacttatatatgtgtataactatatgttcctaataatttaatttactaatgtaagaattaagaaattaccttttctgatgttaatgacctatgtgaatattaaggtggtactttctgaggaatgttctatgtggatgcacattatgagacattttcattgcaaatttgtttgcaacagaaccctgtcaacgcccacactacaagggaattttgtgacatgctggtctgatgctcctctgagccccagaagctgttgtcatgtaaattccactattgaaatgaaagtgatgtccataattaatagaatgtgctaggaatgtaatagtgtatatagtttagatgtgtatgttaacaaaacatagtaattctgttaggattggcagtagcccctttatactgaaacaatctaaaaaacccagtggaattaaggccaaattattcaccgtgctgcattatgaaaagtaagcttacatcatgcatatatcaatgtggaatgtatttcgatatatatggaggtaccatatgtgaaggttactttaaaaatagaaaagcctgaaaaaaaaaacataaaaaaacaggttttcactttgttcacttgaaatcttgttccaagacatccgtgtgtaggcttctttaagattcttaagcaaatatcttggtagactcaccatcccactcaattgtttctccaagttccaggcattgaaatacaagttctgctagacagtagaggagtaaatgatataaatcaggaaataagttcctaggttacacttagcaagtcaagaaaatataaaaccagagggaggtgaatcagcatctaaaaacaccatttagtgctatcttactgcttgttaagcattcgacggtacatggaaacactcacgtggattaggttaagaaatcaaggaggagacatctttccaaaacttatttttaaacaaataaaattagactgcacgaaataatttttaaacaagtactctccctcctgaggtcccaaagtatttttatagtgctattcatcacatagtggtgagcaccctccaaatgattttccttagaaacaaaaggaaaatcaattttcttggtatagaaaatgtaggccattaatatacctatagcttctctctggaacagcaaggcatccaaagaatctgtgcctacacagagtaagtatttcttcatcatattgaacaatctttttattgaactggaaattgtacactgtactttaaggagagaaataaacttggaaaacattctgatataatctacgtaggcatagattaaggcaccagtttgaaaataaagccatatatagagaaggcacctccacaaaaagcccaaagtaactctgatctttaatttcttatcagaatttacttcactacttcactatcattgactgtataactacacacacacatatttgagtaaattcagttgaaagggtatagatatctaaacagattaaaaaaaatcaaaaccatgatgctagatacatagtttgaaaaaaacttacaacctatatatgtagcatgggaatattaggagtataaaatttgagaagattcctctaagaaagagtctatcatcagaaagaaaaggtagctaatagggaaacaattagtcaataaatatttattaagtacctattttgaccaaaacaaaatataggacatgcattgggaacacaaaaaaatgttcacacacaaagtttcacaaacatgtgtaaagttgaaagtgctgcaaaaatcaaacttgaaatttgagagtagagaaaatgttaccagaattatcaaccaaatgaaaaagtctgttccttaacagatgcattcatatttaggattttaaatgtgtgtatatattctgatgccttgtggagacagtgttgtatgctgtgaggtgacaaaactaataataagtcaaaataataggtgataattattaaccaacttccctgtgtgaagaactctgctatacaagaactatacagtacctgtgaagtaggtactgggatcctcattttatacagaagaggagatggaggcccagcaagataaagtaacttgcccaagttcaggtagttaacaaggctgcaactggaattcaaaacctactttcttattctaagacctattttctttactaccaatattgcctcacaattttttaatttatttatttattttaattaatttatttattttaccaggcttcattgcattcaacaagtgttttctgagctccaagtagagggacatgctttggtaaggagggcaaacaataatcaatgaaagggagtctagaatagacttccccaggctcaagatctttctccactccagacactgtcccttctgagaggcagagacatgcaaatggaagaagtaagctaaaacattatttataattgactaggactaaggatgaaattctaaaatagaaaagtctatgaagattataaatgaacaagctgagaaataaacaccaggtctgaaagtgtgaggaaaatatatttcttggagtctgatttcaatgaccattatcatctgtaaaacttagtacagtggcaagaatatagtctcacaaaaagccaggatagaggtgagtaggatttctgctgaggctaaaatgctgatgtttctctcctcttacaacctacctacttcccaccaggaaaacaagctggtaaaaaagttttgtagtatagtaaaattttcaaatttctttaccctgctgaagtagtaatggttcatctttatgttagaaaactctcagcattttacacatcgggacatttatccataatatatacaacagcatgaaactggaagggatcagggattatgaattttaaacacactaagaataggagatgcaaagtgacctgctggagattccaaagactgttggtagtgctgctccaggaaaacccacatctcattattctctgacctcagtgccttcccacagacaggaaacctgctgtcttaattgcatgagcttatacttcttttcacacttcttttcacacaaccaaagggctgaaacaaatctttacttgagggtctttctctgatttgtgatatgtgctagagtaattaatggacataaaaaaggaacagatatcacagatcgcccctccatctggtggaggctgtttcttttgattgttaataatagatagcagatagattattagtaatatttgcttaacagtttcaatgaaccatgtcttggtgaatacaacataatggaagctgcttttacaaaatatgtcagaatacatgccaatctgagagatggcactacaaggtcaaaaacgttggaatttatatctgcctcaaggagaaaaggatatctagagagtataattaactttctactttggaacatcttgtttttcctgaaaaagcagagaccctctacatgcttatgcattaatcccagtgatttctgtggaatccacatatatggactggtgaccagtccatactatattggtcactactacactggtagccagaccatacctaacttcaaaattgattagtagacaagacatgaacttagatgtctaacaaatctcttccatagattttgttcaagacgtccccttgaaaaaaatgttttgaggaatgccaaaagtcccacttcccccaacacccaaaatatatttttcactaccttccttggttcataaaattttccaaattttaaactgaagtatttcatccaagaagtactaaagaacatatagttctagaaccacataacgtactaaccctccaacacattctgaatttataggctcatttttcagaaaaggtaactttaccagtttagtagggagtaggtagaatgaacaattaatttattgaatttttacgtacttcacgaccttgtctaagacaagcccttccttggctatggtttcctaaacactcataatgcagtaatttgaaaggaaacaagccttctcttagttgttgaacaaatgaagccctggtaggaaaaagattgaggtgttagagtgctcaccctctactttttttttcttcttctaaggtcctaaatttgtgtttgttgctatgtgatataacaagacaggaaggaagataatttttgtttgttttttgtttttgttttgttgttgttgttctttttttgagatggattctagctctgttgcccaggctggagtgcagtgacgcaatctcggctcactgcaacttccgcctcccggattcaagcgattttcctgcctcagcctcccaagtagctgggattacagccgcccgccaccacgcccaactaatttttgtatttttagtagagatggggtttcaccgtgtttgctaggctggtcttgaactcctgacctcatgatcctcccaccttggcctcgaaaagtgctggggttacaagcatgaaccatggtgcccggccagtagccgatagtattaggtccacttctcatatggaaaatgctggaacatttgaagtaggaaagggtaagaaaattgaaaaacgaagaatagttaacctctccctttcctttatactcccccatgtattgaacaacaacaacaaaaatcatctatttacctctgctgtaaatagtctgtgaaattattgcccagagagcctgcattagaatcactttgaagtttacttaaaatgaagaatgctgggacacatgcatcccaggctaattgaaacgaatgtcatatagattgaagttttggaatctgcatagtaagtaaacttctgattattcttgggatttgagaaacattgttgtcttagtctgctcagactgctataatgaaataccatagaccaggtagcttaaacaacaaacatttatttttcacagttgcagatgttgcgaagtccatgattaagattatagcagattcagttcctggtgagagtcctcttcccaagccacttttttactctgtgctcccatagctgggaggaagaggaggtgctctgggctctcctcctcttataaatacatgaattccaccatgagggccaaactctgatggccttttgtaaacctgatcatctcccaaaggccctgttagtaaacgcaatcacatcgggagctagggcttcagcatgtgaattttggagcaacacaaatattcggtccataacaattacatgtagaatgatggtcatacacagaatatccagtgaatttcttttaccaaattactttccacagcaagttcattctaattggattaaccagttgtataaagtacattctacaagcctgagtactaattaagctcaactaataaggcacagtttctataagttgtatgaatagattttctagaaatgtcctattatcttcgttgtaaaggaagttttcctgttacctatagtaagttcccatgagatatgcaaacacatataataatacacatcttttggatattcttattcggagacttcctcatttttaatcttttatcctgtattttatcattatattaatattaatatattagaaagagaagttactggtatttgaagaagttactgatattcttattagaaaaccttctcacttttaatattttatcctatattttatcattaatattaatatattagaaagataagttactagtgtttgaagattatcattaatgaaaagattatttcttagaaactctcctcgatttgaataactgcactcttaaaattcaaattgtctttatagttatgcccttatgagctaggggatgtgggaaaacttctgtcacaactctccccactgccctctagatctgcagcgtgggggcaggggaaggacctcatttggcaacttacacattcttcactcagcgtccacttcgttcaagtgaatggttgcttagctaaagccggcaatcctcacaaatactgccaaagatagtttcctaagcagcgttcagagccacatgggaaaaatgccgaacaggaagtgagggactggcagcagggagggggaggctcagcctgggccaccagctttacctcccaggggttttgtgctccctctttgccttcactggaatgctacacttagtagctgacttcatgaagagaaaagcaataaaaaacagagcacacccccactctcccaaatattttaatggtttgaattttttaagactcaggaatctcagagacaaaactgttaaactgttgaaagttacaccgtgtctcagcagagcctggctttcttgaccgttctgatggttacagtacttctacctgatgatgtcacttctactggactgtcccactcacacagcagtctctacgtatctaaagccaaaagcccactgcctcccccaactagcaacttattttctgattctaagagaaacatgattatttctccatacaatcattcaaaattgtggaactgcccatgacatttttcttctgtttagtcctctgttgattccttcctaaatgatatggcaacttctttattctcctaccactgacaaaaccttagcccaggttatcatcactgtcctctcaatctttaaccatttatctccttcgttctctctctccttatacaattacttattcatcagaaatttaatgagtgcctactgtgtgttcagtcactgttctagagatattatagcatgaacaataatgtagaaattttttttatattcagcttacactaaatagacaataaacaagagaacaaatacagtgtgaagaaaatagaatgagggatgtacaaaagtgagagaagctggaaaaggaagtattgccaccagattaaacttgatgaataactggtttttccaggtgttaaaagcattaaatataaatatcacttaaatgtaacttcccagcgtggccattaagcattttacaatcaggtccctggtgtatctttccaatctgtcatcctcaacatgaatatctagtctacccagacctttctgtttgcaccaaatacacacctgagtgtctttgtagtatgatttcatttagaatgtgttttcttcctcctttctccaaacctatatttaagtccaacttcaaagttctgcttaatctaagttcatactaatgattttttatctgttttaccaaagaaatttttattcaaaacatccatgtggtccttactgtaggtaggcctgattactaaaatattgctttggcataagtaacaggtaggtagatcagtaaattgtggaataaaataaaaaagcaaatttatttttatttctcactgcccctttaaaaggtattcagtaaaatatattacatttgtgtaataaaacaacaaaccctaacttgcaaacagtctcaattcaaaaattagtatgcctagaccaatacaataattgaaactttgagcgctaaagttgaatcttttctctatccccagcaggagcctctttcaagtaagaagctgaaaaagtaagcttaaaagtcttatgggtttcatccacccttctttgtcactcttactaactcaagttctgaatcctccaaagttaggggtggaaggtaggcgaaaacaagatggttataggaaaaaagttcctacctgacaaacttcacactagaccccaagatttttaaggctaactctgtgtgtgtgtgtgtgtgtgtgtgtgtgtgtgggtgggtgggtgtgtgtgtatgtgtgtttacttctctcactattgctgagggtctctcacctcagtttcctcgacacaaattttctttcatctgaccatacctcctccgttcctgctctttcagcagctcactgcaacagactcttactttgagattcccatttcccttccaggcctttcaattggtttgattcctttcagtagtgactgaccttcagtccacaggaaacagtgacataatattacaggaaaaaattcttagcatgtgggccagtccaatgcagcaatctctcttcttcacttctccactgccaaagcatcaaagatttagctggtccttctctcatccttcattatttcctagcctggagtaaggcccaacccattttgtgacactatactatgttctttttttttttttttttttttttgagacagagtcttgctgtgttgcccaggctggagtgcagtggcacgatctcagctcagtgctgcaacctctgcctcccgggttcaagcaattctcatggctcagcctcctgagtaattcaaattacaggcatgcaccgccacggctggctagtttttgtatttttagtagagatggagtttcaccatgttggccaggctggtctcaaattcctggtttcaggtgatccacctgccttggcctcccaaagtgctgggataacagctaccttgactgggctttgtgatgctatattctttggtatacataattatttccaatttttgtgaacatatttggactacaggacatatgaaatgtaatacgctcacttgcttagatacctgttgttttctacttgactaacacccagatttagcaaagtacctagtttctaatatatttactcattgaatgtatgagtgtaataatacagcttaagtttaaaaaattactttttataaccaagaaaaatgtttctatagggggctacctgtataaagacttataggaatcaatgtctacaaaataatataagatgtggctaaaacatttgctggtttttctgactagaattagctcccaacgaataaagatcttgtctgtcgtttttagcagagtctataataatgcatataataatgcatatttaacacatatttaatgagaaaacataaattatcatgttaatatcttccattaatatgttgtactttaggaattgtgataatcttaattttaatccataaatggtgctattcttctgaaggcattttcgatctcaaatagaataactttatataaaagtttaaaaatttagctttaaaaagtgacatcaacctaatgacataaatctttaatgagcatctgctactttcaaggcactgggcaaggtactgaggaggacaaagaaaagaataaaacactttgcctgcccttagaatgtaaaatcttataggagagatgagatatgtgcatgtgtacctacagtaacaagaaaattcaggagcttggctgtgagacccctaagtggataataatatttctgtttgacataactgtagaaggtataatgaaaaatttacttctgtcctgggctctaaaaaattaggatttcaggaagtggaggatttcattctagacctatgcaaaagcagagagctagaatgtgggattgaattgtggagcatcatgtaatctagcttagtttaaggttagagtgtatgggggtcagggcagaagataaagctctcagagcagataaaatgatggctaacatttctcctgtaggcagaggaaaatctctgaagacacttgagcaggggaatctgaaagcacaatgtgaagataaataggaggaaataaaggtttgggaggcagagagatgagttggcaggttatggcaacagtccaggtgagaggtaatgatggcctaaactagggcagtggcaatgggaataagacacatggaatgaatctaaaagacataaagatgaatagtgcctggtaggtaggaattagcttctgggcaaaaaaataccagccaaaacaattaagctaatcactttccttcttctacaatagaaaagagcatgctgcataaaatccttagtttaataatggaaaatgtgggagttgtctttcttttaagctatttttcatgaatttgggttacaggaaaatgtaacaatcaaaattctaactctctgaaaataagacttacaaaacaaatcaatattttctatgtggctattatttgattgcatttatctgtagatgggaggttaagccaacatagtctctctccagggctctgcaagagccacctactggcttccttgaccttcgtcttatacccacctctaagttcatccacatggctacagccaaaattatctttaagaaatacaaatctaagcatgtcatccttgcttaaaactctccaaagattttttctttgctcttgctataattgagacatggtttacctggcccacagtgatctgcatgtgtgtcgagattcatgtctcatccctttgcccttacacttgttgttccatccttccctctcactccccaggccttcccacaggctgtgaaacttcctagtgcactggtccactccaaccccttcagggctcagtttaaattctatactacttctgaccttctatagtaggttggttcttcttgctatgtactccccaaactctctgtattttccttcatcacactttattataattgtctctctccccactgtagtctataagggggctaaaaagacagaagtcatgcctgctcacttacaggtgtatattacccagcaaagtaagtactgcatacagaaaatcaatagctttttatggggtaaattgaacaggggttaattaactcactctggagcaaattttcctcatctttaaaactggggtattgtgttttatattccttttagccatatatttttataagtaaacttaaagataaaattcagcatcccaagtcagagtcagtaccctgttatactaaaaaaaaaaaaaagtaattaggtcttatttatacatttaaattgctgtttaatagcaaggttattaataatgttagaaatgtgttttgttattcctcaacctgtccgcattttgaaaacattttatctgttcatcttaagccatgtggtatgagtaacaggaaataaacataaccataaaaacggagttgagtaaatgccccaagaaagtcaacattgaggcagattttgtcctttctgaattctgataaaagcacatttcagacattttcatagaagacgattcttgaatcccatttgttaatactaattcctactagtgccaataaataacaccccaaggtattccattaaatgcagtttgtggcaatatttctcaaaatgaatgcggttaacacacatcctctacaccatttttagaagaatgagaagatattgtgaataacaataatttttattgaatgtttacatatgccaggcaccgttccttttgctttatctatgttaactcatttaatcttcatggtagccctatgaggattatgctattatgatccctattttatggaagaggaaagtgaagtactaacacaaggtaacatagtaagaggatagctaggatttagatctggcatttggctccagagcttacgaatttgaccagttgaatatattgcttctctcaggaaagcatcccaaaactgaaatgtaaactatgcaaaaaacagttggaataactgtctcatattccttgatttgaaaatgagaaacatgttaataaagtgacattgagctcttttttagaaatggaagttagtagtatagtcaaatattgtataggtttttgagcagagtgtatctaattacttatgcttcttattttaacataaaatcctctcatttcaatagctggaaagtcagctgtcatgataataattacattttaaagctttatttctttacaaactatttgttcttttgatctccagaatttgtccagtgcttgaagatattttaatcttcacattaaaagagaagagggtgaatttgaagcaaaaaaacaacaaaaaatcacttttcccagaaacaaaaagtctcagattcctttgtgtaaaacaaaaatgattgacacgttggtgaaaatcattggtcaggaaagaaaactgtcctactttattcttttacctgtccatctagctatcagaatagtatatttgcgtgtagctaatccttgaattgatttattaagctatgtttacaagttagaaagaaagaggtcctgaggagataattacaggaatacaaatcagaagagacaactttgaaagaatagtaattttgcttcttgaaactgaccttaaatccctaggaggagaacagaacagcttaaagcaaccttttctctctattcagaaatgattgcgaattaattgtgcagtttagctgaactttgcctttccttgtatcctaggagaagagctctaatagactgggaatttttgcttgtttgtaatgtaaactcaatatctagagatagttcttaacaccacatgggctcattggaaaactctaattcccaaaacaaacaaagaggaaaaggttagcaaaataatccaccagcaaaaggaaaacaaaaaacagaatgcttgataatctttattttgataatttggttttaaataatcctaaagaaagatccctggtgacatcagaattctgactgcaatatccaaacttgctcatccatgaagatgtataaggcttgtgggttacatggattcattagttgataaaaagcacttagtaaaaattatatctattttgaatatcaactaggctatgcagttctagcaaagaggaggtttaagcatttgaagattaatcatgatgctaagtattaattttgatagtaaaaattaaagcatactcaaattggatatccccatacacatatatactatttcagttagctagttaatgttgacttcttgatcttaattccaatagcttcctttatttagccatgccatttttgattcattcatccaacaggtgttaattgagcacacatattaaatttggtattagctagacactgagtatagaatggcaagcagaaagccaacaacaaatgaaaaataattcctgtcctcaaagatctttctttacaattttaaaactacatttgaagattagaaaatggagtataaacagcatcatggtctcttatctaatgtttcaggcaaaaatcagtcaataaagtctataggagaatgggcttccttggcttccctgagaccatggacagaggcctaagaatcaccccgaacaaagtactctttctattctcttagtaactagatttgcttaatgctttttgaaagaaaaatatgatgcaatgtatgacacaatcatgattatttagggaatgcactgggagtaggctacttaatatcttcacacatgtaaaaatgtcttcatttactttaacttagtgtactttggtacatccatcgatccttcccagaaacttttactaagcactttttgttatgttgggccctgcggtaggtgctggggatctgtcaatctgtagctaatagttctgttgtacagaagtcacagaaaataagcgaggtatagtgtttaacttattaatgatcctgtgcttgggatttttaaaaatttacaaagtactcaatggaatgtagacttcaagaatcacaacttcagtgttcttttcctaaggttagaaaaatatataattaaagaagcaaagcattcttggataatttttagaagaaaaaattactctgaatcaaatgacactggaaaatgtagatgggaccaattcaatttttacagaataaaaaacattttttcctgccaatgttgttctgaagttaattgcaagatgtgttttttaaatgacttatcaaaaaacatgaaaccaatcaataagtcaaacaaggctagaaaccaacattagctagtaaattgatttactatttattataattcctccataaagcataataggcactttactttcacagtttaatgcttctgtaattgagatataattcaatttatttgcacatcttatataataatattttttcccaaaaacctactcatatttatggtgaatcttaaaatgaatggtatcagggttaaaaaaatattagttgcaagcacacaaactgcctatcttattaactatgtattccaaaaataattgcaaatgtcttaaccaaatttactattaaatgcttctttttttgctacaaatggaaagaaaaactctatttcatgtatttttttaagttcaaaatcacatgctttgaaaacacctcattaacagaaccacaaattatctttcagtattttcattatccctgcttgaaaataagaatggtatcttattaacctctgtacatttactgcaagaaaagccatgtcctggtcatttctttatcactgaaatctataacagtgccttaaaaataatgactgttgaataagtaagtaaaataatggaagaaggaatgaaggaataaagaccttggacacaatgaaccctcaataaatatttattagattataatgagcagggcatattaccatatttcagtgataaaattttaatatacttctatagtgtttgcctttgtatcaccaagaggaaattaatagattttactgataataaattattttaatatttggttttatgtatatctaaggtctgtatatttataagagtcttataatgtcagtcatcggctcaaacatttttctcatgtaaccaaatattttcatgatattgcctgtaatatatctccttaatacttaacttttagaaatcaatttctgaagctatgaatttcatatgaaacacaaccttctttagtaatttgtccaaacatgtttgaacttttgtgtatccatgtctttattctttagcatcagcatacctaaccccaaatactgatgagagccaccaaatgtagtatgaatttttaaaatgaacttctccatttagatttttttttgctatagcttcttatttctcttgtagtcttttctctaatgagttaaagcagcacattaaatttaaaaaaactgccccaaatttgaggccagtataaagaaatatatcttaatacaattgatgaatatgaaactttttttgcaaatccttaatgaccttttactagaaattcaaaattatttataaactattatctagtaacagagaccattttactagatctctcagggtatacatgagaatagagaatctcaagctgagccctagggtacttctacttatagttacacctagaagttacagtccaaagaaacagcagtggccaatgaggtaaggggtaggccaagagaaagtggtatcatgcaaataaagggaagaaggttttcccagaacaaggcagtggtgaactctactgatgctgctggagggcaagttagataagaaaattgatgatatcaggcatttagaatcttgattccaaaatctgaggtgatcaatgtgtttagcatcttgtaagccattggaagttgctatggagtaaggagacaagctgtttggaggtaactgagaaaacgggattctaagtagaaatagtgagtactaatttgtgtagttttgcactaattgtggcaagccaatggattctgcaggaaaacttgggtcaaaagagaatttataaatatttattaaattcaactgaattatgtcttttttttgttgttgttggagatgagattgaagaagtagtcttgggggcagatcagaaggctttagatacatcgttaagaagtttgtaagattttaggctcagagcaatggtaagccatttaagcccctgcccatgtggagctcatcatcttgtgagggagacagaataatcatatgtctcaaagaaatattaaattgaacttatacatactaaaattaagagataatgttgtgagaacataaaataaggagtttgatatcagtgacatcaggttttcatgggaaaaatgacaactaaaggatgagtagagttaactaagtgaagagaaagaaatcaagctgtattcagtgacatgagcacagatactgtgaaaggagagataatggcacctatgagcaactgaaaggtcaatgtggcttggaaccttgagaacagagagcagcactatattatgttgagggttgttcttatccaagaacaacagaaaatcattttagtacttaaagtagaaataagagcatccataatttttcttttttttaaaaaagaccctcactggaatgtggagaatgatgggggttgaggggtcagaatggaacaggtagaccagttatgggattttttttattgtctacagaagatggtagcttagacaaagatggtagacattgaaataacaggtgaataaagaaaaattttagtagttaaaaattgcaatgacttggtggtatatcggttaggaatattagataccatcttgatgtgtttacagttgttcaggacatatataatgaatcagttgagcactcaataataagcatttattttgagtgcctactattatgtcaatatatccttccttttaggggaagctcaaaattatttatgtgttagaagtaaagatcagattctagacattgtttatctcaattgtttttgacacactaagaaaaacaagccagtgttgatgaatttctattgtatcctagggattttgtaacaaagaatccattcagaagctacactaggctcatccaaaagagatgacagaattttctctacccagtacagcttgcacaaggctggtgcaagcagatgatggttacgtttggctgagaagctcatagagggtgattcaccaacacaactgcaagattcaactgcatacccacctcctcttgacacatgtgtgctagtaaacccaaagtcacacataccattaatttcactcttaattaaacctcccaggcctaaggggtagtgacagccttaaacttgggaagttctggccagcattattcaaataccagagaggagattgcttttaagatattataaacatgagctttcttatttctttttctcaattctgagaaggatagctaagataaattttagtcttgcaatacaataattttattctagctatcattattgattgtagtagctgtgaaagtctgcttagagagatacagtttctattagtcaaactattacctgctacatgaagaaatctattcttttcgttccgttttattccactgttaccaaattgaatatatttgagaaagaaaatgaggtaaagtaaatgaacatcgcatgtgctctgggagaacgtgttatgaatctcaattctatcacttataagctatcctatcctgaaagtcatattaaatttctccagacttcaatatactatctacctcacaatgttgctcacatgaaaatataagtataaaaatatatttgtaatatgaactatagaagtaccgactaggctctggcacttgataggtgcttattaaatataaactgatttctaccaatgctaaaccaaatgtgcacctagagtaacatccactggcataaatttctttttctttgccctagtagtaacaatatcttactatcaatcacactaattcaactctttcataatcccgtctgcatgttaattaaaatacatccattaatcaaatgctttctacttatttttatggaattttccttctagatcctgccatgcatattatagtcttctctataaaccatatgttatacttcttctgtttatgaagattctatgtgtgatctaaaagtaagaaaatgagaattttatataaattatcatgcgttataaggaagccaaataatgcagaaaatttcctggcttcttttatgctgaactgttgtagctttaataacttctgcactgcagtgattatgaaactaaagcatatttttaaatgttaactcagagtgtcagacgtttacttacattaggcaaaatcttaggaagaacaagttttaggactacacaataatgtgggctgttagacacattttctgtcattcacattttgtgaatattcttaccctctaatcatttttatctaaattatattgtaatcataactttctgagagtcatgaagttagaaataagatgttaatcttaattacaggagcaagttgaaatgtattttaacaaaagcatgagttattgaaagtcaaataatcctttagaggttttaagcttcacttaataagcagaagaacctaggataaaatttttggaataacccattttatagagggaaacaatgttgtatctcactacagaaaatgacctgattagcttcccttttctcaatattaacttcggaaaatagcttacttacagaagcaaatggaatgatacttcaagaagccatgttgccttttcaacagccaaaaacttgacttcatctacaaaccatcacctttttcaggattaacatacttaaccttaaaggtaacatagtcttttagaactaatatgtggaatcatgaatatgtttatggtattttatcaactaaaagctaagtgatgttatgtaagggatttttatatttaaaagtagctatccctctctggaagttacatgaaacagaacttgatcttttaaagccagatgttttttgttattgtttatttgttttcattattcagattctccaaatagctcttcaagtttcagaacgcttttttttctaatgaattctaggatccaaactagctatttttttaatgagaaaattgacttgtttatgaagcacatcttactaaaaagatagattgaggcactgatgagcttaatgatattttgtttggacaaattaggaaactaattcgagatgcaacccctggtgagcaggttcttacctgttctcatgacttctgtttatcccatatggatacctgttcctggcaagttatccagttagtgaatttcttgccaaaatttacatcagatattttgttgtataacttaactacccagaataaatctttgacgctaaggttgtcataggcgactatgaaataatatgagtgggaacatttatataaagcatatttctttctggaagtttgatctcattttcaagctcagtacctctgacaggaaggaggcagcaggaagcaacttatcaaatcaaagacttgtggatcttctctattgcaaatatcaaaatccctgaaaattattttgtaaaatgactgatgttctacatataccaggtaactaacaatgcagtacttgcacatctgacctaaatagtagagttgcctgactggcccagattgttgcagaattaagggcatagaatagtggatgattcaaccaggtccctaaagcagagagaagggaaatacctgtggcttaagatatataatattatgtattgattgctttgcttttagttaagaaataccagtgtatatcacagtaagaatctcaatttatcctttaggattgttttttagttctgcatttttctgattttatcaagtagaggtaggctattacaataaacactaagcaaagcttttactcatattatctctctatgtgactaagttttcaacatagtcacagcatcatattccagctactcttgggaagaatgggggttcacactgcattattttgctctcaagatattccctggagtggggatggacagcaaaggtaaaactgagtatgctctagcaatagagcataatagggctaacaatcattcttgtgcattggccccaatcttttatattagtcacctctgcccaggcccaccctccaggaaattttgaagaaacatttcggcccttctaacggtgtactcttgagaaatgctggctggtgcacaaaggcacaaaatcctgtaataccaactagcatgtcttttgggttgcaagccaatacaattacctaccaaaccttctagtcactttcacccactcaatgaacagaaggctctttaagcagacaccggagggagccaaactgttgacttaaagggagattttgggtagctaatcaaagctctctcctgctctccttcctacccacttccaccccagtctcctgcaagtctgaccccgtttggtgggaaacttttgtccagtttatggatatgaattaaaagtgatttcattagattcttaactcaggtgtgcctaatcttgttgctctgttttgtgtatcttcattatttcaattgttgctatgctagtaagagtagcatgttataatatactgtttcagatattctccttagcctgccgtgcttccttaggattcttctggtttccaaggaacaggtgaaatgtcaaaattttttttttttgttatttaggccatcattatgaacaaatttaggtaatcaagtctatattcacatgaaaatgtacatacattcactcacttgcaggctaaatagctactagggaaataattcttctttcattcacattggctttaaagtgatttaaattaattctaaccaccccctctatccaccccattggactgatttaacaccctttgatcgtgttgtttgggcttttctctcacatgctaatgaggcattctcttcagctaccacaacttcatataatccttgggcaattctcacactttctaatgaccccgtctttagagggcagagaaacttggagggaaggaggagaagaggaaagtgaattactgcctaatatagacttaccctgcaaatatattccgaaaatagaattgtggctgactgctcctaccctggaagattaactgtcattgaggaagaggctcattcccacctgccatgcatagactgtctacccaaccaaaagcaaactattgtcgttttccctgcagtttggttgatcatcaggtggtgattttagaaatgggaggaagtatatcttctgggaaccttgctttatccttagatttcccttgagcgtgaaatttacaaatgtccagagaataagctcctgctagggtttgctttctcataactgtgggtgaaaagcctggattaagctggttaaaaggataaataaatggaaagttcctgtcttactatcccaagatagtaagtatttctccatggagtcatctaagactcaagactttagctggtgaccatgtcttcctcaagcaacctacagaaaataactagatggaatatgtaatcaaatcgaagcccaaagtgaatgtgctgaaacagtggttctctacattggctgcacataacatcacctttaaaaactttccatgcccacacctcaccccactccaattaaatcagaatcactagggctggggcccagtcatcagtatttttcaaatcttctcacatgattccaggggacagccaattgagaaacactacactaagaactagggaaagaacaggtgttaaaaactctgaaacaacaatagttagcttctgctatcaagagcgcctctgctcagacatgtccataatcatgtctctttttctgtgacaagatttcagccagatttaagactggaaaatcttcacatttttctactcttcacacagtactgtttttcaatgttttcctatatctcacaagtagatccttttaagacttagctgtgagttcctgtcttcattgtagaagtattattttgttttccaaaagtgcaaccatagttggtagtaacgttgaatgtggaaacaataactgacatttcacaacaagtattttctcttatatattttgttccattccaagtccttctcttctgtctaaaaacatgcccaatattttaattatataaaaaaatcttcctcaaactgcatattccttcaaatccctgctctcttcttacctttatgattaagcttaagaacagaatacacttagtctctcaatgaagtatctcaacttagtctcacaatctatttactccttaactcactctgtagtttcatttctgtccccaccacactactgaatattttcctagtcctagatcagcaacacattccaaatctagtgatcaccaaatccaacaacttctcctcagttctcagacacttgaaacactctgtagctctaaatatttcaaagcatcttctaaagcaccctcattaccctggtttgttttctatcactgtgtcatcttttcctaattctgtttccttaatgtaagtattttacaatgttcttttgtcagctctcttttcttttgataccaagatattttaaactaaggcctacaaaaatttgtgcctgtgtgtttgcacatttttctggcaaggaaatacatagctctcatcatattcacaaaagagttcataactcaaatagggtaaagaactcaagataaactcagtcaggaatctttcctactcatgtggctccatctatcaacatctaagcaggtaactgctagtgctctacctctaatcatgttcccaaattccaagttcacatttccaaatgcctgtcaatttctcgtgtcttttaatgggactctcattttcttatacatccaggaacatgaccttggaaagccaaaagaatttctgcctgcatatcttgagtccacaaatccaattggttccatttccaaatggcattttgaatccactcctcttttcaatcctcatattcaccatcttgctttagaacttgatttcttcttgactgttgtattactagagtctgactgatttccttttgtgtttttcatcttaatcgtcttgtacatatcaatcagatcaatcttcctaggcttccactctaattttgtttttcccctgcttaaaaccttcatagttgccaatttattattcaggcttttaagttccttcactgggtggctctaatttacattttcatgctcatcttctaatttccttacacattctctaaactgaaagctggacaactctctattctcagaagatatactgtgttttcttgacctttagatgttgtttatattacgtccaagacaaggtatactctctcccatcaattccttcaaaaatcctacttgtccttgaaggtttatctcaaatgtagctttcatgaaatatgtttgaactactaactgaaatatgaaacacatttttgttttggagacagtctcattctgtctcccaggctggagtgcaacggcacgatctccgctcactgcaacctctgcctcccaggttcaagtgactctcttgcctcagcctcctgagcaactggcactacaggtgccttcctccatgcccacctaatccaagataagttttttgttttccccagtttcatagatgtgcccttccatatatttctgcaaccattttaatagcacctacttacttcagtgtatggtaattatgtaatctccatgtatgactctaatatggtttagatgtttgtcctgtcagatttttaatattcaagggtaaataactgttctgtttcattctttatgtcctgaagttagcacatctagcacatagtaaaagcacaatgttgaatgtctctcaatgattttatttaccaaattctgtgcccatattttgtttccagtaaaatgcatatgtattcccaacaagctactcatgagtaggctccatcttactcaccacctatctattaatatctactgaaatgaattatttcaagttatttgagaaaacttaggatgtgtcaacattggaaattgctttaatctagaggtctgaccacaacctccagtgcttttgattatctcactttctgcttctcatgtcaactgctcatcaactacctgggcattccaacccttgattcaattctctcagataattagtcctgctttgacctcacttcatttgattctttactcaatctaaattttatcctgaattatctgaaccatacttctactgggacccttaattccccagtctccttatccatttactgaccttgaaattaaaaaggtccattggacatccagtcagtgtagcactactggaaaccaaccagccataaaaaagcccacattattctttattaaacaggttcgactcaagaagaaactataattttcctgttgctgccacttctctgggggttttatttttattgtttcttccactgttttatttttttccactcctggataaaaactcagccaggtcacataaattaaatcaatcttaggtgataaaaagtctactccattctaaagagtatccagtctagtgtagtgggaaatcagttaggcaaatgtaaagtttttttgtttttgtttttttccagctcaggattgttgactcttaggaagcctgtagtggagaagggattaaaactagcatcttatcttttcctactttgccttatcctctattccacagatactgccttggcccctccacaattgggataaggtagggaatattgagaaaagagataaatgggcaataaaagtctatcttgtcaggcacagttgtgacattccctcagttccttctgtgcataatatatatccaaaggtgacttatggggcacgtttatattgtcttcttgcctagcttcccctctctttgcaataagggcatctatagttttctagatttagcagtgcctttcctccagatacgacctcatctcaagtggttgcctggggcagggtttttttgtttttgtttttgttttttttttcaggagaccatggctggctcccttgtgggggaacacatccggtgtgtgtgaaacacacctttacccccagtggtagatgcaactagctctcaaagcatcacattgtcttgttctgccagctccagccagaaccttagcttttaaccatgtcccctaaactttagaagactcatgtcaagctttccatgtagttttcacaaatgcttttctctgactttgctaaaaatgcacaaaagcatcccctcccctctctatgagtgtgtggaaagtggtgaacatatagaaaaccaatactctctgaaagagtacctcttattcagtatcttttagatcaatattgactcctctctatacccaaaaaaggtaatgaactaaggttgcaaaacaaactttaaaatctttcagtatgtcttacatagataagctgttatctatgggattgttatcaggtttagggctccaggtgatctggaacagaaagattccccaggtatatatattatcatatttccatattggtatcacttacatcaaaggcatgactgagcactcagcacaacctatccattccctaattgtccttgcttactttgttcctcattctccccttacagctaaagactttcctctctactcaactggcatcatccttatttgtgggggaagtaagtgtagcaagacatctttcctcctgttacttcatctggaaaactagtaactatcgagaatgattcctctcaattatccaattatctatccacttcaaaactcaccagaacacccattctttcctccttcttaccggtgtcagagaatgcagtttcctatctaatgcctaaaaccaagccttctgtctacattttcaagtttctctcactacctcttctggtttccttcatatcttcctgcaatatcctgtttatgccaactgcttccagattgcttcctcagacaactgcttttctcactctatattctttccctaaatgacatatatgtttattatttcaactacctcctctatgctgatgattccttaatccctatctcctcattggtacatctattcaagacatttcacctggacatctcagacaattcaaactggatctcccaaactgaatccattctctctctaatacgctcctcctttgtatgtcagcaacactcttaccctggttgcccaagccagaaacatgggaatcaacattgactccttcttctataaccatacttaatcattctctaagttcaagaaatttttgactcctacactttttatatattttgcctcctacccacctttacctgccctaaactagaacttcacgacttctaacctcaccaactatagcaggctcctaacttatctgcctgcactaaagtcctgttcccatctaaaaccagtatattgattatctactgttgtctaacacattgcaccaaaatgtagccatttaaaacaagcatttattattcttcctcatggtttctaatgatcaggaatccaggcgtagcttagctgtgtggtactggctcaggtctctccaaagattgcagttcagctgttggctttctctaatgtcatctggaggcttgaccaggaccaaaagattcacccccaagatgttttcctcatatgactattgttagaagtcctccattccttccacatgggcttgtctacaagtctttctgagtgttcttacatggcagctgtctctctcagggccagagatccaagagaaagagaacaaagaagaagccacatgacttctgtgatctagtttctgaagttatacaccatcacttcattttattctctttgttagaagcgagtcattaggttcagcccacattcaaggggagggaaattaggctctaccttctaagagaaggagcatcaaagaacttgcaaatagattaaaatcaccacagccactatcctttacaactttcagaaaaatctgttaaagctataaatctattaatgtcatatcacttaatgaacacctaaaagatatctcccattatgcacagctacagtcacagtttctttacatagcttacaagactcagtaatctgatccctgagtatgtttacaactttaagtccccattactccttactcatatatgattttctaaaacactgaaacactgaactgcttgttattcactatatactactgtttcttgaccccaagatttttctcagacctatactttctgcatagaatttcttgccctctgtgagtgactaaattatattcatctattaagtcccaatgcatttatcacctttgctttgcaagatttctcagaaatatgactcctagccctaggccaaggactcatctcttccttgcttcctaatatatctgtaaaataacttttctattacaataacttgcacatattctctttatacaaactggctgtaagctcactgagggcaacatattattcattttgtatccttatataaattagtatagcactagttgttataatagtaccccaaatcaaacttcatatctacattttcatgacatatttcatgtttagggcttcttggagaaccagtactgtgatcaaggtggtctgacagttgctagatacactttagttctttctggaatgataccaccattttcaagtaggatttatagacccaggacatcccccataggaggtcagaagtgataagctatgcttaagttataagtctttaaggaaaacaccatatccctgcttccaaagtattctgtgtctgttttagttggaagcctcaagacagccagaaattaaaacacaagtaatcctagcctgagaaccagcaaacaaaatccaagtacagtgagagccaagaacctaccagttgtctttaaaaagtaacactaacacagagaataaagctcccagttctatagccagatctggacttaacatgttcttggagagcttgcaaatagggttaggaatgaaggtgaactattgaaagcaatgctctgaaaccattattctaaagaattatactgcaagtagaatattgatctgatttatctctagtcaagtttgtcttccccattttctaggcaaagacttaaatccaaaataaaaatgaggaaatcttttgcaaaattcttcttgctaaaagaagcattgcatgtattttaaaattttccatagattcaaatgtctcagaatttttttctctgaaatatgttcaagaaataaaaataccaagaataattcacagtgtagactttttaaaatatttaagttctcaataactttaaaactatctttattctgttaattctttcaataataagaaagatgtgagagataagtggaaagaaacccaagcaagaacaataaataaggaaataaatatcaaaagaaggaaatgattgtattcgtcagtgtattgtcctattaggggaacaaacaaaaaaaaaccaaaaataccttaaagccttaggcttttttttcccctcaagctaaagctcttagcagaagctacatgaatttcatcaatatgtttatataattccaagccaagaaattctataaagattaccaagtatttgatgtagcttctggcaagagatgaagtacatctcacaagaactagaaaaaaatatctgttagaagagttgctgatctgatcaagaagattttagattaaaatcagaggaagacaaaaaatatctcaataaaagtgtaagactgaataccatgaaaaacaattcctatactaacaaaaaaattaacaaggtaaaataccaaataattctctgtagaaaagcagcaggataatggggactgtgaaaaatacatcctcaaattaatatacaaagacagaataaaactaatagacataataaattgtgttttaaggcagatataatctcataagtatattctaatttaatggtataatcagtgactaaaatatgtaaaagttatctatgttcaaacattaaaatgggcccgatattagcctctcttttaagaagatgtaaataatcactaaaaatcataaacataactacagcaaatttatttggtgaaagagtagcaaaatttgggagggtaagcataaaggaaaagaaacaaatactgtaggaagttgggcaataatgcaggccatatatgtagatgaagtatatgaataaagcttttccaatggacccttaaacagaggtggggtaaagtaatggtatttaaccatcttttcatctgctattatagagacttcttttggccaaattagaggattgaatatagtcatgctttgatttttggttatttgtaccttttctacagtttagtcctttacaacagtaggtaccaaggccttaaatctgcattctaagcctcatatagtctttaagccaatcttaactgaggcatatcatgtatattaaatacaaacccaccagtagcccaaaatccagtgttggtataactgtttggagccctaggcatctatctacctgctttattatccctgagtcttcattagcccactctgcattttctcatttatatgacttgacttccacttaatttccatttatcactaaaggcctaattagaacaagattcctagcttaagcactaatccacttggcaccttgacacctttttaaaaaaatgtctgttatgagaagtagttccagaactctagatttccagttgccagctgatgtcctgcctaagtctaataagctgatcagaaccacactactctccctaccatcatcttctggagaccttcttcccatcacctgacaaaaccatgttttctacttccagatttctctttgacctgttggctttctgctgaggtcaagcatatttggtcaccaaacctgtgcaagatatgtcactgtgctattaatttgctcttttagaagcccaaagaaaagtaacatttacctgaaaacaagagtatcatgaaagaaaattaagatttttattaattctaaaacttattagtttcaattttcagtctggctaagaaggaagaacttactaggaaattgacaggtggcttgggaaaaggtaaatatgcccacctagccaaataagtataatctagcaaagatttctaaaagttcaaaaaatatcaaggagactttaagatgggagaaaatggcccgcaaagaatgggaaactaagattaaattatagctaatgatcacatgagaaataataatctaaataaattatcggagctggttaaagaaccatctgataaggagatttgaagcataagactattcaacacaattttacttgtaacagcaaaaaaattagaagaacctaaatttcccaaaaaggagactagtaaataaattgaaatgtaataaagtattttgaaataattaaaattttgttctataaaaatattggatgtcatgggaaaaaatcttacaaagtaaaacttaaggatagaaatatgaatttggttctaactttaaaaaatatacctgcataaaaatgaagtatattagactatgaatagttatttctaagtgatggaatttttattttattctttacactctgatatctggttttcaaattttctttagtaaatatatctttcataaacagaaaaatgattaaaagtcacctacaaaagatagataaaggagcacacaactatgaatgtcagaattgcagaagaactcaggattatgaataatgctaagaaagatgaaaataatttttaaagttatatttaaaacaagaagaaaagaataggctaacccccattcctgcaaggagaaaaagttacgttaacgccgcctctctttttctgtcaaagcaaatcacattggaagtagaacacatgtcttaagggtgattccacggtgtctaagaatactgtaaaggagcacataattaaatgattttatgtctctaagcccaagggatttatatgctagtgtttggaaggaatttacagatataattatgatatttcaaacatgatatctgagaaatcatagcaattaggaaaggtgagaaaaatctgcacatggacaagtacgtatccagttttccaacaaggacatcgagatgtgttaatgaaactgtaatctactgatcctaacattatttccagaatggacctttaaggaaattttgatcccttagaaggtaatacagagctcttgagtcaacatatttgcagtgtaaggcatttctgctttcatgataaggttagtagttagtagatcaatattttttccagggtgagaaggctatggtacatggtttttaggcttctaattctgaaattttttgatagcaagggtttttgtgatttcacatagcttttggaaaagtctttttttatcactatggtcaagatagactgtgtagattgatgaataggatagaagtacatattaatagctaggtaaatggccgtatcgtattgattaatatgtcatgtaacccttgattcatctttttctctgcagtgatttgccatggagctgtaatctcttgtctgaccatcttattagtgatcaggataatgaatacataagtgacaggcatatcatatctgtagatgtgatgaatttgtagaaggaaatatttaagtaaatgaatttgggttataaaagattttgataagttatgcgataaaacaatatacatacacaaatatattttgattaaatataaagaactacacttttaaaaggagtaagtttgacaaatacaggaagaagaaaccaccttgttagcatttcctgtggggaaaaaagacctattaattttcattatctgtaagttcaatatagctaaaatcgttctgggtgatcacactgagttattcagaggaatcgaggataaaggggaattagccacttagcctaatcctactatactcacatgggaaaataaaattaaacacagccaacgttttcaaaaggaagagagatctctttattatgtacatcagactaggaagaaaataggagtatcttcattggcatctgccgcccacaacccattcctgtcctcattcctcctcgttctctcactcatccccttgatcatctccatcagaaatggagtcttttctatgggtcctttttccccacagctcatactttattgggtcattatttccaaaacctgcccggggaggtttgttacctaaaaataagaatcatttcagtggctatatcaggatacccagtacagaaaaatttctaatttgttcactcagagccatgaatttaaataaaaaatatattcaacatgaactttgttttctttcttgttgtttacaaataagacaatcacaatattctttaggaaattctctataatccaactggaaaaataaatcaaaatatagacttgtccttcactaattgaaatcaagcgtgcagaacaaggaatgtaccaggtggtctgactgtcctttgcagtattccattgctttgctagagtatgctgagaagttcagcctgtcacattctgaaaggcacatgaggttctagaaatgagcaatcatgataaagcgcctaggaaccacaaagcatgaggattactgaagggaccatgggtattttgaaagaaaatatttaagaggactactaaaattggaataacatattttaggactcaggatgtgtatttattattgcctttagtcacaatatttccaaaaggattaatttgtgttaaagaacaaaactcatagggaagttgtgaagaacactttcagacaatatggcataccttaataaagctcaaatttctagtattttgtcctgcagacactgggacaactaacactactacctctatcttcctaagtttcaccttacctccacagtttttactataggttgccagctgcctctactatgcaagtgttgggttttctcttcccattttaatacatctcactttaatgcgcaatactggacaaaaggacattttgtccttagtaccctatagcataatttagacaaattcaagctttcagtaagactttgttaaacactaaatgattgcaggggaagaatgatcccagacagtgcaagaactgtataaataagaagcccaagtttcagagctcacatagctgacttgttcttagagctcccagccccttcccatttcacatgctctcagatattagctacactttagccaccaaggacaaacacaatttcataggtacttctttttgacctctcacaattcctaaatcctggcctgcccacatgtaatgtaccattccccttggcagcccaaatcaagagaaactaagttctttctcttctccagctaggatctctcttcctactctctggcccaatccacaatatagttcaatgttcacatataacttaaagcagcacaattatcacagcatttctatagcaggattaacaacacacccacacagtaaataggatgattttcttctcacaatatttgcaaacacttgatgagaatgtctactatcactccttttatttaaactcgtaccgtaagtcctggccagcataataagacaaggaaaagaaataggaaaaaatgtcttcaaacaattagagctgtaacaaaactgatacagcaacttcatcaatggagtttttcagcataagtgatggaacccacaattcagtgtctcagaggggatctccatactggccaaggggattgggccatctaggttaattttaatatgccatcagtttctaagattaaaagatactatatctcattcacgttttctttttcctctttttctatatcatgtcacattaatgaaattaaatagaaagaataagacattaactgtgtcctagcattaataaggaatgaatatgctcttttttcaatgtgtctacattattcatcaatggctctgttttttaatttagcaaagactttggtggctggggggtgaggcggggtgtggaattcatgccaacagcagctggcaatcatgagcagatggagcaactatgcctgaggaaatagtataacgtctctggtatatatttgaatgctgaggtaacatctcacatatgggttttcctggtttgaaccctatcatctcttcatactcttatatttcatcttcatgatttcaacaagcacagaaacactgataaagatgaactaagtgtggaactagtcttgcatttcaaagaaataataacccacttaaaagtataaacttaggttgtattcctgagaaaaaaagttcttgtgatatgtgggtggtgtataatattcacatccctgtgttagaagtgaagattcacaggtactgacaaagcaagcttcgtagatcagttacgttgcctaaagtatataccccacactttcagaagttaattcattaattctaacatgggattccagtgttggatttttcaaataatcacatggagaggttaaacaattcttatccttaaacagtgcatttgcaaagcagagagaaaataacaccatcggattaaatagacagatgatagaccgacagacatatttttacaagtttttcacagtacaacttagttgtttccataattttaatttttccttcacaaaggatcataagtatgtaaaataaaaatgtcaatagagcagtatttgatattattttaaaaattacagaagtaaaatatggtacgtgtcataatcttgtacatatattattagcacttgtattttatgcgaatgccactgcaatactaaataatccagcttgtagggttccaagtctatgtacccagtaagataaaaataaattacaaagaaaatgatgaccactagattcatgttagagcatacttaagagaaattctgcttatttattatcattggttttacattatgttttggtttacacttgtattattttttgtttggagataattctggcagagcagtgatgaaaattaagaaataaaaggtgtattgccatgaagtagaaaatcatccagcatgccccaaatcttaccaatttcaattttcacattaagagaggtgaattatttcttctcagccttatttttagttacttttcaagcatttttttaatccaatcattcagcaactatttattgagctcttgcaatgtgccagagaatgagctagtcattatggttcagagatagaaagcaagatttcttttttcaaaatattcttataagagtgaatatgccaaggaacagaaaagcacaattcaatatggacaggacattggtttgaaacaaagacaggcaagagataaagtagagaaaaagaggctgtccatagttaccatgctgaggggcttaattgaataagaattaagagccaagatattgaaagggagagcattttcagatttgaactgaacaaatcattctggacagcagtttgaaaacattggatcacaagaaaacaagcctgaagtcaaggagactctgaggtgatctagatgagccatggtaggttttgaactcaaataatggccatgaaaatttatgggagcaaagaggttgaagaactatctccttgactatgacagaacttcatgactgagtagatgtagataagcaaggagaggagaagaggaaggagtcaagtggcctgggtatctggatggtcctgctcttaacattcactgcaacagaacatgtaggaagagctgagagtctggagcagaggaaataacaagttcagtttgagacatgctgacattagagtacctgtgcaccacaaagatggaggtatgttgtacacatcaattcagagctcagaagaatctattcattgaggagacatcagcacgtggaccataactgaagttatgagatttcatgaagtccttcaacaggtcctatgtgagaggcagatgtcaggagattgaatacactgaggactccactttcttgcctaagagagcctaaagagtatccagagagattgaaagtagccaggatagcattgatatcaccgacaccaagggaaatgagatcttgaaaagcccctgctatgtcacaggcaccatgccagacatggtggggacccattaaggaatatgtctctgccttgaaggaggtcttaagacaaagcatatgcaaatttaatcacaatatgaactggaaagtgccaggtgcctttaatagaaggtttaaataagagtagggaacagccatttctatatctagtacaaaagtgatactatagagactattatgtgacacatgatcatggtgtacagtttatatggtatcctacaagtcataaatgaccactttcccaggacggttttttaattatcacaacagaatgtaatctctccctcctttgaagctctaaatattatatctcaatcaaggtatgtattgcattctttttactattagatttatatttgctggggattttttttttatccctttacaagattgtaaagttcttcgtggtctgaaactgtttcttaccctccgggaactgccactccctccccgaagtcttagacccacaccctgcaacattatagccttgctcttggagtcatttagttttcggctcaaagcccatctcagtcacttgcacagcccttatctcccacaatgcacaaattatgaatgtccactaagccacacagtttcctcaactgaaaataggagtaataatacattccacagagggctgttgcattaaatgtgataatgtttataaaactacctagcacattatttggcacatggtaaatattcaatgatatttttctttcaatgcacaatgtagtaaataaatgtctacagaataaacgatttaatgaatgatcagatggcaacaagtctatgtttctaaccaattttcagactgctttatgattctcgaaactttcacaacctatataactagtaatcttccatatccttaatttccctctttcccctcaaagcttaaaattctaagaaaatgtgtcttccattatccctcttgctctttagcagtatctgaagaatatattgtaaagtgaacttagcaaaatttctagctagtgttaaaatcgaaaatatggtaacagtgtttaatcacagaatcaaggaataatgacatcctattcttcaagaattcaggttaattaagatttcactgaatattaaataaagagtccaacagccggattttaaatctcatctctgccactttctagctttgtgaccatgggcaatttattagacctccctgtgcctcagttttctcatctgttacatgtggataacaagatgacctatatcagagagatggtatgaggattaattgtgtaaagtacttatagtaactgagaaaaaggaagcatgctatccatgttatcactaattacttcctatttgtttgttcagactgttacttttgttttcttatagattgaaaattgttgctaggttcaatttctcattatttaaaatatctcaatatcctcatatttgcagcatgacttccatcctcaattaatgaactacaaaaaatgaaatagaaaacagttaaagatgtattgaattatctgaagtttttcaagtaccaattaaagcaccaaagacagttggtatggcatacattgttcccttaaaggtattcctaaataaagctttgagaacatagtaagttttgttttttttaaaactgctgtatcatattaccagtaaaacttacagattggtttctaaccagaaacaaaataagtctatgtagacaaggcatcatcgattagaaaaaacagaaaagcaagccctggtgttcttagtgagaacctgaaacaagctctggcacctgtgtgtgtgagcaagtgggctttctctcttgctcaagataaaggacattcactttcgaaacagcatgatgtcaccttagtgtcagacagatctggataagcagccaatgtgacctgaactagttcattctcctttctcagtttccttatctataaaggtataaatgggggccgggcacggtggctcacgcctgtaatcccagcactttgggaggccaaagcaggtggatcacaagatcaggagaaagagaccatcctggacaacagggtgaaaccccttctctactaaaaatacaaaaaattagccgggcatggtggggcgcacctgtagtccaagctactcacaaggctgaggcaagagaattgcttgaaccaggagtcggaggctgcagtgagccgagatcgcaccactgcactcttagcctgggcaacagagaaagactctgtctccaaaaaaaaaaaaaaaaaaaatactaataactacaccaaagaccactgtgggaatttaatgagataatacaattaaatccttgagcaccgtatctggcaaataatgaatgcttaatatatgtagcttaaaataataattatcagtttaaataatgagcaagatagattagttatgtcagactctcacactataaaccattaaacccctggacaaaatataaaaactgaaattgaagtctctaaagaactatgaaaataagcagcaaattaagcggctatgatcctaaaggaagacatatgctttcagtgggtatttctccatagacacgctccagtttggcatgggagaacagagctcaatcagaatgaaagtctcttgcttcactgaagagacaaatataagagtttagagctgccagaaaagtgagaaggggcaaaattcaagcaagaaggtagccccagatgagggaaccctaaaacatggttccaaaatttttcttgtgtgatacacagggcaaaactccaaaaaaggaaacaatataaatcaccagggggttgcaaagatatttcagagacgtttttaaggaaaaacagtttagtatttgagtgcctcaaaattacaaaggtttggtaaaaacttcaagctttgagttgagagtctataaagcctcactcaagtgtaagggcaaatattatgtaatcagccctaacaaagactaaaagcaaccaactaaaagatcaagataaagcattactgctatagctgacaaaaaacaaaacaaaacaaaaacttgatatttaacttgtctataatatgcacattgattcaaaacatacaaggcttgctaaaaacaagctcatcagcaaataaaagaaacgcaaaaaatagaaacagacacctaggtattttagatattaaaattataaaatatatttttaaatagcaatgattaatatattcaaatggatagaggaaagaatggaatttcagtggaaacctgaaattcataaatgcatcaaactgaaatcctgcaactgaaaatataaaaattgaaattaagaatttagtagatgggtttaataacagattggaaacatcagaatagataatttagtgaactaaagacatgtcaataaaaagtgctgtgattaatccctataaaagaaaaagtagaaaatctaggaaaaaagtcagggaaatataggattccatgaaaagctctgatatacatgtaatcagagcactagaaagagagaacatagaatgctagaacataaatgattgaaaaatactggccagaaatttttcaaaattgatgaaaaatgtctgattttatagacataagatccaaaaagctgtccaaacacaaagcacaataaaggtgaataaaaccacacttagggacattatggtaacattattaaaaaacaaagcaaagagcatttaaaaagtgcctggggtgtagccagggtacatgttatcttcagtttaagaaaaactaattttgactaccaattcttcaacagaaaaatagggaaacaagacaatggatggatatacttagattcctgaaagaaaaaaataatattatcaacctagaattctgtacaagtaaaaatatttctcagaaaaatgaaagcaaaatagacattttcagaaaaacaaaagccgagaatgtttttctgggcagacctacactacaagatatactaaagggacttctttaggttgaaggaaaaatgatctcatagacatatagaactttaggaaacagtggaaaagaaaagataaattttggggtaaacgtaattgcatatgggctagtaaaacaatatataatgtcttacagaatttacaacatgtagaaatatattgtaaggctagtacaaaaggtcgaaagggaatgatgaaattaaatgatgttttgcatgtttaaataataaaaatgtattgtaattaataatgtaacactgaggagtaataaaatataaaattaaaatctaaagattttaaggtacaaatgtcataatgtaatgaataaataggaagccagaaaagagaaataaaggataaaacaggataatgtattaatagcaagataacatgtttaaaagagctgaatcagtgatatttaaagtaaatggagtcaactctcaaaataaaaaaaatctgcatttcactctgtttaagtatatgaaaacataacattttacacctcgaatataatttgtcaattacacctcaaaactgaaagagaattctaagcaagtaaaaaataaaattgtacctaaaaacacagaatttgtcagacttgaaaaaaaatgcagttttattctgtttacagaagtaacattgtaagcatatgtatgaatacatagttaaaaaggataaagacaaaaataagtctaccatatattaacaaaaagaaaaattatgtggttaaattaacagtgaaaaaagtagatcttaagtagaagtgcaaaatataaagatgtacatttcaaagtcataaaagggttaagtccatagcaagctataaaatcacaaagttttcaatacctaattagcacaaaatttaactgtataaagcaaaaagttgaaagaactaaaggagtcatatacaaatctacaatcataggctatgaccaatttcaataactaatagaaaaagcatacgaaagaaaaggatacagaagtttagaatgacattaaccaaactgacctaatttggcttatagaacattatatccaacaattgcagagcactctttaccatgtatatcatatatatatatgagaaatatgatatatatctcttacatatatgatatatatatatcgtatatatatatctctcacatatataatatgtgatatgagagatatgatatatatctctcacacatatgatatatatatatatatatgtgttgactttttaagggttttaaaattaaaatgaatatcctaagtcttagatgttcacaaagggttaaggaatacaaattttaagtcattctttccaaggctctggtgtcacgagacatagtcttggtcaattaatttattatatattaatttattatatattaattatatattcaaaaccatgaattcttaggaaataattctgagtcattgccattatcctcatcctgacagatattgtaagactagtacaaaaggtcgaaagggaaccaagacattaaatgatgttttgcaagtttaaatagtaaaaatgtattgtaataatgtaacactgaagagtaataaaatataaaattaaaatctaaagatttcaaggtaaaaatgtcataacataatgaataaataggaagctacactatatagctacactatatagaaagttgccacaaactactaagctcctgaggttaaaatgtggggcagcgagcagtaaatagataattcatttattctacaattagtcccattttcagacaaatgttatcctattgtaagattaaataaaataatgaaatacagcaggaaaataaatcataaatagtaacaagagcctaaggataaattcctaatgtaaaaaggaataagttatgtctctttattctcaagaaagtgtttccttaccatgtaactttgtctttgaaggttttgaagcataataattctgctgaagcagcataatgttaatattttgcacttatttagagaaacagtttgggacagatgtactaaaatacaaatagaattggaaaaaaatataagatactggccaataagaatgtgaatagctataagaagtaacttttgaattaaaagaaggatactgataagagcaataagaattattttacatagatgccttgatggacaaaacattacaatataaattagaaaattttgaagtttaaacttatttaactttctctaagaagtccatcattggtctattagattttcataaaatcccctatatatttgcttataagtaaatttttgcttataaataattgtaataatatcattatggactatgccttgcaaatacatcacccattccttcagcaatcactcactaagggtctttcctattctaggattgagcaaaaggctggaaataaaatgatgaaccagctttgccagtgaagtaaataaaatgaaagtaacagaaatagaaggataaaaaagtttccacgacaaacaatgacaggcaaggggcctgttttagacagatgggtcctaggggccttcacttcggaggtgatacttaagtgagaagagaatggagagttccaagtagagggatcaggcctggagttaggagggaaattacagtttccaagaactgaaagaggcctgtgggacctgagcatgtagaagcaaaaggagtggaacagatgaatttggtgaggaaggtgaggtcttgatgccaggctgaggagcttaaattttatcataatacaatagatggcagttgaaatgttctaagaagagaacagacatgatctgctttatattttaggatttctgctggttgttaaataaagagtgaatttacaagaaataagaggtgaagtgagaagatcagtgagaaagtgagagataatgcttgcctggactggagtgagccttcaccatgaaattaaagcagacatatgtgaaatacagaggttggaaatctgccttacttatgtattgtgtataaggggttcaggggcaagggagaaatcaagatgatcccataagtctatctgggtagatagtgacaccatttactgggattgagagtgctagtagtgagagaacaagagagaggacagctttgccgagtgggaatcaagagtcttgttttggatatattatacttaaaatttggagaaaaatgttaaatttaagaatgaggaggtttgagggggaagcttgaagaagttatctgaacacataagatgagaaatcattctagggatttcagaagacatcatgtataaagagcatattcataattatagatatttgttatgtttaagatttgcctggttgttgcaaaaataaacatctttaccataaggaaatttgccaaagaggtataaattatgtctaaaattaacatagccaaaacagatcttttaagtttctttaaaaattctgcttttcctctactaccatttcctagttgcccaagcagaaatcctagattcttctctgaatttcacactccctagccattcaatcttacattccctagtcattcatcagcaagtcttatccttacctccaaatcagatataaaatctaaataattttcataatttccaccactacaacctgcccaggtcatcttgatcattgccattgcctggatctctttaccatcctcctcatttgtcttccggtttctaccttggcaaattctccctcatactctcacacactgcattctccattaagcagccaaagtgggctttttttttagcatgtcaaagcatataatttcctaaatgctaaaaccataactcttatgtaaataaagaagacatgtcaaaaatgtttaactcatcaatgagagaaccacaaggattgtaaagctagttcaaaggataattaaagaaatagggcatataggaaaggcatattaaaataagtttgttgagtgccatggttgcatatgtccctcaaaacatgttttggaaacttaacccccaaagcaacagtgttgggaagcagggcctaatgagaagtgattagacattagagctcttgtgaatggattaataatgcctttaccatgggagtagatttgttatcacaggagtgggttccttatgaaagtataagcttggcctccttttgcctctcttgccctctctttgcccttctgccatgaaatgacttagcaagaagacccttgtcagatgctggcaccttgatcttggacttcccagcctccagaactgtgagaaataaatttcttatcattaaaaattagccagtctacagtattctgttatggcagcacaaaatggactaagatgctaagagacaaactgattaatgtcctacaggcaataaaactgtaatcttcagagttattttctctatcttttctgcaagttagaaatgatttgcctttctaacagacaaaatctacaagttaacatgtgatttcacagagtctgggcccgaatcaaaaataaagtgaatgtcaaacaaaggtactttcacctagagaattaaataatccttggaaaggccaattagacaatgttctagtgtaataaaggatgacacacatagccatactttgggcttgtttccaagtacataataagtgttctcaacaagcataagtcagtttctaatcctctgttttcaaacattttttctcttagaataacatacaaattttctatcatagactatagagtctgtctacataatctggcccttaaccatctctttgactctctctttttactatccttgtcaatcattatgatcctaccacactgatcttgctgttcttcaaacattcaaggttctccttcagacctgttagtcttttctcactgcctgctgctattataccagatttagcaatggcttatgccttcacgtcattcagttatttgctcaaatcacacatatccacctatgcacctgccacatctctctctctcatcactttgcacttttctacatagagcttatagtatgacccaatagtatttctttatgtgtctacttgtttttattgacctcttttattagaatattaaggaatttttgcctgttttattcttgaagctatctctggtatttttaacagtgcctggtacatactaggcacataaaatattttttgaattaataatcaaagtatataaacactagcatctcaaagtgaaaatgttgttttcttaaaatagtttctgattttattagagaaaagtattaaagaagtaattcaaaaaaccaatagtaaagcaggtgtcaggtatggggctcaggacatgaaaagacattttattttggagaggaggggaaggcagcacatcagttcaggacctacagactggacagatccgtcatgaaatggcaaaaaataaaggcagttttcagatgctggtaatatgagcaggtccagataggtggatttttgtcatcaaaaaggattgtctggcaataggtaagtaatggatattatagagggtgaacacggaataaggttaattggagggcagaccactatcattcattgatagcttgctctatgtgagactctataccaggcactttacctatgtcatctcatttaatcccaatcaaaaccctttgaggcaagtagtataagacttacttttaaataaggagaccatttcttcaggaagtagaagttgcatacaattagtaagtggcaaagcctaccttaggacatgggtcagttagaagcccatgctctaatactgatctttgctgctccctaatgcctccccacacacaaacatagcaggagataggtgctcaagtaggaagctttaacatgagtaagcccacctaaagattgcagaaacaaagacacatggaccaggattcaatagaagaactcagtgaaactgggtgattaaaagaaaaaggacacgcttctagctaacaaatcatcagggccaggaaaaatggccaaatcgtaggaaaataagaaaacaggatcttaaattctatggagacaacattcttatgtttttaatcataattaccataatgttaaccataatctcatggtgtgagagagattatctcaggtagcaggttatctcgaaaagaaagagtccaaaaagagagctagagccgagccgctgttatagaaactcaattcattgcaatgagtatttattgaacaccttctctttacagaatactgtgttagatctggaagtaccagaaagtaaaaactatctcttcctttgaccacggaagagctttgaacttgaagagcacagcatttaataactgcattgcctattttcaactcaggttacactggaaatgaaagataatctcctttttactacaatttcatgtttcatacaggcaactatgtattaagttcataaatcacttccacactattaattccatagcttttcattaacactgggttgtagaagacaactgaatgttaactcagtatggactgtggaggtgagaggttaattctgtttggattgacaccagaattatttccctcacttagatgcatacagttttgaaaataagaatgggaaatatctctaacaactgaccaaataactcactcagaaatgaagtacaaactcattcttaaaaatcaaagagaaaggccgggcgtggtggctcacgcctgtaattccagcactttgggaggccgaggcgggcagatcacgaggtcaggagatcagaccacggtgaaaccctgtctctactaaaaatacaaaaaattagccgggcttggtggtgggtgcctgtagtcccagctactcgggaggctgaggaaagagaatggtgtgaacccgggaagtggggcttgcagttagccgagatggcaccactgcactccagcctgggcaatagagcaagactctgtctcaaaaaaaaaaaaaaaaagaaaagaaagaaagaaaagaaagaaagaaaataaaaaaagaaatcaaagaaaaccgaacctcattctgatttctcttacaagtttgagggaaaaaaaagaaagacaaagcatttaataaattatataaaaggtattaaatactgatccatggtatatttattttaaagtatctggtttcacttaacaagtgacttttttatttggccatgaaagttaggtcatttttcaggttctgctgttttcctgaggaaaattgctaatgccaagacagcgcttattgtttgacaagcaacacaatgactggtgctctatggattgaaggagaaataactcttattttcgcttcctcacatattatgttgttcacagtctactttcatgttaattcttttcagagcacttctgttgggtaatgaaggaagatcaagggttccctttcaagactacaaagttaattactgcaatcagagagcatttgcaatagtggtttgtaccaatgcttatcaggcccttaaaagtagtcatttgcttgattcctggacaaatcacataaaataaaggagtccataaatgtacttcaattaccttcctgatttatttatccctttctttctcaactgaagttcattgaactgtaggcaaaaaaagacaatgaactgtggtagattaaaaatagagaagttgtcatggaaaatgatccatttcctttctcctataaatagatttaagattttagaaaggtgttcattatgaaaagagtatctgatttgatagcttcttcagcagattctgcttcaattctgaaaattaaagttatataatccctagaattaaaatctttccataatgttcagtttcgaatatatatatttcttatatctgatatagtaacaccaatatagggaataggataaagaggcctagaacctagtcctgctgttatttaattagcaacttaatctgtaacaggtaaatgcagtcatccactctattaaggccaaacattaaaggacgggaaagctgagcttttgcgtcagataccacatggcttcaaatcatgaactcccgtttacttgctgtgaaactgcaagtaagttacttaaggcttctaaactttagtttcctcaacaaaaaagtgaaagtaacaatgtctacctcaaaaaactataaagaatattaaaggagataatattaaaggagataaagtgttagataattttctaacacttactaggagtttttaaaaggtggctagcttcccctaaaactcacaatatctagatctaaggaagatgtcatttagacaatgatggtgcttttttaagttgtagaaaagcaaaaatgtaactcctaagagacaatgatatcactcatgatgaataaaacttttcatataaaaatatattatctggaaaggtacagtttaccttagcttttactgataaataataaaccagttgcagtaggagttcattcactttgtttcctgtcaaaggtggctaaccaattctttctgtaaacacttgctactcctctacaagttaattcctggccttctattgctttctaaacatgcctgtttcctttgcaccaaagtgctcagtctgtctgtagaaggctgaataatgccccctataaaagatgttcacctccaaatccccataatctgcaattgttaccttgtctggcaaaagagacttagatatgattaaattaagaaagagtgatgggagattatcccgcattatccaagtgggctcaaagcaattacaaggttccttataagagagaaacaggaaggtcagaggtaggagaaaacaatgtgacaatagtaaagattggggggatgaggccatatgctaaggaatccccaaaacctctagaagctggaagaaaaatgaaacaaattttcccttacagcctccaaaaaagaggatagccctgctgacactggttttagccctggacttatttcagacttatgatctccagaactgcaagagaatagcttcatataataatttcttacaccactaaatttgtggtaatctgttaaagcagcaatagcatactaatataccatcagtaccttctatgctgttgatagctcatctgttttataaaggtgaagagtattttctgcttttggttcttctgtagtaatagtggtggtggtggtggtggtggtggtagcggtggtagcagtggtagctcctgctacgtgtcaaacactgggttagatgtcttacccacattgtctcttgtgctttcccaactctgtgctatgagggaacctctcttaaacccattgtacagatgagacaactaagaccaagattccaacccaaaactatctgttgcccaagcccattgtcttaactgctctactattctggctctcttgaccctatctcccatcttttctcccttgttctcagattcctatcctattgggaatatggacggtaaaagatgtctatttcttatagtttcttaaaaagcaggctcttctagagaaagaatgctttgacttataggtatgtgttaaaagaaaataaagctattaagaaactgcctacatagagaaggagaagggaagtaggaaaaaagagaaacaaatagggagggaatgggagagaagaatctttgaaaccacatacccaaattcgttgtctcctaacacacaggggctttgaaagttgagaacatcttgaagagaggaagagaagtaaggacaattatagtatacaattaaacaaaagcaaaaaaaaaaaaagatacaaatatacatggtttgtacacagaatcagtgaaaagaccagcctgatccaaggctcaaatctgaattaggaaaggatggaaaatatttacaataataaagcaaggtcagtttttggagacacttaactgtcagggagtgttcagacctggtttgtcggaggatggaaaagactttgttccttaagagagaattacgaaaaacagagaagacattttttctgaaatttttgctttttttccccacgttatcaattttcctaaaagtgtaagtttagaattaatttcaaaaggaaggtaattttcagaaatgttgacataagtcaataaccattctaaatttttaagtttataacctagaggtaatattactaattttgaaatgatttccctaaaaaaaaattgaaatccctttgcaaacttactttcacagactatttacggtgtattacatatttactcagctctaagaggcaataattccctccctggtgttctaaagctcttctaaaagagataccagaacccatctcttgtgtaggaaatgtttgaagatggaaaagcaaggaactgacgtgctgacttgaactcttttagctactttatctctgtcttctcattaatcctgaaaatcctatggggtaatatttttaatctccattttatagatgaaaactctaagactcataagacttaaataagttgactggtcttacagatattaaatagaaaacagtctgagctacaatgttgtctattcatgggcaaggaattaaactgaaacagacattttaacaataatatccttttacccgtccattttctatagcagcaaacattccaattacatggaaaaagcaactgaactgggggatttaccaaggtttcaatgtcctcacctctttgaatcaagtattccttgacattcttatgacaaagaacaactgtgcctgcaacacaatttgctgttaatagtctgagagtaaaggatccctcaaagaaccctttcagagaaatcttattaaagaagtcccttccttaaaaggtaacttaactctttgtctggggctcagtcctttggatgttaatctgactgggccagtgcacctaaataataaatatcctcctcaaccccccaccacaaatagaaatgtttcctccctttccacagcccttttacctggtataaagagtcccatgtctaaaaagtatttatatatatatatatataaaatacacattattattatatatataattatatatatacaatacacacacacacacatatatataaacactataaaagcttggaaccccaatgcacaaatgcacaactttcaagttcaattttctatttaaaaactggaaaaagtggtgaatgtctgctgagatgttaatatctgattaagacagagaacaaaatgggttacccatgtgaatctgaaaagcccttaagaacactttcccagaaaagggccatagcagcagtagctgcctcatctgagtgtcataagccatttccatttcacattccatcctgtcttcctcattaaaccacgtgtcttagacaatttgaggtttagaaaaacatggccccactagcagtatgtattgttactaggaagctgttcagttttgcacacgtattgatgctatactccagaggctatactccagagaggggtgactaatgaatttcccacaagcctctgaagatcttaaatcacatgtacaaaaccagagattttaaagtaaaaaattatagtttaaccataaaaaagaaatacagggagagaagccattagattgtttcaggaaccagacgtttgagcttattaattagggaagattgaaatccagaaagagaaaattcactgaaatcggatcaactaccttaataaaataaattctctcaatttatttgaatagcagaggttaacacctaccagcttatgtaggaaattagaaacaatacctattagcttgaaattttctctatccaccccttgtgagttataagtcaatccagatgcagaatctggatggttcctgcactgtttattgtggtagttaaataacttggcaattattattctcaatggctattcctaaaacatcaccttcttttctaactttattgtatttcccattgatggacaacacatattgataagagcaattaaacttaacactagtcataagaagcaagcaatatttttaaaaagcacagaatacctacaagtcatggtattatagggaacttgtgttttcttcttaaaatattctttggttttccacattttgaacatgtcttatttattcaatcacaaaaagttttagcatgaatataaattataccttctatcacatactgaaatagaaagccaaccgatctcagtacagatttcatccagaaattaacaaaatggttttgaagtaacttggtcaagaagaaagttcattgcagagaaaaagttatgcgtcaccagatgaggagaactagcttttcccaggaggtaaaggggaaataaaaggtcacacttgttattatcactatccttgctctgggataagaaaaacttgacctgcatccatgtaaatttgataattttgagagatcttaatgaatgtctattctacaaagatctctggttaatgagtcattaagaggtaacccacactaggcttcacagcatgctcgtcttaaacttcgtgaattttccacagtccagaggctggtaatattcctcagatatttccagcacattgagaacagaaccatctgtcagtgagattgccattaaccaagctcatgaaactgatatataatagtctgaattccattttattgacttgcaataaaaaataacgatcttagagacaggaatacctaaatctgcataactagccaactacttattttagatggatctaaacaggaagccaattcataatcaaaaaataatttgaaaagcatgaaattacaactgagagttaaaattaagggaattcattaaaaggcagttttccaacactctctgaaagccctttggtttctgttaaagcattcaatatgggagattttatttctgatttttaattgcgaggtgaaatgagagcctacaatcttactttcaaattctcggaagaagcctcacatcagtccccagctactaaccatgactttcattttttcactgtaatttgcactgtattttaattaataaccctacacctgtcttggaatgtgttttctaccttctttagcatgagcaaaaattgccccacactattattactgaagtcagacagttatcttagttatgtcccaatatctttacacagaaaacaattaaggaagccagaaagagaaatactatgccatatcaggatcctattcctgatgttttacagagaatacaagtcatttatataaaaatgcaatgtgaatggggtcagttacttaaaagaaattattgtttctgctgtcatgtgttctacttggtggctggaaatgataaatactaatgttctgagatagacttataagcattcaacttacgttaatagcatcagtaccattaacttaccctctactaattagaaacgtatcatttcaaacagattaattgatgttcattgtaattttaatgaaagtctaaatttaaatattctacacttttaatttttcataatcccaaacataatccacattagcaaggctctactactgtttaaaccacaattgcattctgttatccagaattaaactggaaaacacagatttccattagtacttttttttaataacaataacctttagcctaataagaaactaaatacaacctgaaaaagataaacgatgtccaaccgaagaatattttattacatttttatatattgaatatcatgcatggtaactattaactagaatattataataaccagaataaacacctgctagtctattaagtaaaataaactttactgtacttgagaagttattcaaaacaataaatttaggggtctcaacatagaatcctaatattacaggtaaaaatctaaattattttttagaaagtatgacaaattcctactggcagagatatcaataataaaaaagttgagaaatctcttctgatagttttaaagattaaggcatttaagtttggtttcattatacaatgttgctaaaactgtttctcccttattttcaacatatatttcctttgttttaaactaaattgaagtaattcattgtgaatcatccataatttgcccacctattagattttattaaatctaatttattcaaagggtaaaagatatccaggtgtaactactcaaacttatttattgaccttcaagtttcagacccaaaaggaatactcttatgggaaacaaaaattcatacatctataaatatttcataatttctaagagtggcttttttgagggtatataggctaaagctgaggcaagggttggcttccctgaatttgcaagtatcattcattttatgtaaaactgatacaatctcatatttcagaatttcccatgcatatgattgtcacatcagacctttacaacaatactcttaaggtaagcatatcagagtcaatccctacttcattacactaaggaagacactgacaagcagagagattcagtgctttgtcaaagaccacatgccaggaaatatctgagagccaagactagacctacatcatcttaagaagtccttttttatttatttatttcgttgtacacatgtaccctaaaacttaaagtaaaataataaaaaaagaagtccttcttaaaattctcattctattaaacagaagatactaagcttacctgagtgtaagtgtgaggccatacaacagaaaatgaaaaggagacaaattccttcctagataatctggggattatctcagtccttcactttactccttgtctgagacatcatagccctgtggatcatcagggttgatcagcctggctggttagtcctgcatctcttcatcccttgctgcatcttctatggacagagtgaacaatgttcttaagccaggctttcctatgtagctgcatatccctgctagatgcccacaacaaccagctctatttaaaatcacagaaaacacagggttatcacattttcaagaatctaagattctaaagtagtgcttcaaagagtatatggcttatattccaatgagattctggaaaagatcagaagtatgagcttaagttcagctctagaatccctaaaagatccaattatgattccatcattctctttttgtccttattctttacaaaattttaccttctttacactgcaaatgaaagactgggcaagagtaaacaaaatgatctctatcttcagtttacctcatttttctttttgttgtttataacatagtattttggccctggcaaacatttgagtacctagcagttctaacacctgaacacagttcttgatttagaccagaaggaagaacacaatgccagggtcaaaagtgagcctgtgtgtcaagaagtagctgatctttgagacgttagagttacccttaatgagaaaaaatacacagaacaaacgtaaaagaaaacaaatcacccatgttgagtcctaggagatgatttcccacaagctgtataaactttcttcagttaaacaaataatcctagaaatgaagttttgttttcatgctttgaggacacatagtaatgattacctgtggtttttctcactggaaaccctgacaatgagacaaaatatgttggggttttttttccagataaatgtcttaaaaagacatttctagaatatgaacatttcttaagtcaatgtttttcatttaaatttaaattttataatcatcatatctgactttattcaaagcacaaatcctagagacaggcaaagtttttattggttaagaaccatttcacaatatcccactcactaagatctcttgcttactacctcaaagaggtgggggaacctccgctgtatgaaatgtagtgtgaaaggttcatggaatttctatatattctgaggactttttttggaagcaaacctttgaaattcaatctcagataagaaagcgcagaaactgagtagacaggagagaagtgtccaagaagaagtagcttgcattcaaaggtaattgaaacacatcagaagagtgtgttagtgtctaagtaagaccttgggcctaaatccatatggatgtgtaaatgaggattatgtaatactcatatcctgtattacaattgccaaaagtatatgagaagggaaattttcactttgttctctaggaatgtgtattcattcattcattcccatctgcctttgactaaaccagagctcagcgaagtggaatgattcatcaaaaaagaaatggaaagttgacggcacagtcagaacatcagagttccattgagtgtgttccactgaaacacctcagtcccttttaattaaagcaaatgaaacagtaaaatgggcttataactttttaaggtcctctctaataaacctgccctagacactagatatatgttcaatgacctttaaagttaaaataagctttgagacttctatgaaatgctgcctcccattccccaaaaaagcccattaaagtttcagatatgcctgtattaataaagttgtttaatcccattattttatctctttctgttggtcttaaatcatctctctacttacctcaggtgatgattgaagttttttatgtattcccttagtctattaatcctgaccctgctaatatttcacatggcagcctcatttaaatagtacaaccaaatattttcatattatgtattactaaaaagtactagcgtttttctcatttcttcattggcattcaaacagttttaaactaagtctcttctttataggtacagataagaaaaatagaatgaattattctcaagttttgattagatgctttctgggttaactagatagttatgatttattcataggaatacattaatgatcaatgatagcaacaccaatatttttccattatcacctaaataattctttaaaaattcagaacctaacactggaccacaaaaggaaatcatcgtttctaatgcatttttactatgaacaaaaacatacttaatatcttcctttgtaagtcccaaaatatatggcagtctttaaatactgttcacaaacacaccacagacaacatcaaacatttagtagtttgcaatacaccaaaggaaaaatgatgatttattcaactttaatcggctcaatattaatttcatgaattttacacctagaggattctgattgctgtagttcttaccatgaataaattttgctcttgaaaactggtaattaattcttacaccttgaaagactgaaaaacctaggcctctgaatacatttacatggaaattaacattcttttctactgtttctttgaaatttctttagagattacctttcctcgttctgttcagactgtatcaaacatccattaatatagttcctttttctttatattctcaaaggcttggggtttagagaaacttcaagtgtgcaaaaatctcaaaactaaggacaagtcaatcaatgttaactatgaactaatttctttaatcttgagaatggtgttgaatgctgtattgttaggcaatactgacataggcatctaattcacatatagctcttccctttatatagcatttttttgaacatccaaaggcagttttaataagggaacttatgtataatatagattatattttgatatgaaaataaaatctggtaggtaatgctaaaatataaatgaatgttataaaactattccaatgagacattcccaacagctctctattttttccttccttccttctgtctttcttttaaattacctgcctttttccttcaatgtcatttatttttcaatctttggaccacttattttctcattaaagtgaaacacaaagaatggctttcattacaactcagagaggtgaagtaccagtcaattggcaccaacatatagtttccctcactggagaactgagagagtcatctctatttctcaattttgagacagactcttcacaatgaataagtaatttgaaaatcaaaaagacattttgatgaaaaacgaagctgaggctgaactagctgcatggtttaagtcatctataggctgagttgtgagcaagtagacaaagctctagaagccttttaaatttttttgtaaacatactgacccatgtatgcatacactataaaatctggcattaaaaagagcacaagagtcttttcctttgttttgcatacataattttgagaagcacttttttggatcaaatgctgcaaacaaaaacaaaacaaaaaagaaacagtttagccaagttctagtttttattcttgggctctctaataataattttatatcaccatgcttataggacataaatgttgcctgatcaatctcatctctcccctttggaaaaacttgtctttgaaccattaatttttatatcatgtttaaagatcacaaagcaagattatgctgatgaagtttattaaaaaatttggaaggcaattttataatagcaagtaaacacaaaagtgtcaaagcaccagaaatacagcaccagacttttagcccatctgcagataatctgtctaggatgataaaacttgtcctttgtttatacaaatccatagactatttgaatagaaattttataatatacactacatttctaattctaaggataaatgaaaattactaagagacacaatttataatgaattcattgaaatattagaccatttcaattctgactttcctatagtttggaaaattcctttagccctgaaggtcaaggcacagtttagtgctaaaaatacctgttagagtttaaagtagggtgagtagagcccatcctttttcacaatttgttatctccataaacaaagctatattgagaatttcctctgcaatttgtatggtatgataaaagatgctaaattcagcagagaccagggtctcagctttacaatctaaaagaacagagaggatagacacacaatagaccacatatgtcaaatggcaactacagataataagcattcagaataggggaggtcacttccagttggtgttagtcaaagcaggctttatgaaaggctttgtggtgggcagtatgctgatgtgcaagtggtaaaacagaggacactacaaatcaaggagatgacactaatggaaatgtagagtcaaaggagtgcaaggctcacatggaagcatatggatccgggagctaagagccaagtgcacagttgttgaatgagggagagaggagaggttactctagtatgccaggcacatgatcttgaactaggaacactgaccatagattggcattgacaaaatgggttgatttttttttaagttgactttaattagcaaaaaaatagcaatgttaaaataaacatttcataattcacaatttcatcatattaacaaagcaagtatttttattactttgtatttccttacagggatttgtccatatggctgaatattttttcctagaagttgtcatacaattttgcacttagatatttttcagtgaacgttataacatcgaacatatctctgctgctttttaaaattttctttgaggaaatatacttccctagaatactaaattagaccgatagcaagagtagctaaaaacagaagtaatttcttgatgagtttttataaacacacttgtttggaaggtccttgagcatatctacactttccacatcttgaattttccagaccaaccctgataacattttttcctatagtcctcccctctctatgactggtacactcagacaacagatttttgtgatatatattaattttattctgtaattttagcaaactgatttggatcacaaatatccttcacttacttgcagtgtgaacttaggcagcttgctaagttctctaaatcttagtgttgtcctctacaaaatgaggcgaataatgatacctcctcctaagattgctgtgatgaattaaggagggcttccgtgacagagagtgtggactgtggttaagaacaaagactctgggaccattttgcctgaattcaaaatttagttctactcctggctctgggaccttgggcaagttatctgacatcaacttgcttcatgagaacaatggggatgatgataataatagacatatatgtactcctgtcagggttgatgcagggaacaaaagagcaaagtggataaagtggcttgtaattgtgcctggcagatgcatgtgctatgaatgggttcattattattacataaaatggttggcatagtatttagatcatggtaagcagccaataagtggtaaaaagtaattatagatgttactttttactcaagcagaatgcttttatcatctctcttaatcaatgtttgttttccttccactaaacctgggagacataaacctagtttatttaacaaacgattatataatatttaccaaatgccaggcactgatgaaagcactttacaaatagttcatttaattttcattaagaaccctatgaaaaaggtactgtcatgattcccactttaaaaaatgagaagcgtgaattacataaaggttatataattagcccaatgtcactgagagactatatgtcaattaatcgactccggtactaacaacagatagaactgggattctaagccagtctctctggctctagagcctacactcttaattaactatggcactgtgtggtttccaagaaaggaaaactttcaacccataggccctttactcatgcaaccttctgggccatatgccaagcaccataagcccccttcttgacacttgaagatctatgggaacaaggcctataaacattcaggctccatgcccagtggtctctatagtttgtatcaccagttctccaatcaccaccccaaacacacatcctacagtggccacacatagaagcctaacagttcaagagatgtctgggaaattccaaaaacagaaggcagatgagaagcagcagggaattttatccatgaatgtcttcacagaagaatctaaatgctgattgagggcatgttgccctccattgaggagagaccagcccctgctggcaggaagctcagcgttgacaacaactactgaaaagaaggcggagagctttgccagctggggatagacatctggcaaaggatcagaggggtgccacgtcaacgaatccaccccagagctggatttaaacacatttcctcttggtgctatgcaagagcttactgagtccactattggaagaatagagctaaagaaattcacccagaagcaaatcagtttcaaagtaatgagggcataactcctaattatgcatcattagagagccctcctgaccagaacataactgaggctggccagagtctagtctgagcatacctttaaagtttaaaatattgagcaactaggttttatttaagattcatgtctccatataagcaaggtgtaggagagttccttcacaatcagctaagtagctcgaatctctgtcacacacatacatatacacacacacacacaaacagagttaaaaaaaatcttaatttttaatcttagaaaaaagttatagagactatttcactttgacacctaaattacaacctacatactcaaggttttttttcatttatagtcaaagtaattacaagctttgatttccctatgtgcccttgtttgagtgcatttaagtagcaatgaaggctgggtttggccctgaactcaaactttcagaccgtgagtttttaagcccaattgtattttgcattcctaaatttttcagttattccaattctctgtcttccttaaggtccccgtaaccgcaatgagttcccctaattcacccaactccaccacactgctccatggctctccccagacaaacttgctccctacccatcctactccactgcttcatagttccccctcagccagctaatcactcatcttataggaggctgcttctgcaccctcattctaatggcccaagtaaattttattctcttgcatatctacctaaccaggcttctctttgattgtcagttttgtatggcccctttatttcaacattctctcaacctcaggtaagaaatgcctcttccatcagacccagccttgtggtaccttcgggggggtgggggtagcaaatggaaccactctgctctcatccccaaagatggacacctgagattctctgctatcagctcacacctgtcagtgagtccagttttcttctttcctaaggggtttagaccttgaaatgatatcatattagtagataccaaagttctataaattgtacagatctaggaatgctgaaatttataaaattaggatacacatctgagccttaccataaatgtctgtaactaaaaaatgtatcaatatatatcctaagacttagtagatgtagtgagacaagagtggaagagagacatgcaagaagtgtgaattatctttggatgactttaaggaaacatttgtccttgtagggacaattgcaaagttaagcaatgggaataacctatttgaggaaccaatatgatggcatgtcttgctattaaaaaatggagctagcatttcacattatgctcaaattaaagcgagcattttcttctatctcaaagccaaatttgagtatgaccttgtacccacagccacacaataatcaagagactacttgttcataagaagaataggctgcaaatgtaacttctattgtcttatcttttcattttttcataatgcaaatatgaccaattaaaaatgtaagtaatatagtccacttatttcttttctatgaactccctaactttgaatttagttagttaaatttaaaatgcctattttttttcatttcaactctagaattcttatgctctcttctgccattctaagtggttattcctcttcatgtttttcctaagtcttctaatacaaatgactgttgttttgaaatttcacatttgaataaattacgtttatgttttatatttactgggaaagcagatagcccaggaaaagttaaaaaaaaaaacttgtataaaataactatagaagactgaagtacttgatgtgcttttctgaatttctatgtccaaaagtaagctgctactgtgtgtgtgtggtggggggtggggggagggggcgggtggtggggagagagagagagtgagagagagatttcattaacttggggaaaatagttttaaaaacatcctaaatttacagtggaatgaagaaaataaagtttctttctctgtaattcccaactctagtaaacagtgtattttctcagagtctgtagaagacaatatagcccagtggctaaagtttggaccttacaactagataataacatgtctttaaagtgttactatgtgtcagtcaaatataacaataaaccaaaaggtagattgttattattattatctacattttacagatgagaaaactcaggcacagaaagggtgcctgaagtcacagtgttagaaaagtgttaaagcccctgttcctcctatccaggttgtctggctccattattcatgctttgaaccactcttcatgttgcttcacttaacttgtaatcctggctctaccatgtagtagctgtgtggccttagagaagtactctctctgagccccactttcctcatctataaagtagggaccataataaaatatatttcttgtagtaggggctcaatatgatttgtcttctctaatttaatttaatttaatttaattttattttattattattatactttaagttttagggtacatttgtgatagaacagttgcctgtaaaacatatatgacagcttttgtgaacatttaataatggacaattttgcagagcaaatcctaatacggaacaacagagcactgcatgcacatatgtatataaatatgtatgcatatattaggccatattttcctgaattatttttgcaaaatatttccacaatattatttggtggcatgttaaatatactaagcacttttctaccattttatatacttttccagaataaattccttcatcatttcctttttactttctcttgtagtctctgttccactcccatcattgcacaacaattaccctattcgtgatcattgatatcttttagctgccaaatatactggtctctattggtcttcatctggcttagcttttcagctaatggaagatgatgtataatgggtgttcagtaacaattcaccatcatcacaacttatagttaattaattacacataattaattacactgtcctaagccaggcacactctaaagctctttttggtttgctggattcatctttttccacctacctccattacacatataattccccaaggttctgtcctcagtcctcttttcatttcactgttttatttacacttagggaacctagatccatctcttctattagggtacatatactttaaacctgacctaatcctgaattctagacactcaattccaaacctctggacattctacatgaatgttgagaaaatacctgtaattcaacatgacaaagcagaattcacctcctacaaaacctgtttctacttttgtatgctctttctgttagtggcatcctaatattcagatcttccagaagaaaacctcagaggtagtcttaacttctctctctcctcaaagtctagtcctcaaattctgcttactttacctttgacttgccccttaacctcctcttcactcctgctcttctctataactggtcctaattacttttcatctgaaccactgtagctgtatttgtaagccattcttccttcctcctgtcatcattttcagtactttctgtttgctgccatagtgttctcttcctaaaactcctttagcgttatgtcacttcatcactcctctatttaaaaacctttaatagtttcatttaaaataaagtatatttggggggaggtacatgagataatttaattcattcaaataatgtacaaagatcaaatcagggtaactgtcatatacatcaccttgaatatttgactttatgctagaaacatttaaattattcccttccaggtattttgaaatgtacaatagattattgtaaactatagttaccctatatatctatagaacactaggtcgtatttctttttaaaactgtacatttgtatccatcatcaacctctctgcatggccttacccctctactcttcccagcctctggggactgatctattctctatcttcaggagatccactttctagctcccacatttgagcgagaacatgcgatatttgtctttgtgtgtttgtcttattttacttaacatgatgctctgcagttctatccatgttgctgcaaataacagaatttcattattttatatgcctgaataacatttcattgtgtatataacattttctttatcaattcactcattgttgggcactcagttaattttatattttggctattgtgaatagtgctgcaataaacataaaaatgcagatatctttgatatattgatttccttccttttggatatataaccaagagtggaattgctggatcaaatggtggttctatatttagctttttgaggaacctctatactattcttcatagcatctgtactaatttgcattcctaccagcagtgtacaagggttctgctttttatatagcctcatcagcatctattagttattctgtgacttttcgataagagccgttttaaccggagtgagatgacatctcattttggtttcaatttgcatttctttgatgattagtgatgtatatattttcatatacctgttagccttttgtatgtcttcttttgagaaatatatattcagatattttgctcattttaaagtcagattatgttttttgctgctgagttatttgagccccttatagcctcatattcaaagtgctccacagcttagctcctctttgttaattgtgttcaactttcaacctatgtctcatgtaactatcaccttcctccacatatccagatatcctgtgctaacagtttccccatgaaagccccatattttctcccttcatacctttgctcatgttattgtctcagtctgacacaacctccaggcccctccctaccccccgtcaaacctcacctatccttcaaagcaaaatgcaacttagagcttgtttccctgttcttgtaggatgcctttttctgtacttcatttggtacaaaatacagtctcttgtttgaattacatggccagggcagcagaaatatgtcttaactatctttatgtttcttacaacttctagcaaagtagttctatgtacatagaaaatgtccagatattgaattattgaattattaaattagtatatatgacaacaataaaaatggggctcacagacttccaaatataaagaacgtaattgaccaagggcccctactactgggttcggagctctatgctgcatttgtgctaggtcatgccccttagagctccttccagcccattgtaggatgtgacagggacactaaggcaggtccattcctaggagacaggaggacttatctgacagacaactctgacatacagctatgctgagcctccttacatcacacaagagtcaagggcacatccacacaccagtctctacttctctcccttactgctgctcttcctaccaatgtctggcatcattctcatgctctcctagctttctccagttatctctccatttttctcacacagatatttcccctaataaaatacttacaaatttaatcccattttggctctgcctctaaggagaccaggactgacccaatttcatgtgatgtaactatacactttttctgaatttttttaaaccctgtgctacgtaaaccttgccttagtcactactttaacaacaagctcaaataatagtaataataatagcaacaacaattaaccttttactgtatgtgcattttctcatttgtccacaatgagaaaaatgtgactattattcccaccatacaagatgaaaaaagagtgaaagagggtaacttgcccaagtcacccagttaataaaacaatggagccaggacttaaacccataaaacctaagtccagaatataatacatctttttaaatactacactatgctgttaagtaattgacctgctaaatcaactatgttgatataagtttgaaatctttgcatccatttaaaaagttataaagattcaatttattatctacatagctaatcccaaagtgctcccaaactcccaaacagtataggataagcatggacattatatataactatgattcaggaaaatatttttgctgctacaggcattcattcatttatgagtgacaaccttgtgccaggcaagggttatgataataaagggcactattctctctttaaagaggtgaaaattataaaaagagctcgatttaagccaatatccaactttaaaatggttctaaacatctgattaccatttaccatgtgattgtcacaaaacaactcttgaataaaaatttcacctctctactcattcctgtatattttttcttgatttaaaagcattgcttttaataagtgtccctctgtcaggaccgttatgatttcattggtcagaaatggctaattagaacagaaggtctcaagcatatctccaccttctggcaggtgtcattctgtgtttgtcagtcacccacattaggaaatggagtgggtcacaataaaggtcaaatataaatgcaaaatgactgttgttaaaatctcaaacaccaattaccatttcctggttaccttggttgcactcatgcacatatcaaaatattctattaactcatgaagtagcagagaatagtgcaaagatggactttaacataagacatatttgggtttacatcctattctaccacttactgactcaaaagataggcacatttcttaacctccctgagcctctgtttccttatttgatatttattgtgagaactaaatgaggcattttaaggaaggtgtcttgcattataagtagatgcccagtaaatgccttttactatcattacaagtctatctcccttgccaggctggcagctccttccagacccatcttaaggtcatatatcctcagaacctgacacagcacctaacacaaatagatgtttaataattattcatataatgaattaatgaattatttgtgctctagatagtggactctaaagatacaaacacatgggtaaccttctggaccaaagctaccttcagccatgattcataaaagcaattctaataactcttgaacctaattccaaaatgctggcttactctaaaaggtcaatatgcacaagtttagaatacaaagagaaaatttctatctgtcatcttgcaatggcatttaaacataaaaggcctggaaagtaagggtggggtagagtatgacaaagggaaagctagggaaattatgagaaagagacaaaatatgtaaaagcaatggtgatttcatctttaggaaagaactcacctgaagcacagattaataaatgatagtagcaaccacctacgtggtacttttcatcctcaaagctctggatcaacaattaacataccttctttgcatgtaaatgaagtacacagatgtcatttgacaggtggatggtggataagtagagataaagatcctcaaatgtattcccaatgtcatctagaaaactcctaagaaagtcaaggtggggctcagggtttatggtcatcacacttgaccttctttaatgataagatgatgtaaagaaaaaaaataattctatgacagagtatgacaaaaagaacggagagaggagaaagacaaagcagagataaaaaggagagaagagaaacaaacatttactgagttcttatgttacttagtatacgtattattccacttaatcctcaaatcaatccttggtttggatttatcgtcagaaaactaaggatgagaaatggtaagaagtttgtccaaatcaggcacctggtaaatgaaaaacttggaattcacgcccaggttttcctgactctagaggtcaagatatcctaatatccttatccacaaggtatccacaaggtaatgaaaggaacctgatgccaggagggagtgagcacatatgcaggtatctgcacacatgagtcaaacaagatcatggaagggaaacaccaagtgcaataacccaattggccactattccagttatatgcaaaaaaaaaaaaaatagtttctgcttattctttataaattacagaattataagcccaatttgaggcttataatttacataagattataagaaaaactatttcccttgttgggatagtttgaactatcccaggcaggaaaagtaaacattttatttcatcttcatatcctcagcactgttaaagggatcaatgactatttcagatttatagattaaagattgatttttccagtgcaagtagacaccagaacatagtactctggagttggactacctgggttcaaactctgactcctctacttattaaccatgtgtacttgagctaattatttgatacttcctgcctcagttccctcaatagtaatatgtgtgtcaggagataataatgaagattgagtgagccaaagaatgttcaaatataaaatgttagctatttgtcccattataaaatgcatcactcagtttttaagtctggttctcttatcactggactgtgctaactccccatgtagttttgttaccctccatagaacaaatagcactcattttagttttgaccaaaaagagatgtcattgccaagaaatgaacttgattgcttttaaatgtcatgtcctcacagtgagatataccaaattgctccctcttacttccattcaagtatgtgtgagcaatgacttttatttaaattcataatggcatttactgcctacaatatgatagatacagacagagcagaatgataatcagcaagtggctatcatttgatcctgttttattctgttcactttccttcatccatctctctttacaaataagaatctaactttgtcactgataaaaatttacgagactattacaaaggtattctgaagcttatattgtgcctttaaaataataaacaataaaaaagtatcaaattccctagaaatgatgcagatggtagcatgtggttagccattttagagcaagccaaatgccttgctctaaaggcaaaccacagaagtgggaaatcctccgtgttacttgaagacgtgaaacataagggtttgtcaaggtttactaaactctaagtgaaaagatgggcatcgaggaaagggcttttgaaatattaaagaacaggtaaatctctgcagcactattgatttcaaaagcacgtagggaatattcagaacaggaagaaaacatgaaaaagtcattgtgaaacattgtgcataccatctccactgtcagtgactttaagtagaaaatacagtatcagctttaaaaaaaaaatgcctcactaagggtattttattgatgtgtgttcatttactagaggcctcttaattctcatgggttcctaaaactcagaaatcctacaagtgtgaatagtgttttataagcaaaattaatgtcttcattgctgaatgtgatattttagcctttaaatgtgccttattagcagggttttataaaaatggaaatgtagatctgttaccatttacatacttcagcttggctgaccttaagatattatttcagtctggcatttatcttggtatcataaagcaagcactctcatccatgcatgaattccacatcacaatttatctaaactagccaccacctaagatttgaatgtaaagacctagtcaattaaataaacactggaaaacattatactgtttgctttcagatttattataatctgacccattgaataagaatgatacatgttgtgtgtgtatgtgtgtgtttgagacagagagaggaaaggcaggatttgaaaggatactctgccttttcttggttaatctcagacatcatttctgctagaaatagtcattttgtttccaaacacttgaagctaattgctggtttgctaggggaggataggggtgttatttccaatgacactgatgctgagcacagttgtttcaacattctctcacagtcaccacctgcctctgtaaggcaagtctgcatagtgggagagatggtgtagagaaaagagtgtcaaactagaaatcagaacacccgggtgacagtagcattaacatttattacttaatttgtggccaaaagcaattcaacccctcaaaaccttggcattgtacattaaatacagaaagttgaaataaacattactgaaaaaaacttacaattctaaacttctcttgtaagaatcatttgcttggcagaaacagtgaggcccacctatattttataaatgagattaaaactgaatcgccactgcttttgagctctgaatgacactgactgtctggcaaggtagaattgaaaacatttctgaattcatttggaaagaaaacgactttaatatcctggaccttggaacaatacctttaataaacaaggctgttctactttggactgaccaaggaaaacatttcaataaactactcatctatataaagaaggttctgatccaagcagttctgggggaaaaaaaagatgtagtgaaaaaatacttgcttttcttatttagggtaatacaaatatacagaaaaaactgaattccagaaagagagtatgaatactttagttatttagtataaaatcaaagtccctaaatattttcagtctcttgaaaattaagaaaccagtaggctataaacaaagtttttctactctccattctctgggaagtttcttcatacatctatttagcaaaattttgatcatctctaatatttctgacagtgtaccaggcatataaagataagtcacatgtggacctactcctaaagagctgacagtccaggaaagcagacctgtgaacaagaaattattgtgcaatgtaataaatgctttgataggcatttatacaaaatgtaatagaacacaatggattaaggtggacttattgggtctagagttctctaagaatgtaacattttataacttgagaataaatcataaatcaattgtggaaggaaggaagaaggggatgctattctttcagtatgacatagcactgactatgtgtcaaggagtgacaaagacaaatactgagcaactaattataagaatgatgagtgaagcaaaagagaagtatgataaaagagcatctaacaggacaatctagttagactgggaaatcatagaggactattccatgaaaccttacaagctgccttaaggaggatgagtaggacttagctggtcataaagccaatgacactagcatgactgaggtcctgatgtgtgaggaaggatggcttgctcacaaaactcaataaagaatatggtggctgtggagtagattacaaggataaaagtagtataaactatcagaaaagtcagcaagcaccagatctggaaagacctcataggccacaggaacatcctacagataatagattgggatagaacaaccatggaaagagatcagttatcacagtagtccaaaggagagatgatggtggtctggactaaaatggtagaaacaaggataagaagatgatgataaagtcaaataagtcagaaaacagatcagaccttggtaattgaatgtgagggataaagaaaaatgaggcttttacgataattccagggtttcttcaatgagaatctggcaggacactgagatagaggctactggaagaaaactacagatggaaaggaggtaacatcaagtgtatcatgtggggcatgttgtacttcaggtaccagcaaggcactaaaatgagggtaccattgagcagttgattaaaatagctttagacatcagaagatgaatgaaagttggaatagtgataagtaaagtcatgggagtggataagagtgaatttgaaactgaaagtgtaaaacacatttacatacactgatatagaataccaggaaactggagaaagttagagaggcaatagcctagatatcttggccgtgccatgagatatgacagagtccagagcctccttctgaattcatctaccctatacccttactacttatccccttctcaattttcattctgccagagagccccacagagcaaagcatcaaggtaaatcaaatatgaactagcgcagtgtatcactgtgtagatcacaaatattcaatgccttaaatacgtccacttagaatttgtatgaaagtgttcactcattcatttgttcaacaaatattgatgaagcacctaactatggagcaagcactgttttaaacactagagatagaaaagtgagcaaactctgcctctgagagtttacattgaggtagagatactcagacaacagtaaacaaacaagaaacagaggatgagagttctctgtgtactatgagagaaataagcaaggtaacaggagcagacaggaggctgatttaggtagcttgatcaagcctttgcttgcctcaggccccaaagggaagctaatactaccatatcacctgcctgggccgctaacacacaccttgtttatgtgatcccattctttctcactggtgatagagacagctgtcctctcaagaatccccattgctcagtaccaagttggtaacaaattaatctactgagcagaagagttcaaaaggggttgtacaggagcatagtatttaacagatgaaagcttttagcatcccagccctcacgctggtttgttgatgagtttttaatttcttcctcatggcttctaggatgaaataccaagtaagagaaaaagcaagaaagtcattcatttgacccctaaaaacctggaaatttttacccttccctgacacaaataaaaaagaaatctcatcaaataatgcctaagtatttctatagcatatattcttccatggaaagaataacctatttcataatagacaattgtattattgttctggaattccaatttggaaattcagatcttaggccactggattaatactaaagttaaacatgaaaaaatatgtaagtacttgggttggagtccaacactgtgctttataataagatctgagaggaatcacaaaacctctctatcatcgagccaaaggggttaaatgttcaccactagacctttgttttagtgttatctccataagatctctattaaaatgtatttgttaccttgtcaaggggatgataccaagaaccaatgcattttgaggcaaaagtgaaaggctgagacagcattgggaggcactttgtaggcagaacagattcaggtggcaaatgccacaaactgtgacaaggcagtgtgatgtcattggcaccttgaagaaggaatatcactaggaagcatggaagataccaggagaaacattgactcctggaaactagaattggcagaaccttaaagttgagaaggtcaaggctctttcttgaggaaaactgggtccctgggagaaaaggtattttagaacatagaaactgaaaattgaaagaaactcttgagattgggcacaattctcaatattactcagtcataatagaccccagagaggcttctgaaaagtacagattcccagacccttccccttcccaccaccagcaactttgattcattatatcttgggttattctcagaaaactttttttaaaaattgaaataccatttgacccagcaatcccattactgggtatatacccaaaggattataaatcattccactataaagacacatgcacacatatgtttattgcagcactgttcataatagcagagacttggaaccaacaaaaatgcctgtcaatgatagactggataaagaaaatgtggtacatatacaccatggaatactatgcagccataaaaaaggatgagttaatatcctttgcagggatgtggatgaagctggaaaccatcattctcagcaaactaacacaaaaacagaaaaccaaacaccacacgttctcactcctaagtgggagttgaacaatgaaaacacatggacatggaaggcaggggggcatcacacactggggactgtcggggggtggggggctaggagagggatagcattaggagaaatacctaatgtagatgacgggttgatgggtgcagcaaaccaccattgcacctgtacacctatgtaacctgcacgttctgcagatgtatcctagaacttaaaatatgataaaaaaaatccacatataagcaaaaaaagaaaaatgacttatctagcaaatttgagaacaactcctctttacgttgtaagaattccatctattcggtcctttattcatcatgcagcctttggtagtcttaacatgctagttctaaggtcacagagctcactaattagagggctggaatttatgatcttaatataacatatttattccaccttttcactcatttcaaatatatctggagttgacaattcttagtgcagccctaatagccccaaatgatataaatattaatattactcatactatggaatttgattttgtgcctggtaaaatttgtttttttaaatgacaattagaattaatagataatatagaaactgtatttcctgaatgaatctctagaaggtatttcattcccttattctccatatgggcagaaccctatgaaaaataacatctcctcttgagttctacatccataaaaaaaatatagaatatagctcaggtgatagatataatgatgattaaaaggaaggaaaatgacacctgtgagaaaaggtaacagaaattggaattacctactctagagaatgctggcaagtgatattcttctagtacatagagaaatattatacataatggtgactggctgagccccattttaactgccagaaaattttttaaatgggcctgatactcatttctttctctgagctaaacttaaaaagaattaaattgatggtaagaaaatgttgataaacatatgatctgattagcaaagatgaattgtcatccactaaatgattttttaccaaacgagttaaaaaacaagaactaaactaaactaaaatatatttgcagctcattgtgatgatgtaagttgtgagactattcagtggctgaggccacagggcagttctttgagggaacatgatggtgttgcctgggacacttaacaaaactgattacaaaatgtcatttaattaagcaaagagaactctgaggactttaaagttttctctgcccctagttgcagtcttcaccttgttccccagctccaccctcatactaatatgaatcataggaggcatagattgtaccaagctgtagtagtttgttgaaccctcctggctgaagcacaatgcaagattggtgttaaagaccatggtagtaacgaatgcatttcaaataacatgtgtttacaattatagataagcactgcaggctcattaactataaatgaggtaaatctgaggagaaatgtagttttcttctagacttcctggaagaggtgtttttgtcaccatttcatagcctttgcagctattacttagaagataaaagtgggatcactaacatttcaattaacgctttccaataacatgagcagacagacactattgtgtataaatcaactgtatctaagatgatgtgtagataaataggttaaatagaatgctcttatcattcttgaaaataaaatagtaggatggttgctgattccctttacaaacacgacatctataaaactgctttcttcctgaggattgttcaataggagtgcctgggaaagggctaggaaataactttccaggcaaggcactaacagtagaattgaactttcattagtgcagagtgtaaccacaaggcttcagctcatattgtctaactttacagcttccaaaaggcctgaattgaagactcaatttccatattgcagagttgttttcctaggagccctttacattatttatttttacagtaatacgctggagaactcagtagcaagtagaccaactgtcccatggttggaaagttatcctaaatgagtaccaaaatcagctgaatcagtgttcctaacattctaatgaacatctgaaacacctggcaatattgtttaaactatagattctgattcaataggcctgggatggagcctgagagtctgtgtttctagcaaatcctaactgatgtctctgctgattcataaatcacactcttgagtggggagggttagattatttgcaaaagcctattcagtttagcactcacttgatgatcacttactctttgccaaatactttgggtgtggtcttctaacgttgcctcattaaaagactacaatattatttacagaatatacttcagtttgtgtggtggagtttaatagtattactaaacttcccacatcaaacaaacaaaaaaaatctcctgaggtttatttagggtgattttgtggaattaaggtggatcctggacattagcattaccagataattcttatcattagcctggaaacacttcttactattaccaggggatgtatgcattggagttgccaagaccttgatttgaatcctcattctttaatttcatggctataactttaggtacatttcttaagttctctcttctttgattttcttatctagaaaactgaagaaacaatactaatctttaaggattgatttgaggattcagcaaaataatgtacataaaagcctaagcacagtgtctgacacatagtaggtgttccagttactattgctgcataaagatcacctcaatctgaatggtgttgaacaaccaatctcacagtatgccatggattctgagagccaggaatttggaaagggcatgatagcctcagggtagtcagacttttgatgtgatacctcaaggcttcaagcaggagtatgacaatgacaggcggaggctgcatctttcataacctagcctcaaaggccacatagcatcaccctcaccacattctatttgttacagcaagccctcctatagtcaggaataggagaatcagactcccactatcaacaatacagcagcaaagtctcattgtagaagagcatgtaggacagctctctttggaaaataaagtcagccacagtaggcaaacaattttctcctccttttggatggaaaactttctcttagttggcttgggctgctgtattactatagactggttggcttatacaacagaaatttatttctcatgcttctgaagactggggagtccaagaataaggtaccagccaattaaagttcttataagggccatccgcctggttatgtcctcacatggcagaagaagggggaaggaggaagaagaggaaggggagaaggagggatctggtttctttctcttcttagaaggacactaatcccatttataagacactgccctcatggcctaattacctcccaaaggccccacctccaaatatcatcacactggggattaggcttcaacctgtgagttttggggtcacaaacatttagaccatagcatctatcagatagttgtgctagagtgacattgttcagtatctttgcctggcaaaaactatcttgggtctttggtcctccagaggtcactctttttactaattgcatttctgtctagctcttagtccaagaacacctctagcagttcttagtttacaatcatgactaagtatattcacagaggtgttggccctcaccccaaagtgtgggcagaggccatctccttcagtcatgggaccttgtggtcattacagagattttttaaagcaaacaacagctctttttcctgaggctgaatacatctaatttctctggataaggggaaatgatggcaagctccctgatggcaagagacctaactctgattatcctcatttctagattgaaattatattgcaatatatagttcagagttagtactcaatactgtttcatgaattcagttcaattctttgtgttctcatacaactttctttcctctccaaattcttttctgaatctggttcaccatcactaaccatttcccccatatttcccccagttggacctttaaacagcctatttccattactcagagccatatagaacaaccacagaagtaccacttttcactcattttcctcatctcaaataagttacttttcaagcacatagttaaaaatgaaagcactaagaacttctttaaagtcccattaacttcgcattcactgttcagctaatctgagaatctattgccaattaatacagtcacttcctcttgtaacactattcttaacagaactggtcaatctccgtcattcaagagtgataactatctgtcaggagaggtctcagtactggcaataaggaacaagtttgaaatggacaactttgacattgcagccaggatagaggcagggggagaaaagacccaagtgggaatcaaatacaagtaataagcaaggtcccaagacccagtcagggatagaaactacagattaggagacaattcaagttagaataagacacagttctctttcctagggaaattaaataaaatgggcaggaggaagataaatacaagataactataacacaagacagaagatgatatagtgcaaaaagagacaacagagtcataggaaatttgtggaagatcttaatggaagaaatgtcattttaaccaaatatgaccctatccctcaggagaaaagaaagctctttagaaagacatgcaaagttcattgtggtctactccctagctatagctcctctcccagttcccctaccccagccccattcatatatattccatctacttttctcctctggttaactcccaaatcccaaaagttcttgaagactcccttcagttatctctttctcagaaaagggaattagtgactaagtctctgtttctgtcagcctattatagctgagcataaagctcttctggcacatagtacagaacatttgtatttaccatatttactcatcttattcactagacagtaaatttcttgagggcagaaacctttttttatctttatccttgtatgtttagtacaatgcttgacagattatagcactgaccaagcagatgtttaatatatgaatgagaatctgaagtcaaatcagaagttagatcaagtgagaaatattttagcaaagaagattcagtgagaacttactgtttttcagtccccatatgtatgagtgtaaatgtgtatgatctaaaccaggagtccacaaacattggcttttgtaccaaatctggcccgccacctgcttttacacaaacttgtaatggaacacagctacactcctttgtgtgttttcaatgacagctttcatactactaggtcagagttgagtagttgatacagaaaccatatggcctgcaaaacttagaatatttattatctgacccattacagaaagtttgccaacccatgagctaaacatcaagaggtggaatatttaaaataaagtgtattgtctctaaataatatattctgtagacaatttatattggctcaaaaaagaccatttttttcctgtgaatatccctccatgtactctctactttttattattaccacattaatacaaggcccagctccatgcctgtctcccccattgcttagtctcctacaacagatgctgtaaaatagcatgcacaggagcctagactctgccctctaggaacttagaattaagacaacaatgtaactggcaggagcattctccatcctgtaaaccacagactatcaaagacagtatatgtagcagaggggcctatcccatggaatacagagaaaaacattaaggaaagtcagatatatttgaactattcatagttttggaccatcactttcttagtctactagaaagttttaaaaagcttgactgtcttaagaacttaggaaactatagtcaactcagcctcatcccttccttctccaggcaatggggctgttaagtaaatcaatgaattaaaccaggcaaatcaggtatcacatttgaaatcttccaaagtcctggcatggtgctgtacagctgagtaactgcccttcacctcatcatcttccctcctcttgacaggcttctgtttgtcctaccactttggagtactcaggtgtgactttccccatatgtttactgtccttcatttgccacacacagagcagggcatctatgtccatatctgatatgttggttgggattttatcatttagctagtgagcaggtagtgaaactggtaaagtaactgcaatgaagtcaaagcctctcacagtgaaatcagtggtaaagatacacaatgattgttacagggcttgtggtgatacacagggtccagagaaacttaattcctttatttccaggggagtttttgttgatacaccaacttttcctagtataaaaaaagcaccttccaagataaggagttgacacttgacttggtgaatttatccccaaagaagggggcactcttttgtctgctttcgttccacctttgtagaatgagtccagatgcaatcaccccaaattacttctgattagcttccttttgtgagataatttcaagcagattttttttttagttgaagaatgctgatgacccttagatgtagtatggtgcaatggttaagagaaggattcccaagctggactgtctgttcaagtctctcctgactatagcaaagtaatctcttcttatctttgtcatctgtaaagtgatgatgatagtgtttactgcttgaggatgttggaaggataaagcgagttaatatatctaatctaacattcttagaatagtgtctggtgtataacgtgttccatttttttaaagagagtattattgtgttacatgttattcagcacagaagtgacactgtcctattaatagcagaaaaatatttttgaacaaaatgttagtttatgcttctaattccaaacacattctttactaacatggaggaaagctaatatttctaaattgttaactttaccatttttcattagcaataaaggaattcacttatggcttatgtattggttgtaatttaaagaaaattaatatatacgcatatgaaattatgtatgtacatacacaaacttttctaacaggatctgagtgaattatttgtatgttcttatagagtaacaaataatttacaaatcacacagaaaaaaagtcccatatttctcacattgctttgatcataaaggattaattacattctttcaataacccagcataactacattactattaaaaatggcataactcggccgggcgcagtggctcatgcctgtaattccagcactttgggaggctgaggtgggtggatcatgaagtcaagaggtcgagaccatcctggccaacatggtgaaaccctgtctctactaaaattacaaaaaattagccgggcgtggtggcaggtgcctgtaatcccagctacttgggaggctgaggcaggagaatagcttgaacctgggaggcggaggttgcagtgagccgtgagccaagatcacaccattgcactccagcctgggcaaaaagagcaaaactctgcctcaaaaaaaataaaataccataactcagccaggcacagtggctcatgcctgtaatcccagcacattaggaggccgaggcaggcagatcacttgaggtcaggagttcaagaccagcctggccaacatggtgaaacccgcctctactgaaaatacaaaaattagctgaacatggtggcacatgcctgtaatctcagctactcagaaggctgagacaggagaatcacttgtaaccgggaggcggaggttgcagtgagccaagatcgtgccattgcactccagcctgggcgtcaagagcgaaactctgtctcaaaaacaaaaggcataacataactcatagccatagaggaaagctattaagaagtgtaaagggcttcactagaaagggatggcccagcagttgacttcttaggagctcatttttccagcattgcacctgttacttcatttattttgtgcaagttcataaggaaaagtagcttttcagaaacatattcccaaattaacttccaaaataattacgtaacaattattggtcagaccaactttcttccaacagttttagtctcctagatcttaaaaataggccgttttgcatgctaacctacattccttgctttaactctttcgccatttattttctaaaccttagcattatgttttccactgcaactaatacgcagggaaaaggaaactttgagggtcacttctaatcttctacttgccaagtactcacaaaatggccttttctctgccctcattttcacggaatctgctaagacaatttaatagggtcagctatcactatgtcttgacaaacctccttctatgactacccttttttgaatgtccctgctctgtctcctagcccggctgtgttttctgtatgtccccctcaaatctaggcattcttaagtttccatccttggctgccatctgtaaaatgccacctttctcaatgagctcaattagtgctatgatttcaatcattacgacaagcttgactcccttcctaacctctgtagagctatgacctgtatttccatctatcttttggattcttttgattgaatattggctgctcgaattctactactgaattcatcatattaccttttcctttctcaaacaagctcctcctcctaactttccacttttagtagttctttcttttagtcacctgggtttaaatcctaggaatcatctttgatttttctctctccttagtcattacacaaaatccattaccaaattatcttgttccttcacatgaaatggcattaaattctgcctccatgattctttccatgtccctgcaaaactacatagatcttgcttttattaaactctatgaaaataacaatattcaaccagttttgatgaataaaaaagctaattttacatggtttaacctaatatactgccggattatttggtgttatacagatttgccttctcatgtgatcttggacaaattatccctttcattcttaattttcttatttaaaaatattgtcagattggattggctatacctatctcctaggatttttgaaaataggtttgagagtgtaaagggtaacagcatcatgtatgctagaatgtgaacatcttgatggttacctgtgtcatgttccaggaataattattcagctgccccatgaggaacataatggtattcaagtaactattaaatgactgaatgactgattcaatgaacacatctaagaatctgaacccacatcttaatttttttttatcttaaatgaccaaggctagtgactgagtctgctttttattttttatcaccaacgcctaatacaatggctagcttataggaaataatatgtatttgttgagcttaatttaactgtatttttctaaggtattgaggattggtaatttataaacactgaataaacctagaagtagaaataaaaattttatttctaatagctactttaacgaagcactgagatgttaaattttaaagatgtgaattatattctatatggactatcttttgcttattcaaaatatatgtattaagagccttccatttttaagaaatattgggaaacacaagagtataaatgaaaaagtttctgactgtaaaaagcatatgagttagcagacgagaaaaaaacaaataaattttaacccaatgtgtactaagtgccttaaaaacagaaatatctaaggcctgtattatcaggactcaagcacatacaagtaagaggcagatccaaggtagggcagaggaaaagtctcagacagattagagtgggggctggaaaaatgaacctggctatagaggcagttgttagtgttcaaatagtatagcaagttcagatatgattcaagcagagattttagttcagagactatagttcaaccaatacggcacagtaataatggtgttaagaacaaaaacaataataacagctaatatttttgagcatttactatgtggcaggcaatgttccaaggattaactaagttcatcttcacaacagtcctatagactagatattaacactatgccaatttccacacaaggaacgtaaggcttaaaaagattcaataagtttccaatggtcataggggtagcaaatggaggagtaagtggtaggtggagaccaggaattaagtaccaattaaagtgaagtggaaaataattctggaatatcatttatttcacagaagaatagagaggtagccaaaaaacatttagcacctcacacggcaagaccaagggactggcatgatctagatcagttctacagactccaaacatagtgttggaatacaaacccagcaggaaagtaaaattctaaacagcaaaactgaggcagaaaagcgctatatataaacagagacactgtgggggaagaagtgatggggagataagaaaggctgagatggccgggcgtggtgtctcacgcctgtaatcccagcactttgggaggctgaggtgggtggatcacgaggtcaggagatcgagaccatcctggctaacatggtgaaaccccatctctactaaaaatactaaaaattagccaagcatgctggcaggcatctgtggtcccagctacttgggaggctgaggtaggaaaatggcaggaacccaggaggtggagcttgcagtgaggcaagatcatgccactgcactccagcctgggcaacagagcgacacgccgtctcaaaaaaaaaaaaaaaagaatggctgagatatagaagctctccctagactactggattcccattgacaaaagaagggctgagcttagactcagaaaattatgggcttgaggctcttgtcattcttccttcctgaaggtaccaggaggactgggcatgaagatagggaatacctgtaactccaaaagggatgggccaactccaaaatttaagagtggacaaatgttggagtataagaggacttcatggagaagataagagtttatttgagtcttcaaggagtaggaagacttataaggacagggaaaaaggtttttgatgaagcaaagatgcagcagcgaaatagggagtgtcaggttctaacagatctggggggagttggtgggtgagtggcgaatagctggaaaaacactcgaagaatcatggacagtttcaacatgactttaccctctctctgggcacaagcgagcctaggtgcaagtgaacccagacaacagcctgggcacaggccatatgtacagcattagcagggtaattacaccttttactgacactagtggctccaagcgaagcacgagctcatgtaagtgatcatctaatactcctcaagtgatgtggttacataataagcggagctgtgtgcctgcactccaaactcgctgagtcatgctgaaccagatgtctgccttggcctattcttgactgcagcacatccattttccttacagggagtatccagttttactgagactgtgtttatttaggaaagtagccaaagaaagtaggggggagaaaagacatcagactggggactccaaagaatacctgataggctataaggagccatatttagttctgagacagtgggaaggtattttcttctacttctaactgtccaagattgaaaaaagaatgtgttgaaaaatcagttaagcatcaatatacagtgtatattgttctaagccattttgatccctccatcatccccactgctcactggttttggccattcattgttgaattagttccttttctgggagaagtattaggcaacactcagtctatcagtcctgctacttattagcaattctgccatttgaaactataggttaaaatgaaatttggagattatttctggatcccatatctcttccctatttctgcacttcaataacatagaattagtcataagccattaatctattcagacatgttagggttacataattcaaatatttatttgtaaagaataatatcctcatattcccataaatgtcacacaggaagtctctcagcatgcagcctcaaaccaagcaaaggcctctgacaatataaatgtccttcacagacaaacatacacacagacagatgtacttctatcccctgctaattttagaaacctgatgaaacccttattacacttgtcctattttcctgtatctttctctggcctatcatttttattttcatttccacttccatagtcccctcctcatcctcctctatattcccccttcatcacatacaccagcttagtcaaatgaagtcacaattttttcttttatacacgcaccccaatttttttctactacacttgatagaaaatatgtaaatattgtaaaagctcttttctcaaatttaaaatgtgtgaaggcttattattactattagtaatggtctcacacattttgttaaaatggttggaaggaaggcaataaatggagcaaggagaatagtctttatttgcatatgaagctggataaaagtttaaatgtgatagttaagcttaatccacaagagaccatgcctttgaagagattgtcttaaaatagctggaatgggaaagagcgactagatgtggttaatgatgacaggatcttctttgctgttattctgcttcttcagccttcagtcctaacttattaacagcagatatacctgctgtagatctccacactcctcagtacaaataaatgctctatgcaaaacatttgttctagacctcacatagaatttgtaaaatcaagtagaaatttttgaagtcagacaaaaaaaaatcccacttgttggcattatactttctaagaagctttatctaaccaccaattgactgtgacttctaattcttcattattaagtttgtctactctcttatctccattgttaaatatttgctaatatgcatgcaaacagttacaactactggaatgatctgaccagcaggtttttaaaatatattaattatatttttcagtgctccatttataagcactcatttggttttcataacaactctgtaaagtgggtattattgtcctaaacttataaataataaaaccatgtcaaggagctactagttcatacaactacgagtggatgaaggatcaaataaagctgtctacaggtttgttttaatacacaacactgcctttcacaaacaaaaagaagtctttcataatgggactaagtaccattttaccataaagacttcaatattcgcattattactttatataaataaagtttaaaaaccctgcagagcactttctaattctttgaaaacactcaaattgtatgtctatcctcaaagcattagagagaagcagcacaggaattaatcacattttgcagatgagaaaactgagttcaagtgaaatatagacttgcccaaggctgtatggtcattaagcaatgagaccagaactaacccatggtcttcctagctgactttttccactgtgtttgaagaagtcaactttgaagtgctgagctgaattgtgcttcaaattctgtctgaaatgtactaatatatacagaaaaatattcatatggtaccagagagagctggtgtaggggagaaaagctaacggatacatggtgattgttggggaaggtgttgtcaagatcctcatgggaaggcaggtaggcaaacgaggaaaagatccaaagtgatcttcaggggccagatgctagttcattcttcctgcaggtggtgtgccttaactcaaagtgggtgaaaaaggcaagaattacttgttcagttaaatgccaatgtgattaatgtagctgccaaagttcatgaaacatttctctattggtttgtaacaaacaaatcccaaaataaataatgtctcaacacaaaagaaagttacgttttgctcaagcagattccacttggggttttgagacagagtcgtgctctgttgcccaggctggagtgccacttgtgtatttttaagggaaacgtagcaattcttcaggcataatccaaagagaccaggtgctttccatctatggctctgccatcttccacatgtggtttccaaggccttatgcttgtcagcagttcagccaggaaagaaaaagagcaaagaaaccttccaggggaaggtttacatgagacatattccgctcatatcccactggtagaatcagtcacatggccacatctctttgtaaagaaggctaggaactatgatcttactgcatgcactcaagaagaggagaaaccagatttaatgaagatctaacattctcccacagctctgctcatagtgctctctttcataaactaaaatttgcagatgtgtgtttccttaaaatttaacccatatctaatgagattctccagacaggctcatcaaaaaaaacaaatacatttatttttaccattgtgtcagaagtcctacatcaccagtcctaggggccataaagaaaaaaaaaacatccaactccacttcaaaaatgatcattggtatgatcgctttataaatggccaaactcagctgctaggtaagattttaattcagcatgaaaacagaaataagcaaaaccttgagcttgaggggatggacataggagataaagacctaggtctgaatcctcactatgtcttttgttagtgatagctaatgtttaataagtgctttctaagggccaaaacccagtgcttgcacttcacatgcactatcacagttaaccttcacaaattcactttgagagtgaattttatgagtgaggaaataggcttaatatttgtttcacttccaagaacacaagaggttacagaagtaggctctgacctaggtctaatattccgatgctatgctgtttctggaactgactgaatctctctgaacactggctactgcatttgtaaaacatgaataattatacctttcagatttgttgcaagcagtaaatgacagcaggaatgaaacgtaacacagtaccaggcacataatgaagtactcaatttgttacggttattattaaacacattaaatacctattttctcaatacgtgctttagtctaccatagtttacctccaaaaaatacatctgaaaaaaattattgtttgccacacatccattttggacacatatctctggaaatttatcaaggggcagctttgctagtgattaataaggatttatatagcctctgcaggggcagaatataatacaaaataaatatgatctgtaaagcagcaaaaaaaaaggaatgaaatataatggcaaattcataatgaaacatcccagctatcaatctataagctggcagacaagaaggataaatactctcattatgattttagcatgccccacttagatctatatgaaatctattgtgcacattcccctcaccatttagatgttcctttgccagatttgacatgaaagcatttcccagatttagaggtttcactctgttggggacattttgtaggcagcagtgtggacgcacagttactggccctggttgaatgacaaggagagacaggcaggaaggggctgtgtatttatttccttgggatgctccatgccaccatagggatggacagcaaacagtgattcaggaactagtgatttaatataggccgtgtatccacagtcatttcccctcttcgactaactcctctgctcccagaaagaacagaaaatggagctagactggaagatgtcaaattcacacatggctcagcaagtaaaaagtatggatgcttttgaacaaagtcaaggagaacagaatggcatattcacaggattgtgaggaagaaagtctgacagagacagaagtccctttggaggatgtgagatacaaagctgaattaattgtgagggccagatattgacagcacttggaagtcaaatataaagccatattctactcttacattatctcactcaacttatttaatcttcataagtttcctgtgaagcagatgccatttcctcatgttacaaatgaggaaactgacacttaggcaagttaaatgacatgccaaagatcacacactttatgaatatcaaagctcaaatcatttttaccctgaatcaattctcctgatacagtagatactgggatgcaatggaagggtttttaactgctactgacttgatgaaaagagatacttgtataataaaaatgaaattgaagtttaaacccaagtaattatttttaattgatagataaaaaatgatatcatgcacaacatatagttttgaaatatacattgtgaaatgaccagatagagctaattaacatatccattaccttatatacctggttttttgtggtgagaacacttaaagtctactttgttcgcaattcaagaatacaatacattgttattaactatcatcactatgttgtacaccaggtctctttttgtttgttttcagacaatctcactcactctgtcacccaggctggagtgcagtggtgccatcttggctccctgcaacctctgcctcctgggttcaagcaattctcctgcctcagtctcccaagtagctgggactacaggcaccgccattatgcctggctaagttttctatttttagtagagatggggtttcaccatgttggtcaggctggtctcaaactcctgacctcaggtgatctgcacaccttggtctcctgaagtgctgggactacaggcatgagccaccgctcccagcctacaacaggcctctggaaattattccttctacctaactgaaattttgtagcacttgaccaacatcttcccaaccttcatccccctccttccagtaaccttccagtaaccttctactctcgcttctgtgaattcaacttttttagattccacatatgggtaagatcatttgtctttctgtgcctgattgatatataaaaacttgttacttttggatggaattacctacgtagaacggccttacctctacctgaagggaatgaactaaatcagtggttctcagaattgttccagaccagcagcatccacatcagctgggaactttctggaaaggcaaatttataaagactgccccaatctccttaattagaaactctctgggtggagcccaccaattcgtagtttaacaagccttccaggtgattctaatcatgcttaaatttgagaactattgtaacaagccaaactgaatgcaccttttggaaacttaaaagaagtaaaatcagagcaaaatgtccatttagaagacaggaaagaaagattatctaaggctcaagagtaaaataattaagccctttctaccagttttgtgatcttcagcaacttactgatcctcattttttccttcagtttcctcatctctaaaatgtaaatttcctctagctcactgggatattgcaaggattaaagaaaacagtgcttgtgttaataagatgtgcgtgctaaaattgtgagcattcaaaaacattagctattatatatttaagttaacaccaaaggcaaagctcaacaaaatgcccaaagcaataattgaacttaagaaaacttacaaatcagaagaaaaaccaaccaaatataaactaggaagaacagcaaaccaaatgtaaatgagaacatttactaaatggaaaaaaaaagttccatttgtgaagtaattaacaagagaggtagttaatgaaattggattactattccataggcccaacttccattttgaggaggaagaagtaagtgtatctagtccttagagtaaggcattctggggataatatgtgttctcttaatccggaaaatctggaaaagtcaaggctggggagaaaacaatgagataacaagaagcccaaagcaatactcccttgattcaaaaaaaaggcaaccaagtcaatttaaaaaacaactgtttgacaaaagaaacatttcaaagagcaagtctggctaccagtaagaaaatgtaaaataagcctaaccagaataaaaagattaacttatttgccaattcaaaacctaatttcaggataatgtaaacccaaaaccaactaaatttttaaaaatccataagaaattctcaagaaaatattaaagatttaaaagtctaattatggtagagacaggctgaaagaaaatttctgtgaatcaagaccctcttaaaaattctcgagtcatttcaaaaattaagctgataacttgaagactaaagcagaaagaggcccttggcaaggacttccaactcacttcatttcatacaaaacctgcgttggttggtctgtcatcttcctaccagagtaatggaaataattttcaccatatccatttttttcctgtggtagtctattacttagcacattgtggagcacgtccgctgaagatgtacagatcaacctgtatgcatcatgtcaaattcaacctttgcaggcagatgaaggaagaaccatatatatgtgtacatagaccttggcagtcaggcaaagagaaaaccatcatctctctcccaccacgttttcccatctaaaatgttttcctggaccatctccacccagaccttatgaaagcatggagacattttattaactttaaaaaatagagtccccgttttgggatgttgtgtttgacctctactaactctaatatggatggtactaggttcaagaggctgaagaagagacctggagccagtgaatgaaacatagggtttatagaggggaacttacatacacggtattccagtggcggtgggccggacaggaaaaccacaactgcttctaaaaaacattcagtttatatagcactttcacttagcaatctcccccagcaacctccacatggcaactttaatttcttaagttattgctctcaggtggatcttccacacatggggcagagataaatgggctatagagttagcttgaagaacaggtggtataagaagttaatatttatagtcaactatattgggttatctaaagacaggtgttttagatgatgaactggtgtgagctactgaagagctgagtgccagtttcagctcactaatttgctacccaaaacaagttaattcctgcctctgtgcctatctctgcatctttaagtttgaaagattaaacttatcagatgtttccaaaattcttggacaccaccccagaacttttaataagaatctcaagaaatagggcccaacatatctattttcaaaatatccagctctggaatagtttgcaaattgctggattagatgattgctaaggaccatttttgttgcatatgttttgtacctagcattgatattttatttacataaagagcagagaatatatggtttttagccttaaaaaactttaaatataaatggaaagtagtacttctcagttgttccagttatttattgcttagtaacataccacaccaaaatttaatggcttaaaatgatacattaattttctcatgaagctgctattcaggcagggcttggtggagacaactcatctctagcccactcatcatcatctggggcagctcaagactggtggctggaatcatctaaaggcttgttcactagcatgtttagtgattgatgctggatgtctgatggaacctcagctagtgctgctggctagtgcatgtgcctctctatatggttgcttagtttcttcaaggcattttggttccaaaggtgaacatctttagaaagaagcagcaggatcaggaagcctcgctgcttttgacaacctggggtcactagttcacattcagctggcacttctacttccttctattcatgaggaaatcaaaagtcctgtccaagttcaaggggtaggaaaatatactctatctcttttttaactgctttattgaggtatagttgacaatttaaaattacatatatttaagatgtacaaccacttctcttgaagacagagtgaaaaggtcctgaaagagcatgtggaatgagaaatatttctggaaaatacaatctgccataccaaggaataaaatagaagatgtaagaggaaggataaaggagacagtaagaaattgggctggattggtacagtttacaagattataaaggaacctgaaagtcgggtggaagagtttagatatatttaggtaggaaattgagccattgaatggtttcaagtaaagatttttcttagcaaaaattcttattgaatcatatcccaataagaagtatattgtgattaaaggtgacctttgcaaagcactttagggaaagtacttcacaggcctacagcactgagctctaattctcctctgtgacattttcacattttctatagttataaattttagaacgaggataatgaaagcgcttcgaggtatttactatatgtgacttgggtttttagttcattattttatttaagcatcacaagagcaataggagattcatattattattctcactttacagatgtggagaccgaagctcataagtattaaataacttcctcaaagtcaaatatcatctgattcataaagctattattaaaacccaagtctatctgattacaaagcaagcactcttctcactatgttatattacatgatcgtatctctttgaagatgaaaactatatagcatgttttatgtgaaaatacaaataatatagtaatctctcaatatataggtttcaatatcaggtatggagaatggaagcaacagttaagattcagataatactctctgatttaaacttgcaataaggactttttgggagaaattggaatgttggtagctatatcccatgatatcacaaaatatcctcccccagccacacacagaaacatacctaaacagcacaataaacatagtctctgaagaactgaaagaaaacctcaataaagtgggaaaaatttatggagattttatggcccttccttcttccctttctattttaaaacatttatctataagggtccaaggtttatatttcttctcccttgcagctgcatatattgtccttattctgagatttaatctgaaaccctaacccaaagccatccctgtgaccaggggaaaattgtgagattgacaatataggttttcatacctcttagattctagagtgtcctgtattgattgaaataaaaaagtttctgatattatacttgtcagaggaatttacattacaacaagggcctgttggtataaagaagagtaggattgcaaacctagtgaatggctggagagcaagatctctgtgggctagaaaagagtgttcagcccctcctccaaatctatcatgtatacactaatgcattaacttcaagtctgactcaaaccacttccatatgtaattcctcaagaagagagctgtgtgagactatgataataagatactacactgaaaggttttatatcctttacaaagcacattcacaagcattatctcaactaggttcacaaatgacattctggggtaggtattattagcatcatcttacagataagaaaacagagatgccaagagctgttcaagaccctaaagcaaatgggcaatgttacctctctaatctagctcctctccttatgaatccactatacgaagcatcccacacccaggtctgggcattgctctcttgtgcctgaccatcagcataactcacactcccctctgggaggatacttatgacagagtataagtataagtaagactattagagaatgtggaagctttacatgaaagagtgtgcagcagacaggcagtgctagaaacacttgccctcataagtttttgggatacagccctccgcaattatcttaaggggtccagaatatttgggaaagatgtcatattactatctttcccaaatattctgggccccttaaaataattgcagagggctatcttacagattctactctatagtggagagcatgaagaactttccaagactaggccccaccaagaggaaatactatccacaggagcatgaggttccaaggcaggagtagcaaagattccccaacaggccacatgtcatgggtcgcccctagggtgtcagggacgcttaaaaccttttgctgccatatctacaatgtgaggttagtgtgggtgagcaccaccatctcaggtaagaataaactcctactatatatgccgggcagtctgtcagcattctgatgcatgaacaggtgaataaggagctgaatatacaaaaatagtgttaagaaacttacaggaagtccagcatggtggctaaaaccagtgctgagatagattctctaccgcatggaatatgatatgcctgccttacaaaagatacatgaaaagcactcctggaaatatgtagaaaggcaccatcagaagcagacatgggctttcctttgttcctcacacccaggctcttcgactcctagccaacaacccatgctggtcccccttgctgtagtcaaatctaggtaccttagttgtcttggcatttcatgatctagtgtgataaatggctgatttatgatgtggaacaaagttgggctttcacatttacatatgttaccttacggaaatttcccttccatctcataactccagagctggcatgtgggtcattttcttttccagttggctttgttaaacagcagcaaaatgtctgggcgtttggccacagcagaggggcaggcaatgcttgactgagataaagcctgtttgacttggcacatgtgccagaaacccctgagggcagtgggaggtatgctttatctaattattcatggccatgctgctgagtggaatgtgacattggccaaaggataaagatagcagcctctatcatcttagcatagcccaccttggaaaaggaaggctcagatttagaataccaccctccaaatctagaaacatggtcaccaaaaaatcttacttaaacatctgggaagatgaaaacaatataagtagaaatcttccccggtcaccttcagacagcttggattcagggctcaaggccacctcactctctgaccttggagaagccacatagtctcactaagcctccaattacaacataatgtgaatgacttcctgcagagcttctcatgaagagcttaggagaataggaaattgggctttgggcttttggagtggaaaaattttaggtggattatgctatattatcattatagtaaaatgtatacatgcctaatttttctgtcattcatggctaggagaaatttttaaaagaagggccacatctccagagtttctaaaagaaatctaaagatttacaaaaccatgggaatttcttttgtctaaagttgaagataaagtatctacctgattaaacgagctcactgaggacaaagacagatgtagtctcattcacctctgtatcttgagtgtctggcatgtaagtgtacagattaatatttgttttaatgagttaatgatggagagaaaagaattaaaactaaacagatgtgtctaatcccatgcctaggaaaaaaataggttcttgataagtattttgtttccccttttctcctcccttcctttttatccaactttgtcaaagatacaaagcttctttcaggtaggcatcaagcattaaatatctttcaatagtattaacttcctaagtagatttttctaatgttttcctcatctggctctataatctttattttgtgagtactttgttgatgttctgttcttaagtggaggcagggaggatgggtaatggaaaagtcagaaagaatggcaggataggtcaaatatatccataccactgagaaacaaaactcaatatatgactaatagagggtcagtcatgtattatatatatatatatatatatatatatatatataatcacttcaatagaattctgtgctgcatttaagaggagacaggagtgttttgaacttaagtggatagactgctagaattccagaaatatttgtcaatactgaacttagaatgaaaaaaaaaatgtgcaagttagaggatgccttagggatcattcagctcaacacctttattctacaaatcaaaaaactaaagctcagggacattcaaagtccacatagctcagcagaatccagccatgggcttcatcacctctgtctcaccttttaaaattgcataaattcctagcccgatgcattgctaatgccaaaattcaagaaagctgatttcacggggcttatatatcacttcactcaaaagaaatattggacagagatgcagtggtatttttagtgattcttgggtacagcagcccatttggaatcagcttttttgaataatagggttggcaaatgccactatggcctgataaaaagtagaagaagccaagggcctcatactggcttcagatttgaaagtcaactctgattttgcagatcatgtgtagcaaagatgattgacacctttcagtatggacaacatgttcaaagaggatttgggaatcataaacttagctctagtcctggctctggtcctggtaatcaagtcacttaaagatgtagacaaggctattcactgctctaagcactcataggagttggaagagacattttataagttcccttccatatgtaagtgtccatgatcccattatacatttaattagcctgagaaaaatttaagcagagaagccttgagccatgcagcgaagttagctgacacatcagctttactatgtttcagtatactcaacaaagcatgttttatctgtaaaattttctcttcattacagtttctaaaccctcactaacatgtatcaaaacagaaatgataatagactttctaataccttcagggtaaaagggatttcaaagccattattttcagagaaaattgatgagatttatactttacattttaagccatattttctataagctcattttattttataaaaaggttgttacatgggcaatggtgatatttaatatctttaatcttatacataaatcaaagcctttgttctctttataggttttatattgtctctaagcttctgcctaaaatacattcaacagggtccagttataatcttcaccagaagtacacaaacagatcaataaagaccttgggaagactcaattgggataccttggcaccatcagttctggttgcctatttgactgaatccatttcctgcttctgcatccttacactggtaaacatccaaaatggttaagatctaaaataccaacagagtaaatgtaactataatcagctgtttttattaatgatttcttcaagaacataacacagtccaataaacatggagttgttcaatgtggttgttctaaaagcagctaatagcaggatgtaatttgaagcagcttcggctcacttacagaacccttgctctgttaattgtgatttcacaccccactaaacagcacagcctggagctaacgtttgcgcagggaacagttagtattctgtagttcagttctctccactgttgttcctcctgtctccctgtggttaacttcttctttttttaaaagcttagtagactgaagttgttccctttcacaaggaaacattctttttttcccttcacctggcaggagacagcctgtggatatacctattatttcgctttttgcttttgttttaatctttcaccttttcaccattgttctcagagcatacactttatgtttcctacagctgaccatcaatccctgttattaaacaatggaatatatatattttttgttttggctcatccacactagtacccttgactctttatttaactaaccatccccctcaggaagtaagaatattgtctaatgaaaggaaaacggctgcaggaattcgaagtcatttggaggcaagtaacaagtctctgactagaagaaaaatatatattggaagaaccaagcacaatatgttacatccacagatgttcccaaagaggcaccacatgcagactagatttcattcaggggaagagcttttaaatacattttaggcaagaccctaaaatagaaatacctgaataatccccttccccagggactccgatatttcgtaagaaaattaagaagatcaagggtcagcctggatgataccggaggctttcttactaaaacattttataatctataaatactcatattttaaaaacaaaaatttagttacagtgcaggggagagtggctatttagagaatggagcagtgggactattacattaaaaggtatactgtgaaatttttcatagaatagggctactgtcctgttgttcactgatggtcatgaaattaactcaaagtcctcaaaagaatacttatcttctccttttggcttacccatgtcgaagatagtgtcattgttcttgacattccatatgttaatcctccgcagttaataatagtgaattccaagacagaggtccagagtaagtgctgaagaagaatttgtttaaatcaatacccaaagatcattcaaaacacacccagatgctaacaccttagttagatattttatgcaaagttgaggcaacattagtaatattgaaagaaacttttgtgctcattctttgtacagcttaaaataacatataaggtgatatttcacatgtaaaaaatcagggcttattttctaattcttactactggcatagtttttctagctaataaaaatagcttttaaacaaaatctgcttttcccctgatcttcagctttcctctgggtgtcatgtgaaacaccatcctttgggtgacatcttgtgtgccccaccacaggtcctataaagtggcagccctcccgtggtgaaatgggttacttgtaggctgtgagaaggatgcttgggtagttcagcatctacactactgagataattttggctacatttcgcaggaattgcagttcagggcttttgaaattccccaaggttattaccccatatgtatgctaaacggcaaagtgtaaatgtcctgtgctaagccacaagtaaaagaaacatctggacagtggatagaatcagcaccaaacacggccttgatgagaaggctaatggatgccagatgtggaaacaaattcatgtacaaaggtcccctctctaggcaggatcatttctaagtgtcgtgacctagaagaaaagttctcctgaaactgaaatgaagcatgtatagacttcagaaaaaagtatttttgaggcaataataatgtaggaatttaagttaagccaacacaaatatgttctaggaaagagaagcaccagatagacaaacaagctgctggaggtgcctagattgtcacatcttccttactgcttttcagagtcctctgagacattaggacacaattctcaacagatgggagttataaaaggagttatccccagtcaaaaactgggaatcagataattctattccactactcagtgactgaggagtcctgagcaagtagcacttaagtttgcccctaagctagttttactcatctatttatagcagaaatcttggaaagagtaaatgagcatatgtaaagcaacttgcatacaagttcaaaaaaaattggttacttttcccattcaagaatgaagaaactagtgaaaaagaaagctgaggtttgtcgtaaagtgataaaaggagaaaatatatattcattaatttagtcaacaaatatttattgcacacctaatatatgcctggcaatgcattatatatcaaaaagaaagattatgctaatctacacagaattgctgcagctcacaagtttagctacgctaactaatttacacaaagctttccaagtatcttgcactacagtttactttgtgaccaatagcatgcttgtgtaatacagactatgaccaaatatgtaacaccagttttgtctagaataatgcaacttggacaaatcaaatgatgtaggctttactagttctatgggctaagtaactgaattagcttgcccagacttggaaacatatgctgtgttaggaatgaaaagaaaaagcatgaggagttatcttagtgtttcctagccactaaagaaattgggccgtaaaagagaaaagaagtgaatggataaaatcattgaaactggtgctgctaagatgaaatttagagtgacaagagatatttgcatcgttcaagtgaccacaggtgaagaatacaagtttagagcaatatcttaaatagactaaagtagattaaaaaaaaaaagtgtgtgaaatctgaatggaagaaggttgcaacaatcagaaacaaagatcaataaaagattgatgttatctaaaaatagcaacagagaaaagaaagccaaacttggagctactgtgagcaaaacagcaactaggacttggcgaaagcttgagtacagagaaaagaatgtatacctaaaaggtcaggatagggaggataatttaaaccaactttcaatacaatttgtgtgaacattttaaatatgagagtccactgtaactagaaatatagggcataaggaaaataatagaagtggatatatgaaatatattcttatgactgccacctattgatattttaatcttagaccagtgagttgatctctgctgtcatcaatttccccattgtctgaaatggcatcaggtatcaccgtgggcaagacagccacattcaaaggttaactgcatctggaaagagcagtagtaatccgaagctcttaagctctgccatgcagtttgcccatccagttggaaatggtaatctatcccaaccttcatggtagaagcaaccaattacggcaatgaaggaggaggctgtggccctcttcagatgtgtcacactggagtgtgctgccaaaataaatttgagttatgttttgtttagctgttaattgttatcagagtcccaacaaacttcatttactgtattttgcagagatgccgtcctactgctccttgtatctttagaacctaccacagggcctggcacataatagacataataagcaattttgtttaaatcattgaacataattttttgaacagtggaacatagtaaaaccacagtataatttcattcacttttcagaaatcaagctgtgaaagtaacagttgcctgacttagaatcttctgattggaactcactcttcacctttctcttcccatgcagcctaaactataaagttgcaagttccaaatgtcaggcagtgtgtcactggtagtatttgtcatttacacccagactcatggtttctgcttgtgtacagaaaggataacaaagtgactggcttgctattataatgagaaggaggcctctgcacgcccatcactcacttgcagtgaggtatggcatctcatcttcctctaggacttctcaccaggcattagaggattctctcatcagagttagtgctgttagtaagcccacagttgcaaattcatgtcaatactcctgtgacctatttgttatatactgtcatttttaaaaaatgcacagccacactagccattctttttcacttcagacctgcttttgttattttaaattttcattgaagtgtaatatacatacagaaaaatgcatgtcataattgcacagctttatgacttttcacaaactgaacacacctcatgaaacaaaagtctggatcaagaaacacaaatttgccagcactcgagaaaccctctcaggcttcctacaagtcagtaacctctcatattcacaagagtaaaatctgtctgaccttacaatactgtagataactttggtatgtttaggcttttatataaatggattcatgcaatacgcactctttggtgcctagctctgcctttattacttggagaaatgggcccttgtgtaacatacacatgccataattttatgcccataatttgagtataatacaaagaaaggaaagcaaacctagaagctgtgttatatgaaggctttgtgttattcttagtctttttaaagcacaggtaaaatcagaaccagtttaaaagttgaaagctatacaagagatatgttagtcttgttagttgaaaatctgtctcaaattatatctgtgttgggagattcctacattgaaatgtgtacaacaagatagtaggggtcaatattccctgaaactcatcaaggacaagagggcagaagacagcccagacttgctgtcacaggcacagtagttgccatggaatttaaagactaataagtgttatagaggacccaaacctcctataactaaggcctctattgtgatgggatagtgaaaattaagtcagaaacaacttggacaccagaattttaggaaatattcttcttttgacattaggggtcagttaatgtcctagtccagattgactcaggataagacgtgcccagcccccttctaacaaaactcagtacaacaggagaggatcaagggagtaaggatgctaacattttctggagaaacagaatatatcaactgagtgtgagcacatgtgtccttttgaggagaaggagatgatcactttccatcttctcctggcatattatggtatttagcacccataaacactaaacaattcagaatttactggagaccttggaactttgattccctcattgcatcatccgcacagccagcagttccccaagatcacacaccaccttacacctcaatgagaagaaaggcagaatgctagctgatggggatcatttggagagtccagaacacccccaatttcattagagtcattgataaattatcctcactccaacaattttaataatagctaacagttattgagctaatgttatgttttgtttcatttaatcctaaaaaaacatgaaataggtattgttcttgtcttcattttacacatatataaaatgagagccaaagaggtggccatgtgctgacatcatgaagtagattcaaacatttcactgaagaggccaaaccctaacacagtggctttcaaaatgtttttttaacatgtcccagtaagaaattattttacattgtaacccagaataaatattcatatacacatgcatacacaccaaaatatcttagaaaataatattcaccctttctacataaatgccttatattcatattttgatatttttattatattttaagctcttctatttccttttaaaatgctcgctgtgatttgctaatatggattatgacacttgaataggttgtgaaaatttgatctgcagttagaaaaactctgatctaaggtactataccatattgccttcccaatcaatttctacttgattttctaggaatggattttataagagcattgttaaatttaccaccagtggtgtgctggtaaatatttaacaatcaaatcttgggaacttatggagggactgatttttagtgtttgctgatttctgtgatgtaagcgctctcaccacggccaattttaaggtgccagcatggtgacactgaacacagccttgggaagagatatgtgtaattggtttttgagagatggtaccagccaactactgcatactaatgattgtccacagaattttccagctaagcagaactgaaaaaatatgttctaaggtcacttaaatgataggagagttccattacgccaggtttaacttatcaatggcatttaattgtctatctgatgagatcaggattattctaagcctgaaatctcatagtatctgatatacacaagttgacttctatttgagtatggggttcatacatgctataacttgaagaacatcagttaggccttgatactttactatctgtacacaaaggtatctacaattccatgattaaaaatgtctctctctttaatgttttaaccctgtgttttgggccattcaaaaatttgatcatccctaaatgggtaacaaattaacttgcattaatgtgccaaaactggtggtttaatatatcagatgacttgattgtggtaagagaattgagaatatgggacttctgataatagcataaagaaaagatgattctggagtcactgaatttctggaaagagctgtcattaatacagtagcacagtgggagccatcatgaagcctgtggccatctgagatggcatctatatgtaagggtataaatgggataaaagttatgggattaaataaaataatctatgtagaacattaaccatagttttagcacatagtaggtgcccaataaattttattatctttaatgtaaagggtatgggaaagacagagagaggctatttgggaatctttttgggcaagttatataaaaccaatttcaaactgatttcagcaaaaccaaaagggaatttattgtctcatgttactgggaaattttagatggattaagcagcacgggtgtcactatatccccattccttggctctgcatttctctgtgtttattctcagacaggcatttgtctcatggtggtaagatgcccaccagcagctcccatacttacaagagcttacatgcattcttttaagccactctaccagagagaggatgttttcctcctagtggttctgaaaaattttcttaaatcatcctgcttggcaatgatttggtgacaggctcattccttaaccaactgcagtagccagggacatttgactctggttaatcaggtgtgtcataagccacccatcaagccaggaatgaattcacctcactttagaagcatatgcattggttcccgaaggaaaactgtggtgtagtttccaggaaaaaaaaaaaggaaatggatgctaatctgtcagaccaaaatggaaaaattcagctctgttttagctgattgggattttgcttaaaagtgaaacttcccaaatgttgaaattttattcagcaagtcaattcaggtatgacattcaaaaggcttaacaactagtatcaagttatcgaaatgggcagtaatcataaccttggaagtggaaactaaagaccctactgtgccagaatctaaccctttagttgctgggtcataaggaaatatgggggttaaggatgggagagggtaggtggagatatgccagagaggggaccagaatagccagaaagatggagaaatgctcaaagggcttggtaggattggctatacaccaacttgatggaaatatttaaatattttaacaactggtatggctgtaccagtgtgtgccagctgggtttaagccttgactaaatctattagcagcaataaaattaaagaaaaatattctctcaaatgctactttcagaaacatggctgttgaattatggggatggctcttttagtagaaggctctagaatgcctaagggggtttccagcaaacaggatataggatgaaggcaaacatatatatacagagagaagtaaaatcaaaccataaaataaacaaaatggtagtggaacttttctcactttttaaaaaaatttgtgacaaatatagcttttatgaaattaagctaacaatatctaatgtctagacttacagattttcttctgtattaacccacatattgaccattttggtattgttcattccttcttgtaggtttgattttccatctggtgttgtttcctcttactttgaagtaattcctgtagcatttctttgtttgtttgtttgtttttgtttcctgaaatggagtttaacttctgtgcccccagactggagtgcaatggcgtgatctttgctcactgcaacctcctcctcctgggttcaagtgattctcctgcctcagcctcccaagtagctgggattacaggcacacaccaccaagcccagctaatttttgtatttttagtaaagacggggtttcaccatgttggccaggctggtctcgaactcctgacctcaagtgatccacccaccttggcctcccaaagtgctgggattacagacatgagccacggtgcctggccctcctctagcatttctgattgtgtaagtctactaattgtgaaatgtctgttctaattgcctataaaaagtctttatttcaacttcttaaagtatagtttaactggatagagaattctgtggtgcttgaccagtttttccccagaacttcaaaggtgccatttcattaagttattttttctgataagtcagctatcattaatattgttgttacattacacatatgtgctgctttattctgattgttttcaaggattttcctttacctttactttaatcaatttggctatgatttaactacatatggttttatttatatttatcctgcttgagaattgctgagctccttggttttgtaatcttatgtttatcatcaaatttggggaattttttggccattacttcaagtattttctctcattcatctctccttctgaaacattaattttgcatgtgttagactactaaatattgtccaactggacactgaagatttgttgaatttcttttctatcttttttctctctgattggattagattatttcttttggtccattttcaagtttattattttgcctctccaatctgttgcctcctgtcatgaaatctttattttaaatattgtacttctgagttctagaatctccatatagtatttttatagtttcccttctctgctgagattccccaactattcattcattttgttgtgttttcgaacatatttataatagtccaagttcttgtctgttaattccaaaatgtgcaccatttcaggtcttatttcaaataatgctttctctctttgctctgggtgctgtttttctgttgtcttatatgtcaagcaatttatacttacatgctggttattataggacatatatttgtaggcagtctgaattatgtcatctttctttaagagtttgagttttgtcctaacaggcacataaataaatactggtggatcattttacttttgttagacttagtttcattctttataaggacaggtctgttttatacttagtcctatgacatggccctaattccagagcttggcctttactaatagagtacagccagtctttctaaggttttaataaaaagcacaaagtgcctagtttgatctctgcactccggctggcttggaactctaatacctctcggatatgtctgccaggcctcactgagtctcaccctgtggatgaccactcagatctgcccaccaactccatgcagctcactgccccacaaatagcaaccactttagcagcttagaattctattaaataatccctgcctcctcaagtcagaaagactgccactgctacatggcaggaaagtgccctgtgcagaatactggggaatctatggggtaaccatggggtttccctcatgtgtttttttttctgtcaaagatcatagtttgcttcatattttttctacaattttgtagttattttcagcaggagggtaaatccagttaacagtccaatatctgtacttgacttctcctagtaaccatgtcataggaatggtcaccaggaatatgtgaatgatagaagtgatatctttgtaaagacatgtgtgacatatgttctgttttgtagacttgttggagcaataatggtaacgtcttcctaaatcctaattctgtatttattactgctgactaccatcttgagcaatttgctttactctttctctcagtccctctctcactctctacttagcaatagatgatataattatttcttaccaggaaacagaagagttaattcactatgcagaatactctgaaattatataaaaagggactgtatacatctaggaaattattaataatagccacttgatgggtcatattgccaattggtaaaaatatcctcctaaaaatggtattcctccatttctgctccttcaccattttgtccagagctagagagaaagcttttgagaaatccagtttctacactcggtttatgctgacaaacctgaaacttctattagactttgcagcttggaagaggtaaaggacaaaggtggatcacagggaatttggagaggctctaattcagaggctttgtaatgagggtaaggaacttgaggatgctaaagcagctgaaatggcaacacacacatgtgtacgtgcacacataccatgaaaatactgtgcattttgatgcttaggaaaataaaggtttactttgaagggaagcgaataaatctgcaatatattctatactgagtcactcaacaaagtgaatactattgatgggaagtaaattaccagcattcaccaaagtttaggacaatctgtttgcctacctcataaaatcattttcctctaaattcagaagataaagaaaataggagatgaataggagatgtgatttttattttttaatttaccttacttagtttttttggtcaaggtcgaatagtgaagtcggcctttcttcttttggcctcatcaccatccgtttctcagctccaatatgccgactggcaacgtccctctcttcaacatacccagggttcttgggtgttttcattttatctattaataaaataggtttatataagagggtcttatcaattaattcccatgatttgacctaatgtttttgttgtttaaaatttcacacacattgtgggatttcaaacagccttaaactcagaaaatttgaaggaaagcagaactcttctccctaactttaaatcttagtgcataagcctggcctcctctattctgccccgtccttcatactttgaaggaacttaacctgtcatttgatgtattgttttccattcctcctaacccctctcagaccaataacatgtattctaattcttttttctctaaatgctctcaaaatttccagttttaatttatacttttcttcctgtaaaaaatcaaccggcaattcagcatcacaaagtcagatcaaagatatttgggtcaaatttatccagggccaaagttgaattttgccctactataatgtcattttgaaaatgacagatctttttagcaatctttgttatctgaatgaaatttccaaattattttttcaatctcctgatcaatctttctaaaacttgcatgctactgggaatttattatttaaccaacttttgacaactgtgtgtgaggcactgtggaacatacaacaatatctagagtatgctccttgatatatagtagtttacaaactaatggtaaagtaagaataattttcaatttaaaaactttgcaaataaaacacaagacaaaatatgatcctcatgataaacatagcacaaagtatatgggaatttagcaaatgaaggaaccccttacagtggagtaacatggaaggctacaaggaaaagaaattttaaggtagatctactaaaaatgattgggtttgaaatgatgagctactcataatagcttcctaagacttctggggaaaaataccctttttctctagtaaaagaattacagtcatgcaatggcatatctcctattaaaaatgccaatatagctacagcgtctgtttgtttacccagctgaaaatggcagtctagagcaacggctatgccttttgttgcccataatactgacagctgaaaaattacagaatcataatcaaattgcacatactaggactaaccctaactttgttccagattgattgagtgtgcaggatttgagcactctcagaaacccttcagcaacttaaggatttatttctgggaaagagtatgtatggtttctggcattttatctcccaggtagaccctttcctttccctggataaactacttttgtattgactgaaagtgcatttcatttccgacaccgagtccctgagcaaagaatggatgaaaagacatattatcatatgcagagtacagaaatgctttcagttcatatattgcaggggttatattcatagcaaacatctgagattctattaatgcatgaattaataaaacattggtgagcaggttgcctacagagagggctacacatgcttgtttacagttgacgcatcactcatcatccccgaatggagaactttgactgtagagatgcaattctccagctgcatatgaatgtggctgcagtagggagcctgtttatctgaggaatgtgctgctggctgatttataatgaaaagaaccggaaaagaggtggttggtgccctttcacacaatccgataaactgttacacagagataacagtggcattgaattaaacatgtttgtctatttttcaatgttacttttttttttaactttcttagggcttcattttaaacagtgctaattgtctctgattatgcatagtgctacagtattaatcattataagttctgctataaagaaaaagtaaataaaaatacagtgtatttaaacattaattgatttttgatttgtaattctctaaaatgacattaaatgttacttagatatgccctgtcacagagctaaaaggaaaaaatattttacatgacattgtcatcccccaacttatttttatggtctgcatatctaatttttaaatttatataacacatgtagtatgaataaatcagtttttgagtatagcacttaacaattatcatgttgaaggaaaccaatggtatacaaactttcaagattttcactaatgatgaaaatagttcataaaaacagagatgcatacttttctatcactctttatataaaaatgtgtaagcatttagaatgttatttgacagcagggatgatgttcatttgtttacaactaaagtatatatcctgggtatccaacccatagcctagtgcacacatagtgggtgttcaataaatatttcataagtgaatgtgtctctgaggctttgagatagaagaatgtgcatattccttatttagtattctcctgaccaaaaacttaagcagtaaatgtaggtcagttcaggtctacatctctcctggcttcctagatgccagtctcagttgcaatattcaagtacaaaggcagtattttttcttgcatgatacaaattcattactatatttctacctgttggtgaccctaccatcaaagagtgcaataggggaaatgcatctgatgtgacaaggtaggtaatgaagcaaaaataatgtatttctcttatttaattcccatttcccataccataaataaaatagtaaagggtcatgtgcaaacatagatatcatggatgtctatattccttcaagaaacattcgttgaattcttttactataccagaacgtaaacaaagagaaataaaacacagtccttacctgtgaaacaggtaaactgatagacactgttgccttctttatcatttttgttcatataatttttatctctttatgaatttggtaacaggctctattaatctgttccttccctatttgaaggacaggccaaagatccagtttggacaggagagactatttctttcagcgtaatgctgtgtttcatttgaagtcttttttggctaagagccctttcccaacagagaattaagctttctatagactataaggtaatctttatttgagtagccaaactttctttacattcaaaagatgtctacactttttgcaaagacacatggtcagcctgtgttgatggccttcttttaattagctattctgttttactaggcacataaaacaattattttatagagaaatttctgcatctttatcattagcgataatgatcgcagtgtcttttgccttccatggcagtttttcttcaaagggaattgcacgtaaagatcaaagagaccagaaattgatatgaaacaaaaaaattctactacagtatcaactttttaaaaaaattattattattagactttctggtaccctgtggcagatctcccagggaggctctgagttaatactgagcattccaatggctgctgccatcagtgctgagattcacacctaaacaaacagacaaaacataccccagctgactctgtggctcaggaaaacagcccatcattcgctgcatgtgaaaggaacagaaagtaagcagaaatctgtgttttaaagggcactgctaatatgaaaagggagaaatgtcaaaaatgttgaagtaaacactggactagctcctgtcttgcttgtttcattgagtttttttcttccttggcacctaaaaaattctaaatgctgtgccatttcattaattctcaatgagcacacaagaaaacaaatataaatcaaaatagcaatagcaaacatttcttgaacaaactacaacaggaatataaagccagaagtcaacagtttgattggggaagggagataagacagaatacttgatctttcctggtagtaactgttgagtcttaaattggtaagtggctatttgctggagaaattggtatagaaggacattcttggcaaaagggaacagcatgagcaaaagcaaggggtcatcaacaccctaaacacctactgagtgcacatagttcaatatatctgcagcttaagatctgaaggcagaggtaggcccatgcagataagcatggtgagcagtaggactttagagctagccagggacaagatcataaagcactgagaagagatttataattagttaattcttaaatctgtgggcaagggaaactcagtatacattgatagaagatgggctactctgaatagtaattgagattgtgcattagagtgtctcccccaatgagacatcattcaaattgctaacatttgctaatttatctgagagcacatgaatagtgtggcttttaggcatcttgattgagtcttggaccagctaggagggcccttccttcataaaacccttccaacacacaatcatgtgtgaaggttgaaaagcagacaggcatgctcaactagaacacacaagggcatgtggctgcaacctgtcagaagaatgctccaggagtctgatgcagtcagatctctcacttgactctgaaaataatacgttcatcttatcttgggggatagaagtaagcaggctgtgtgaatgtgctgaccaagtgtttgctctagtgctagaaagctgagtgtcaaagaattcaacagcaggtacataggttcatgtgtgcatgcaactagactactccacaccagagttttggaaagctctctagaaagatcccagactactgtccaaaacatgatcctcacagcaaggctttgcctgattcccaatagattcatacgttctagcctagaatgtaaaaagatgctcaattcacagtagctacagtcaactgtgtgcaccccagcactggcattcattgcactacctgagatgtgacgacaaaatgaggagttgcctcactctggataggggaggcagccaccagcaatcacacttgccccatcatctatagttgtacaggttatacaacaaaaagttgagaaatcatgtacttttaaagggggtatctttgtctaatgctcaaaacagtgctttggggggtggtagcagctctctaggaatttattgctagggtcctgctacgaattacaagagctcagcatagtggggataaggaagaagtggtagctttgggagatgttaagcggttagattctgcagggcatagtggctaattgaaagatggtagcagggggtgaagtggagaagactctagggtgcagatttctggcctgagagcctggaaacagagaagatccattcatagacacgcagactttgaggtgtctgaaggatgtgtgggtaaagctgtttaacaggcagttgacctaagaagtatggagctcatttaagtggtagttgaaactgaaaatagatgagttggcccagggagaggtagtgggaggatgggggaaggaaggtgttaaacaatggaatttgagatgttgtcaagatgaagcatgataacagaaacctaggaagttgtaataggtagagaatagtcaagatttcaattaaggtcaagtaaaatgagaactacagtgagtttatagtttattcaatttagaaataagtagcagctttttccacaacacttttgttagagcagttgaggcagactcttaacctcaatgggctaggatagttcatctattaagggagggacagagatgcagtggtagaaatgcagaaatggtaacagagttcattgtgttttcttgtgttttaaatggaaagggtaagagtccataaaaaaggtaagtttacaaatgcagcttaaagagaagggatataaactcacatccacattgctgccctaacaaaaacaaagtaaatgactcagtagagagagtactggacttggctttcaaaagaaaaaaaaacaaaacacaaaaaaactggagtccaaacccaatctgcaataagtacactttgtaaggtcacctccttgaccctctgtgcccatttctgtgagatgggaccactaggaactacatcatagagtgtgtaaggatggggtgagaatacctgtgagagagtgcctggtgctgtggtgtactgtgtgtttagtaaatggttttctgagtcatcccattaaaggtctgattgggcatgatcgatgtaatcactgttgctttctttaccatttttgttcatataatttttatctctttaggaattttgtgacaggctctgttagtctgttcctcccttatttgaaggacaggccaaagatccagtttggaaatgagagaggactagcatgacacattggctccaccattgatatctcccagaggtacagaaacaggattcatgaagatgttgacaagactgcaagttcttaccttagctttgttttcaaagggatttttactctctttaggggaccataactttctaaggagagagattaaaatagaaggtgaccttgttttagggggcctgtttcctattaacgaaaaaggcactggaactgaagaatgtgggcgaatcaatgaagaccgagggattcaacgcctggaagccatgttgtttgctattgatgaaatcaacaaagatgattacttgctaccaggagtgaagttgggtgttcacattttggatacatgttcaagggatacctatgcattggagcaatcactggagtttgtcagggcatctttgacaaaagtggatgaagctgagtatatgtgtcctgatggatcctatgccattcaagaaaacatcccacttctcattgcaggggtcattggtggctcttatagcagtgtttccatacaggtaagattggctaatgctattgctaaaaggctgtatctctttgcttttatgtgttgggggaacaaaaggaaaatatcataataacgtcatcaacggattatatcaacaatgcaattattaatttttctagttataatttgataatataggtttgcaggcagaagatttttctaccaatgaaaattgtttagaagcatatcaggtagctattgcaacattaaacactacccccaaaattcagtggttcaaataagaatattatttattagtttacaagtctaaagatcagatgctgtgaactaatggaggctgggtttcactgggggcagctctgctccaggttgtctcttatcctcctcctggaatcgatcatctagcccaggaatgttctctgagtgatggcagaggtgcaagagaatgcaaactcagctgtacaaagctctttcaagtttctgcttgcttcgcacctgctgacatcccattagcaaaagcaactcacagggctcaatccagagtgaaggagctggtaagtatgccctgcccacaggacaagtgctgcagttatgcaacagactatcaaggtaagatgaaataataatttgaagccactgatgcaatcaaacacaggaaggcataatgtcatggaactccattattcccactaatttttactaaagcatttttttgttcagagataaaatacaaataaaatttctcaggatataaacctaaaaatgtatgcagagaagccagaggattactaccattaaaaaaaaaaaggaaacatttaacacataacttaaactaaatataaagctaataattggctgtcataattttgttgggaaagaagaaatatacatactcttgcaatccttacttataaggttactaaattttatagaagtaaataagtgagaaatcatctagcttaacttcatcattttcccaatccccagaaagattggtttcatgaaaactcccactggtagaaagtacaagaactagaactcagatagatcttttgtacttctgtgttcttttaactaccccatgtgatatttatatgttactttaagtttagtattttttctgattagagcattaatgtcacagtaataaaagtccatgattctaagagtcatacactttgcctcccaccaaattactataatcaaagccccaagcactaaaagaaactataccacactcatgttgtctttttatgtcatgaaccacttaaattggctatatttgcgttggaataaccttctttctctatctcacatttgtggcacttaaaattctaggtataggccaggtgctgtggctcatgcctgtaatctcagcactttgggaggctgaggcaggcagatcacctgaggtcaggagcttgagaccagcctggccaacatggtgaaaccctgtctctatcaaaaatacaaaacattagcagggcatagtgggacacacctgtgttcccagatactcgggaggctgaggcaggagaatcacttgaacccagggggcagagattgcagtgagccaagatcaggccactgccctctagcctggagcaactgagcaagacttcatctcaaaaaaaaaaatgtaaataatgataaatatatagatagatacataaaataaaattctaggtataattctttgtggttctctatgagctatttgaaatttatttccttcttcagattacaccatcatgttatgagtaattaggataactggttttaaataaacatccttaggtttcactagatggatagaaaatattgcacatatgaaagcacatcatgttaattttgccactctttctatacttggataaagagagatgaaaaatgctattttatttgaggaaagagtatcggtcatacttcatatatatatatatatatatatatatatatatatatatatatataaatgaagtatgaaacatttcatatatgtgtatatatatagtctgccatacttcaatcataatttccagatgaatgccagtcatttcacgaatttatattatacccaatattaccactagtaagggcttatatatatgcgctttttctcaccttagtttctcctagtgcaataaatggtactctacagcagatgtgtaaatatcccacttatccaaagtaattgagaaactgtgccctgcaaatggcctttttacaatctaattttactcttttactacctatttacttcctggaagaagtcagactagtttagaggaaaaaatgtgggctaccaaaaccctgtactagttagttctgaaggtcagaagccacttcttactcattgaaagacctatctcattaggtttttttcatttatctggtcaatatcaccatgaagtcacaaacattgataaggttcttatcttcacagcataaataaaagacccaaaactatcatgctataatggaaacagtgtagattttggcaacagaaagacctgagtttgaattccaactacaccgttttctggttaatctgtaaaatgaagaaaatatcatctacctcaaaaagttggagagaagataaattaagaaaatctgtggaaaatgcctcaccaaaaactgacagattcaataaatggtaaccttatgtccctaaaattataggaaaggtcagtggaaagccatatcgaaagctaattatgtggacttctctggtgcccaagcagtcccatgaagtcattgctggtttcccacatggttaatcagcaagtcagtctgtattaagctcctactgtgtgcactgcactgtgacaggagttagagcaaacactaaagtcatatagaacacagccctgatctcaagaaacttaaaatctggttatgggtacaatgtgctctgaaataacagtaactataattcagaatatgttcatgtagctcacaaagtaagaaatgacctttagaaaggttttgaggatgagtaagaatgaaagttgcattggagaaaggctaacagggtgacagtgtaaatgagatgctggatctgaagaggccaatcagaaaactgtgggagacgtccatgtacaaggggataaaggccttgacatgaataagaaggaacaagagagaaggctccattccctcctccatggctccaacatttcctgactagtcagactctgattaggccacagacttgtccaggccaagtcaagccaggagttggagcaattaggctatacactgacccccatgcccccttccaaggaacccttcaatacagggtcctgtattcagctaggcatcacaaataataagagttgttaggtggctgttatgtagctaagaattaaagtgtgttattcctttgaaacatatatgtcctttaataagaattctaaaaaatatagtcagtggtaatccaaagccataaattcctaatggtgaatttaaggccctcttttacactaacgagggaaacatttttggagagaagatttctctgggtacctctgatactcacatgctcctgctccagtgactgattctggtcatacacctggtgtgtggtaaccgtggtgacagtgtgcagcctgtagcattgccatccatttttaactacttttgacttcctgcatatgtactggaaattgtcttttcttgaactgagccgggggaaaaaagagggtggaagaaataaatgagtatgaacctgtcacataattttaaaaattcctgctgtctgattataacatctagtcccaaaccagggctcaggggttttccattgcaaattgcctgttgagagagaactttagagaatgacagcattttgtgcatcttcccttttgtggttgggtcagtttagacattgcaatctccccatttgggcctggattcctttctctgctgaattgcttcaggaagtgctttctctccagcttcctcttcttttcttatcttcccactaaaggatagaaacttttccggaaggcagcataggagatatgccatgctgtgttagttcatacaataggcagtgtttgctgataggaaaactgcatggaggggaattcttaatgacttgctgggttaagctgtatcaccattgatgaagaaactggataattattttcccaatgctcttattaagtacaacaagccagtctgctgtggtcccttttataaaacaacagtattgatttcttaattcagtaatcaatgaaagctaacatcaaaatccttctatattagcaaatatatgtgggagtctattcactctccctggagaataagtttctttcaaagcatttttaagactgtatcctgcacttctccataagcctgcaatccacccacttcagggaaaacagtatttatatttattcaagaagagaatcaagttggttgctgttaggtgattgtctacatggtacttgttttgaaacaatgataatgcttgtgcttttcgaatagactgtagttaactgctaagttgttcaatcaaaaattttccttgaaatgatcttcactctttccagagaacacatcatttcttcagtttttcttgcctagatggagcaaattttaattagaacatagcagatataagttgacccagttattgttttgtccctgagtgttaaagcgacttcaggaacaaatgaagatttggcttagatggcatgtaaaagttaagctcatagaaagggcagaagagagccttgaaaggaccttcctatctctttcccatccctggtatagaaattttccagaatttctagcactatccacatcccaggaacactctaactcaggagatggttactatcacatagtataacatgacatgacatgacatgcattgttcacattgtacccctgagaagaataactcctgaaattaaatccattgcagtaaatttcacaggttttagctatatggggaagagggaagagcatataaagacatccctctattatacccccttcactcaactccacagtgctcaaggggaccaccgctggtcaatttgtattaagcattggtttctttcaatgattcattcctcctttaaattcaaatgttttgaggaaaagtcacacattaattgccagttttcttataggagcataggaaaaatagttgcagaacttgggagtgtaatagccttcatatagttagctgtctccaagtatctgatagacagctgaatggaaacaagtacactctctctgtggacaaataggttgactctagagcaaccttggcactattgctgttttgggctggatataaggctgtcctgtacatggtaagatgtttggtagcatcaccaccctctacccatgagatgccaccagcaccccaagctttgtcatctaaaaatgtttccatacattggcaagttacaaaattatcccctttcctcactgagaatcactgatctggagcaaggtatatttagagccaacataaggaagacttcttaaaaaggaaatagcctggaaggagaggggttgaaggaagtgagttctctgtttctggagttattcaagcaaaagttggcctgttactgaggagactgaagccatatattagtatttgaactacaaggcatttaagggtatttcttaacattataattatatgtcactttatgaaaatactctactattagggtttaagtaattgcaaaggaagtatttaaaatatggagcagaaagtttacataatgggctcttttatatcgggatcactttgaagcagtagtccagtcaattgttatttcacttgattatattagtatttttgcaaatgccatgaattaagcatcttatttacctatctattataactagggttctcatataaaagcatttttatcagaaaataagcatttattaagcatgtatacagtaggcacagcaagaacagtattccatagaacattattctatagaacattattctatagaacattatcatgtagtcttgacatggagtagagggaacataaaatacaattttaaaatagtagatatcttacaagcttctgagggatatagaagcaaattgaaatatcaagaccatacataaaacaagtccaagtgtagaatctgagtatcaattggcaacataagtacagggagatcagaaagaagaatagaattagcagacaggaatagaattgaacaggggaaagacgtctagatatacataaacagaaagcctgccttcgaagccttcctggaaagttgctttctcatagtctacagaaagatgtctgcacagtctttcatatatgagggaacacagtgtttcatccacctagaatgcagtgttcttcagctgtctgtatgccttgcaaatcctactttccttcagtcctatccctgtgagaaccctttcccaagtactcacttcatgtacatgcccctccattactaagtaaatataactgttcatttgcatatttattcttccatgaactataagccacttgagtttaagaaccacattttttgtctttatattatattactgatacctagaatagtgtctcaaccaggtagagagtaagtctttgttgaatgaattgaaagaattgattacctatgtacagttgataagaactgaaagatgttaacctgctatacttccagaaggctcaaaatctttatgggaatcttggattaagggtcacaaccatcacccacctattctagatcagtctggatgctcataaatgagaaataagcatttctctgcaatggaagacttgtttagatataaaagacagacaatgttgcaaggcgagcatgtgggacaaaattgcccccatcgtcctcactcccattctttacacatgtgccacagatgctttgatttgagagcagctctaggggttccattccaattgtacttagaccaactattccagagaagactatccaaggctcaacacaactagacagtcagggccattttgaatgttagagcctgtcctcttatctagctgtctgcagtctctccacgggaagaatatgcagggaatatttttatgccagatgctgtgcttgtagctaatgcaaaggcaaagagaacatcatcctaccctcaagaaaagcagagtgacaggattagaaatccattcactactctatcaccagtatctctatcactagaatagtaaaaatgatagttgcatttagggagtttagtactgcaaatacaatgattatagcatggatatgttacaattgtacatttttagtatgcctttcttgaaaaatttcaacacagtgattaaaactctgtgcagactgactaggattcacttaaccctgcattgtctctttactcatgtctaaaactgagttttttttttacgatttcaacgtttatttttgattcaagggccaaatatgtaggtttgttacataggtatattgtgtgttgctgaggtttggggtacaaatgatcctggcacccagataatgaacatagtatccagtgggtagcttttcagcccttgaaccccttcctaccttctccccctattagttcccagtgtctactgttgccgtctttatgtacatgtgtacctagtaatatggggatattagtagtacctctctcattgggttattgtgggaattaaataagaaaatacatgaaaagtgagaaaatggtaccttgtatacttagcagtcaacattttagtagatattattatccattaccttttatttatttatttatttatttattttactttcaacatctccagcccaaaaggaacagtttcaagaggaattgagactcacagaggtcaagttccaagttcaagtttttatcactttacaagtagcagaatcaacatgagaatccagatagcttgcctcccacaccaaccaccccctcacatagtctaagctgcagaaaaatctgactcaaaagttatctcagacagaatcttttcatttatttccttcccagacttttcattctaaagcaatctcacaacactgattgttttgaaacctccttccattgctcctgcttcaactcctccaagaaagggcaatgccattcaaggacttcatcacagggagggaggcaccagcaacagcaattaaaaatgcttttgttagcattgcttcattgtagaaatttctcatcagaagtaattatctgatatgctactatttttttcctttgcattggggttaatttgtttcttaattaattccccttctgtcatgtatttatttggaaactactctaccgaaagataagaagttgccgtcaggaccactgttcacaaggcaataggatggtccaggcttacactgcaggtcaggtgtctatgatggaggtcacgcgataaaaagcaaagaatacagacattcctaagatagcagcagtgttttatgctatgattatagattaataggtaaatgaattgaaataggactgctgacacttctgattaaacctatgatattttgccttaatgacacaaagttctctttccaaattaccattaaatatgtgcctttttcatggattgatatgtacaatttcagtatttcaatatggaaagagcagcggttagcagtttataataatgaaggtccatggatttaatgtagtagaggtgcttctactgatctatggaaaatgcagttgaaaattcacagattacctttctaattagcagactttgggaatttaagaatagtgttccaaaaacacctgcagttaaactccaaacaaacgatcctccaggaggtttatcagtgggactttgaacactaaaagtgtagtgtgactatttttgacaacaccacctggtatattgtggaaatccctttgttactagtaacaaagttttgattcttgccaacactttggcttcacattccaataaagcgaactgcaatacaggggagaattcaatagaagcaacaccttcaaaaattatattttaaacatagaccagatttccttgccaagtggtcagaatggcaaagcatcttgacagatttgccatcacttaatagggttgaattgtcagtgtgtttacacaaaggactagtagtttttttcccaggcacagtgcctccaatttcggtagataccataaggttcacaaatgaggcctcatagaatgcaaaccaggcaattaagcttttccaataaggaaaacagatgtggttgaacaaatgatctaaaatttgttctgaatttctcaataaaaaagtaaattccatctaaataaaaatatacatgtgcattaagtctatattacctaagtttacaaagtagttttaagaaagattatttatacaagatttaaaggaatgtaacatcagacaatatacccacataacatatatgtacatgtaactccttgatctaaaattaaattaaaaagtaaaggaaagtaacaataaatgcagataatccagaaaatttcaactgttaacaatgtttatttaactgactctcagctcttatttttacattaaataaagtttttgtgttatcttttctaagatgcttctaggaatttaaaagttcttcatctttcctagagacctttctccaacaaccattattatttatgacctgcttttttccaggaaggattcaaggtgacctgtaatgacaaaaagaggagaacaaataaaaacacaagtacttaggtaattactaccaatgaaataaaatagtttcaagtaggctccatttgttttaaagctccaatctttatatttatattatcaacttactcagcattattgagatgacatcatccctagctttcaagaacccatagcctaagtcagaatgggtagtttgttcatctgattgcccttccctgattcattcctttcaagttggatatcaccaactctctttttaaaacataactttggtcatgtcatttccttaataaaaaaaaattaatagctttttatctcttaaagaacaaagttcaaaatacttataattgtatataaaattcttagtggtctcaccaccatccctctatccttctttaccttctactaatccctgtgaggccctgggtattctgaaaatagggaactacctactattaaagcaaatatgtactttctcatctctgtctttgtgttctctcttctatgtaaaaacctcatttcctctttctctgcctggaaaacttccacttattcctcaacatcaagcctatatgttacctctatatggaggtctgtgatgaatcatctgagtgtaattagttgctcttcacctgtgtttttgtgtaagtttgtattcatacataccttaaaattgtatccttggctatgtttctttgtctcccatcaaattacgacttcctggaggactgtaggggtacattgctcatccaggaaaaaaaaaacaaaactagattttagaatagtgccttgtataatcgacatcagtcaaagtttgctgaatgagtgatgacaaattagctattatcaccctctctattgcttcttgagcatttactacatgcccatcagtgagttaagtgcttcatatgttttcatttaatctttacatgacttcataaaccatggattactatccttttcttttgacagataaagaaattgcagcttaaggagttaaaataactagccgaaggtcacacagctagtgagaggagctgagattccaatgctggcctgattccaaccctgtgcactgtttgcttcttttgcttcaataccatttgcttcttttgtgtctgacagctctgttgaagtaaagagtagttaacaagaaaacaatgaataacacaattctgtttgctacaatatggtgaatatacctttgccctaaattattgccccaagacctcaaaagtaaatgataatcatttaaggaaatattaggctatagccctcagctatccccaagcatacccaacagcttttgtcctttggttaacaactgacaaagattggcatgccttttgttattgataaggccatatttctcatattattgttatacaagtgacttcagggaccacagaaaaatatagattagctcaacttgtggctctgttaaaacttcaagagacattgtcaaaaatcaatatctgaggtactaaacgatgtgtttctaacaggtcttttgatgtcaagtcaccctggaagtcatgctttcgcaggtgttgctggcaaacacaaacactcttgacaccagatatgacacagactttttgatcctgttgttaggaactggaacatgaaccacttcacttctgtgatttctcctgaaaactaatgcatgggggaaaagggaagcaaagagcagatgcagactaattcagtgggcaaaataccttcttgtttgtcttgtaagtacctgctaaatctggatggaaagaaagttattcctgagatagttccttgttagtaagggaacaagctagatatctgaatgtggaatagcatcgtgatggtgagaaatatgacatgtcttttaataccagtctcctgaaatgataggattcgaggaatcctttgtggtctgcatatcacttcaacctaaatgatgagttatgaaaatgccaaaatgaataaccttactatttaagaagtccttcagtttcaaatgaagaaaataaaagtgtgtgacaatcctggttacaaactacaggagatgagtgcaatgattttcagagagacttgggatggaaagcagggtgactttgagcaatttttgaaggtttccactatgattagggagtcctttgtttggaatgtccatgtgaaatcactggtactgagccatgctgttgaatggtgataaccaatatggatctttgactcaagtgtttttggggcccatggcatgtaagagttgttgacctcttcatattatactgcgtacactggtatttgctatacttcattatacgatttctaaaatcaacattaattcctggtcttgggacatgggcatcaattgttttcatgcaaattgttcccagatgtgctacaggtaatgtggccaaaacaaaacaaaacaaaaaaagttactaatccttttagcaataacaatatgattggactcctttatgggcagataactcatatgatgtgaacagcttgaatttctcaggcagttttgtcaactatataccacctccagttccagtttaaaatacaagccaatctgggattttgtacagctaataatgtaacttgaacaagctgaataggagggacactgaggtctctaaacatcacaaattctagaacttgtttttatgtaataacctgtgctatgaggtaacagatggttcaaagtgcagcaactcaatggttctcttccaggcacatatataagcatttaattaaaagaactaaacaaaacattcagcactgcatgtgtgacaaagcaattaaaggtgtagacttattcttagaaaacagccccaaaaagataggtgaacagcagagaataaacatgaaggttattatcaagtctcctgattacagggcagtagcaatggtttattttttaaatgtatatagttcagctctgtaaataacattcttcttggaagtgggcatttgatgcctctttgtcatctggaatttttgtagctaagtatagatcctcataaaactatttattattgttccctttaatgtattagcacaaattcagaagccaataactgtaaaacttctgaaaataattctcatagcactaaaaaatcactttagtgggaaacttgtttctaccagattctacatgtccacagtccttttgtcttgtgttgaaaaaaaaatatttggcattgtgtcagcatagaaggcacaaagctctgtttgaaattgatacatcatgtatatcctgagtagaaatagtaaataaggaactgatgtgggggctcacaagtgactgatattttccagttcacattctcttttttcacaacaggaaaagaatagagtaaactgcctgagatctttctcatagctcatattcttttgctcccatgatcacagcacctttcatgataagcaatgcacaacatgtgataaatcaacacacagaaatagaagaaaactatgtcagtgtaataaaaagccgtatactaaaaatatacagctaatgtcatactcagtgctaaaagactgaaagtttatattcaacataatattggaagttccaacccccagtaccttagaatgtgacttgattgaaaaatggtgtcattgcttatgtacttaggttaggatgaggtcatactgaagtagggtaggttcctaattcagtatgactggtattcttacacaaaagcaaaatttggatacacacacacactcatcattgaaataaagcatggcacctgggatcctaaaaagaaggctctatgccttgttagaaaatatcatgagaaataaaacttccaaataaattagtattgaactaaaaattcccatctgtgaatgagtatggcttggatgcctactgtagcatcattccacaattggctattgattgtgaaaaaaaataaagttttaaacattcctaaagcaagaataagggagcaagtggtgtgagttgattcctgaaggtctaaatcaattccttgtcttatgtgtcatctcgttttaataaaaaaatgaatatgactagttaaagatccacattgcacaataaaattgtttatcagtcatatttcagagtggcttcatattgcctgctggtggtcagcttccccgtcgtgtgtgcatgtgcacacgtgcgcacacacacacacacacaaacccatcattataattagaaaaggttacatggtagagcagcaaaatatcaattccctcatcaatccatttaacaaatattatagagcacctctatactctgtgaggcattgagaattcagagattaacgagagttctcactccagtggagaacttagtgaataatctagaaatcaccatatattttcattagtaccatgagagaaacacatgagggaatgaaagaggctcagagaatgggcacacaagtcattctgaagtcaggcattagaacggttccttagagaagaagcccttgaatggattagctgagcagacaagtggtaaaggtcattctagacagaaggaacatcacagtaagtcagagattctccataaagttgagtttatttggaagaaaaaaatatattgggaaaatggtggcagatatttaataacatttagcaatggtttgttagacaactactgcaagtaaagcccattctaaattacaccagcttataactacaacaatggggaaaagacacaaatactaattttttttgtccttgcaatagtttgctgagaatgatggtttccagcttcatccaagtccctacaaaggacatgaactcatcattttttatggctgcatagtattccgtggtgtatatgtgtcacattttcttaatccagtctatcattgttggacatttgggttggttccaagtctttgctattgtgaatagtgccgcaataaacatacgtgtgcatgtgtctttatagcagcatgatgtgtaattctttgggtatataccagtaatgggatggctgggtcaaatggtatttctagttctagatccctgtatgcatatgtaacaaacttgcacattgtgcaaatgtaccctaaaacttaaagtataattaaaaaataccaattttataacattgcatctgctggcaaacataatcatatctggccaagtccagcatttcttcttgagcaaaattaatcacatctgtgacttgataacctgcaatgaaaacattgcaacacctaagtcctggataaattcaaaacaccaagaaaatgggtaccgcataatatctgaacattgaaaataaaatgacagtacatgctacacatggaaagagattctgctaaacataacttacttgcatgccgcctctcaggccctaggaactaatgggttctgctataaggccattgtgtttctcacataaatcagaaagccaaatctgactctgatatttatagcttgaagctttcattgcccccgtggaaatttcccagtagactcttagactatcattgttatctctgttgatggccagtcagtaaacgaatgtttatggagtcaccacaaagcacagactgacaaatgaaaagcatacttttgatagcaagggatgattggtcatgatcctcaaataaaggagtttatggcttcagaacaaaaaaacagacaaacattataccttgaaatatatcattgcatcattatagtgagaggaatccattacgagcttggattgcagaatggactggataaatatgacaaaagtgagtacagtgagtggtcccagaattcctaccacttatgggttcctcagtaagatctctatgcactctttaccttagtttctcaagctataaaatgggataatggtagtatctacatcataagaatgccctgaggattaaatgagaaaacacatctgcaacaattagaacagtagctggcacaaaaatattaggactactgaaaatactagggatctttaaaaggcttccccaaaaaagccttacccaaaaaaaaaggtagtctgaaaacagtaacttagagaataggaaaactgaaatagctcttctttgttcacttctgaggaattctgaattggaatctaaacaggataaaccacttaataatccgtctttgactttagccacccttagatttctggcacttgctgaactgcaatattgaattttgcatttataatttcattttttctagttttttcttctttcttcacctgtgtaattttaacttaaactcaggaatttacatctcttcctatataatatcaccttgtttcctgagagggaaactagtcctttgagaaaatcaagagactgagctctaatcttaggctttctgcctattagttgtctaaattttgaaaagtcacttcaccctgtgagattgttttctcacctataaaacaaaaggtttagatcatcttcacagtttcttctatctctacaatgtaaagatcttattgcttatttatgcttttttcaatggcattaatacaaatgtaattttatttggccactataaatatagaaatataagactttatataagacttatataaagacttggaataaatataagactttcttccaagctgctgtctttgagtacgtttaactgtattatccaactcctatcactttctcttttcctcaagagtccaagcaatgtcaccaataacttattaaagtcatggtcctccaggctgcaactcttccttatataatgttgaaaagatggccccctggtaaaattcactcttattaaacccatgctgattcctagtactttcctcgttcagttctaagtgtttccatgctctctgttagcaaactttgttctagaagattaccaaagcacatcatgcttattcatttatatttcttcttgatttatatatccagaatttgtccttcctccttccctttcaccctgtccctttcaccctgtgggagtcctccattgtgtgtttttcaagaattattgatagtgatttcataatgtaatctgcaatttcttccagaattcattactggggacaaactccattcatctgattatggggtggttttttttttttgtattctctcctacttttgagtgtgataacctttttatattatttgtactgccatttccatgttagaaaccattctcaatggagagaatgagaaagtaagagggatggagcagcatctttcttttattcatatagaaccaactttcccatttgatgattctgtatcttcctgccacatcttctcctgaaacataatttcaaatcaaaacaatagcaatgacaaaaatcactttgatgcattttcacattctgcgctttagcgtcccttatttttacaggcttatgtcaatcttctatgttgtatatggggacgcccccaacatacatacagacagcacccattctgtgttgctggttcttctaacaccaaaatcccccaaatgcagcctagcacccagtggattctttagagttttcatcttctctttcttgttgagactattctgtattgtatgaattatttttatagtcctcctgtattccattttagagtcttaatttatgtgaagcatatctcttttaaagtatttttttccaaagcatatataactacatcctgtttttccttcctccactctatctaataataacataattgggtaactttcttccaaaattttacattacttctccattctaaaacaatttttcttttatcattcaaaatgatgtccagtgtaggagttcctttatttctttatgctttctcagagaaaccatatggccagtaaagtaagtcaagaatattccagaaccaagcttttagacaaatgagacaggaacccagttaacaactacctggatattccccaaccctagttttaaatttatgttaaaaggaaagttcctgctaacagcaactaggcagtctatggtgtataccataatattgcttctgttcctcttgttctttctacctggatgcctttctgtgtttgaagcctcaggtttatagtcacacagtagaaggtagagaggaagctgtgaggggatagccatagtccttgaagtcaaaacacctggttttacaccttgatttcacccacacattctaaccatatggctatgaacaagtttcttcacctagcagaactgtttttgcatatctaaaatagagataataatatccaccataaaaagttattgtgactatcaaaagagcaaaatatgtttgtgtgtgtgtgtgtgtgtatgtacatacccagtacattggtacttggttttacaacagaataaacacattttttaaatgaataaaccaaactaacattcttctttacaaataaggctgaggtggatgagaaagagaaaggagagagacttataatctattgcctcccatggtgtttacttttaagcattttaacccttttaatctaaagaaactaattttaaaaggagcagctcactgtgataaaattacttcaatacttcactccatgattcatttgtattacatgtgtttctaatgtaactctgaatatcgtaagtttgactatattatcaccccatgctattcaatataggtgatacaattgagataatacttactatgttccaatttcacgtttcaactcaccaaatgtgcctcctttttctagagtcagttgtggtctcctcattaaacacacacacacagaggaacataaaattattcttaaaatgttggcaatagttgctgttttattctagcccacagccttccccaaagttacagctcattgtgcccctttccaatgcagagaatctttcccacattgctgttattctatggctagttcgttctcttgcaaagcctgccttcattgtaaattattctcgtacatcctggagagttagacatgaagcctatcattgaaaaacaagaacttttttgttttttttttgagcagtttctcattactcctacccctatgggagaggaaatttcagcagtttaggattgtttcactgtgattcttcgctgccagaaaataatgtccagatattttttaggtcctttcattctctgtctccctgaggggttcaggtcctgattaatataacttgaagatgagaaaatcattgtatcaagaagagatggcctctccagtgctagccagaaacctcttaacaaagtcaagctatgcatagacagggctcctatcaccaagccttccatagtggtacataaatccagtggaagccaggcactcattctagaagtaatgacagtacctgtttggtgacacctgccatttcagtcaggctgagtgaagcaatattcctatgcctaaataagtcagtataggccattttgtccagagtctcctagtcctgagaagagaagaaataaataatatattagcctttaccccttcatccacccattcacctccattcccctggattaaagaatactaaatgcaagaaagatttggggttttaattttgcattatattgtgtgttaagccccagatttctagctgttttatttgtggttgagaggtagcaggattggaaaagatatagaagatatttttgatagctctggactatatctagtgttgattttaatagcaggccagatatccaagaacatgctgtgtagctgtgtatgaacttggctgttggtttctcttgccagatgaaattatgattaatcggggctcagatgtcagttgttttatgttgcttgtgctctttgctaacagctgcctatttcaagctgtgcttgctacatgtcaaatataaacgtgaaaccacaatttccaaaaggaaaaatttcaaagtactaatattcatgccaatgtagacagagcatactgtaatagtcaatgtcatttctgattaaaatccacttagtatgttacataatttaacttaagtcagtatagagaaagaactctcctacgtgaggtagacaggagaaattatttttaaaagctaattattcagtatgcatataatctgtttagatatttgtaaatatatatctcttcaaatactgtatgcataaaatgctcctcaataaacaagtgtcactttcctttttattctacaataaataaaaatgataaatattgttgatagtcaattataaaaaatttaaatatttgattcagatttaggtttaaatacttggaagtaagtggtctgttcttgacaaggtcctcaataccttttaattttttttaatcaaaaatgatgtaagaatagaattctatattatttcttttcacatagtccaagcagaaaaatattttaaaaagaaaaagaaagtaaagaaaatattggtcaagattttcaggagtttagaaaagcgtatgcctaaaatgttgggtggtggactaaatagaattgatttttttttttttttttttttttttttttttttgcttaacctagatgataaatgtctaatctggactgcccatgtggcatgcagttcccaaattaaactctttcagagactgccgtttttagcaaaagagggggaagtgagaattagacaacacccttgctctttctatacaagtgcagtcaaaaaccgagtttggccaattcactgtagttcattgcttgagctatatatagcaggaccccagaaacttaaagaaacctgagagcccatggacaggttttatcctagtctagagtctagcacagagtatagaagagagtgtggtgcccttctcatttctctactctgccctttcctgaagcacacactacctgtgtgagacctgcttcctagtgtccaaaatacagtatccaaggaagcatctggtattcatctcaagaactaacagaaaaatgtagccatctagagtagagggaaaagggagtcagtaaaaggtgtggatgctattattcattttcatgtccagtcatctacctcggggtttctaacaaaggtccttcttctccctcccctaggtggcaaacctgctgcggctcttccagatccctcagatcagctacgcatccaccagcgccaaactcagtgataagtcgcgctatgattactttgccaggaccgtgccccccgacttctaccaggccaaagccatggctgagatcttgcgcttcttcaactggacctacgtgtccacagtagcctccgagggtgattacggggagacagggatcgaggccttcgagcaggaagcccgcctgcgcaacatctgcatcgctacggcggagaaggtgggccgctccaacatccgcaagtcctacgacagcgtgatccgagaactgttgcagaagcccaacgcgcgcgtcgtggtcctcttcatgcgcagcgacgactcgcgggagctcattgcagccgccagccgcgccaatgcctccttcacctgggtggccagcgacggctggggcgcgcaggagagcatcatcaagggcagcgagcatgtggcctacggcgccatcaccctggagctggcctcccagcctgtccgccagttcgaccgctacttccagagcctcaacccctacaacaaccaccgcaacccctggttccgggacttctgggagcaaaagtttcagtgcagcctccagaacaaacgcaaccacaggcgcgtctgcgacaagcacctggccatcgacagcagcaactacgagcaagagtccaagatcatgtttgtggtgaacgcggtgtatgccatggcccacgctttgcacaaaatgcagcgcaccctctgtcccaacactaccaagctttgtgatgctatgaagatcctggatgggaagaagttgtacaaggattacttgctgaaaatcaacttcacgggtaagccaagagcctttaaacatcttctcagatgcaaacaagtgaaataaaataggaatcaaatgcctctgtgcccaattcagaaataattatttcaaagccataaaaagggttcaaactgttaaccaaatattccaggatgcaataggatggttctctaacattcttactcatttctgaatgaacatctcggctggtacacgacatggcaatgaaaggggccccaggcagggctgacagcccactgtggtagctccctagattagggccaggctagatttgagctctttgttgatgttggctgcaggattatggcatgtgtgatatgggcacttaatcttctttagcagaattggcacctctctagggaacatgaacttccaagccttctttgtgggtgacttgagcaaaagaatctcataactttcacagtgggtgacagagagagagagagagagagaagtcactgttctcccagagcataattaggggcaaaacagaaaagatacccagaccctagtgatttctaggcattccgtttatttttctgctataccaaaacatttatatattattaatagttggggattttctcaaaatatgttatgaaatgaaactctttttctgggagcttgactataagcaggttgaagactaatggaattcattctgatacagtagtgaacatcatacaaaggtgtattcaaagtgaaaagtgatttttgctgcctctttatttctaaatacagtctaaatatttctctaactatagtattgcattgaatgcattactacgtaaaaagcacaaaatctttaggtctacattctctacttaggtacatgggatatctgcttattaaggcacttgttctgggtagtatagcttaatcccaaatcataaaatattaagtaatatttggggcacaaagattttgatgccaaaaacattacagtgataaaatgctttcatcaacctgaattactaatacctctcatgccactcaggcatcgttccaatctgcacaatgtctagtctgcttccacagaagtatcatccaagacctgaaagtttatatgctcagatcatactaccattggcgcaaatggcagttctcacatctcccttataagtggtcactcagaagtcaagtggtctatgaaatcacaggtaataatgaaaaaaatgcctcatgaccattggcttctattccataattcttacctgcaaggcagccttgaaaataagcacaaaaatcaccacactgcatgttgcataacttctttactttccccagagagggccgaaagtagtcaaaatcaattatgtcagtaattcctccaattaatctgatggataccacttcttatcattagaatgactactaaaactggtaaagattaaactttttctgtgccctgtattcccatgagtgtatttcatatagcaataacaaaaataaataaataaaaagagtaataaatgagcattcatcttcaaatcccaggttagttcctgttgacatctctaaaaattgagaatggaccttggagtcagtaaaaaaagaatatctttactctaaaaataaattaactctcaggtattcgtaaaaggtatctgcaatgcacttaattcttaaagatgaataagaattcagcacatactccccatcagactacccttcagggtattatttatctttactcaccacatatattaattaactttgttattctagttcctttcttactttttagtatgcaaatatacaaatatattcactcatcaacagctaaaataaaatgaacgcttagaattcagagagcctttgcaaggtgttttatggaaccaaaacatgttccttcattccagtgacttcttgggtcttaaaaggcaaagaaaagtaaagaaacaagcccattatttggataaacaaaacaaaagtatcctctttttgtctgtcttgttcaattactcttttcaagtctaccgttcagtttggctgtgcaaacctgaccacaaagtgctattttagccttctcaatttgacagacattaccagtcattctccatctctgaagagagtaggagggtgaaaaacagatttaaactacataaaagagagggaatttagaccagccacaaggtaaatattctcagcagtgagaattggacaagaaaatacattactaagggaggataccaaaatgctaagttagctaactagtacatttaaaaaataagtcaaagaactaactatagtaatagaatgcagattttagcttacagtaacctgtatatgactaaatatatgtatatttttaacttagagctaggtaaaagattataagtatgtatgcattattactgctttaagcttgagatgcactatggaatattttttcctagctattgaaaagcagatttgttttactttttttctgaaacagtatctttgttttttctaacttgaatattgtggcaataaactaggcacaatagtacacacttagcagacactaaacagtctgttcaattaggctgaaaaaagtcttcttctggctatttgcatgtactcaatacatttactccaagattcttctgacaagggacacttttagccaattccccaatagctctcatcattataggattaaaaaactaggcctcctgtgaatttaaaaatagattaaaatactccctggtactcagatgtgttcccactagctaattccagcattggtcaacatggatcttgtttgaagctaacccagtttaaatattccttttgcaaaacagatttttagagctatgccttgctaaagattcttccaaatagtaatctctcctggcacaggagctaaccactgcccaggtctctaggctcatctcctgctgtacactccacattcactcttccttccattagcactacttgcagttccccaaacatggcatgcctctatttttgcctgcatacttcctgtgaatgctatttctttatctagaagattctctccccacccccacctgccttatctggcatcttcagtgattcctgtgtctctttgagatccaatttaattgatagttcctttaggaatcattcctatacttcccaaactaagataaatgccccttcttatgcccatatccatctgggattttgccttccttcatactttatatccaatacaccaaaatctcttgttggctctaccttcaaaatagatccagaatctgatgacttatcatcttctcaactgctaccaccctggtccataccaccatctctagcctacatttctgtgatagcctcctagttgatttattcttacctacttcaacctagcctccacaatctattctctacatgatagccaggatgcccttttaaaatctaagtcaaagtccttcctctactcagaaccacttgagttcccttgtttcactcatagtgaaagtcaacagccttacaatgtcctgcacaccaccctccctgctctgcccctacctatcctgactgctctcctgtcctcaccttttactctccttctttctcacttcactccagccacccttgtttccaacattagggcttttccactgccagttctctctgcctatattgcccctaacccagatatttctgtggttaatccattccctacttctttcaaatattcatgtaaatgttatcttctcaatgagacctactctggccattcttaacagtgtaatgcattacccccaacccccactacagatgcccctatttcccttgtaccctgctctaccttttgttttttcaccccatgacattttccccttctgtcatactacatcatctattactttcatatttagtctttattgtttgatcctcacactagaatataagctccacaaaaaacagaaatcattatcaattttgttcacaaatgcatcccaagcataaaaggtgttcagtaagtgttgattttgaatagcagttaacccaaacttacgttttcttctctacctttattactagcttgtgggctctttcaaggcatggtacatatatttcatctctgatctcaaatactcagcatggtttctggcatagagcagacattatgtaaatgtttaccaaaggaatgagaaattataaaagcaagcaatcaatttataatatgattgctttgaaaaaattttaatatataaattttgttcattaacaaatgaatgtcaagaaaggaaagtgtatgacttctagagtggcttgcttttttacctaagtactctcttttagttatattctatcatttcatttgagataaatgtaaccaaatatcattaaagctggaagagacccatcactgttttatagatgaatcccaagaattgaaagtgattcgcccaagatcagtcagctggttagtaacaggggccaggactgttagctcgttagtaacaggggtgaggtgaaattcatgtcacctgacccagtgctgcttttgcatgtgcacgaggactctgggaaattgatgtatttgatcccaaacatctaccacagtttctgatccattctaaatattaatgaaatgctattgaaggaatgaaagatgatcaataggtttatagtatgtttcctttttttatttctttttaagatacctttaatgctcctggtctactttttcagttgacacaaaggtggttcatcaaacacccaaactttgaacgctgagccttggattccaaaccttagtatatttaaaaataaataaagtttcaaatcattttttaattgttcagtaaaattatttccatgtgcaagagttatgtcatccagaatcctaaagtaaatatttaaatgagaattatgtttggtgtcatgtgaattttcaaacttactttgagtaaaatttcagaatttatgatgtaaaagaaagcttaaactatgcaatacagttaagaaaaaggaagtcgagaggtctatgaaacatctaaagaaatggaatatcactgtgattgtgttcacagtacagtacattctttctcactttttatcctgagaccagttccagaaagtcgaatagaataaaatcatagagttacaaaaggccttcctcaaagatgagcttgcccctacttctcacttgacagaggtgaaaattcaggatgtcagcattattatcttcacttactgaagcacataaaaatgaactcaactgtcagagtgatgtggtaactggagtatacccaatttgaaggaaaaaagaaagagcttccatttgctaagcataactgccagaagtgccccaagacacatccaatgtcacgtaggcattatctcaggaataacatttatgccattcctctctgcaattcttagggttaggctaaactgtttgagaatggagaaattgagaacttgacacaaaagaaaattcatccaagttcacataatgaataggtgacagagtaaatgccaaggtcctgatttagtcattcattccacagatacgtttagatgtcatgctgggacctgaggacccaacagtaaacaaggcagatgcagtccctgcttcatagagcttacacagacatttaaccaccaaaaacaattctaaagtataaaagcatgattattatggcttacaatgttagggtgttgccctaggatttttgttctgctttggtttggattgggaaattactatgtatcttacacccagaaaagatctaggatccctgaagaaatcttactcccagggcttcacttatatgtgaagaggacaattccctgttactgatggactcatcataacaggactgaatagtatgtacagctaagctaagacagttttcttttttatttgtttgcttggttggcttagttcattggttggttgcctttttttttttttttttttttttgctaccagtgaagagacagactactgggatcagagacctagagcctggtggagacagtccagccttcttcttatgtttacaattctctacacctggaagaggagaagaggcagaaaatgggtagtccagccttgccaccctactcacctctgtgtctgattcatccaataggaacaaggttcactcctggttgggactataatcacagagcacaggccaggaagggcagattttctgggacactgcactccaaggaataacgttttagctggccccaacccagcaaggctctcctcttgaaaagtacagggccatccaaggcacagtgaggaagccaaaatggtaatggccacatctttagatgaatgggctttgaagtccctgaaagagcaaactgctcttgatcttgcttcctcccctggaacatttgtagttcccacaaaagcacagaaacttgttccagctctgctgatcaaaagcatttccaaaatgtaaagataaatatcctgtacttctttcttcccccttctctctggtcagcttcctggggtcataagaataagattttaaacccccaaagggcaccactaatgtggtcacttatttgtttatgcaccgtgcatctgtgctttggtgtcttagaggcttgagaaatgattcccattttaaggtcatgctgtggagaacaggagcctctaggaaacctaattttccacttaggcttgtgctttctgctgctgctgctgctgcttgttatttttactattatcattatagttgttattattattgtcattattatttaataatccttaatttattatgagtcatttatacatcctgtgaggcagaaaaaagtaatgatccccaatgaagtatgaaagaaatggatcataccaccttgctagtcagaaaaaattacagtaaaaatactatttccttgatgtttccagacttttttggatactgtggtatgtttacaggaatatcacttgcaaaggtatctggagattggaaaaaaatattctaagtatttttttttaaatgtaactaaaatcctgtttaaaaatcagtttaccttatctatgtccctttcaagatagcttgtattatcccaacaagaacatagtcttctaaaggtttctaatctctggaaactttgtcatagtagagttaaaaacatagttttttccacttctgtatacctttatgctattacttatcctgagcaggacactgagaagccaacatacataaaggaactattttcagtaggttcagaaaagctatcagattgctgtactcaccaggatagcaatcacatactgaaatagaggaatgttctctaaagaacttcaaacaattatactgttatccaatggaccatgagtgtatgggaagctatcctaaagttgagtttagtaagccttcacagaaacatagcaaaattttcataatgcctgagcaatgagcatacatcctaaagattaaggatgctgatgttatactctgaggatcaggcattgagaaggatggctaaagaacttgaaaactagtcaccattttcacctgcctcttaccaaaagcacttagcaggggtccacaatacttcttatcactttatgtgacatcagcaggcaaggttagctagtcagtctatgtttcttccctgaacccctagcatggttcctggggctactgtacctacactccaaactatgataatcaaaggattcattccactgtctaaagtatattagaatttgttaacgtggcagagtcctctgaagtcatagtaataacattccagaatattcaaagatttcattctcttttgtctttaaaaaaaaaaaaaacaattttactagcacagagttgaccataacttaaatttacaaaataacatctcaaccaccaactacaaaatcatattcatacacacaaagctgctggaccaagtatgattagatagtctaagattgccattaatattaacctactacttgtccattcattctccctagcacacaagaagtaaagtaacgaaagtttctcaaatgtatgttttttttttaaattaaggcagtttaatgtattactttaaccagccactttggaaaagatgattatttctcttttacttttagagtggggttaacacatacagaaccgaagtataggaggataagttaagagccattggtctaggttagtttttattttattttattttattttattttattttattttattttattttattttattttattttatgttccaggatacaagtgcagaacatacaggtttcttgcacaggtaaacatgtgccatggtggtttgctgcacctatcaacgcatcatctaggtattaagccccacatacattagctattgatcctggtgttctccctccccctgcaccccgacaggccccagtgtgtgttctcattgttcagcttccacttataactgagaacatgtggtgtttggtttcctgttcctgtgttagtttgctgaggacaatggctttcatgtccatgcaaaggacatgatctcgttccattttttggctgcatagtattccatggtgtatatgtaccacatttatttttatccagtctgtcattgatgggcatttgggttggttccatgtctttgctatagtgaatagtgttgcaatggacagaatgatttacatttctttggatatatacccagtaatgagattgctgggtcaaatggtatttctggttcaaggtctttgaggaattgccacactgtcttccacaatggttgatctaatttacattcccaccaatagtgtaaaagcattcctatttctccaaagccttgccaccatctattgtttcttgacttttaaataatgtttattaataagtttaagttccttgtagattctggctttgtcagatgaacagattgcaaaaattttctcccgttccgtaggttggttgttcagttgagaagtctcttttgctgtgcagaatctctttagtttaattagatctcatttgtcaatttttgcttttgtggcaattgcttttgatgttttaatcatacaatctttgctcatgcctatgtcctgaattgtattacctagtttttcttatagggtttttatagttttggggtttacattaaagtatttaatccatcttgagttaatttttgtataaggtacaaggaagggatcctattttaattttctgcatatggctagccagttttcccagcaccatttattaaatagggactcctttccccattgcatgtttttgtcaggtttcttaaagatcagatgattgttgatgtgtggtcttatttctgagatctctattctgttccattggtccatgtgtctgtttttgtacctgtactatgctgtttgggttacagtagccttgttgtatagtttgaagtcaggtagcatcatgctgccacctttgttttttttgcttaggactctcttggctatatgggctctgttggttccatattaattttaaagtagtttccctaattctgtgaagaatgtcgatggtaatttagtgggaaaagcattgaatctataaattactttgggcagtgtggccatcttcacgatactgattcttcctatccatgagcatggaatgttttttcatttgtttgtgttctctcttatttccttgagcagtggtttgtagttctctgatacggtttggctgtgtccccacccaaatctcatcttaaattatagctctataattctcacatgtcatggaagggactcaatgggtggtaattgaatcatgggggcaggtcttttccacgctgttctcatgatagggaataagtctcatgagatctgaaggttttataaaagggcagatcccctgtgaatgttctcttgcctgctgccatgtaagatatgcctttgctcctcctttgccttctgccttgattgtgaggctgccccagccatgtggaattgtgagtccattcaacatctttttctttataattacccagtctcaggtatgtctttattaaccgagtgaaaatgaattaatacaataaattggtaccagtagagaggggtgttgctctaaagatacctgaaaatgtggaagcgactttggaactgggtaacaggcagaggttggaacagtttggagggctcagaagaagacaggaaaatgtgggaaagtttggaacttcctagaaacttgttgaatggttttgaccaaaatgctgatagtaatatggacaatgaagtccagcttgaattggtctcagatggagatgaggaacttgttgggaactggagcaaaggcaactcttgttatgttttagcaaagagactggcagcattttgtccctgcccaagagatttgtggagctttgaacttgagagagatgatttagggtatctggcagaagaaatttctaagcagttcaaaatgtgacttgggtgctgttaaaggcattcagttttatgtactcacaaagatatgtattggaattggaacttatgtttaaaagaggagagcataaaaatttggaaaatttgcagcctgacaatgcaataaaaaagaaaaacccattttctaaagagaagttcaagctggctgcataaatctgcataaggagtgaggagtcaaatgttaattgctaagacaattgggaaaatatctccaggacatgtcagagaccttcacagaatcccctcccatcccaacatcccctcccatcacaactcagaaggcctaggagataaaaaatgatttcctgggctgggaccagggcctcagtgctttgtgcagtctcaggactcggtgcctgcatcccagccgtggctaaaaggggccaatgtagagctcaggccattgcttcacagggtgcaagccccaagccttggtgacttacacatgatgttgggcctgcatgtgcacagaagacaataattgaggtttgggaacctcagcctggatttcagaggatgtatggaaacacctgggtgtccagggagaggtgtgctgcaggggtggagccttcatggagaacctctgctagggcagtatagaaggaaaaagtggagtatgagcccccacacagattccccatctggggactgcatagtggagctgtgagaagagggccaccatcctccagacctgaggatggtagatctacctacagcttgcactgtgcacctggaaaagccgcagacactcaacccagcccatgaaagcagccaggaggggagctgtaccctacaaagccagaggggtggagctgcccaagaccatgggaacccacctcttgcatgagcttgacctggatgtgagacatggagtcaaaggagaccattttggagcttcaagatttgactgccctactggattttggacttgcatgggtcctgtagccccttcattttggcctacttttcccatttgaaatgggtgtgtataacaaatgcctgtacccccattgtatataggaagtaactaatgtgcttttgattttacaggctcataggcaaagacacttgccttgtctcagatgagactttgactgtggacttttgagttaatgctgaaatgagttaagactttgggggactcttggaaatgcatgattggttttgaaatgtaaggccatgagatttgggaggggccaggagtggattgatatggtttggctgtgttctcacccaaatctcatcttgaattgtagctccaataattcccacatgtcatgggtgggacccagtgggaggtaattgaatcatgggctgatggttttataaaggagagttcccctcttcttgcctgacaccacgtttatgtgactttgtgttcattcacctcctgccatgattgaggcctacccagccatgtggaactctgagtctgtaaacctctttcctttataaattacctagtcttgggtatgtctttattagcagagtgagagctgagagcagaccatacatactccttgaagaggtccttcatttcctttgttagctgtattcctaggtatttttttctcttactagcaattgtgaatggaagttcattcatgatttggctctctgctcatctattgttggtgtataggaatgcttgtgatttttgcacactgattttgtatcctgagactttgccaaagttgcttatcagcttaagaaggttttgagctgagacgatgaggttttctaaagatcatggcatctgcaaacagagaaagtttgacttcctctcttcctatttgaatactctttattcctttctcttgactaattgccccggacacaacttccaataatatgtttgataggagtagagagagagggcatccttgtcttgtgccagttttcaaagggaatgcttccagcttttgcccattcagtatgatattgcctatgggtttgttataagtgtctcctattattttgaggtatgttccatcaatacctagtttttttttttagaaggagtctcactctgtcgcccaggctggagtgcagtggtgcgatctccgctcactgcaagctccgcctcctgggttcacgccattctcctgccctagcctcccgagtagctgggactacaggcgcccaccaccaaggccagctaattctttgtattttttttagtagagacagggtttcactgtgttagccaggatggtctcgatctcctaaccttgtgatctgcctgcctgggcctcccaaagtgctgggattacaggcgtgagccaccatgcctggccaatacctagtttgttgagagtttttaacgtgaaggtatgttgaattttattgaaggccttttatatgtctgttgagataatcatgtgttttttgtcttcagtatgcttactgatttgtatatgttgaaccaggcttgcatgccagaagattaagaaactcactcaaaaccacacaactacatagaaattgaacaacctactcctgactgactcctgggtaaataatgaaattaaggcagaaatcaaaaagttctttgaaaccaatgagaaaaaagagacaatgtaccagaatctctgggatgtagctacagcagttttaagagggaaatttatagcactaaattcccacatcaaaaagctatgaggatctcaaatcaacaccctaacattgcaactaaaaactagagaaccaagagcaatcaaaccccaaagttatcagaagacaagaaataaccaagatcggagaggaactgaaggagatagagacatttaaaaataccctttacaatatcaataaatccaggagttggttttcagaaaaaaataattaaatagatagactgctggctagactaataaagaaaagagagaagaatcaaatagacacaataaaaaatgataaagggatatcgccactgatcccacagaaatacaagcaaccatcagagaatactataatcacctctatgcaaataaactagaaaatatagaataaatggataaattcctggacacatacatcttcccaaggctgaacaagggagaagttgaatccctgaatagaccaataacaagttctaaaattgaggcagtaataaacagcctacccactaaagaaagactagaactagatatatttacaggtgaattctaccagaggtacaaagaggagctggtattattttttctgaaactattccaaacagttgaaaaggaaggacttcactctaactcattttatgaagccagcacatcctgatacaaaaacctggcagagatacagcaaaaatagaaaacttcaggccaatatccctgatgaacattgatgcaaaaatcctcaataaaatatggcaaaccgaatccagcagcacatcaaaaagcttatctaccacagtctaagttatttaagttatttaaattgcactttgagacaagattatactttctacccctatagtaaacaagttggctagcaactagtctcatcttttatgttttaccacggcaaacttcttcttttttttttttttttttttttttgagacacagtcttgccctgccaccccaactggagtgcagtggcatgatctcagctcactgcaacctctgcctcccgagttcaagcaattctcctgcctcagcgtctcaagtagctgggattacaggtgcatgccgccatgcccagcaaatttttgtatttttagtcgagacggggtttcactatgttggccaggctgatcttgaactcctgacctcatgatctgcccacctcagcctcccaaagtgctgggattacaggcgtgagccagtgtgcccggccaccacagcaaacatcttacaagtttgttcttcatgataaagcaaagacagaatttggaattgagtgttttagagctagtgctgctagagaattttcctttttaatatggaggggatttgtgggcaatggtgacatatgtacatagaaaaaaacaacacaatgctataattatgaaacttttcagagaatctttagtattcagtgtgaaacagtgtcaggtactacaacagatgagattaaaagagaaaaaaattctttctgccatcaagtatcttagcaactagtaagggcaataagagagtaacttttacaatacacagcagttcatcactggcctcttaagagagctataagttgcatagtatttagatacaaaagagggaccatagtgagcagagggtcagaaaaggcttcctaaaagttataatttttagaatacaatcaagatttcattaacaaattcagaattccttgggaaattaaaaattaaattggaaccgtaaagtgttgttttgattttatagattaaatataaaatgtgtgttttagtccccttgtataaaaaatatataaacttctctaaaaccacattggttgtgatccttggtctatcattttcaccctgaatttaagctaaaaccaattaaattttaatctgaaaggaaaagaagaaaaaagaaaactagcatttattgattgccactggcctgacataaccattttgtatattttattcattaattctcacaaaaatccatcaggttggtagatattatttccctctattttataagtttaaatgtgtctcaaaagtgttaaatgtctttctccaatttgcaaaactaagtggctttggagatttggagacccaagtctatctgtttcctactcacacattattttccgctcctgcttcctaaaaagaaaagaaaaaaaaacaaggtttgtatttagaaaaaggatgcagtctcattgtcatttggctcagcttacctatgtgcattcacagtaataataaaatattgtttccaaatctgaataatataagaaggtatttgttaactcattagttgttataatgtaattgttataatgatgtctttaataaagaatgactcataggaaaggcctccaactacatacttcactccttcctctgagagcatcagattgcgccagatcaatatttgcaatatcatactgttatttctgagaatcaatagtaaattgaaaaaaaaaaaacgtaatcaggctacagatcaccatgtcttcaatgctgttgaagactacatttctcttccctatcacaccattctctcactctaattacaaacctccatatatttaattaaaagtaaattggttgaagaaatgagaaaaatactgggtctgaaacccttctaggtttccatccaagaccatgatagttttgtgggtttgtttaatgtgtttaaaagcttttcctgttgaattcatgttattaaggggtggtagtagtagttgttttatagcacacatcacaaatcaagttaaaaattttaaatgcaattaataccttcataagttagagcatcttcagagttttctatcacaaagttttgtttacaggctattcagtcaccaataatcacattttagcaatataccactttcttagggtacttaacaaaatctttatctctaaaatgcttatagtctaataaaaccttcaaccatgatttctcaattgtaataaaagtagaaaacaaagagaatttatcatttctcagtcatcaaaaagcaagcctttagataaagaagacatttatatcttcatttctattcactatgtgtaatcttcagcaatattttaaacaacagatatacaaacaaaatatatctaaatgtaaagccaacatccagagatgagttccttatcttttgcctacctcaattcacccttaaaacttaccctgttatgaatccttcctcaatttgaatcctttcttttcagtagagaaatttgtcacattccttttctgcctttttctgttgcaagggtcttttaaggctgaattaatccaatggctaaactgtagaaaagaaaaaggaaagtatactttgttttctttttcttgggagcatgatctcatggttttatttaaaatattgtagcaatatttaggatgctgatagacacttttagaaataaagtaagagtaattaatttgacagcaaaactaggaaaaccagaggctgccctcccagccttctactttttgctgccacttacagtttaagtttaagtcatccaagttacttggctaaggattgaattaactagcatgattccctgagtgcaggcacagcccttttttcgcatcccaagccccagtgtggcaagaggtgtttgtttgtttgtttgtttgtttttccctcatgtttgatggcccaccacaaaagctcactcagtcatgaagctaaaataaagaaattgtcaaaagttcagaatcctgaaattttagtaatcgttgtgaagatgtatgtcagttaacgctttatcatttttaaattgcttttgatcacagtcatttgatccttaccacaatcccgtgaaggtggtcaagcagatattattatttaccattttatagatgagaatatagagaatgaggtggagtgactcaactacggtcaaagaaaaagaacccctcctggagtagaattcacattcttggatcattgcacagtgatatgttccttcagcttgcaatgttataggcagtaaaatgattgttatctcataatgcataaaaattgcactggaggcaaaaccagtctccagttatgattgtcactggagattcttgagagaatattgccatgaataagagtaagagacactgaaccagtaaagatcatattcattctagatctgccactgcatggctcagtggattagggcaaatctcatcgacaacccaagattcatctgctaatatttcagaagcacaacccatatgctgagtaccaaatattaatagaattatcagatatggtatttttatttttatttcttgagatggagtcttgctcttgtcgcccaggctggagtacaatggcgcaatctcggctcactgcaacctccacctcccgggttcaagcaattctccagcctcagcctcctgagtagctgggatcacagctgcccatcaccacgtccagctaactttttgtatttttaatagagacggggtttcaccatgttggccaggctggtctcgaactcctgatctcagatgatccgcccgccttggcctcccaaagtgctgggattataggtgtgaaccactgcacctggcccagatatgatatttttgtccttgcttttcatatgacaggtgcttctgtttctggggaaaaatagagcggatttctattagtgataataggatatccttctgcatttaaagaggatggtaggtatgagtgtggtggctcatgcctataatcccaatgttttgggaagctgaggctggaggattgcttaagcccagagttcaagaccagcctaggtaatatagtgagatcccaactctacaaattttttttcttaattaactgggcatggtggagcatgcctgtagtcccagctacctgggaggttgaggtgggaggatcacttgagcccaggaagttgaggctgcaatcagccatgatcacaccactgcactccagcctgagccacagagtgagaccttatctccaataaaaatagaagggaagataaagaggatggtagtatacattccactcacactgagatttcctaaaggaaattggattagaaatggactttgaagaaccagggaaaatttatgtgttgttcaatatatattatagaccttttttttattttttaaaactagactttatttttttagagcagttttggtttcagagcaacattaaatggaaaatacagagagttcccacatactcctccctgaccacatatacacaaccttcccaccattaacatcccaatcagtgtggtgcatttgctacagttaatgaaccaacattgacacatcatcaaccaaagctcatgttttacattagggttcactctttttgttatgcattctatatgttttaagtgtaaaataacatccattcagcattatagtaccagagaatagtttcactgccctaagactcccctgtgctccacctattcatctcttcctcctcctaaacccctggcaaccactcatcttttcactgtctccacagttttgccttttacagaatgacatatagttggaatcatatagtatgtgccttttcaagtttgcttctttcaattagcaatatgcatttaagattgcatcatatcttttttattattatgattatattttaagttctagggtacatgtgcacaacatgcagatttgttacatatataaacatgtgccatgttggtgcgttgcactcattaactcatcatttacattaggtatatctcctaatgctatccctcccccctccccgcaccccacgacaggccctagtgtgtgatgttccccaccctgtgtccaagtgttctcattgttcaattcccacctatgagtgagaacatgtggtgtttagttttctgtccttgtgatagtttgctcagactgatggtttccagcttcatccatgtccctgcaaaggacatgaactcatccttttttatggctacatagtattccatggtgtatatgtgccacattttcttaatccagtctatcattgatggacatttgggttggttcctagtctttggtattgtgaatagtgccacaattaacatacatgtgcatgtgtctatattgcagcatgatttataatcctttgtgtatatacccagtaatgtgatggctgggtcaaatggtatttctagttctagatccctgaggaatcgccacactgacttccacaatggttgaactagtttatagtcacaccaacagtgtaaaagtgttcctatttctccacatcctctccagcacctgttgtttcctgactttttaatgattgccattctaactggtgtgagatggtatctcattgtggttttgatttgcatttctctgatggctagtgatgatgagcattttttcatgtgtctgttggctgcataaatgtcttcttttgagaagtgtctgttcatatccttcacccactttttgatggggttgtttgattttattcttgtaaatttgtttctttgtagattctggatattagccctttgtcagatgggtagattgcaaaaattttctcccattctgtaggttgcctgttcactctgatggtagtttcctttgctgtgcagaagctctttagtttaattagatctcattagtcaattttggcttttgttgccattgcttttgatgttttagtcatgaagtccttgcccatgcctatgtcctgaatggtattgcctaggttttcttctagggtttttatggttttaggtctaacacttaagtttttaatccatcttgaattaatttttgtataaggtttaaggagggggtccagtttcagctttctacatatggctagccagttttcccagcaccatttattaaataggaaatcctttccccatttcttgtttttgtcaggtttgtcaaaggtcagatggttgtagatgtgtggtgttatttctgagggttctgttctattccattggtctatgtctctgttttggtaccagtatcatgctgttttggttactgtagccttgtagtacagtttgaagtcaggtagcatgatgcctccagctttgttctttttgattaggattgactgcaatgtgggctcttttttggttccatatgaactttaaagtagtttttttccaattctgtgaagaaagtcattggtagcttgatagagatggcattgaatctataaattaccttgggcagtatggccattttcacgatattgattcttcctatccatgagcatggaatgttcttccatttgtttgtgtcctcttttattttgttgagcagtggtttgtagttctcgttgaagaggtccttcacatcccttataagttggattcctaagtattttattctctttgaagcaattgtgaatgggagttcactcatgatttggctctctgtttgtctgttattggtgtataggaatgcttgtgatttttgcacattgattttttatcctgaggctttgctgaagttgcttatcagcttaaggggattttgggctgagatgatggggttttctaaatatacaatcatgtcatctgcaaacagggacaatttgacttcctcttttcctaattgagtaccctttatttctttctctcgcctgattgccctggccagaacttccaacactatgttgaatacgagtggtgagagagggcatccctgtcttgtgccagttttcaaaaggaatgcttccagtttttgccattcagtacgatattggctatgggtttgtcataaatagctcttattattttgagataagtcccatcaatacctagtttattgagagtttttagcatgaagggctgttgaattttgttgaaggccttttctgaatctattgagatagttatgtggtttttgtctttggttctgtttatatgatggattacatttattgatttgtgtatgttgaaccagccttgcatcccagggatgaaaccaaccttatcctggtggataagctttttgatgtgctgctggattcattttgccagtattttattgaggattttcgcatcgatgttcatcagggatattggtctaaaattctcttttttttgctgtgtctctgccaggcattggtatcaggatgatgctggcctcataaaatgagttagggaggattccctctttttctattgattggaatagtttcagaagaaattgtaccagctcctctttgtacctctggtagaattcagctgtgaatccgtctggtcctggacttttttttggttggatattgcagacctttttacataagtcccagccttagactctggaaattaagaagcgaaacctagcaatggccccaccctcttctgtagctttttttttcccccacaaataagctagtacagatatagaatgccacatgctgatccataccatgaagaaaaatatagcacgccaagtggaataaggcatcccaggtagaggggtgtctgtgtgtgtttgtgtttgtatgtgtgtgtgttagaattggggtggagggggtagaagtttaatgttttatataatgtaatcaaaagaaacctcactgacagtttgagccagaggtcaaatgagcagagacctgaagaggtgagggagcaacccatgaggaaatatgggggagagcttcacagcaaggaataacaaggcataaggtgtgagccacctgtttaatatgtttaaggggaagcaaagagaccagtgtggctagatggagttagcgtggaagagacagaagaaataaggtcagagaagtggtgagagccttgtaaggattttggactttactctgagtgaaattggaagcattgagaaactctgagaagtgacaggaacaatatcaaagatttcaaatagggaacatttttaaattatgattatatatcagaaaaagctaataaagaaacctaaagagacttatcaatgttgacattctaatacatatcttctataaacactgaggattcccccgccatttaaattttcagagaaaataacatgttttaaagtctccaagccattcaactagaacgagaatcaattctctattatacaatccaaattaagcacagttaaagttacttctcatgttaaattgtaatttttatattcaagactcaactaaactcaaatacagtacttaccaaaataataaagtgtttctacagaaatctgtatacttcctatccagacttcccatcatacaattgtggatcatgttttaaaaattcacagagggatatttgctgagccctgaatgtcatggtgataataggatattattctctgtgtaaatctaccttcctcacagcaaaatgtctctaatctaattgtgtgacttcaggcaatcctcgggttgctctagcctcttgcacatcctgttcataatagggatagcaaggtggcctacttctttccccgtaataatttattattaatgataggaccatcatgaaacattgtgggcttcattgatgaatgtgttatgtcatttcacaacaattattgaagcatcattcttatgtcagacattgggaagagtacaaaggaaaagtttgttgaggagactaccctccaacaagcgctagtctcctgggaaaggcaagcgtgtattttgaaaggtaacatgatgcagaatgcattacgagctgtcacaggagtattagggcaataaaattatctgtttggtactttagatttaaaaagaaaaaattctttcacatacagcatctcatttaatatttacaccattcccaaacaaacaatgcttcttaaacatactcaaagggaatgtaaatttcaactaacgattaaggaaagaacaggagtagctcaaggaagacctcatgacaagaacatgaaggataaattattttaaaatcggatgaatatttgcataagtgtaaaatgtagtaaactctaatgatcctcaaaactagcactgttgccttttcacccgaaggtgggatctcctgctctttggtttgtgatgaccttaaatcgtctttattcctaaagaaaaccacataaattctatcccaggatggtttactcaatctcattctttgtcaaaaggtcaagaaaatagaaactttcgttcaatattgtcaaagaaagaaaatactgaaatccattatacagttgtggtcatccttaatatttaggaacatagcaagcacaaactttttaagaataacatggatatgatattaaatgaaaagatgacattctgctagaaattcatgaatagttactgcttttattctgaaaaaaaatgttgatatacctcatgtcatcgggagttttatactttcgttccacttcactgaaaataacaaggtaatcttatgtggttcctccaaattggaaaccacttcacataatatattgaccaaaaacattccctctataagtttaaaactgtcttctttcttgaagacaatctttgcttaatggctttgcatagaggtaactccaattcaaggtaacttgcatgcagcccaagtattgcaatataaataaaatacactggacagagaatcaggagatgtgaggtctgccccaaatggttgtattgactagcaagtcactcctgttatttaggtctcagttatgccatctatcaaatgaaagaatatttcttaaaaagacttttgttttttcttgaaaatttgtgtttaaaacactcatttgtgatagacatatctacatacacacattgcatacaaatatacccaataaaataaattcccatattttttcactaaatcaccatggatcatttttcctacttcatcaaaatttcatctagtcaataatgtttcttgacctgggggaccatttttaattgacactggccaaagtgtcatttttcctgtttgtttgaagctcataataaaatttcccaaaacatcaattttcatgtggatttctccataagagaaacatcaggtaaaaagtagggaaggcagagcaggaactgaaagcaactcatgtgaaccataaatttttgtttacagcacatgaggtatcatccaattgcttcataagccatcattagagtaaaagttgaagataaggaacaacaataaagttttgctgaagggctggaaaaaacatttagctttatttcttttcacatttttttttcagattgctaatataaagagtcaacttttgaaccttaagccatttttagaccagccctaaaagaagcaataacaacaactaaatcacttcatggaccattttgtttttctccatcctaggtgtatgattttcctttcctgcaatgtttccactcaccaggaagtatcatctctaggaggaccattcagcatagatgaatagagatgcagcagcttagatgacactattttacccaccatcaatgacaaatattccccaaaccctaaactgtgcccttgttgtaacctcacatccatctgaccccatacgctgagaggctttcaaagagctcattggatgcaatatttgggcaaaattgaaaggaatcttagagattacttagtcaaagcttgaaatctattttttaaagtaacgtaacaatttcttaaacaacattatattaagaattaaaatatttaaatctgataaaagtggagtcgctttgattgaattcagatgtggaaaaccttgataatcatctgtataatcctctttttcttctcttccccttcctcaacctattgtactcatttgttaaatgagaaagctagtgtgatatttctatccatgtaatagaaagtttatataatagatttataattatctgttgatatatagcttataatttctatataatagaaattatataataagtttctgtacttacagactgtacactcagtaatgataaagaacaaaaattctacccactctactgaaccaaatgagggtatgagcaattgtctgtagtcacggcattcacaaccattgcagtttattagtttgaaatgtttttatgaaaattatgtaccccattatgagaggtaaaagtaatgagactgttaaaactgcaagtaggaaaatacatatgactatcagagaaaagagatgtgaaataattgtaagtgctgagagaagtgatgaattttgcaatgcatatattagattaagttttggagagcttagttaattctcaaggcaaggcaagggattgcctgatacagtgtgggacaggcctatgaaattgtacagatgtgcttgtgcattaagagacaagaaaagcaactgaaaaaaagggagaaactttagagtatgtggctacagaatcagtattagttctgacgcctgttaaccaggtgttaattccaaaaaaaggttaggattaacgttaagaatttaaaatctactctcagtaaaaatattactcctgagacttttgttccaagccactgatgatccattggtttcaaagcccattagaatctgaacacaattaaagtgagcatccaggttgtgaaggagaatataactgctgagaaattcctcacagcatttgccgggcatatcaaaggtaattgcatctcagcagatatttgttgtggaaaaattggtctatttggggagaaaataatattctcattttaccactttatgtttttagtggaaatgataggattgttggcacaaactcctctcagtctcttaggacttaggagcaaagggatatatgaatagctttttagaggccagttcattcatatctagagacccagtttgctctatgtaatgaacaactaaacttctcagtaacaccacaagtttcttatcatgaatgagttggcctatttggagggcactacacttaaatttttattttcctttagagatataatatgattgagagaatgatgtctagtcacagtgcccctcattatcatcagaacttctagagttatttcagagttccaatattgtttttaatcttctaatttaaaagtacaacataaaaataaattgtattgtgtttcaagtaataaaatctatacccatcagctaaatgcgcaaaattctccctgtaaagctaattaactagataaaaggttcatatcagccttttagcagttcctgtctctaagggcctaactcagtaattaattatgtttctgggagtctctgaaaacacttttccagcttcatgggtctttagaaatgaagcatcttgcacatcatccaaaatatcttaatctctcaatctgtttagagtccagtcaagttcctacaaggagcagagttaaatgtccttggaatgaagcctgtgtattctcatcacttaagcagtcatttacctcaggatacagagaacagcagttgaatttttaatcaacttttatttttaaagcgttattaacattagcctgatcatctgagttcaccttagcatgctagcttggttgaaatcagagaaagtaatgaagtatgagttaagcactgaaggaagtttacaggaaaaatgtataatactacacagatgtgttgtttaacaggccacacattggttcctattaatgttccagatgttagctaagaggtgtatggatatgtcatggtggccagaactcttgggcatcatcacctgctatacgatcatgttaattttattcctctcttaaggaaaataccttggcaatttaagacctcccaagagaggtgacattttaccagctagaaccctaattgaacaagacttgctgagagcaagaacctaaaggatgcatgcagagacagggtatagaggaattggcacccaggagaaaaggctaagatcatctttcccactaaatcatttggctagcttcctacctggagcttatcctctaacccccaattttccagactagacagctttttaaaaagtccttgaaggaaagtagactataaatcatctataagcacgatcagaagatgtacagagaagacaccgattcttcataagcctatgccttagagttagcacccccaatttaatggctctgttgcggtcacagtctgaatgtactcacctcctgtatatgcagtctccagtgatggatttgaaaatccttcaagctattcttttttctttaattttatttttccataagttattggggtaccggtggtatttggtaagttctttagtggagatctgtgagaacctggtacacccaacactccagcagtagacactgcaccatatttgttgtcttttatctctcgccctctcccactcttcctcccaagtccccagagtccagtgtatcattcttatgcctttgcatcctcatagcttagctcccatatatcaatgagaactaaaaaccaagggtaacataaacttcaaaaaaagactactagaggatgtggtagacaatatcagaagaaatacactctcttgaagatataaagctaactgccatggacttttttaaatgaggctttcttcactttttcttggaattttatagtgtcactctaacaaagctgaagagggtcgaaattgttaattacacattttctttaattacaggctcctttgctatatttaccaaatagctagtagccctgagggtggagttaggctctttaaagtcatgttttaatctctttataattgcaatttgattgctggtgtaaattatctagtaggcttgccactttcagcgccagtcatttcccagagtgcataattttgaattaaaaggctgatatccatccaaaagtttcccagaatgtttcatgggctcagtgaattatgcattaaacagaattctttaaaaagaaggcaagaagtttctttgatgtcagctgggtttttcatcatattatggactattaatttctagactcttttaacggtagtttcttgaaatctatgttcaatttaggacttattactgatctttctctaacctttatattttattttaacagcatcatatgtcaccctgaacatggcaggttctggcagaaacctggtggttaatttcttagggggaaaaggagggggaacgggaaaaagaacaatttgcgtcaaatgcaccatctgctggacagaacacgtatctacttacaggagcttgccttcacattaggaaaatgctttagaaacctcatgaggacaaaaccaatgaaagggctgagatacacatatggaagctcatctatggatacctctacatcatattcaaatgccaatgtccccctttgatgattttgtcaagccatgaaagagataacctttgactggtatgtttgattttgagctatgttccctttgcaaatgtaaccctatagattgttaaggaaataaataccattcccccaacttatacaaaagaaagtaagggtagtcaagtttctaccatcatatgcaaatacaaattctggggaaattatttacattatacacaatttcatattactattctccttttatattttcagtacacaaagcacttcgaaattagtcacaggctgtgttttactacacccttatagattaagtgaacatatactttatcatccaacccagccacttatgagagtgaaaagaagcactatgaataactatgccagaacatgcacagactagtattttcttgggcaaaccagactttatcctgtctccttgttttatgtctctttatttataggtaatcaaatatcagaaacagaaatcatctcttagtctatcctactgccaactcatgttacagaagaacaaacataaaaagatgaaatgattcagtgtagtagaaagattccagactggggcagtgaggagtaagatgtggttttcattgcaaatatgctcagcattgagattatttgactctattattcgtataataattcattcatggttaagtaccataagaatggccaggtaaagtttcatgagtacctggaaggtataagtcattctagctaaaagaatacattgtttcatggagaaggtggcctctgaattaagcattgacagagaggtagcatttgcagagtaggcactccagccaaggcagaagcattcagaaattaaatgggtaaacaaagaaaaatatagtgcttccccatccagtggctattattgcctttcaacaaacattccttgaagcttactaagcgacaagcactttttttttaacctttattttaggttcaagggtacatgtgcagatttattacataggtaaattgcatgtcacagggatttggcatacagattatttcatcacccaggtaataagcatagtactcaataggtagttttttgatcctcttcctcctcccagcatccaccctcaagtaggcccagtacctgttgttttcttctttgtgttctatatgtactcaatgtttagctcccacttgcaagtgagaacatgcatatttggttttctgtttctgcagcagtttgcttagcataattgcctccacctccatccatattactgcaaaggatatgatctcgttcctttttatgactgtgtagtattccattatgtatatgtaccacattttctttatccagtctactgttgatgggcattttggttgattccatgtctttgctgttgtgaatagtgctgcgatgaacatatgcttgcatgtgcctttatgctactccagacatcaattcctaccttcaagaatttacagcctaataagcagtaagatttacgagtctgtatttgaaaggccatttctgaattagagataagtgtgggaattagcagtgtatttaaactgacaggaaatagattaagatcattcagggaaaagatgaagaaagagaaaaaggcacagaacagaaccctgaggttctccatatttagaagtaagagcaagaaattctcagccaaggaaactgaaaaaaacagttggtatggtaagagtaaaatgaaaagaaaaataatcttgttattttctccgatttgggaatatgggcagagcttaggggaaatgaagcttgtcaaggtgtagatcagatttaactttaagcttcttcattatccaataattatcacaataatttaaaaattataaatagctttctccaagaaaccttaaatgctttacatgtcccttctaatgttatctccctagaattgttattaaattataaaatgatacattattgaaagttaagcaaaaacaccattatcatctctgctgtattcagttttagatttcctgtagggaaatactcagttctcccttttcacttcaatgaggcggatcaaagccgagctacaattccaatcttatttatgaatataaaattaactcaaaatatagctcattttctccagttacatcctatatagggtactctgttttgttgtccattattttttaaatgaatgctattcaatgagctgtttagggctagcttttgatcatttttcatgttaactattatggaaaatttaaagtacaactaaggctgaaggtcagtgcaaagaagagaaaatatttctcagattttctgaggcttgtcaagtctcagctgtcatctggttgggttttggaactcatttatccttgcagtaatattaaagcacatactacatgtgaggccctataccttctagcctacattaaagctagaaaggtttcagctctgccttcatggaagttacaatctgttagagaatgcacatgagtaaatgaaattatcaatacaacaccactaaatctatccagaagcaacttataccacaaaagcaactacctgaggtgcaatctagaggcagaaagagaatttgaatctactgcagtagatcaatgcaatacatgcacacacacatgcacacatatatacaacatacgctgagcctacctccttagacattatcttatgttgcagaccagagcattccttcttgtctggatcactgctttgtgtggtaacaagaaaaatgaattccttctcaaacgatccatctatagaaatcctcacatcacactgcgttcatctattttgcctgaaagaccagctctgcttgtcattgctagttgttcattcataatgcaattagtaatatgcttagtatgtgcctcttattgtgctatatattgatgataaataaaacatggtctctaccttcaagccaactaaatcaacatgtgataatgactatagtacatgaactcacttagggcctactgaagtaccaggaacaaatacataaattagactggggatctaagaattggagtaaggtagaatagaacacaccatagttaagaacacaagtgctggagtcatgtagacctgagtttgattctgagactttcacttactagtcacatggctccaccttttctatgctcagttttcccatctgtaaaatatcagtaagaacccatttcattgggttaagctaaatgagatgatgtatgtaaagcacaagcactgatacatagtaggtactcaagtagatgcatatgcagcaataatcatacatataccttatgatttattccttatgtgattagaaggaacaattgggaaagtatccagtagactaaagatattattaagtaaaaaataaaagtgcatatataccaaatgtgtcaatacccagcagatacctatagtcttagttacttcctagcaaaattccccaaattcccaaaattcaagaaagtaaatacaacaattagcaagggaagagaaatatctgatccaacaatgccacacgatgtgggccaatttcctggacatgcagatgtacgctgttgaccttaaacttcttttctgggttccaaatttcaacctccctcatcagatctctaatcagaagtgggcagagaggcctcatatcttttccagttgtcaaacagtgaacctctaacttccatctcagacatctttattgtaagatgaattcgcttgtaaaatgtatccccacggagtcctgacagctccaactacttcacttgaaagagtacttccctttatactgcaattatcacagccagagatgcttgaagccatttgctgaattcataggatgaaaataaaaaagaaagaaataaccaacattgtttgtatgtctttgtgtgtgtgtggtaagccataaatctatggaaagcaatagtttttcacctttctccttaattctgcaacaaagtttttgcaaattccttccttctcaaatcacacattatcaaggaaagctttgaaaaaaaggattttacatttattccaattgatgtcctaaaactgttattgcttgtgcttgtacttcaaatgagttgccatataatgcattcaataaggacaatcataactaaagccaacaaaagaagtgctccaaagacaattttgaaactgtttgaagaaaggtactgaaaactggccactgtagcagcaacaatcagagatggagagcccgagttgaaactaatgccatgctgcccagcaggcctagggggacaagcacatcacaatggctatgatcagcaaccaaagaatggactcgtgtcaaaactgcaatttctgcagtgcagtttctcaggggcatttgattcaagatgtatgatgttctaatccatgaatgccagaatcacaaaccatctccttctccttcaaaacttgtccttccctagtcctaaatgggaaaacagttgctacagtgaaaatagtcaaaaattctctttccattttacagaaggtactgtgagatcaaaataaaatgagaatagaagttggatatgtaaggttggtgtctgccaaattctaggtgaacctaggtatggggaagactccgtgctaccctcaaatatatcctttctacctttccaaaaagcttctgttcccagatggccacattgaattccactaactagaacaaagctttcatttttgatggtatgaattcagacttttacaaattgaacccatacttgacctcttacagtgatttaagtttatactctggtctctataatcaattatcacactgtagtttgtgggcagcttttgatgtagagaaggcatctggctcatagcatatagaaaggatgtcaatattgtggaaaaggagactggatattcgaaaaccaaatatcgaatggttttgcctagaaatagctgtgagtgtgtcttttcatggttggaatagcccatacttgcatttacaacagacagggtgcactctttgacttccatcaggatcttggatcacagtgcttgggtagagaggtgagaggacattactgttacctctaggtcattatttttaaagagataatagaactgagtaccttagcttatttcaaataaatgcagcaggtagtacatattgagtaccttatataagtggacaatttacttcacttacaaatgtttttcagttttctgatgaaagctttgtagtattaaccccaaaggtactgggtccctttagagtgttatgataatatttatagcacaatgtattatatctttataaaaatggcattaacttagaatatcagctgatatttagggaggctccttgccttcagtctcatattaatcattcctccagcacacatttattaaatgctaggcattagagttaaaattaacaacacaaaatccctgctatcaaaaatcttttatgttccctgagaggaaaaaaaacaggaatagaaaagcatgttcaagcttcttgagactggcaacaaagtaaatgcttccagcctcccaggctcttccccttcaacgtcacccagtgcccatcttccagcagagatgacccccaaggtggagaaatgcaaagtcacaggttctttctttcttacttcaaagccaaaaatatgtcctgcagacaaattccaatacttcttcactacttgtagctttttacttgtgtgtatgttttgacacacccctgtagcagaggtaatagtcacgcaaaacttgggggtggggtggggctcagttaattcacaaatgacttgcaaaagttataaggggacaatattgcagataatgtgctccatggaaaaaggctgaataaagggttttttttaactagaaagagaaagattatgtcataaacatgtagtttaattttacttagtctaatttaggtaaatgaagtctgcaatataaagaactgctatagctcatataattctgtgaacagacctacaccattaactaaagctcagaaaaccagctgactaacagcacagtggttacacagtggtggaaacagagtcactcactcactcatttattaactctttcattcaataaacgtttattgaatacccgatagatggcaggtactctagcagtcaagctaagagttatcaaacactttctacatattagacactggactaatcacttttaatttaacattcacaataaccctatgggtaaacaagacgcgaaaaatgaagtggacagtacatggtaaagctgagattccaactcaggcagtcagactccaggggaaaatgatgcgtgacagccccagccttcaaggagctcgcagtctagacaggggacccagagcaaataaacgattcctcgaaggtgaatcatattctggtggaggtgtacaacaaaggtcctgagaccccagaaaagagattgtttatggtcaagcatcacttgtttactagcattctttgtcaccacgcttccttaatttttccctctcctcatttttacaagaaaatcaaatttaaaaatcgttcccttcataattttctaattagtgggatttttccccatcttctttgatatttgtgaaataattacatctggcttagagcaacttttttttttttttgagaacagattttgtataaaacattgttcaaagaagtgaaaattcaaataagtcatcaagcaggttgatctgcttcaggtggggaccaggctaactacaacgctgattgtgcctatgttgaataacagcacagtggcaccagatctttctctctctcaagagaaaatgacatctatttttttttctttcaatattttactaaagcacactaacgcagatattttgaatatacggtgcaggataaacaaaacaattctcaggatgaatttcacttatagctcccaggttacaatttctgtttgaaaaataataaagttctatttgtgcctttaaggagtttacaatatagtgataagaagatagtaataataagatatacagaaaaaaatatataatgtgagagaaagatagtaaatgccagagaaatggaatgcgggatcatggttagcaatttcagctgagatacaagggcaagcagaagcaatatttgtgctggccttgaaggatgtgagtgattttacaggtggtacagagaagaaagggcatataaagcagagaacaagatgaaaaaaagcacaagtggaaaaaaatgcatgttgcatgtgagcaaagaggaagggagcacttaggttctgtcatggattgcaaagggatagagcgagagatatgaatggtgaatgggaagtgggccagattgtgtgggactgtgaaattcatactttgtgatactttattatgtaggatgtagttccatgatacaccaatatagtacatgttagatatcttttttaaaagtaaatcaattaaaataaaatttgatagtccaaaaattgggaaaggctacataccatatcaatctctggatgatcctcaaagctgactcacaaagtagattgtctaagaactaacccctattcagtaacgaagttactgtttagctttgttaatccagcttgttatattgcataatttttgtcttttcttagaatattgatttttatcctaagaacagaaatttcagctaacatcactaaatgcaacaggagagccactgagaccttcatgcaatgaagtgatgggatgctggtagctgtggtaccttagacgtttttagagaattgtgaaccagaaaagaaggggacagactaggaacagaaaatcagctgcaaggctatcacaatagcccatagaaataataatggcttcctattacacagccctgccaatatgctggacatatttgaggtgctgttcatgttgtatatgttttgtaatgagaaccaaaattgggataatagcagcaatcaatatctagttgagaggcaaagatggacaagccagcatccaccatccccattctcagcatcccagattcatctcctttttttttcctcttctctgttttctactacccctgcttttcttttgttgagtcccagtatatatgccctacaactccaatttaaaagaaaacaaacttgaaatttgaatgctgccactaaatcacttttcaattatttgtgctctctgcccttttcaattatagtgcagtgctctctgcccttttctaaaaagaaatgttattagctagaactaacagaaattcagcggttagctgtgtgaggtatttttttttttttttttttttttggcggggggggattagtgcatgctgggggctgtgggataggatttagtgcccaaatcctactttctccttttcttttcccgggttctaaacatgtaaggatcaatagccaagcagaaacaaatttcaattcttgttaacaactgagctagtgcctgatctttcccaccaccctcccttaaaaagacttctctgatatgacagctagatccctagtgtaggccaggagccaagaaagctttggtttcccacaatctgtgactaaatgtctgcatccttagagcagatttcaagcctacttacccaggtgtccttatgtatgagcagtgaatggcagatcttccttccccacctgttgcagtggggagagagagcctggagcaggggcagagctgctgaggcaagacccactcagtctgtatagcctagagactggaagtgcaaaggagcgcatgaagacgaccaaggccagttctgagaagctagttcctctgtcagtcagccagtgaaggtagaactcctgccttatcttttaatagctatgattctgcccattagggaggaaggttcagagaatgttagattcaccagtcagacctgctgcttctctgaggggaaggaaaataagatggtgggaaaagaaggaagttaggaagcaaaagttcccttttcatgggactgaggctaaaacttgatctaagaacaaaagtattcctacttcttcaaagtatatcattttaggaaagcaagacaaagctcctgtccaaaattctttctgcactgagatatcagatcccatcatcaatagtttatttgtgatgacatttgatattgtcctttgactatgatatcttttaatatgactgttcctgaggggggtaacatatacagtatgtagtacttggatgagaatttgttttgcttggggctacaagagaggagtgggtttcaggaacaagaaggtaggctaagaaaaaaagaaagtggaagagccttaaagataactgtgtctgcttcataattacacacctagttggatatgtgattaccataattctcacatgtactactaactttctccatctatttcaaggatgactgtgggtgaagttttggatgttaacaatgccccatctcctggtttttcagtaaaaatatatgagaaatgtggaaatttatgcaacaaatttatatatatatgtgtgtgtgtgcacatatatatacagatagatagatagatacacccataaggtattatgttagggtactataaccaagtcaattttatctatcttattaattgagcacagttggaagaatagtgagactcaaatgatttctggggttgatcaatttccagggagattttctaaaaagggacaaaataaccagtttatcataaccttaacaacattattttcaggttagttcaaaatagaaattatgggacagaggagaaaatttttattcttttcatttttttgaatttcatcctcaccctcctcctgccctccaccttctagtataccctggtgtctcttgttcccctctttgtgtccatgtgtactcaatgtttagctcccgcttataagtgagaacacatggtgtttggtttattctaagtgaattaacccttacgttaaaagggagaaaaagaggagaacattttttaaatcataacttcttaaattttattttgtcacctcaattatttccaggggaatagaaaccctttcaggatgatgtagctttggaatttcttaacgacgtgtggatatgcttgaagatttgacaagttcacttgaaatcttgtggttcaataaggcagccttttctgtggagacagaagactaagctatgctacagtggcttaggagacacatgacaacttaacaatagaccagcacgctggcaggagaagtcatttattttaccttgtattctctttacgtgatagtacacagaaagtcaaatgcatgtccatgcattcataaaacaacaaaatagaaattaatttgccttacccatggaaatttcagttactgcatgcttagctgctgtgcttgtcttcggaaagttcatccttgaaggctgaataaaattttcctgttctgcttctttatataaagaagtctatggtttgcttaaacatgggaaagctcgttttattaagtatccttgatactgtgattgcattcttcagaatattagctctgctaccaattttcaaatactttttaatagtttgcacggttggcttctgagagcatctctgaatgggattttcccagctattttcacaccttatgtccatatcacatttcactcttctgcagcacttagatcttcagcacagcaggtggaaaagtgatttaaggacagaacaatgggatgtttatgcctttttaaaaaagtcatggatatgcatttctagccaactttgtttggggaaagcctttttgcccctttttaagacattttaaaatctttgctgtactatatgacagtcacattaaaaaacaagaacagattaaattggtcatcagaattcacaatttatcttcacaaaatcggaaaattttggagactgttgcaaagtcacatagtattcttgggcgctccggtttgtgctggggatagaaattaaatgggagaaaatttgcattcagaccccacttaactctcactaataacagacattcttgcttgtgagttagctctagaagactatatatctcctgctcctgctgcagacaagaatttgcttctttcctaagagctgattgaagaggagatgtgcagctggctgactggtttcttaaaaggggagaaaaggagactgtgaaaatctgtgtgtaatgggcctgtagtgactgttggggtaaggtgggaggaatgaaacataattgaaacggctgatgaacggggaaaggagaggactccacatattcaaggaagtgtataagctggaaatgactatagtgagaaaacaagactaggtaatagtaaccttaatatggtgacaccataaggaatttatcaggcatagatattttccattttcataaagggttgagcttttcaaaatatatgtagaaatacaaatatttattaccctagaccaaggtttctcaacttcagcactattgacattttgggccaggtatgtatttgttctgaaggtgtgtcttgcatattatgggatgttcagcaacatccctggcctcacctgctagaggctgcaattcccccgcccccttggctacataataatatatgcaagtgtcaaggcccttaagattcacatttaattggccggtattatgactcaggcattagcatgatttttaagttcctgagatgattctaataagtctaattgtttaggaaacaatgtgtccagtgttccttaatgagagtacaaagttgaatgagaaatcatccctgttctggagaggcttaggaatagcaaagagatgggcacacactgaatatttttccaacatattatagtccatttccttaaggtcaaacgcacaatacactatgtcagcacaaaaggagagctgataccttaaagatacaatattcttctgaaatgtttttcagtacctgaaatcctcacattttagaattatatatttgtaatcttgaaataggtaaagatttcttaaacagaatgctgaaagtcttagccataaagtaaataattcataaattggaaattggcattaaaattaagaatttaggggcattaaaactaaagactgtactgggcattaaattttagaatttatgtttattggacaaaactaagaagcaggtgaaaaggtaagccacagagtagatattcacaacacatatatctgaaaagtagtcatatctggaaaatataaaaaactcatataaatcactttttttttttttgagacagagttttgctcttgtcccccaggctggagtgcaatggccctatctcggctcattgcaacctctgcctcccgcattcaagcgattctcctgccccagcctcccgagtagctgttattacaggcgcccaccaccatggccagctaattttagtatttttagtagagaagaagtttcactatgttggccaggctggtctcaaactcctgacctcaggcgatccacctcccaaagtgctgggattacaggcatgagccaccacgcccactgtcaaatttttaaaagagagaaaaatccaggccggtgcggtggctcacacctgtaaccccagcactttgggaggccaaggcgggcggaacacaaggtcaggagatggagaccatcctggctaacacggtgaaaccctgtctctactaaaaatacaaaaaattagctgggcgtggtggcaggcacctgtagtcccaggtactcgggaggctgaggcgggagaatggtgtgaacccgggaggcagagcttgcagtgagccgagatcgtgccactgcactacagcctgggcgactgagcagaactccgtatcaaaaaaaaaaaaaaaaaaaaaaaaaatccaatacaagtggactggaaaaggtactttataaaagggtatttatagacatttgattgacttatgaaaaggtgctcaatattattaggcattggggaatgcaaattaactaccaaaaaaatcacaacgagataccggtacattttcactcaaatatctaaaattaaatgacatcattatgaagcatatgaagcaactgaaactcacatacaatttactattatatacaaatacatacacactatatacacacttttgcacatacacatataggcatatttcagaaatattttacattcagttctaggccattgcaataaagcaaaattcacgataaagcaagttacataagttttttggtttccagtgcatataaaagttatatttacactatactgtagtttattaagtgtacagtagcattatgtattaaaaacaatgtatataccttaatttaacaatactttattgctaaaaaatgctaacaatcatcccagcctttagcaagccatactctttttgctgattgacggtcttgcctcagtgttgatggctgctgactgattagggtggtggttgctgaagactgaggtgactgtggcagtttctgaaaataagaaaacaaggaagtttgccacaataattgaatcttcctttcacaagatttctctgtagcgtgtgatgctgtttgacagcattttacccacaatagaactttcaaaattggagtcagttctctcaaatcctgccactgctttatcaactaagtttatgtaatattctaaatcctctcttgtcatttcaacaacgttcacggcttcttcaccaggtgtggattctatctcatgaaaccactttctttgctcatccataaaaagcaacccctcatctgttttagtttgatcatttagtttgcagcaattcagccacatcttcaggctccacttctaattctggttctcttgccatttccacctcatctgcagtgacttcctccactgaagtcttgagcccttcaaagtctcatgaaccatcctctcctagctttttcttctgcaattcctcagctttctcagacttcaaataattgaagataattaggaccttgagctggattaggctttggtttaagggaatcttgcgtctgatttgatgttctatccagacaagtaaaactttctccatatcagcaataagactctttcactttcttaccatttgtgtgcttgctggagttgtgcttttaatttccttcaagaacttttcttttgcattcacaacttgcttaactggtgcaagagggctagttttgagcttatctcagctttcaacatgccttcctaagcttaatcgtctctagcttttgactttaagtgattctttctttcacttgaacacttatagaccatcataaggtcattaattggcctaatgtaaatattgttgtgtctcagggaataggaggcctgaggtgatggagagagataggggaatggccagtcagtgaagcaatcagaatcagcaatcacaacatttattaagatcaccatctgacctgggtacagtttgcggcacctgaaaacatttataataatagcatcaaagatcactgatcacagatcactattacagatataataataatgaaaaagttgaaatattgcaagaggagttgccagaaagtgacacagacacatgaagtgagagcatgctgttggaaaaatggtactgatagacttgttcgatgcagggttgctacaaacttccaatttgtaaaacaaaacaaaaaaggaatatctgtgaagcacaataaagcaaagtacaataaaatgagctatgcttatatatgtatatcccaaaatttatatacaagagtcttcaaggtagcatgtagaaaatgctgtcagtgcctcacttgtatcttcttaccactcactattctcagacatgccaatggcttctcaatagaagtatctgtgactctctgccagagagctttgtctggtcagacagcctctacctatagagaacataccaaaaatgccatgaagttaccactctaccataaaccaatgacaaatgagagttgtcccatccaagctgatgagtaagctggggttttatgtcccaatttccactccactgtctcccacaaggccccagtgaggctgagacccacttgccctcagcagtaacttggtcactgacacatcctgtattggattcattcctgtttgtcttatttctccattgccctataacctcccaaatcaactacgtgaattcaaatttagtcttggggtttgcttctaggataacccagctaaagatagaacattgtttatataagttaaaaattgaaagaaaatttttttaaaaatgtccatcaacaaaagaatggataaattgtggcacatcatatgataaaatactatgcatcaataaaaataaactagagctcctcatcactacatgatgaatgaatttcataaagcttaattttgaacaaaagatgttagatacaaaataatacatacttacattaatataaagttcaatatcaggcaaaatagtctgtggttgttatgagttgaattgtgttccccaaaaagagatattttgaagtcataaccctagtatctcacaatatgaccttatttggaaatagtgcttatacaggtaaccaagttaaaataaggtcattagggtgggccccagtccaatatggctggtgttcttacaaaaagggaaaatataaacacagagacacaaggagaacactgtgtgaatgtggaagatcagagtaatgcattaacaagccaaggaacaccgaagattgccggcataccaccaggagctaagagagaggcatgggagagattctccctcacagtcctcagaagaaacaaaccttgctgacaccttgatttcaggcagaccatgagacaataaacttctgtcatctcaagccactcagtttgtggtacttcgttatggcagccctaatacactaatacaatggttgtagaaagtaagatagtgattgcctttggggctgaggaagggtggaatgatagggacgggaacaagggaactggtaatgctctgtttcttaacagtcacagtgttacatgtgtgtgttcacttcatgataacccactttttcaaaatgcttttttttgtatgcattaaaactcaatgaaaatttttacaaatctaaacacttattagagcagatgagaaaaaagcagtacactgtgtaatgaagagggcaagagttggggaaaagaaggtaggaaaaaaatgtgatagtatctgtagttcacattaaagaaggtccctaagcaaagattcaatgaccactatggactttcagctcaaataaatcaggttagccctgtcccctgaattgcgggtaggaggattggaatctccataatttccactcatttctattttccctatgcccctacctccccattcttccttcttagtctgagagtagattgtttctgagttgcctagagtattgacaatttcaacaataatacgtagaatctagatagaaaaaccagtaaaatttataatgaagactaaccatggtaacatttcaagggaactgaagagagtcctcttcaaaagtcatagcaccgttaaaaaaaaaaaaaaaaaaaaagctattttagtatcttttctcaaacattcactttctctgtggcatgttacgtatttactgagtgttttccacacgtaagactgagtactgaagacatctaagtggtgctttgtcccagctgttatactcagctgatgactgtgagaaaggcttcagtgattttgttcctaatcagtaagtaaactaattactgacagccagtgattcattcttattctttcctatcttcttgctgcatgaggttcgtaaaatattttgtttgctctaaccaaaggattttggtttctttacctcttgacttctaacatagtctttccagggagatgacactgtctttcacctatatcttaattctgattcatcagattagttcacagaaacattaatgaggccctggttgtaaaattggagccatgttcctgcttgtagccttttttttttttttttttttttgagttggagtttcactcttgttgcccaggctggagtgcaatggcgcgatctcagctcactgcaacccctgcctcccgggttcaagcgattcttctgcctcagcctcccaaggagctgggactacaggtgtgccaccacatccaggtaatgttttgtatttttagtagagacaggggcttcaccattttgtccaggctggtcttgaactcctgacctcagatgatccgcctgtctcagcctcccaaaatgctgggattacaggagtcagccactgcgcccggccactgctagtagcttttgcaatctttatcagtgtttatgaatgcgaacccaagcagtggaggtaatattccctttactgaaggcctaagagccacactattctcttaccttaattggacttctgtctgagaagaaaaaaataatgaatttaatctctcctgccattgacttatgatatctttaaggtatagacttgctgcctctctaccaaatgattcctaggaggactggtcaccttggtattcaagccaagttcccattcgaaactggggtcagaactaattggataataagctaacccgagaaatgattctcctgacccaaagccacatccgactccttctgaaagtgaagacctgattttgaagcacccgagtgatgaggagcttgaaattagagtttggagaaggttgtaagtcttttataaaaaattcttccatcttcctggttgttctttttcttccccttctagtttggtttctttcatgctgttgcaacaccagtgaaaggtgaagtgatgtatttttccatttctgatgatgcttactcccatggtgagacttaacttgagaaacagcaaattccctggagtttcttcacgccaaagaactatgcatattctcactcacaggtgggaattgaacaatgagaacacatggacacaggaaggggaacatcacactctggggactgttgtggggtggggggaggggggagggatagcactgggagatatacctaatgctagatgacgtgttagtgggtgcagcgcaccagcatggcacgtgtatacatatgtaactaacctgcacattgtgcacatgtaccctaaaacttaaagtatgataataataataataataataaagaaaaaaaagaactatacaactgattgttggagaatcatggtttcagttcacagggttctattttcctagtgagtcatttgacttagaggcaactctaaatgcaccaggaaggcaacaggatcaatacactagggcttcaagctctctgccacttgaagccactccagcagcacctaagagcttgcttttcttacttgcttcctcattacccaggtcaatattgccattgcgttcgaaataaccgttcaaggacaggattttttctcacatgtggaatatttgacatatgtggttcacctttttcttcttggttcttatttcattctttcccattctagtacagacagagcaacctaaggatctttattacaagctaaggagcagagcatttcttctcaaaatggcttttttttgtttagaatttgtaatgtatgcatttgaagtaatttgttttatgtatttgaaggatgtagaaactagactgaattttgttacatattttacacattaacaaaacaaatttagtaaaaggtaaatgtattaaaaaataacattccaccaaaagtagcatttgtttattcaccacccacttttcaagcagttgttccaatatttgtagcagcattatttttgtaatttatttactttaaagctactctgcctgaccttgcttaattatctttatactattttaactttataatttcttttttatcaaaataatacatgtacatagtttttacaggaatataaacacacttataagaaatcagaaaagtttcttgcttcatccttccccaagctaagtctactcttcactggtgttcactttgcctttcaataatgtttactctccattttctctttctggaactcttgttggttacatgttgaaattccacagagtaattcttttcctgttgtattttctacttgccatcacagcattttggtcaaactttgagatttttctcaaatttatctttcagtctttatgttaattctatttctgctatttgccttccaaaagctcattcttgttccctgaatattcattttaaggatatcttgtgcctacctcatggatgcaatatcttcacttatctctcttgagcatattgttttgaagactttgacttcacatcctgcactgctctgctttctccatttttttttttttttattttctggttgttttagtctctttcaatcagttttattgtttgttaagtacactaattttaagaactttatattcaaaaattgctatgagaacagtgaattatttaaagatataaaacatattactttagaagtgcttaccagaaattatctaataacatcaactgaacattggtagaggttgggtgcatacttgataataatgaaattaataacacagtaagaacctgagggttcttattcttacatctgatatcaaatgagttaaaatattcaatatttttcttatttgtaacatgaaaggagttcctaaaattcttaatgaactttctctaatcatagaataaacaaatttagttttatgtgacataagaattctgatattgattactatacctgaaaatatagtaataatgtttcaactcctgtgttcacttgtcctaaccaatactaaaatttagtataatactgtggtagttataaaatgaccatacaactgtggaaagagaccaagagaaacaagaaatggtataaaaatttgggtatcaggggatttaatatatgacaagtattataaatcagtggaaaattattaacttagtactttataattttcacttataaattattgtatggtaatatacattttaaaaggtgtacgatattttattatttagtatttaaattgttagccatttgagaaaaaaaatgaattgaaatcctaactcatactttaaagtaaatttgaagtgcattaaatttttgaatataaaaaggaaagccataaaagtagtagaaaaaggtttagataaatattttaataatcttggagtaggaaaggattttttggactgataagtaaactagtagttataagaaagagatggatagaatcagttacctaaggttttagcaatctgtttgggaaaaagcacaaagttagaagaatctttccaacatatatatatacatatatgacaagcatttaatatgttcagtttatatacagctcttacttttttaattttgagatgggatctcactctgtcactcaggttggagtacagtgacacaatcttggctcactgcaacctctgcctcccagacttaagtgatcctcccacctcagcctcctgagtagctgggaacacaggcatgtgccactacaccctgctaactttttgtatttttggtagagatgaggtttcatcacattgcccaggctggtcctgaactcctgagctcaagcgatccacctacctcagcctcccaaaatgctgggataacagatatgagccatcacacctggcctacatattaatttttaaaaacatataaacatcccaaaagaaaacaagcgaaaaatgtgtgaaccagaaattcacaaaataaatacatataatttttaaaaatattaagatacaaccagaccctctaaaagtcaaagaaataaatacagattaaaataagatgtgtttcctgtcagtttgtcaattattaaaaagataaaaatacccaaggttagtaagattgtggagaatggacattcccatacaatgttcatgggagtattagttggtaaaacaaaaccaaacaacaaacaaaaaacagctttccttggcaagccagtaatctgtagctaaatttttaaagaacctacgctttgacccaacagtttttcttctatgaatttgctctaagtaaataactagataatgaggtttataaagggaaaaccttagaaacaacataaatgttaaaactataagaatatttaagtagcttggtacttagctacaagataatagtatacagctattgaaaataaagataatttattaaaagattaattttttaaaaaattctcaatatttcactaagtaaaaatatacattacaaaacaatagctaagtataatcatgcctactaatggaagtgtggggaaaaggatggaggagcaggctctgaattgggtcagaagtgaggtttggataaagcagtaggtagaattgaataacatctccctcctcccatcttctccctccctgtccctcagtagttctcacttttatgagcagctttcctttttcatgaagttctttttattacttttattatcattatcactaacacatatgttaagtgcttactgtgtggcaggcattgtgcttaacatgttatatgatttatctcatcaaatcgtcaaaagaactcttattcccaatttgcaaattaggaaacagagtcagaaaggtccttgctgaaggacacacaattattaaaagacagaaacgagaatcacacaaagtccatctaaccccaaaactacacactcaactactacatcaccctgtgttacaatgaacttgaaaccaattcacaactggagtacagacacaaagagatatatgtgatgggtttgtgaagtgtggtagaaaggaggtggaggttggtaaagtcaaattgtagggtgagataacaagaacactacaaagaaacaaataacaataagtgaataataaattgggcatataatatttataatagaacttgattctggtatgaggttttattataaactacccagcccagccctctaggggcacctatatcctttagacaagagagggctattttgtaaaatataaagtcctctttttaccaagagcccaagtaattcattgaaggatccttttagcccatacaataactggatccagttttccctaaacagtgtttcctggacagcgtttccctgtaagttagagcagcctgagcctcagagaaggtggaatgaagctcgcaggggaggcaacaaagacagccaatactcacagggtcagacactgcagcgtcctctaaattccaatctctttccatagtatggaagtagctgagcacattagctaagctacatttttacagcctcttttaaggttgagtgtgtccctgtgactaatttctaatcaatgaagtatgaatggaaatatgtgccatatttatactatctgcttctgctgggtggatgctgatgaagaggagggcctaggcaggggcacagcttcactaagcagtggcacagcttcaagatggaaggaatctggggttttgaatcacaatgtgaaggacagacacccagcaaccaaaatcttagactgctacatgagggagaaataaacaatttggggtctatttaccaacacaggcaagcctaccatgagtaacagagtttctctatgtgtcacataggtatcagcaacatttgtcttctaattctaagaaaagagtaaagattggcagtgaaatagaagcacacagtagtagaacagagtacgtggcatagaaatgggtgatcagaggggtggtgtatgttggcaagacaaacatgatgagcagcagctggaagagaggaagcatgtatgctcagagcttctgctcttagggacttgcagaatcctgtaaaaaagagacagggttgagggtggcccacttggctgagtgctactgaccctgttcacttaggaaatttcaaagtctacttacgtagattctacatacagctaggttgtatgtatttgtgtgaatatgagcatgctgtatatagacacaggcatatatgtagtcagaattaatgtcaatattaaatttaatatccaaaatattaaactatcagagttgaagtatgataggtagtttaatttttttctttctgaatcatctgaactattgaaaagaatcatatcatgcatctgtaatgcaaaaaatgttctttattttgaagcagaaaaattcttcctgttttatattttcatgaaaatatttaagatgggaaacattttattggctgtacataaataaatacgtaataagaatgagacacaatgttttgtccaattcttatcatgaagtctttcaagaagggaatacatgcccatcataaaacatatgactacatgtttgtaaatcccccattacataataagcattgtattgtattcatgattatcaccggtacttggcaccctttgatactcagtaatggtaagtgaatgaatgtataaatgcatgagcactttagtagcttttgaagtgtaactttcaatggtaactgataaattatttcagccttggaatcaccatttcctgttatttcagtgtatggcataaagtaattgactaatcacacgtaagacacctaaacaagtgttcttttttttctttcactttacatatcacagctccattcaacccaaataaagatgcagatagcatagtcaagtttgacacttttggagatggaatggggcgatacaacgtgttcaatttccaaaatgtaggtggaaagtattcctacttgaaagttggtcactgggcagaaaccttatcgctagatgtcaactctatccactggtcccggaactcagtccccacttcccagtgcagcgacccctgtgcccccaatgaaatgaagaatatgcaaccaggggatgtctgctgctggatttgcatcccctgtgaaccctacgaatacctggctgatgagtttacctgtatggattgtgggtctggacagtggcccactgcagacctaactggatgctatgaccttcctgaggactacatcaggtgggaagacgcctgggccattggcccagtcaccattgcctgtctgggttttatgtgtacatgcatggttgtaactgtttttatcaagcacaacaacacacccttggtcaaagcatcgggccgagaactctgctacatcttattgtttggggttggcctgtcatactgcatgacattcttcttcattgccaagccatcaccagtcatctgtgcattgcgccgactcgggctggggagttccttcgctatctgttactcagccctgctgaccaagacaaactgcattgcccgcatcttcgatggggtcaagaatggcgctcagaggccaaaattcatcagccccagttctcaggttttcatctgcctgggtctgatcctggtgcaaattgtgatggtgtctgtgtggctcatcctggaggccccaggcaccaggaggtatacccttgcagagaagcgggaaacagtcatcctaaaatgcaatgtcaaagattccagcatgttgatctctcttacctacgatgtgatcctggtgatcttatgcactgtgtacgccttcaaaacgcggaagtgcccagaaaatttcaacgaagctaagttcataggttttaccatgtacaccacgtgcatcatctggttggccttcctccctatattttatgtgacatcaagtgactacagagtaagtctttgattgtttcttatttttcttgttctttctcctccagtgtttcttgtgtagtatttaaaatagactccttttatttcatctcaacgagttgggtaatttcaaatgccatgatgagcctgtatattgtatgttaaaattaattatgtatgtagatagcatttaattagtacctaccacatgcagagcactgtgctaggcacagaggggaagagaaatataaatgatacggtcatttacccaatttataatctagtgggagataaaatgtaatacacgtacacataatgttaattaaacttaaaaagcgattgacaatagaataagacataaactaagaatctaattgtgaatctatttgagaatactttaaattagatataggaggactcggctaccatggatcaatctgtaaattaaaatacacttgcaatattaagccaggataagtttaaagatagaaactttcactcatgcttcattatttctctaaaacagattaaaatacaatgttaatttgctatgtcttttctatagctttagttatatgtacatatatatttttctttaactagttaaaaattttactgtacatatccaggtaacctaattaacatataatagggtattagtaatatacagttcaaatttatgggctcccttataattaccatctcttttgaaagaaacttcttcattccattataatattccaaactgttaaaatgctacataaaatgtagcattttataattctgatttcagtatcttacaatgagtgagtataagaatgtttctctcttcaggtatttgttttttattctctatgtttcttaaattgtcagagattaaagttttccagaagcataatggtttacttgctgcaccatgatttcacaaaatgaagtgcctccatcagttgtaaaaatcctcaaatctgctgtttaccagcaattcctacatcgccaaaatctagaaaattgcagcccaaaaagaagacagagtagatacaaaatttcagttagataggaagaataattcaagaggtctgttgtataacatggtgactacattgtattcttaaaaatcactgagggtcaatttctaagagcttttagcataaaaaatggtaagtatgtgaagtaatgcatatgttaattagctctatttacccattccacaatgtatacatgtttaaaacatcatgttgtacataaatgtatacaattgttctttgcgaattaaaatagataaatacttttgttaaaaaaaggcaaatctgtttaaagcttggaatcaagatgttggcaaagtatattgtatctattcgctgtaaattattcacaactatgtaactgaaacctatgggctacattaagggatgaacaataaagatgaagaaggtaagttcaatgttgtggggcaagactacctataaaaattttggaaaattttaaaaagaggaaacatcagagctgatcggcaaagtcaaagagtggagtatatgaactacaggggagttggagtgttagaatttgaggattaacatggagaactatagttaatgtattgtaatgccccatctctatcttttgtctttatatatacatctagtcccatatatctgtaggatttttttttaagtttttaggaagccactgttagcagacatgatttggagtactgggactgcaaagtagttataatactaattattttgtcctggacatatgatttgaaactcttcattctcaaaagagctggttaaaaaaatgacagagcagaaaatactactgagaataaacataaataacattataaaaatttaattttattgagtgaattagcatttacttctaagacacacaaaaaatgactttcttctttacatgatagcaatagagtagaacaactgactgaatggaattagctgaagacaccagaactttcaccacatagaagaagtcataaggcaaatgaaatgggacagaggttgtggaatagagttttttaaggtccgtgataattaaggtatccagtgatgctaagatcatttaaagtctcagaaataatgccaatcctaagtttacaaaagaaatgagaaaggtagactgaagcctccaatgtagtggttttcaaatttggctgcatattgaatcaactgtgtagcattaaaaaaatattgatacctgggacacagcctcagagattctgatttaattggcctggcctgtggcttgggcatcaggatttttcaaagcttcccaggtaactctgatttgcagccaggattgaaaccctcagctctaataaatcacatgctcttcttatcccaccaatatgtctagttttgcctgtactgttttgaaatagttgtcaaagttagaaacttgagaaactttacataaatatccagattcttggtttttcttaacaaagtaaaaacgtaagcccaaattcccatactcaacaattagctggacctgagtagtgctcacccctgaagacagagcactcttattcctgttgcccctatctcccactgatctctgaattctcacacctggtccctttcacttatgaactttcatagaccctataagcatttgaacttgggaaccttgctctagaaattccagaacaagactgagatttaaaatttcccagaggaaaatcgtgtggttcggacagaattagcagcaataatttaagagcagctgaaaaaattttgagcatcagtcaacaaggtttatatctcagtactttgccacccattgtgagttataaataaacataaggcatgattccagtcttcacaaagtttatatctcagctggaagaaagatattaaacaagaaagaattcaagaattataaacacagaatagtttataattaaattgatgatataaactctaaatacctgtgggctccataagagttatatgggtaacatcatgatctttccaggatcacttcttgaagatgggatttttaccccgtaaccttggcaggcaaatgcaactaaggtatttagagaatatagggaatattctggagacaggacaggaaagaaccaaccagaaggaagccatatcagtcttactcagttggaaaatgggccgggggcagggctggttcatttagataatgtttaagggctttgagatcttaagtttgttttgttttggttatttgcttgggcaaaaaagtgacatgatgaaaggcaagagggaaacaaaccttcctgatcaactgactctgctagatgctttaagtacatgagctcacttatcttcattttgataaaatttggaagtaaattttattatccattagaaagatgagtaaacagagcataatgaccttcccaggtggcacagttatgaaatagtagtttttctgattcaaatccatgcccttcatactgtaccacagacgcatccataatatgaaggacggatttgaaagggtagagtctaaatcaaggaggactaattgaagctcttataggaattcaatacagagcaaacaaggaattcagtcagaaaaaaatttcaaaggatttttgagaaactatccgagtcatctcctgctgtatcacaactaaccattctcagatagtttaagaatcaaacactgagtcattgggatctaatacatagcttaaattgtgtaaataaaaattcagccatgtttgagtggaaagttatccataaaggaattcatttatagtaattactgagtgttttgttcatgtcttccaaaaaatatttgaggacttattataggccttggagatactgttatcaacataggcaagtctctcctcttttgtaacttacagtctagtggagaatgaggtgaagatggagatggagcataaataatgaatgaatgaaaatgcaggcttattcagtagtgaatgctgtaatgagatttttaaaaaatcaccttgaaaagcgggttactgcagtttatctcaaattttaacgtgcatgcaaatcacctggggatcttgttgaaataaagattctgattcagtaagaaaggatgaggaccaagaatctcgatatcagcaagctcccaggaaatggagatgctactagactaaggaccatacttggagtgtcaagactctagattcttttgggggttggagcagatgaaacaatttacctagagtaggcagagtcttgggaattgactctagaattttgacaaggttcaaatacttacaaagaaattcctattttcccatgttgactattttgaagattcaaaaatatatatctcaaattctttaaaaaaatttgtgtcacccctactttgctggtacctatttcataatattccactgaagaaaatattccactgaagggaggcagccagacattggaattctatgtgctatgcagatgaaacagcaagttcaaacactcttaaacaaaaatatcttagaaaagaaaagcatatggctacagtttaatgactaaatggaagagtgatttgatatgagaaataggcaggagagttaaatcatgtaggactttataagccatagcaaagagtttagattttattctatatggaaaggaaaatcactgaaagatttttaagcaggggagtttatgatctcacattttagtagaaaaaatcaggctgctgtaaagactctattactacatggcaaaaaggcataaatgaggagactggttaggaagttgaggtgggtactggggtcagaaccatcccatagtaggatgttaacaatggagatggttagaagtagaggtagaacctgtcaagaactgtgaaaggtttttaccctgttgcaatctaccaggttagcctgccacagtttcagaatccttgtgtcagaagacatgagactcctgattcagaaacaaagaactttattactcatagccatagcaatagccagagtatcaacacttctgtacattccttgagtcctgatttcttttttttttcttagatggagtttcgctcttgtcacccaggctagagggcaatggcgtgaccttgggttcaggcaacctctgcctcctggattcaagcgattttcctgcctcagtctcccaaatatctgggattacaggcacatgccaccacactgggctaatttttgtatttttagtagagacaaggtttcaccatgttggccaggctggtctcaaactcctgatctcaggtgatcttcccacctcagcctcccaaagtgctgggattactgatgagagccactgcacccagcctcgtcctgatttctacaaggcaacgcagagtgggctaggacacctgcataagcagtactcaaaagaggatcagtgttacttactttctttttgccttaggatcaaatatacaacagcatggtgctgttattgatcctatccttatttaaaaagttgacattgtgttcatcatgggcttagcatttttgatgttttaaatattgcattattgtcttgattaatgcatttttgatgcctccttaaatttgtatctcaggcaagtgcctcacttgcttcacaccagccccagccctacctttcccctaataagttaggatggtgatttgggtgtctgtcaccaacaaggcataaaattttgagttcctcccctctctgaagttcctcagcatacttagtctggtgtgtatggacttcacccacccttcaggatggggaaattttaatctagccttaagtaatattttccttaatcagctaaaattaggatgggggaggggagtagagcagcacagtgagagagcagctccttgccaataaataagacacatttgttttcagttttaagcactcagcagctacctatggctcaaccatatgaggtccaatatttttgtgcacctaaaagactaaattatgaaataagatcatcattactgtcactattggcttcaactttgatgacccattgactaagaagccagagcctatagctttctggctggaactcatggcttgttcacttaactaatttggcctttactcacacaccaagtgtgttttgcttctttttgatacaaaattaacagagcatttgctctctcatcatgataatatctcttagggtcttgccttcttttaacataagggttggggaagttttccagggctgtcgctgatggtaggaatttgtctagatttctttgcatacctttctcattctttgtcaacactgtaaaccaatccaggtgagtaagcgcccaaatacaaatcagtgcctcatctatatcttcccagaaagctaagttccactgaaaaacaaacaaaacaaaactctgaatcctttgactgtcatcttggaatgaatctaagtttggaataagaaactacagctggggattaatccttcaagggcccagctgttgccattcttccttaacaagcgtatgtgtcttgttgtctcaacctcccaaggaaaccagtcaaagtttgaatgattcacctggcttctaccttctctgaaagtctctctctctctcaatgctcagtgaaggtacatgtctctgcaatttttgtgtaaaagagagtggaattttctgcctacccaggacaaatgttagtactagttattagaatcaagtgaatctgaatccaaatggggaggaaattcaccccactctaccctccagagaagagttaacaacagccaaggcatcagtctagcagctgagtttgaacataattcctgttcctcaaacttcgaccacatctccaaatccttctccttaacaggaaataaagtggaacactatttattcttggttaatcatacaatttggtcaacatgtttgctagtgattcccacagacttcctcaaattctgttaatcagcccctgaaacgctcatattttctttctgaaaaagccatgtgtctgttggcgtttcttcctcattgtcaaaactgtcaaagactgtagtgcctgagattttactatacttacaaggcaacaagttagcctaccacagttttactaatgctagcaaaaacctttatgactcacagcaatagcagtagccagagtgtcaatatttgcacaggtttcctgagtgccacttctcacagggttacacaaagtagtccaggtgacccctgtaccatcagtgggttacatcacaggagaggaactctgagactagggaacctgaatcttttataatgaatagtatgctgccctttgttctagaggtaggcactgtctctatcttctaaagctctttgctacacaaaatccttgaaaagacattctggaacaaaggcagtcagagccttgctcacaaaataacatgagaggctcatgtagaataatttcccaacagaatttgctgttggactggatgtgtaagtgtaaaggcaatggtaaagtcaaggatggtctttggcttgcacactgggtggcatttggtgccacttaaacagtgacacttggggaaagggaccaaattttgattacattattacgatatgcctatttcattaccaaaagaatatgtcatggtggcagttgaatatttaattctagaagcccacagtataggtcaaaaccagtaataattgatttggacatcatcaatatttaagccatgaaactcagtgggatggtgaagaaagagagtccacaactaagctctggggaactccagcacttaaagttcaagtagaatagataactaagacaaagaacaaccactgagggaaagatgtgtccaggaatccaaaaggaaggaagtgattaactgtgtcaagcattgctgcgagttcgacaaagatgaaaacagagcatcgtaagctggtagtattcaaagggtcagaacacagaattacagataaaaacagacttttaatagtgtgacttactgaaggaactggataactgaaactatgagactgatatttgggctttgtaataaataaaagctatttcaattttataacaggtatactgaataaacatggtgcacaaactatgataaaaatgcaattttagtgctccttccattatctcttcagtatttagcaagggtaatcatcccccaccttgggatggaaattcctgtgcacgtattcaaacaccaaatgttcactacatgtgaggctcagttctggtgctggggatagcacaatgagaaaaaacatccatgaccttggtaggcccatgaatttatatgcttttaggtaacataaggtactaccatcattttcaattgaaaattgtctttattaagaaattaaaatatatagtcctatgtaatgatcaaaactgtgtcttcacattcaatctcatttcctcctgaggtctggcctgtcttaggctgagagcctgcagtagttggcatcttccttggtgcttatgttccccaatccaccagttgctacttccctctcagcgctgattaaagagtaataaggaagcagttggacagttctttgtggctagatgactttatgatctctaagtccacacatggaaagatacatccttcagatgcctggaagatgactagagggcgttttcatctttcatgtgatctttagaaattaccctctggccttttcccctgcaggaccttgagtgagttgactgggagatctctattttgatttgtctctggtggctccattcccattctcagggcatccagctatcctaccccaagcctctttctgtgaaggtctccaggccaagacataagcccaagaccatgcataatggtttttgtgtggcccatcttgtccatgcataccattcacataacctttgctttgataaattctcagaacaaaggactacctcaagacagtagcaagttttatgcaatgccaatagagcaactagccttttcctcaccttctagatttccaaggcaggaatcaggtcccaattcagggcatcctcttcctgcagaaacacctgactttttgtaaatggccacactgaagcactccttgctaggctttcagcgaggagacaaaaatcacagtacagctttgcccaagatcccctcctcctaaaagcctctcctcacctcttcttgtaatgtcttaaagtgtgtgagtagttttaagagttacagaaatgcttttagaaaaggtttcctggaaattttgcaaatttggatttgtctccccctcccatgatctctgatatccttcacactggcttcagagtcataggcaggaactgaggcagaaagaggacaatgctaacatcatattatacatatacgtagaaaacaaattgtcccagattcagatttatgaaggcttttgcatcacagaatcagatagcagcttgttttctgagaatttgacaagaaaggagcctgcaattaggggtcccaaggtggagagcactggactagttaagagagacaagaactttaaaatgacgaggatggattatgctttcaggattcaaagtaagcaaggcctaaagaattatgccacagggcaggctgaattttttttaaaaatcaaaagtaaaatgaagcattctaaaattatgtggcttctccagttatgtgttcagtcttcagctttccttgattagagaggaaggtcagagactttacagaaatgttttatagatgcctaaagtcatttaggacatttgaaattatgctactttataatagcatgtgcctaaggggaaaggaaaaaaatctaaagttactctgggatgagaatgagaagacatgataaaccctggttctgaggaactttcagggtaaacaaagagggagaagtgaaaattacctgtcaagaatgggtgtatagaagcctagagaacatgaagattgaacagttagtacctgatgaatcaaaattccagagatgccaataagcaaaagcaaaggtaccacagaagaaagctgacagtgatccccaacaaagaatagggaaaccagtagctgataggcagagcttccagcaagcaagggagatagaagaatgtaaaaaacaaacaaacaaacaaacaaaacaaatttgtttataataaccttaaatcttaaagaagccaagttcatagactgaaatcatcagcaatctggccacttcatcattgaatatgttttactatttaagattccaccttctgtggctttgcagaaatatctttataaaaatataaagaaaacaaacaagaaaatccatgtgaagtcttggcaagcattcagaagcaccccacacaaatggtgtttgcttgcaaatcctaagcaatatttccaagactaccccaaacatagaagattcaatataattactgtattgatttggctacaataaggacagagctgtcaattattctggatttttcattttggtcttatttcagcactctctttagttggccacttgactgaatgtacagccagacacttactagccaaccttctcttgtaggtgcagacgacaaccatgtgcatctctgtcagcctgagtggctttgtggtcttgggctgtttgtttgcacccaaggttcacatcatcctgtttcaaccccagaagaatgttgtcacacacagactgcacctcaacaggttcagtgtcagtggaactgggaccacatactctcagtgtaagtatggaactcagcactaactccttcatacatagcattgtagtcaggaccagcctgccaagaacaggcaacacatgtctgtccccatgaacaatctcaattcgattttactaagtatggatttaaacactgtgagtcaggtattgtgctaagtgctggggattcagtaaggagcaaagaagtcaaagtttctgtttgggcagcacatacagtctagcagggaacaaagacattaaatacatagctgcagtgaggggtttgaccatgttgtggggttagataacctggtctctcgtcctgttctgcactcaatttaatagataacttcaaacaagtcactctattgctttctgcctcattttactaattaaaataggggactgggctagattggtgttttataaaatatattatatgtcacacagatgccaaaggagcttcatgaaaaattaaaaggggaagataataaaatacaatgaaaagtgctacattcctaattcccccttggaagtttacagtacttcctttaacatgagtgtgttataggttttgagaatctctatgcaagaaaacctgtttaactttgttaaaagttaaaatacttttaaaaatattttatcacagtaaaactaacatcccgtggaacacaccttggaaaatgctggaatagatcttcctcctacttcaatgacacaatgttttctcagcttagaaggcagtgtgaactgaaggatactaggatagttcccagtccctaattctctctgctactggcctgcaaatgtctgaaacactatccttagagaatcattgatttaattctttagagttctctaaagcacaaatgtgcctgaaggggataaccttttaagccattttcagctaaattgtggtatgaagtagaagcaattcactgacactggatgagggggaagaaaagaactggaaccatgagaggggaagggaggacagaaagtgacagagacaaatgactgcttcacaattttgcctcgagttgatcagaaaggatacttcaaaatagctcagcatcacagggtcagcaatcacattagcgccccaatttctctaccaaagtacagaatttaacagggcagcccttcccccaggaaactgaaggaagactgacagtctgagagcacatgttcatggataggctgcacattcctgtctttccagctaaactccaacgtgtcacaaaagttgagcttcagggcatggcaaagcctgtgaggtcgttttccatggatcttagagaaatatgttgatttcttgagcaaacaaagctctttttagcagactaatcttaacagctacctagtccagcccagagagaactgtcaataactaataaaaatattaacaacaggtaacaggaactttcatttgttgagtgtttttcatatgctgggcaccatgctaaatactttacacacatgtgtgtatgtgtgtgctgtcttattcaatgctccaaccccttaaggtaaagaaactcacccagggtcacacactttaaaaatggcagaaacagaatttagagtcagttcctatgatttcaaagccagtgcacctaactactgtatcgtgcagcctcttccagacagcaagctgggaaagttctcatggccaggctttgcagagagaataaaaagaaggttatccaagcaaaattgtctcattgctagctcagaacttttgcttgttattagaacaatttagcagagtccataagtcttccatagacgttattcaaaattgcgtatatccagacctcagtaatttagaaatggcagaattttctaatgcatatgctgggaattaacaaattccagaagggatagcaagggcactttctccaatcaagtctcttgttagaaattcagaaatatccatctacataaaaacaatgtactgcaaccacagcagacctgttaaactattattcagtatgctaatctgatagtgacccaattagtacttcaagacaggtgtttgaacattgttggaatgtcttgttaataaaattataaataaacttttttttaaaaaaggtctaaattcagacctcattgtttcagcaatatttccctaatcaatacaaatcaatgaagtagtaccatgtaacaaagtgaagattttatataacatctcttggcattttaacgtgcataagtaacaaatacattcacctgttatttgcatttttactcttttattcaaagtagttttatattcatgaactcattttatcctcatgagtaccagatatcacaagttctattttataggtaagaaaattgagaattgaagttacttctcaaggatatacagtgatacaagagtcaagagttgagcctgatttcctgactttcaattaaaaactttcccattttaataagttggaagtatttcatatcaagaaatttattcattcattaaattattgagtacctactacacaccaaaaatttctaagcactgtgtacacagtaacgaataggacggaatccctggccccatgaagcttggtgtctaggacagtggttttcatactgtagactgtaagccattattgggtcatgaaatttagtatctttggccagtgctttttaaaagaaaaaaacagaaaatcttaagagtgcattacatgtaataaaggtaaggcataaaaggtaagtcatgaagagttatatgtatatgtataccaggtccgggtaaaatgtatttatttctatagatcacaatcaaagatgtttaaaggccagtggtctatggaattgagttctgtgtatgaacatgttactgacccactttggtagaattgaagcaattatttaatatcttagtgtctgtttcctctattgtatattcagctcaatttatatccatttccctcctaaatacttggaagtatgttgctttagaaatcaagaacattccttaaactgctctgcgttcattagataaagcatatgtttttcttgggttgtacataattcacgttcttccagtgagtataatgttagcactttatttcattgggcgattgttaatattgctgctggttttctgactttctcttcagaggtaaaacaaaacccactgtagagatgagagtaagctaatatggaaacagagttatcgcgtttcctccactttatctattcctgcataacaaacttctccataacttaaaggcttaaaacaatacctctttatatgattatctcttacagtttacaagtcaggaattcagacagggcttggttcatctgctccatgaggctgacgttctttcatggttttaagcagagactgagctgatctggaagatccatgatgctttcactcttattcctggcatcttggcaggaagcctgtccatgttggctcctaatgagcaagttccataaaaaaaggaagtagaaactggcttggccaggaaactggtatagcataattggtaccatacttatttatcgaagctcagattcaatgggaagtgcatagaccccacctctcaaagagtctgtgattattataattatgccacactttccaaatcgccaattaatccattactgcatcttatcaagaattacagtgacttgacacaatctcgtataataccaagaagtcaccccaactggaaagtacagccatatcaattccaagttaattctctgtcaagagagtaagagaaataccacattactttggagtctaggagagcctcctgatggcagccaaggtggttgatagcagaaagagtattggtattgaatttttaaagctgaccagttgctccacaaaactggaaaagcatgaccacactcagtagcagacatgaaagaatgaacatggttaacaacatcttggaaaactgaaaagttttacatattgctatgtgcaaaagagtacaattaaagttgtgcctaattaattatatacagtagaagtaagaataataaatgacaccttaatttttctccattaagaatacccatggatcaatgattcccagatatttgtatatgaaaaataactcctttgaaatggagatgccctggtcccacccatagatattctgattcatgtggtctggagcaaaggccagaaatctggtttgtaacagacaccccagctgtttcaatagaagtggtccaaagaaaatattttgagaacctctacctaaaaccatccttgtctgcttcatccactgatatcagtgcagtcactgcagggaggttctctagcccatcaaagaggaagcagggtttcagagagggagtgacattctgaatttccaccctttgcttcataataccagtggccacatccacatgcagtgatttcccaggctccctctggaactttcagggaagtcatttccagcatagaagaacctggccgctcagaaaacatttactaaaagtgggcattctccttctaatggcagtataactcacagaccttgaaatcctaaactcgtacttttaattctactcccacacccacacacataagcaaacatcctttgtatatggatgaaaaagaggtcatttttattctcttctgctctagaagcaaaagagattcccagagttggttcctaaggacaggcaatcaataacatatgttgggaatgtaagtagaactgcataatatttaaagagacaagctggaagtacacatgaagttacatagcataaaaccctataggagtcatgcaggtgagaatattggcactaacatgattttgtatcagcatagactggggagagaaaggtgaaaaatgaagtgtgccccatagtcttcagagctattatacccagacttggtcctataaggatatgtgtctcttgctcatggtaattgttcagatgtatgtatgtcattatcatgaagatcagccaagaaacttcgactacccaatgatgcccagattttggtccccaaggagctgtaggcatatggagattgattttctctgccaagacagtcacttgtctaggtggtaatgtgtgaactgttcaattaatacaattacttattatcacaaagttttttcgcattataaaaagaaagtggtagtataaaaagattaagtgaacactcttctagaatcatggcatcattttccatacagctacaaccatagaaagcaagcacatgagaccagactctggcctagttagcaaggggcaatggcctagttagcagggggcaagccattgttgaagtctgaatatgactttataaaataaaagcataacacgtaatgcccaagcttcttctctatagttcagcccccgaaaaacagcatcatgtgcctgtaatctaagctcagggaaccccacatgacactatgtactagcctggccaggaaaattagcaaggtatttggtaatacaaactgaattgatggtctttcttgccacaggtatatcatacacgtaaatcttcaatgggcagtgcaggaagaactagagtattcagcaagtcaagccagctgctttcatggagaatatacccaaagcatctaaaccagataaatgttaatctatttttccctttagaaagttcacagaaaagaggccagtcacagtgactcatgcctgtagtcccagcactttggaaggccaaggcaggtggatcacctgaggtcagcagttgaagaccagtgtggccagtatggcgaaaccccatttctactaaaaaaatacaaaaattagccaggcatggtggtgtgcagctgtaatcacagctactcatgaggctgagacaggagaattgcttgaacccgggaggtggaggctgcagtgagccgagatcatgccactgcactccagcctgggagacagagcaagactccatcgccctctgcaaaaaaaaaaaaaaaaaaagtccacagaaaagataactattgggtactgggcttatttcatcacttgaaatctgtgcagcaaacccctgtgacacacttttacctatgtaacacaccttcacatatatccccaaacctaaaataaaagttaaaaaaaagaaagtccacagcattcctgagaatctcattccattcccttttactccctttgtcattgtcaatggaagaatagagtctccagctacaataggtaactctacatgtattagagaattgatgtttagtacctctcctttcttctatgtaacactttcattgtgtttgtctcacaactgcttttttccatcccttaaatcattctctctttatctctaatatgttgctaggttttcccctagtaaatatagcccaccttctttaataacagtgaccacaaatatcagagctgggagggccactttggaacatttattctaataaccacatttctagatgagaaaactagggccctatctactagatactttaggaatttgataactagagttatagatgaaactctcaaaggctgctatattgttcctctggcctccctgaatttgccgcctcagctcagttacaaaattcagctcatagactattctgacaatgagaatgttagcatctgcaaattcaatggtttttttttttttttaagttaaaagcttacttttcagctctatacctgatggcatcttgttctatcagcatgggtacagactcgttcatgtagtcccataatgttcatggagtcccataatgacactacgtagtagcctggccaagcaagttaggtttgaatgtggctagaggaagatgaataaaagtgagaataagaggcgaggagaacagagaggcattataaggatatttactctttgactgaaagaaatgagaaagtactagaagggtttcatcagagttgtggtatgacctgactttaaaagcataaattttggctgtgtgggcaaaatataaaagagggagcagccaaagagatcatttaggaggcatagtccaaatggtggtggtttagaccagagtgagagatagcagtagaagccaataaagtgttctgatactgtacataacttaaaggtgaagctaacaggattagttccacagaaaggagactaaaactaattttattagagtttaacacttttggttttagacttttgtccctaggcatagtagcacatgcaactcatattagttatctgagcctcagggtgaaaaagtttctgatccttgtctgaaaacatattttgatagaaaagaggagaaaccagtgatgttgggcaactaagagagtgaaaagaatgcaggattggtagaaaagcacagaaaaatgatccttttcatttaccaattatttattgggcatccctctttatactttttgagggaaggagaagagagtaaatttttattttattttattttattttattttattttattttattttattttattttttgagacggagtctcactctgtcccccaggctggagtgcagtggcacaatctcggctcattacaagctctgcttcctgggtttacaccattctcctgcctcagcctcccaagtagctgggactacaggcacccgccaccacgcacggctaattttttgtatttttagtagagacgaggtttcaccatgttagccaggatggtcttgatctcctgacctcatgatccacccacctcatcctcccaaagtgctgggatcacaggcatgaaccaccatgcctggccaagaacatgatattttaaagcaacatgatgtggcaacaatggagggaagtatttagttgaagactgatggtttgaatgtgtcctccaaatttcatgtgttgaaaacttaatctccaaattcacatcctgattggaggtggtgtctttgggagggaattaagattaaataaggtgatcagggtggggcccccatgatgggactgatggctttcacaggagaggaagagagacctgaactagatgctcactctatctcaccatgtgatgcctctcaccatgtcatgatacagcaggaaggccctcaccagacgcccagtgccatgctcttgcactttccagccttcagaaccatgagctaaataaatgtctattctttataaattacctagtaagtgatattctgtcacagaaacagaaaatggactgagaccaagtgctatttctgttggtaaagtaatgggtcattaaaaagggtcatgacatatcttctttttccataaatcttgtctcacaagaaaagaatcattgaatgaagaagtcactgctttcatacagttctactccccatttggaaactaaatcttggatttgcagatttttatcccacagtataatgaatatgatgatcttaaatctactgttaacagtttaaaaccattatttgggtcataaagaggaagcagtcactgagaattcagtctatgtattttttcttttttcttgtttttgaagagacctttttcactgacaggatctcattctgtcacccaggctgcagtgcagtgacatgatcctagctcactgaagcctcgaactcctcggctcaagtcatcctgcgacctcagcacttgaggcacatgccatcctgcccagctaaatttttttagagatggggtcttgctacattgcccaggctggtctcaaactcctgactggcctcaaatgatcctcctactttggcctcccaaggtgcagagatttcaggcccaacccactgcaccaggcccagtctatatttcttaataatgaattatttgccttcccctgtgaaatctctgacatagcaagaataccaaaccaatgggtagtagtagtgtcttcatctgcccagataacatctattattcaatcaccagatacaattctcctgaaatggaaccaagggaccctagcataagtaaaattaagatgatgagtaagaaaacagattcaatgacaaagcaggacacaagacaacaaacagttggtggaaactggattccatgaccataatagtaaaatatctaaacaaacagacttcctgggaaaaaattatttggggtcatcagaagcaaggaaatggaacagatggagcaaactggaatgtctgttccgttgaaatgtttattttttttctgagactgatgcaaagtaacactgctaaagtaacactgactctcagcaaccagtcttagccactaaattgactaacagacttggcatccataaaaatctattaaataaatatatttagcattgattgagggtccaattatctgaaaaaatacaataattttctccaaagtctggctagcccatgcattactggtggaagagaagtggattttgcagagcaagacaaagctgccacttggttacactgatcttcaacgtttcaccagtttgtgaagcaaaatatgccttttgatggctgtgaattacccttttgtgatcaatagtggaatttataaggtccttttccatttaccttaaattttcactttgaatggcaaaagcacaccttatcctagagtatccaatagttactatttaccccaagtcccaggaaagccaaaaatagggctacatgcctcttatgtctagtagaaaggatgattatagaaatgtgcttaaccacacttaagaaaatgggctaaacttacaccattaaaaatctcatgaggatttcatcagaataacagaaaaagctcatcacaaacatacacacagaaatgatagtactttgcccttctacatattttattaccttggtgaataacagacgggctaatacaggaggcatatgtaaaatatttatgaaaagcaaagtaattgagataataagctcataaaacaataattttccctactatattcaacagcatgtgcaaaaatgagaattttcttcataataaaatgcaccagcagaagctaccgatgaaataataaaagagaagcagaaaaatataagttagagttcccttcgacacattaaaaagtatttaggggaaaaagtagttgcaaaaacagtcttgtgggtattttttgctgttgctatttcttgtaagaagaccttgaatttgtattatcttcctctcaaagagtttagacataggttgctcctttgaatgtccctatgaagggggtagatgaaacaaagttgttctattaacttccatgatgatgtccatggggtacatagtagatgactattttatactagaacttgaggattttccatgcagctatcttttgcagactctgtcctccttacctaggcaagatatacctaatttttaagaaattagaatgcaatgggcaagttgactctaagagtgcactccaaagcatagcattacatcaagttccataagaggacagggaacatcagagtaggtttcagatacaaacttaagagggggtatttgaatcctaggccttagttctcctagacttatccctgtgacacattattcctcttcaatcgctaaaatttcatttttagcatgcacagaaataatacaacttgatcctggaaaagataaagagattagttaaaatgtcaaaggcagcatgcctgaatgggagctcacaacctgagtcagttctcttggcaagggtagttgatggtcattgtcacaatgtggcttgagaagcaaaagcccacctgtctgaaaataaggctgcccataggcttcatgtttgctggtcatttctttagtttaaaagattatttccttcttgaaacttccattggtttcctgattctttgaaatgcaaacatttatatgataattcaggaaatatttatagacagtctattccatgaccagcactagggataaaataatgaaacagataagtaaaacccctgcatattttctagtcaagggtataggatgctacaccaaaaataataataagcaagaaaaaaggcagcaacaactgggctaggctgagtttcaaaactgggtgatgtgacagtaactgattggctattattttaaattaagtggcctgatgactacctctttgaggtaacatttcagatgtggatgacaaggaggagccagacatgagtagatcagagggaagaacattcctagagaggcaaaggctactgcaaaggcagaaagttgagaaacagatttgctgtatttgagaacaaaagcaaaaagaaggaaaaaaaaattggaatgaggtgaacacaaaaagggggacatggtccaaattacgatgggatttataagccagaataaagagttagagcacacagggaagccactggaagtgcatatgtaggtgacttgtattttaaaatactctcactgctgtatagagaatatattgcaacaaaaaagcaagagtggaaacagacaggccagtggtgcagctcttgcaatgatcaggagaaacatcatggtgggttgccccagggtggtagatgcaaagagaactggttagacgtaaatctagaggtgagtgaaactgatgataggtttgacatggggcagggtcgaaacaaaaaggaatgaaacatacattttagatttttggtttgggcaattggccagatggcaaaaccattcactgaggaaaggaaagctaaatggaggcaggttagggaatcaagagttcagctatggccactgattttgaagtggcttttaaacgtacacacaaagatgtcaagtaggcagttggatacaaaaggctgcagaaaaagcacatattgaatgacctagagtgctctcctaggtttccagtaacccattttgaatctcactttgcctttccctttctcttaccttacctacatttgatgaagctggaattaggtacaatatatggaaataatttttctaattaaagtatttataaataataaagccctcacatttggaattatgattatgaccactttccatcaagtatttatctggcacatactgtgttaccaatttcttcattgtagcagtttcaggaaatgcatatgacaccgtacctgccctcagagatattatagcttttaatgggctcgtattgtaaagaaaattgaacctgatcctaataagaagaagaaaaaaatctccaaaagagttagcatgttgcatgactccagtgtaacttgaggtagccacacaaacttgacttcatagatttttcttacatacctagccaagcaatcaatgtaaaattgaggggctgtagattccctagtggtggacctgctgatagacttcagtgccccaagtatagtgaatgctcccccactgaatgccatataatctcacatttcataaatagttgctcctgtttaaggaaattaataggaattttgcctaggtaaaatgaaaatgtaggggtcaattatatatccactatcaagcatggacatttaaacatgaagccagtttatctgcaggttaactttgagatatgctcttaaagaatgggacagatggctggtcaatttgatctgggctgtgatcaagtaccccagaggatcagctcctactggtcagagtatatacaaatagacaggccaaggggttgtatgagagagatcttaaatgtaatggaacaccatctctttaaccgattctctcggctacatggtttcagtccatagagaatggggctccttgcttttgttctcattcagtgaaaagaaaaagcattaagggtgaaatatatataacttatctgtacctagatttctcatgaaataaaactttaccaacaacaagttaatagctaagaactgtatctaggaaaactgagtgccataaaaagaatgagtatatatatccatactatataatatggctagggagtactttagtttcctatgactggtgtgaggaattagcacaaactgggtgtcttaaaacaatagaaatttattctctctcagttatggaggctgaaagtctgaaaggaaagcatcagcagggccacaccataacactgttgtcactatttgtcattaacaagggcaccatccctttggaatatcttttctgagacccgttatgaaactgaagctcttagcaacccagcccttactagtgtttttactgaggttatccacttgaacaatgaaaatatatcaaaccagtctctaaggcagtggagttcacagatgactcacggactatataaggctcatccctgtatagacagaacaaaactaattaaggtactgaaaacagtaaataatttagtaacctataaaaattgcagtgagcttttgattttgcacattgtatttaaaccagtttatagattaccaaagctaattttcaacccacaagtgacttccttcaacaatgattatacttacaaattccccgccaagaggtataacgttagtggaggtatgttccaggttgcaaactaatttggagcagaacatatttagaaattgacctacaatagcattttaaccatttagcactttccaaagccaaattaaaatgagtttttaatttaattttattttttttcacattttttatttccatgggtttttggggaatagatggtatttggttacatgagtaagttctttagtggtgatgtgtgagattttggtgcacccatcacctgggtagtatacactgaactccaatttgtagtcttttatccctcacctccttcccacccttccccccgagtccccaaagtccattgtatccttcatgctattacctttgtgtcccacttgactaactttgagttttctgtcccactttgttttccagcctctgcaagcacgtatgtgccaacggtgtgcaatgggcgggaagtcctcgactccaccacctcatctctgtgattgtgaattgcagttcagttcttgtgtttttagactgttagacaaaagtgctcacgtgcagctccagaatatggaaacagagcaaaagaacaaccctagtacctttttttagaaacagtacgataaattatttttgaggactgtatatagtgatgtgctagaactttctaggctgagtctagtgcccctattattaacaattcccccagaacatggaaataaccattgtttacagagctgagcattggtgacagggtctgacatggtcagtctactaaaaaacaaaaaaaaaaaacaaaaaaaaaaaaacaaaagaaaaaaataaaaatacggtggcaatattatgtaaccttttttcctatgaagttttttgtaggtccttgttgtaactaatttaggatgagtttctatgttgtatattaaagttacattatgtgtaacagattgattttctcagcacaaaataaaaagcatctgtattaatgtaaagatactgagaataaaaccttcaaggttttcca

SEQ ID NO: 45 - DNA, 364905 bp, Homo sapiens
ctccctctcctatcggagcacaatgaaagcctgtgtatcgccgtgactccgggcgcgagccagtgtcagcaaagcggctaacaacagacgagaaagagaaaggaaaatacaagctactttttttttccatctataaagcggagcaaatacaggagatagaaccagattgcttattgcgagtccagaccctcagatccactggccggggatggaatgtacaaaagtggacagaaaagtggctggacatgactcggtgcaatttgctggaagtttgtaagtttgaccatcgtttgtaaattactctcggaagagtttgtctctcttgatactgtattagaatagagccgggggtgaggaatagaaacgtaagcgggaaagaaaaaaatgtgttgaaggatctctctcagtggctagcgacttaagattgcttttcatttaaggctaggaaaccttagagggagtgaggattttaccggtgattggattagctgaagaaaaaagcatggtccaaaagtccaattactgacattgttaacagttgaaaagctgtctccctcttttgggagaagacaacatcctacagtaccccaaagaggagaaaacaccggagcgaaaggaaagggaggaaaaattaaaagccaaaagacagtctcccttgatttttgcacattttgaacagtgacttaaacatcttctgaaacagcactgttttgttttgttttggttttttatttaacctgaggaaaagtcaaggctgctggttacatagacatggtagaaatgtgtttctctgcagaaacatccccataaagaattgtcggaaacaactaggtgagggggagtcctctctattaatacctctctcaataccttttgctgtgtgtttctgtctcttgctggacaatccctgaattcttgatctaacccccagatcgtgtgtttacaaagtacctagtggctcttgtcagcttggtggaggaaaaaaaatccaccaactctgtccaacttctccagagctgtcaaatgcaattagagtaagttaatcagggtttgtttccaacttatcctccccccagttggtttctattctttctccccaccctctttttactaactcccctcccccacaacttctccacggctcccccacaacctctgaagacctctattcatgtggccctgaacactgagctcacattgtcaaaaacagacttgcctgcaatagccagcagtagcctctttccacctcaccatcccagaggcagcaatcattgtgtccggtaagatgggggacacagcgcccccgcaggcccccgcaggagggctagggggggcctctggggcggggctccttggagggggctcagtcaccccgagagtgcacagtgctatcgtggagcgcctccgggctcggatcgctgtctgccgccaacaccacctgagctgtgaaggacgatatgaacgaggtagggccgagagctcagaccgggaaagagaaagcaccttgcagctcctgagccttgtacagcatggccagggggcaaggaaagctggcaaacacaccaaggccaccgccactgctgccaccactacagcccctccaccgccccctgctgcccctcctgcggcctcccaagcagcagcaacagcagccccaccgcccccaccagactatcaccatcaccaccagcagcacctgctgaacagtagcaataatggtggcagtggtgggataaacggagagcagcagccgcccgcttcaaccccaggggaccagaggaactcagccctgattgcggtaagcacctggctttctcatggttctggctgtggtcctgtgaccttttgtgagggtagagtttgctttggcctaaggtagagtggatggcaatgaaaaaggccaagatgtcacctgactaccttaaaggccattgggtgtgttcgggtggtttcatgcgcctactcatcatgttctgttggtgctcactcctgggttttccttcgcttataggatattccttaactgataagaagcctgagttttccagaggctctctggggtccacatcttataaaagaagaggctaccagctggcaagatctgagccactgaggaaggttctatctcatggatcctccagctttggccagccagctctgattaggcccccaagccatttttcagccccaaagcatttatcagcccagctggcctttattaaagcctttttctccttgccccatttcccctctcccttttgaagtgacccccttcttcttcgcttaagagaacataaatggtaagctgtaacaaatagcaaattccccgaatgtcccctcagtcaaaaacaaaatttggggaaaatatcccaaagagagactagggaggcactgtttcttaagaggcctactctctgattccctctagactctctcactcctgagccacatctcgattattttcccaagcactccagtccaatccagtaatgctcccttagagcattcgttaagcagacaggcacgaagcagctatttacacagatcatcatcctaggaaataccttgtcttcagccactcctggtgataggatatcaaacccaaaagttctgattaagtttctggctggaagttcttccccagaggcacagacacacaccatcccagaggagtatcccttggatcattgattctcagtgccagtcctggtcaggtgactgcctgctgtttgcaggcttccccccaaagctgctggaccagtggcctctggtggaaggtagaaccctgccctgtggccctgcaggcttcctcccttttggagctccatgggacttctggattctatgtctgctccagtttacccaggtcagccctagcaaaagcgacaggaaatggccatgcaagccccaaagtactcaaaaagcccaaaggagatggtgctattgtgtctaactgctcctccaaaggagcttgatattgagctctcgggagaggacatcctctggccagacgctcaggatggctctttctggcttcccttaatccctggcctgggtccatggtgacgaagaccctgggaatctctggggagtaggatggtgcttttctccccagccataagcacatttacttgggctacctaggaatgggactccttgaggccagctccagatgaaaaataactaccaacagttaaactgcacagggtttacagttttacccttgaatagcagcactagcttgtggggttgtattagagcttcgaagcctaatatcctttttctaccacctgctctattcccgcttctccctggaattccctaggaaagcagtgggaggttgttttgtgaaaaaagagatgttagggtaaaggaggggggtaaagaatcgctcaaatggagagaagaatgaggtttgtatgtatgtgtgtgtcaccagcatctgtagccaaaagtatctaaatgccttgattgtccccagtaaatttataatctgtctgcaagtctcccaataatgcggctttgtgtgcttcacagtctcctggtaagtgtttctggggatggaaccgcaagtgaggcacccggcccaaccctgagtggagaagactgatctctgcccggggtgtcaaggccggagcggggccgtgaagagccacagtgggcttcccttgtggccttcacagcccagcctctgaaggaaaggtggcatgtttgcctctggccttgttctttgagcttctgcttttgtccaacttggcagtaagctgagacagccttttttttctagggtgtttcatgatgggaaatgaaaccaactttagtggtcgtggtaactttacagtagcaatacccatgctgggagggaagtgagggagcggtgtctggcccttcccgactgaaagcttactgctgcagaagccatagctggctgctgtgctacctctggcctaagagggaatctttctctcttctaaccaccagccatctcctgagacattcccttagaggagctccctctccaggtgtagtgatgatgcagagaggcacagtttaagttaggagggtaagggatagtatatttctagtagttgcttttcactgagaatatgtggcattgcacgggttgttggaaattccctctccattttagctgctaaatttggcccgttgttactcagcacggtactcagagatggtgatgcaagtgctgtattaacctgataacattgtgtccaaagggaggcctgggcattttgaagtgattcaccaagcccattacattggcaggtctcactttactcgggctcctcttatttttcagatatgctattaattttaaaagggcctttgttcagggtgagtgtcagaattttttcttaattttattgctactgtgtccataaccagatttatgtgacttaggtgtgttgaatgtataactttaatagttaattcgtatgccataagtggccataaatgtcctttggagaaagggagagaatattgatcatctaaaatcaaagatgtgctgtgtcctcagatgaaagctttgtatcctgcataccttctagtacaatgccttgaagacagtgggtaatatttgttgaatgaaggtgaaaggacaacttctgtttggtgggataatgttgactttcatgggtattatacagcaaggaatatataatgtctgaatcctttcaatagccttaagtttcaagaacaatgcaagaataacctccaagccagttttaattctgtccacattgacagcctaattctacagcccttactcagccagtttcttcatttagctcaagtacaagttcaggggaagccccgctgctgcagagtctgcaggaacagggcctttcagagggcccggattatagggctttgagcagatctgcatttctaaccacttggagcagactttaggcactaactcattttctggtgaagtatgtttgaatctttgaatgaactgtgaaactgaataattgctggtccatggaacagtaaggtttagagcttctgtggtacattattaatctttcccttttgcctgagacaagctctttttctgttgcatagattgtgttgctaggatcactagataagtggttccatgtcatctctggcttcagagattatcttttctctaatgtcatgtggaggaaagaaagtagatcagacaaggagcctacatcccttggttttgtgcctgctggatcaccatctgggttacctaggacaagtcacttagcagtcatctgtggaacagagaggacaatcatgctgccccagcttgttgagagaagcaaatgagcgtgtttttctgaacaagctttaggaaaaattaagcactgccaaaatgcaatactagtgttagtagtaataaacttctaaacaatgaatgataatactggttcttctaggagttaaatgtatactcagctttcagttgtcggttttaaatgatgaaatagcacttattgtaaatagagggattggcatttcaaatttactgctgtcaagataagactgacgtatccgtatacttaagtgttcctgaaggtcccaggaaatcctagtgcaatgctatgaaagtctttggagtctttgaatgcatctactttacaggcctctgcatggacctgggaagctttggaaagatgtgtcccccagaacatctaaggcatattagaaaagttgtttacacaaatgcatgggagagttaaatattttgtcaacaattgtctaaaatgttaattgttagcttaagaaagtcaaacaagttaaatcattgccagagtaccctggttatttttaactgataataatcaagtttccaattgacaattaaaaagttgagagctgtaagtgggaggccagatctgggtatctatggctgtctacatgataaatgtcctcctaggacagtgataggagtgtttatattatttatatatgcagccatcatttccttaaaaactgacctattttcgttctgttttctagaacaaagtaaaaaaaaaggagaattcttatctatctaggaccttcctaccacttatttcaagtaaatataattataagatctcacaaaggcaaaagggttcaagtggagagaggagttagtataatactttacaaaaaattgataaaaacctttctttgacatcaaggtgatgttatcatgtaaaccaagatatcttgcttgtttaggacaatgtttgtttatagaaggcatctgctttctttgaaataatattggtaggtgatgttcatcaaatgtttctaaatcgtaatgtttaatcacttatggcttctgtattgtaaacatttttaaataccaatatgtttaaatatgggctttcagatgttcttagacataccaatttaaatatgactaaaagagtggccataattagctgtttttgtttttttgttgttgtttgtgtttgtgtttagcactgttatttaatctaagaaagcctgaaagggaatctgaaaacagtcatccagttctgctatccatggcagctaagcctttctgaatggattctactgctttcttgttctttaatccagacccttatatatgtttatgttcacaggcagggcaatgtttagtgaaaacaattctaaattttttattttgcattttcatgctaatttccgtcacactccagcaggcttcctgggagaataaggagaaatacagctaaagacattgtccctgcttacttacagcctaatggtatgcaaaaccacttcaataaagtaacaggaaaagtactaaccaggtagaatggaccaaaactgatatagaaaaatcagaggaagagaggaacaaatatttactgagtcctagaatgtacaaggctttttaattacatattttatgtaaggcctgcaaaaaacaggtgagtaatcaacatttgtcccattttacatataaggaaactgaagcttaaattgaataatttaatgcatagattttatagttagaccatgttcaggtccctatgttatacttactagctgtatgaatatgagaaaataattttgttattttcttggcatcagtattttcatctgcaaaataaagctaaagttatttagcaaaacagtcagcatagtgcctgatacatagtaggtgctcaaaacatgagtaccactagtagttggtagtagagagattcaaatataggccagggatagctatatgagaacatgggtcaccagcagggcctgagaagagggagaaaatacggaaatgtgggattggggtcgctgagtgcaggcatgtaagttaagtgtttggggaacagagcagtgcttgactgagtgtggctggacgtgagtactgagggggacaaatgagattgatccacatcctggagggcctggagatccggtaagagcaaatcagaagccctggaaaatggtagagcaaggacggctccaaggaatcaacagctatgatgcaataataatccttcatatacttgaagacaagtattacatttcccctccagcagcctcttctcacagcgcattgcctaagtgctctgtactacccatcttcaagtcccttgagctgcttaatgccttgctatttacacattctcccattcatggtgagttatatactgcatgacatgccctttgacactaaaaggacatagttttaaagcacactagctagatgcagaagaggaagtaaaagaagcagaccaagctatacctcgcttcttaggttcactgggccttccagtgcaaacaagaaatgccctgttggtaaaagtgtttatactctcttgatgtgtaaatcagtcttcccaacaaatgagtttgcctgtatactaatgtggaaaaggtattctcattattaaaaaaatcatgaacaaaaattcgtgagaaaagcattattttagatggtctttgagatgtacttatttccttgcttgtaatacagatgtgttacaaattttttacttgccttaaggtccagttggataccagtttcccccatttagttcttgtttacaagggaaaagtaagggaccctaaggaaagatggcaaaggagaaaagccaacatctccctcctccctgattcatggcatgatgcttggatgctgacggtagtgaatgggctattgactagcttcaaccttggcctacacatttgtgagaaacagaggtaaaagagcaaaagctattccacttccctatagaggacatgaagagagaagttcacatattctccacaggttgaggacaactagagagctggaccctaccatagccaaattactgaaggaatggatatgaaaatgggcaaatggcaatactgacacatgctacagctctccaaaggtcttaatgttttagcaaaggttttaaactcttacgtcaagattgtatgcatgggtcctttttagagtttgggaaaatattcattaattcagtaaataatctttgtacagctcttctgtgccatgaactgtgccaggaatacattgatggacacttcagtatagcctttgccctctttgaatttacagtgtagacgggaggtgagtggggttagaaatagaactgttacagttggcttgtgtaaggaggcaaagaagcatagcagttaagagcctgagatcttaactcttaactctgaggtgagacgaccagatttcaaatcacccctctaacacttagttgtgttttcttggataggtcaattaaattcccttgcctcagttttctcgactgtgaaatggagtgatagtaatagaactaacatcttagagctgttgattaaatttagcaattgcctagcacctcgtaaaggctcaataaattttagctgttattattagtgtgtgaagtaacatacctgaatcagattcataggtttcccagcccagaattgtgtttccagtaatgcatcagacatttagaggaagagcatggcttttctctttaatgtttacttaaaatggttagtgaagagtatcatattatcagttccctcaatagttgaatatggagacatcacctgggatagatttccatctccctagaatgttaaatagtgtccttcttgagaatgggaccaagtactacctcttccaatcctaagattctaggactcctaatctagaagttgaatagagtgaatgtcctcttgactccttacttctagaattcagtctgggtttccattcagttacccagcaagtgtggagtgtgggcttagtaggtaaatgagaaatttaaaccatctattgggagttttgaatcattggaaccaaatagacaaacttaccaatttaattgaattattaattgaaattaatgaataattcttaagtgaatttggtcctagagccacaaaaggttagacgcttcctactgtggagatttaaatttatgcttttgaaagccagatccctggctaaagttgctaatttactgcatctgcagatgaataggcaacacagatttgccgtctttccaaccctaagcaggagcatgttgaaatttccatgccttgatgtggctctcacctcagaatctctttactcagtacctcctcaagtgcggttttccataaaaaacatgaggaagatgttgccaagggttcaaagcaagttttattgatgacgattcttaattgaaagcatggtgtttctatgaagtgacaggattagaaaacaaatagtctccattctttagtagattatatttgggcaaggatggatttattgtccaaactcagagccaagaatgtagtcaaaaatttttatcttttttttttttcgcttactccccatgatttaaccttagattcctcccctttcttgaggataataatgcttaggaaatgtagtgtcaaacatagttgggttgttttgtttttaacagtgttcttgcttcctgagtcattctggcagattcatacattaacatggaatcattaacatttttgctttaaaatttctcttttgtcagaaatgtggctgagttatatttgtaattcttatccagccctctaataactgtcacccacatgaagcccaacaccttaaatgcctcattgtacaacagagttcttttcaggtagctctcatagatttcagtagaaagttaattacatgtctgtttctaagaaaattcagttaaggcaaaagtcggctacaacctctaataacttaccgggagtctgttggatacacagtatctcttagagtcctggtaaccagggtgcaaagaagtagcttaattgaatacaatatgtactgtactgtgtcttacttatgtgtaaaatgctcatatctggaggtcactggagtctaaattatgtaaaaataaaaacattctctggctaagcagctgagaaatgaggattttttgttgttgttgatgtttctgttcacctaagtttctgatacttgctaaaccggctaagtcttgcgcatttgattgccacaccgtgctacttaatttcagacagcacaaagtatgtgctagtgtattatcccatttggttgtttcgcagaagtgttaaagtgcaaagtgcagagatgagagtaaacaggaaagaggagctatcctgacagaaacaacagacagaggcaaccgtttagtaaagtttgggcccaagtcctagagccattgcaccaaagagagcttccttttctcccttagattctttgcatgtggatctgtttgcaggctcagtcccccagagagtgactctgagctgtctttgtgctaaattaaacattagttttctccttgggaacctgatcttccatagactaggcaacaatatctttctgagagagcgagctcccagctaagcatttccctcaggaagatactggctcaggagccctttcacctctccgatctgcttagctagtgtgagtgcgtgttgcatgggaattgttttgtctaaccaggtctagaagcccttaaagtgatgacttgtactttaatccttggtacaatgctggaggacccatgctactttagcatataataaatgaaaacagagtagcacccagatcatataagattacaaccacacatgggaaggagttctgattgctcactgcctcccaaattctgcacccacagcaatgaaagagagtgagttgcaaaacagaagccatctcatttctagccttctctcatctctatcctgcccatccccctagagggccagttcatattagtctaaaaataggacactattctgcaatttatagagttgtataagcccttagagagaagacagaccaaatcctcttttcgtaaatgaagaaattaaagctttttttttttttttttgagatggagtctcactctttcgcccacgctggagtgcagcagtgcaatcttggctcactgcaaccgccgcctcctgggttcgcgtgattcccctgcctcagcctcctaagtagctgagattacaggcgcccaccaccacgcccggctaatttttttcctttttcttttttttttgtatttttagtagagatggggtttcaccatgttggtcaggctggtctcaaactcctgacctcaagtgatccactcaccttggcctccaaaaagtgctgggattacaggcgtgaggcactgcgcctggccttaaagctcatttttttattaaagagaaagcctccaagaacccatagcaatagatcttggactacagcccaagttttcctgacatctattccaggttataaaaagtagtcatttgattaaggatttttaataaacctataaaaagaacagttaggggaaatttggtatttttattaatattttggtagtaagagtagcatggagtttagagcctgtggtagattgtcttttttgtttattgttttgaaacaggatctcactctgtcacccaggctggagtgcagtggcacaatctctgcttactgcaacctctgcctcctgggctcaagtgatcctccccgccagccttctgagtagctgggactgcaggtgcacaccaccacccttggctaattttagtatttttttgttgagacagtgttttgccatgttgcccaggctggtctcaaactccagggctcaaaggatccacccacctcagcctcccaaagtgctggattccaggcatcagccaccatgcctggctggtagatggctttttaaatgatcacaatgatcccttccaccccacacgcccctttgtaatgtaactttgccactcctggcatcaaaaaatggatgcttttttcccccttgaatctcgattggcctcgtgacttgcattatccaataacgtgacataaatgacatgtgctacttctgaggatggcctttatgaagccctcttggaacaccgacctgataccaacatgtaaggaagccagtctagctaattgggagatgagcatgcagagaaccaaggtgccccgactctaatcagcaccaactgcccacacacaagtgaggccatcttggacccagccaatcttccagctcaatgtggccacacaagtgagcccaggtgaaaccagcagaggaactgcccagccaatccacagaattatgagaaatattgcgtcattgttttaagccactaacttttggggtggtttgtaagtagaaaagtttaacagaatcagagctggaaaattttagcatggaaaatgactctatttcattagctgtgttatcttggactggttacttaacgtctttgagcctcataactctgcttttcaggataatagtagctgtctcaaaaggttgtggggattaaatgagataatacagtttatgaaatagcctacagttttgtttggtacatggcacagcttaacaaacagttttcctgctttctctttgtctcttctcaatgtattataattcatacaaattccctctttgtcagttcacattcacttcatgtgcatcaacattctcctaggcttcctcagatcactgttcctctaaacagcgattaattttttccctcctgggtgatgctgtcattccttctaactaccaaatttcaagcattcttgctatactccatggaacacatctgccttcagtagtctacccttaaaatagaaaagggttaacctcataaagatgtcactccctttgtactgttatgctgcccttgggagactcaaacagcatagcaaatatatatgggcaatgtaattgcattcgatcttctaggtcacagaagactttgttagctggtatagcagacagggaaaagtgagcacattcccatctttaagagcactgcttctaaattctgtcactctttttgataggaaattaccctaacagcctcattttttccatcttagccttcacaacaaataataaataaagaaggagtgatatagtcatactgtattatacctacttactatacttattcgtagtgatactgtatgagagtactggtcaggggattgggtattgaaggttctagtgctggctctgatactacctagtagggcaatttagtcatgtcctttaacttcctggtatttactttgcttcttggaaaaacagtaagtggcacttggtatgtggcttgtatcacttcttaggcctcttttggtatgacacactttgcagagttccctgatatttgattttgtttctcaaatttcagtctcttcttacatatgtttattgaggaagaattgaaaggagcagtgacaaaattggcaatgttttgtagcagtaaggagggtctgaagttatgtgggggacaaggtccagccatggcggaagggggaggtccaagccatattaattgttgaatacccttcctagaagtaatgaacaaatcactccatctctggccatattctgagggacttagagttccagtttgagaaacacatttataggagtagagtttgattcattaaatttatttttagagagagtactgattttttttccccagatcctctcaattacacttgtaatatttctgtagggtaaagattcccaagcgattaccccttgtgaaataattacatgaaacattaaaaaaaacaaaaaggaaaatattctgtagagcctcttactaaagaactaactagtctttcagctgtgtacatccgtctctccatctgtttgtctatctatttctcatatatacataacaattgaaaagtgcagattgatggatgggattttatatgtgtcaccacttcattttttaaatatgtgtctgctttaacggggaactataaaagagagtcaagaaattgccctgggggaggggaattcaatccactgcctctttttttcttatcgctaaaaccctaagcagagagtataatcacctatttcccaagggcagccctaagcccttaaaactcagctctgtttagggatttaatagaactggaaaaaagaaatgcatgggatctgcttctaggagcaaaccaacaaagaaaaattttcccaaacgatattaaatctaaagaatttttacggtaacacagtcccctctctccctccctatctcttgattcagttagagcacagctcttccagtcacttctttatgactcgtacgatcttggggggtggcgtggggtgtctgtggatcacatcttaggctctgggccagcccgagcattttttttttcaacaacagagcaagatgtaactagcataaagtgagcaaggtcatttggttgtggttgccattttatttcattcaagctgagagtagacacactcagcttcattgttaggttggagccataaagatagtgacatttttttcagttacctctaagcaccttagaatttcttctgttaagatttgctggaattttaggtgaaaatatcttggtgttatgcaacatggcttttctttttaaaaatattaaaataaaggaagtcaagttgcctttctttcccaatagatggggtcttacctttgcttaggaaatataccttaagctcccatcacacatatatacacacatgcacacacacatatgcgctttgtttttgattgttattattttggggggatggaatatcactctgtcacctaggttggagtgcagtggcacaatcttggctcactgtaacctccaccccccgggttgaagtgattctcctgccttagcctcccgagtagctgggaccacaggtgtgcgccaccacgcctggctaatttttggatttttagtagagatggggtttcacctcgttggccaggctggtctcgaactcctgacctcaggtgatccgcctgccttggcttcccaaagtgctgggattacaggtgtgaggcatcgtgtctggcctgattatttttaatatatatgaacggaagttggttacatgagtgccttgttagataaataagaatcaaagaaatacattgaagagtatgggaaagggccgggcgcagttgctcatgcctgtaatccaaacactttgggaggctgaagcaggcagatcacttgaggtcaggagttctaagaccagcctggccaacatggtgaaaccccgtctctactaaaaaataaaaaataaatgtgctggacacagtggcaggtacctgtaatctgttgaggcaggggactcacttgagtccatgaggcagaggttgccgtgagccgagattgtgccactgcactccagcctgggtaacagagcaagactctgtctcaaaaaataaataaataaaataaaagtgtatgggaaagaagatcagttttgaaggaagtttctccagaagacaagaacctgccaattacagaaactaaggaaaaactccattatattacaatgataagtctggagtgacaggagacccccattcgggtccaggctttaactaacaggatgacctcggggccagtcatccctcctttgcttctttatttccccatcagcaacccacacgggttggattccctagcattttgcttggctgcattattcttgtcgtacaggattcagctcaaatatcacctcctggagagacctgcctgtctaccctaactagagcagacacacatgactgatctccttctctcgcgaaatctcccatcatgttatcccattacagaggttttgttttcttcataatttttatcactatctgaattattttgattctttgtttatttgtgcatttcacgttgtttcctatattccgttcaatgtaagctctatgagaccaagaacctgggcagttttattcaccataagtattccaagccctagtggttcctggcacattttgtattcacaataaatatttgttaagtcaatgaccagatgaatggcttttaaactcaagatagttttttttttgttttgttatttatttatttatttatttactttgacagacttttgctcttgttgcccggctggagtgcaattgtgcgatctcggctcactgcctcagcctcccgagtagctgggattacaggggcccatcacaccatacctggctaattttttgtattttttcagtagagacggggtttcaccatgtttgccaggctggtctcgaactcctgacctcgtgatccacccgcctcggccccccaaagtgctgggattacaggcatgagccaccgcacccagcctaaactcgagatagtttttaagactttcagcaaagggatataaaagaaagaaggaagggcatgcaattggactccaaggtcttaacctcttgtttatgcatttaaaacacacacacacacatacatgcacacacacacacacacacacacacacacgctttagtgtgattaaaaatagagttccagtgctacaaccatttgaaaagtacatggactagataatctcttaaaattcttcccaggtttaaattctaaagcccagtctgccataagaggaaaatgttggtgcaaggaaaaagatgatggaatagggttacagatgttgagtgcctactacatgttgggtcttgtgttgggtccttgaaccacacaaggacagagttcttgtttaatggagtttacattttaatggggggggggcggggtagacagagagtaaacaaacaaaggaacaagagaaatttaacggtgatacaatgcacagctctttgttccttacttcatatggctaattggagattgatttgggttaattaaaagaaagcaaatctgggaaactctgtggaaggtgataaccataaacaaatttctacccacagagctagaagaggggtttctgtgcccgtggctgctccaagcctggacatctgcctgcacagtggtctttttggcccaggctgtgtgctactttggccagtctgtgtgaaatgttgattccgacatttccagggaagaaggtggtcttgtcagcatcttctgtgccttggagctattgtgatcattttgttagaaatcatcaagttttgagagttaaagagaaactgctgaaaggtacggtttgtgaaggagaatattgttcctctttatagaaacagaaaaaaaaaaatgatcagtgtcccaaggaggtacaggcataaatctaaggaagataactcgcatttgtaatggtcataataataatatatgtacatgacctacagagtcctcacagaaaccttatgctatcactgaaaaagatggagctatctgtagtttacaaatgtgaaacagacttggagaagttgagaaatggtaataatatcttacttttgaatagcaaatttgcagtttatggagtgtgttatttcattatttcagtttaaacatcatttcagtttcttctctggagtattactaccctcgtttaagagacaggtatgagaggctcaaacttgtctgtgctaactccactagtaagcatcagtctacccctggggctcctggacctatgcaggaggcacaaagctggcaaagttgaatagctaaaccccaaatgtataactaaatttgcaactagatggggacgttgaatgtcttcagctcccagacatacacccacacataatttgaagcaatgactcccctagaaagaatggcaatcatgaatggaatgaggatgtcagacacccagggcacaccaagtctagaataagagaggctgaaacaagagtcttgttttttcttatttaaatccaataatttgtaagaatacaaggcaagatgagaaaaccttttaatgtatgaaagcccacaatttggtacctgtatttcttgtgggtccagtcagccagcaagtctgaggagcgagggctacaaggtcattatgaagagaaacttgatcttgaattaaagaagtagactcttctctgccaccaagattggtctcttaactttttctccttaccattgcttatttcagaatgaatatattagatggaactttagggagagacctgaagctctttgctgagaagtgattttgaatccattcagattcaagtagggaataggttttttaagccgatgaatgttttctcattacctggagaaaatgtggggactcataatcggtgggattttgcttcaaggtgaagatgtgccttcttatttatttttgtatttccatggcctacaatagtgtcagacatctattacacaagcattccataaatgtgtgttgaactaccctgtggcaagcatgaatttttaagggacagcagttctttatatttctgtggctgaatgtattgtacaccaaatgtgaaatactgatcttcaaggcatccttttggttcaacacattaaaaaaaataacatgtattaagcgtttatcatgtttggcactcttctaagcgttttctgaatgttaacatatctttgcaattatactatgaaataggtactatcttattcccatttggcaagtgaggaaattgacaaattaggtgaaggaagatgcccaggtcatgcaaccacaagtggtggagtcagaatttgaatacagcaggatgatgccagggccaaggtttctaatcatgacttcgcacctcgtataggagcagataattacataggtattatcagactcaacttacacatggtccaggcctgaattttgaaggcaagtgcaacaagacatttgaaagccaatgacaattagaactaactgctaatctaagctgcagatgaaattcagaatgaatgtctaggggccacagattactctttgagactgttgccagtcgtctcttttctaagaggtagaaagtgcttgaacacgtagagcctatgagtgacacatgttttgactggcattccagggtagctttcagtagccacctggagggctgtgtggaggattctaaggccatacctacgcatgatgggaaagacagctgtggtggttcattgtcgacatctgccctgcaggcacagagaaggcagcatggctgaccggtttctgagatagattcttcagggttgaggaatccaaatctggagcataatccatagagattccggatgaattgttaattcccatgaaggaatgcatcaggaccagattatactgtgagtgggcctcaaatctatttatagaataagtttgggtttaaataagttaattcattgtaagtgccttgaagacagataagttccttgaagacacaaaaacctcttatctctgagcatgcagatgggtttttttttttttcagcattttgtaaagggcaatacaaactcagcttcactccctcgccaacctgcaaccagatcgttcttcctaagcacctcttacatggaaattctaaagataccattactgtggtgaatattctgagggaaattctctttggctagaaggagcaacagaaacgtacagatgtgtttaaaaaaaatggataccctaaacttacgtgatcactggaaccttctttggggaatcacatttttctataagctgccttttaaaacattttagcaagtatgtcttgagatattgtatctaagccccaccctcagcactaggaatggagtggtgaataagataagttccatggtctcttggagagtgcttttttttttttttaaaccagtagcctcttttcatgctagaacataaatgatccagcttcttgagtttgtgagttccctaaattgaatacacaactttgtgcgatggcatatatgcattttcagtgtggacgcattccacagtttcgtcagattctccaggggttccaagggcgaaagaacctgaagcctaggcctgtggagatgggaagactccactaatactaggcacactgtgattctccactctacacaacagctaactctaggacatccggcatttcctttctttgtgtgtctgttcattctagtttcaggaatctgaagagaaagcaaacgtaactttcttcatgcctaacatatttcctttacgttggacttttgttatctattttgttatctatctaggcattttcttgtttcttttttttgagacggagtctcgctccgtggcccccagggtggagtgcagtggcgcgatctcggctcactgcaagctccgccttccgggttcacgccattctcctggctcagcctccctaggagctgggaatacaggcgcccgccactacgcccggctaatattttgtatttttagtagagacggggtttcaccgtgttagccaggatggtctggatctcctgacctcgtgatccgcccgcctcccaaagtgctgggattataggaatgagccactgtgccccgcccattttcttcttttctaaaaggcagtcagtcctcagatagcagctgaactcttttcattctcttttgcagttcaggtttgagcccagtccaacaattttttgctttatttttaagtgacctcttaccattttcaggcttcctcccctctcaccttgacctctaactccaaatttatgtctccttgtcattgtggggaacttcttggagaaaaggttaaagctaagttggagctctgtctcgggcctttcatagcaacactgactcttattattagcggtgcactccaggctgctagagttcatattttggcagtagaccatcaaacaccctatttttaagagcctttaacttcgttgtaaacatgtgctgtgactgggagcttattttctttactcatatttaccaaaagcaatttagctgttgaaaagttgctataaggaaaaaaacaacaacaacaacaacaaaaaactcggccttcaggaacatttttccactcatataactcaaaactgttcatgatctttaaaaaaaattggcatttagttgtttgatggtccagtcatattggtaatttgaagggaagaagaaatggaactgctaggtcattttgctatgacaaatgtccattaaacacatgtggagggaatagtgttggccacacatattttatatgattgaccagaacagaatggctcaaagaaggcagtctagtatactgagtaaatcgttttgcccttaaaatctcctatatttagaacaaaaaccttctatagacatacttcctgcacactctaaattctgtagactctactagtcccattaggagaacaaataatatcccaaacgccaagcatcagcttgtacatgcactgatggattattgatgtctgaggaccttgaaaaagaatctacagaaatatgataaaggaaggaatatcgcaaatatgtctatttcttttgtctctggaaggaatttaagcaagtgtaacaaaacacatagtaatcttttgaagcggttgtgacttctggccttcaagcgggagctttaggaggaatttcagtgttaaaaaggagaggcttgaactttgacatctttctctcgtgatttaagattctaaaagtagtgttaggcaaattcttatattccagcacaggagaaacaccagctttccaagaggatttagcatttcttcatccctttagcaatacaagagggcaactgtgctcagaggttggctacatttgtgaagtgggaagtatagaaagatctggaagtatgttttcagggtcacgagcccagtgggcagccatatgctgtggaagtaccttggcctggaaaccctccagctaaatgatgagtgtgtctttctacacaaaccctatttgaaggcatgttgctgcagtgttgtttttacccctcaggtaaaatgttattttctaccccatatccgaggcagataagccctgaaattggccagcatgtggattccacatgttttctcccactcttccaactggatgtgctcttgaaaacattgactttcttggtccttgtcatatgatatgttttcttattgccatacttcctgctctggtttttccatttctctccatttcaagtactttcaaagacaagaatcttctggttgtagcaggcattcatttgctacaaatgctggctgtttttccaggcataagaaatacacacacaaacacacacacatctctacctcacaaactcctattcctgtcttcttatagtaataatgaattgaagactatcactgtacattaatctggaaattgacaagagaatgcctctataccagcagaagttgagtagggtaagggggagatataatacaatcaacccccaagtgggaattgtctactccactcctattagatctgctcagagatgagagtggatgttctgccagagccatttccagagtcagcaaaatgtgcttcttccctgagttgccatgagcttgagtataccagagggctagagaacaaactcaaaattatattctttagtcagctgagcagagttgctttggagctgtgatgagtagtttcatgtctaatgactcccttactccagcctcccagtgtgtcagcagacccctgactgtacttcattgcttaggtttgctgtggtggaatttgttagttgacaggtgacataatccaatcaatataacaaggagttcattccacttcattccattttcctccttgttgagttgcaaatatttcatagatatatcctaactcataaaacgcctttggtgggaaaagtatctttggagttgtgtctagtttgcatgtctcttatctttctggccagcatggcaagttcactgtagcttctgcagaatgagctggtaattctcatcagtgaatgttctctgcatgattttttgaatgagatgccactgtaggtactttgccaaattcagaaaaatctcaaccacctccttctgagagttggccttcagaatgtacggactgtggtatgctcattggcatcctagtgcttgttgcaataaaaaattatcggattatttagttttatgggttatgatatttcccctaacctagaatttaagttcctgagaaattaaactagaatcaaaattatttaatgtcagcaggaagatttttcctaaaagttcacaagaatatctcctctctcctttgggggagatgtatactcctcctccacataaccataacatcacatctgggccctattgtacctatatctgtgcataactaattcaatgagtagcaaagcaaaagagaccatagcaagacataaaaatatatcttgtgtttcaaaagcttctaggagggagaagagtttgtaaaattgagctattattttaaaattctctgatggcatgactttttgttcagaagatagtttccagttgccatgctaataacatgacaagattaattttagcagttatctattgctttgtaacaaattacttcaaaacttggcagttgaaagcagcaaacatttattatttcacacattttctaagggtcagacttttgcgaactgcttagttgggtggtactagctcaggatctctcatgagatggcattccaactactggttggggctgcagtcccctcaaagccaggttgaggatggaggatctgcttccaagttcactcccatggctgttgggagaaaatctcaattcctcactggctgttgaccggaggcctcagttccttgctgtgatggcctccgtataggctgcatgagtgttctcaagcagttagcttttccagaaacagtgatccaagagagagatcagtatagaagccacagcatttacaaccttatctcaaaagtcacacattttctcttctgccgtattctactggtcacataggccaaaccaggaacagtgtgggagaagactacacaggatatgagtaccagggagtaggcatcactgggagccatcttaaaggccatttaacacattaatgaataaacattggccaatagcccaggttaccatgtcctcttctgtgttgttaattaaggaaggttataccactgaatattttaaaatttgaccattaattaatttcataggtattcaatgaatgtcccctatatactgaggacagctattttaagtccttaggatatatcagggaacaaaacaaagatcctcaccctcctgagtgttacattctgttttacattctgcttttcatatagcaaatctcacaggtcagtgggcccatgtaattaggataagtacaaggacatcaaaccgttgtttcagactgagtatgccttgaccagacttagcaggaaataggggtatctgttttctttatctgccacaataagggtttttttgttttgttttgtttttagaaaaatgtagcaacaatataaactctctagtgattgcattcttctattagttaactctcttaaatgatcacttctctgtctttgatagctaaagtgaggaagtaaagtatattaacttaagaaataaggtttggggtccgatcatatcggattttagtcataagtctcttgcttacttcttcctgtgttaccttgggcatgttgcttgactcatctgagcctcagttttgtcatctcatctctaaaatggtgataatagtggcacctttcttggagatgtaaccaacaaatgacctaaagcatttattacaggatctggtacatagacactgctcagttttatctgccctttctttattctaaccacatctgtgtactgactcattgccaaaagttgctatcagaaatgacctcctagttcaacccaaaatatccaagatattaagaggcctagtaacctctaaagcaactctcacttgccagttgtgactgccacttgcatatgtactgagtgggaagaataactctggattcacagcttgtgttaaagtcttgatttgtcctcaggagtttaccatttagatacgtaaaagcactttcaatagccacctgatgttttcctactcaggctgttcctgttgaatatgctctgcaaataagtcatctgtcagcaaaggaacctggagaagaaagacgcaggtgccctggggtttctgtctccttctgtcagtcttggcacctgagctaggaagcagctgatttttcttagcccagcactgaccaaggagctgctccctgccacagaagttcttgcctttccaaagctgggcagcctgcagccctattttcagttcctcttgtcattttctttcctggagtgaccattagagaaactggcagtaagagggaagggacactagtaacttccagcctcagaaagaatataacaattcagtaggttggtatgttttggtaaagggaggcacagtataattcttgaagacatctggtatttgaaaatttgtgcatctcacataccctcataatttcccgggcctctactgggaatgaaatgtgtggctcttttggagacacaggcttttaggaaactctcaagtcttggaagtttttgaaatcatcttggcttaagcattttaggcatttttggaggtcggatatgaaatgtattttttagctttgaagacactgaagcatagacgttttaaagctatctatgcttccaggtggcttctgggtgccttgagaggcaccaatgtatagatttgcaaaggtgcatctttccttctgtggaagctctgttggcttcatgtgtgacccagatggaacaatttactccttccacaggcaccatttcagtgaatgcaagcaggaacaggacaccgaggaacatctgtggaatgcaggcctgaagctgaaggacgagtaaaaccagagggcttggcaagataatgagcgccaagacactgagtgcttaactcttaaataaagtgtccaccagagtggggagggggcttggccccaacagcagaggaggagtccaactatctgctcttctatgtgccattggatcatttgctcagttccatcttcaaagcatagcttgaatcccctgtctgggcaccactttggcccagttcaggatcccctctcccctcgactgctgcaatggcatcttctttctagtattgtccatactgagtacagcaacaaaagttaacacctttcaacatacaattgtttacatcctacccctgcttaaaactcttaagtagcctcctgttgcacttagaataaaatccaggccccttacgcaagcctgtaggtcctgctcatgctgctgcctgcctcgcttttcaagccacctttgcttactacacagaagttgtgtgtggatcatttaattctccaaatgagcccagatctttctccccagagggccttttattatgttatttctccaactcatcacctggctgcctcccacttaatttttagatctcaacatgaatggtagccttattgaacatccctcctaaagagattactcttctgttattctgtatcttagccccttctttgttttatttatagcatttgttacaacctgcattttctgtgtttatttatgtattggttcccattctggtctatcactccctttagagtagaaactccattttattgcctttttcatttgtgtatctgcagtacccaccagagtgcttgggtatactggttgcttcttgaatgggcaagcaagtaccctgacttattctattccagaagatagggtataaaggaacagcaggaataggtgcttctgttttccctaacaaatccatccctctagaatattaagtggaaggatattacaagagtatgcaacaagtgacccacttacccagattgaaactcaaggaactgaaccagagatcccctcattctgtttttcagaaaagtcacaggcttacatattgctgaatgatggcaaggctatgtccacatgatagaaaaactgtatatcccagttgactggtgcttttggctaccttaatggcttcagtctacctgccgatctgaccattgggaaaaaattagttgtgaagttgcattatgtaaaactgaagcttgtgtagtcaagaccagggtttccctatagttcctcacagccagctcctctgtgcagggactggatgcatagcctggctcagagaggatggtaggaggctttgagccaagtatcctcagggacaactagattgctctcttctctgttgggccttctgggtaccacgcatgatgagattgagtcattctgacctgtcagagtgggtgagtgaatgctatatgaagataaaccaagaccattagaaccctttgaatccagaggcacaaaaatgtaaaaagctctatgaaaaaaacaggagtctggaaactgttaacaagatcctaggactagtttaaattttaaagtgtgaaagagatagcattggaataaataaaatgtacttctactttatacggtaagtggagataagcatataggaaaatcagcccaagaggtagtagcttgaatgaaaatataagtatgaaataaattagatacaatataaatatattttacaggaaaccaaaatggattatttagggaatgtttagagttatcatttccagcctttaaggttaacaagaggacaactatgtccttccacaaattatccattggcaccgttttgtcctcattttttcaataccattccccaccttccatctacattaggaccatgaattgggatcagacattgtcaagtatcccctggaaggcaaaatatgtctgatggagaacctcctctttaatatactctttagaactaaggaaaacagcccaggttgttgaaatcagattaggaaactcatactatctatctcagaagctttctagtgcctactgtaactaaatggaacctctagggttggcactttgttgtttggagtaggacaaatgtttggccttttaaattgtggagtaagaatacaattcctcactggtggctgcaacaccagcttcccgttcagaatgctgactttgtctgtcctctggcctagagtctggattgcagggggctgggatggagccatgcctgcccctgccactcccataactacttcccctctggacccatttgaaggaaggctgtttctgtgccaaacatttatattgggtacaaaatgagtctatattatcttctagacagaataatggaacagtagttgactcagggctagaatttgggaggcatcttggaaaaggggaaaaaaagttaagctgcctattttcccgtttccctgtgttttaggttatcttagcagaaggagttgaaacaaagagaaggaggtggcaatgccaccgtgtaaaatgcttattatacctcttagatacgtgcagcactggtcaccaacccacaggaaggatgttgttattgtctgggagtgggtgaggcctcatgaaaaatatctgtggtatgaggaaatgttaaacaagctggtcttgttcttactaggaaagaggggatatcaagaggacttaaaatgattccaaactaccactcagagttaaaggtgttgtctttgaaataatccaaaaagaccatctgtagcaggccctagcaggccacaggtttataaacagcagctggctggcctagctcagggggcacaggccaagaggccacctgtgactcttgtcccgttttggtattggttttctgtctttaaatcacatcacccagggctcaagttaagcaaaatcttctctgcagaactagccttaggagaccttagaaagttccctttcttgaaaaatgctacttcagtttgcctgaaattttttcctttcctttttcatatccctgccctctcccaaagaccctatggggagaagaagacaaacaaatttagaaagcagaaacaccagatgaattactgtgctcctactcaagctacttcacgggatgtatcagggtacttaaatcacctgattcacctggcatcagaaccacctggagtgcttgataaactgcagattctagggtcttatttcaaatgtcgaaaaatccaaatttctgctgtaaaaccctaatatctgcatttttaatcaagtatgaggaccttcatgaggatgggtatatttgtctttttattcacaaatgtatcccaaaacactagatcacttcctaaaaacaccttaaaaatatatggttctctgtaaatatttattgatgagtgaacaaaccaaagccttgtaggattggcttagtaggatttgtttttgtttcttttactaaattatagcagaaaacagtgacaggaaagaggagtctttaatgggagaaaggcaggctataaagaggaaggaaaaagtcagtttgaagaatggggcaattttggggaggctgggcgaggtggggaacaataatgaagactgtgtgaccaagaacaagtggtgggatttggcatggtgggaaaggagtgtgaaaaaagggaaatgcaatgaggcagtggctagagcaaaggttccgaaattccagtgagcctcagaatggcccggagagctgcttacattgcaccttggcgtccaccccagttctgagatggggatgaaggatttgcatttctaacagctgctcaggtggatgccgatgcctcgggatttgtgaacctcttagagttagactattggtctcagaagttagatagatcaggttgtgagccccagctctaccccttgctaattgtgggatcttagcaatctatttaacctccgcacctcagtttccttcacatgtgcaagagggataatgacgattagatggttgtgagactgagttgatgcacataaaatacttagcatagtagccagcacattcaagtactcactatcttaaagattattattttgtctggcgctaacactgcactttttggggaaagtagaaaatatagttgtcttcccaatgaaagagaacatattgcttcctataactagcataacatttaataaagagatggactagttcagattccaatacaactaagctatttatttctgtgtcacagtacagttcctaactaactgaaattagttcctgataagaaactaaagctatttttcacaacaggtaagtcgatggcctgcctggagatagacggtgtgatggctgcacagcaatgtgaatgtgcttaatgccacagacttgtacacttacaaatgattaaaatggtaaattttatgtaatgaatgttccaccacaataaaaaaaaatagtggatagcctgaatattactttctgtgctctgcctcatacttcctagagggaaattcagtttagcatattgtcaaacaactattgttcaaatttgcttacttaaagagtgactaaatttcaaaacatacattgtacatctcctgggatgagctctcggggcttcctactgtccattcagactcagatgaatccattgtaatgatgaatccaatgatattttcagttccctaatgttgaattacaatcacttctcacacacaaaagcccacctatctggattctcattgggtgattaaagaagaaaatgccctttaggacttggcctgagacagcctgttttggctttggagttttcctttgtgagatgataaacttgattgagaaaggcagggcatttgctcattctttttttttttttttttttttttttgagatagagtcttgctctgtcgcccaggctggagtgcaggtggcacaatctcagctcactacaacctccacctcctgggttcaaatgattctcccacttcagtctcccaagtagctgagattacaggcccctgctatcatgcccggttaatttttgtgtttttgtagagacagggtttcaccatgttggccaggctggttttgaacctgcctcggcctcccaaagtgctgggattacaggtgtgagccaccaagcctggccggtgtttgctcattctagctacatagatctttatcagtggctatagctttattattgttacatgctacactggcaaagaaggatatctttgctcttagaatcaaatagtacacaccattggaaaaaagccttcctcatcaaagtcacaaaaaggatcttgaaaaaattatttagaaaagcaaatgtagacaacttttgattgcctaactctcagtgaaacttaaccatcatagaggtattctccctattataacaaagttagattccaaaagcttgtaagtaagctgtgtataacttggacatatgttttcctatagcaccatttctgcatgtaagactgtgtttcgaacctcagcttggagcttggacaatcaagaagaggtgtctttgctggcctcagctatgagaatcctatctaggtaccgccatctctagctatctgtagcaccaaccctctgctactactgctgccttctcccgtgggatgaatgtggtgaattgtgcattcatatttcaggaatgattaacattcaaggttggagatattccagaatcacaatttgattttataagatgctttgcagaaatatcttagataatctaaggattcctaatggcttatacaaaagaactaaagtgagtgtgactatccagcttcttctatttcttcctactctttcacttcttttgttcccttcatgattctgctgcatgccaggaatggactcacatgacttctcaaactcctagccaatgtaaacatagtgaaacataataaagtggtaaaaagctatctggacctagatttgagtctaagccctgtcttttcttgtgaacatttgaacaaattccctcacctctctgagttacaatgtccttatgtatgaaatggggtgataactaataaagagctattgtgagagttaaatgagatgatacatgtaaagtacttagcttggtgcctagacatagttgggactccttagatgttagccattgaacacatttcttgggctatttattgccacttttctggtatatggttaacatattcacctacatttgcataaatgatattgtaaaatatgccttagaagagtcccatgcattcacatagcagattatagcttataaagaaatttctcattttatttttacaacactggacgcagaagagttgaccatattttccctttttacacctggggagactgaggctcagagaggcacagtgacttaatttgaattgacttgcgtgaagagtcaaaccagcagactctttagtccagtgcttcttattatatatgagaaagcatgttataaattactgacaccacagtattgccaacctaaggactaggaagaaagggcttacatgtttcttgctttaataatatgtgaattagaaaaggtattcaagaagatacagggttagaatgtgtatctttcttttatgtactgaaatgtttcaactcatatgcagcaatgtggtaacttgaaagatgattccagagatttcatgcttctggcagtttcaggtcacattggggtgaaatttgacatactgtagtcatccccaaggtaataatgttgatgaaatggtataaaccctgatacattcttaagcaaaatgaatctaaaagtttgtttcaaaatttttaacgttttatgttgctctgactttccatatactgatttttacattacttagtgaaaaaaaaaataacctttagcttctgacaacaaaaacattttagctatttttttatagtaggcttctttgcatatcagttctcagtttatgtatagaagaatttccttttcacgtaatcacagtataaactgatttcttggctccaaatatgatgatagttttttaaaagagcaagaagcaagtatgctccctatatgtcatcatatacattttggaaacttcagagtcttaaaaatcattctgaccaggtgtggtggctcacacctgtaatccaatcacttctgaaggccaaagctggtagactgcttgagtccaggagtttaagaccggcctagtcaacatggcaaaaacccatctctacaaaaaaaaatgtataaattagctgggcgtggtggcatgttatctgtagttccagctacgtgggaggctgaggtgggaggaatacctgagcctggagaggtcgggacctcagtaagccgtgactgcaccactgcactccagcctaggtggcagagtgagaccctgtctcagaaaaaaaaaaaaaaaaattgttcctttgggaggtggaatatcacagtagtcaataccttgggcactagaatccaagctctaccatttattaactgagcaaattgagggaaattatttaattctaaggctttaattccaccatctatgaaatggtgatgtagcaaaacctgcctaacagggatggtggcaagattaagggagagtgagcaggtagttactgtgctcagtgttagatactatcttcatcatcgtcatccatgatgatcttagcaatcctgctactgggttgaatgaagttctctgtacagattccatggctgtaggtaagaatgaattactcataattgtgagcagaataatgtgtggtaaacaaattatgcagttattcgaatccttctactaaatcacaactatagggttaaactaaagggcagttttgaaactgacctctgggtgtgaatgcattgtcaagcacttcatactaaaacacaatggcattccaaatcccagtatgatgctagacacaatggattactcatttcagtgggagtacattctctccaaaaacccaaaaacattcacccagaactttcaagacaaaagacattgccagctaacaccagcaagggcacttagttttcttcctttctctatcttttacttctctgttttgctgaacttaactaatgagttattttcattttattgtattgtattttatgccatgaattatttgtttatgctgcagcatttttacatttggacaagagtacacagagcagaaagtatatagcacatgtatggttcactgtgtatagataaatgaagcattcattcattcaataaatatttgctcagtatccattgtgtgtaagacatgaggttagctacatggtccccagcttcaaggtctttacattctaataggaagacatataagaaacaagcaaacaaactaaaaaatatacattattatagctagtcattttttataaagcacaagtttctttaaatttaagctgaaacataaagaagtaggaagtagccatggatgtaatttttgggaagtgtattctgagatgttagagcaactctgatgcaaagtaccatttgtttatttagcttaatattttatgtctaaagtaggtttcttactgataaaaattgcaacataattagattttgggtatgggaaatgattggataataaagaataaaacataatcaggtatgcagtaagtgaaaagttgatgtcagaatttccagtaatactgtaattatgtaaattgtcactaaaatggattttgagggttagtacttaaatacacagagtcttgaatgacacagcagtcacccatatgtatgttagagatgcttcagttatatttcagaattctactattgtttagtaaatcactggatttttttttcctccttgtggtttaggatagcattgaaatatcttggtataattacttccatactttgtcattagtattttatattctttattacatggactaatgccccaccaccactgccccccaaattttagctatgctgaaatgaaactccctctgaaattttgatttctgaggtcgggtgatcccaaatgtaaactataacactgtgtaaggcctgagtctagaattgtaaagaagccagaatcttccatgagcatgcgcagggctttaccataattccagagtagaacaatcagcattcaaaaccacatgaagccaggactctcttccaccctcctcttcctttcccctataaaatgatatccacccatgagtcataggccattcattcccttgggttcactattagttctgttcctgaactctcatgggccatcaaatgaaaataaaattaatacacacgaagagattatcattttaggggatttgtgggagcccagacactttttatgagaagagactggcacccctaaggatgttatttgaatctgaaaagaagcggtcataaaggaagtggtgctgctttaatctgctgtacggagctgccaccctgctcttactgctaggcagccttcccatatgagcagaatgatcattcccttggagaaagcagctgaggtttgaaagccgttccaattttgcagtttcaggaatgtgtcggagttgcagctttaagatggcatttccccctccccagctgctgtcgagagtgcctgggctagatgtgaatgggagttttgtatgaagattgtgagtgagccagagccactgggtaatcagggcagcaaggcacattaaggaatatactttaagggatatatttaaggaatatacttttcatacagcctctcactcttcctttacagtaaaagcataagtaaaacttccctatgctcctgtacttatcctgcttttggtctgactttaagctcagcactgaaggcaacttgatctccgttgctatctcctttcatagatgataatgagcacagttctaagaggctggctgcaatgatatcctttgctgttagaaaaggaaagcgggagcagggattggagtgattgtttgctgtgttggtgactgtgatgttgccatgggaaagctcaagacttcaggagagtttgtattttgttgggcgaggtgccaaactgttgtgacttattacagccgtgtgagtgagctgtacagaacagtatcctgtgtagcaattcaaagggcaggatcactttaatcagggaaagatagagtgctgagtattcacattacgctttatttcaacttggaaatgataaacaaacctaacattttggtagtctctgggtttgctcttttaactttggagaaaaaaaagaatcaattcctcgtgctcactccaactgaaaagcaaaacaaaaatgtttctgctttacatataaagaccccttgtaacgaatggtgtgctctcaagtaaccactccacccgcaaatgctagttcatcttgactcagcctcaaggaaagaaaaaattcacaggccaagttgatttggtgtgaaaaaaatagtgtaagtttgggaaggtttcttttcaatttagactgaggacattcctctgcctcacttacctgggaaagtcagcctttttacccctagtattggcaaaatacatggcccagtctagatgttcagtcgttgtctaactatgctgaaggcaaggagttttctttgaggttttatgaaaaattaatacatagatccacataaaggaaaattctggagcttggagaactgttttgacctttcaagtcacaaagggagctaggttcagtcccctttttgcagtagtcaacacagccctaattctttagggagatgccaagcctccatatcattttgtgctgtgtagacattgcctagaagttcccttggagccaagtcttttgaagctttttgatccattccagggaactcttggaagaggagagaagagcttcacaatttccatttttagcctaaaacagatgtcaacatgttaactcttcttcatttgatattgtgggcctgggctcgtgcagtgatcaaaggcacaactgaagtgcacaactgaagtgctccatattttcagaatatatgtttattgagagacttgtagaaaactatatatgtatatgttatgtatataattatatatacataatttgatactcaaggcagctatgacgtcttgcagcataacaagaagaaaggtatgtttcttattgtgagatattaaagtttcatatgatacattttaaatgttcattttctaggagcatttcactttgtcttttaaaaacacttttcagaatgtttatacttgtgtttgttgctttgtagttttatttggttgccaggttagctatttattttcacccagtttaacctctgagggacatattttgcatagagacagatgtttttatctgccttaatttccagttaccgtacttctaagttctagtaacattcagaatagttcatcatagaagttgtggaaactttttctaacatagaaaaaattccctttgtgtattagatgacttgaatagtaacttacagatatctagacatttgggaatcagagaattgatgagactttctttttgccaaagttttttcatatagtacagtttcacatgtattttaatatagaatacatcctgtctcattattattattcaaatagactttattttttagagcagtgtatgttcacaagaaaattgagtggaaaatacaaagagttcccagatactcccagttccctatccatgcatagtcacccccattatcaccatcctccaccagagtggtatgtttgttgcaattagtggacctacattgacacaccactatcacccaaggtctgtagttgacattaggattcactcttggtgttgtattctgtgggctctgataaatatataataatgtacatctttcattatattatcatagagtattttactgctctaaaaatcctctgtgctctgcctgtttatccttccctctcccttaactgcaggcaactactgatctttttactgtttccatattattttaaaatgtaatagctttaattttaaaatattacactaaaatgtgaaagttactgaaaaatggattaaagtgtatatattttttggcctcagaactcagtttttgcattgagaagttgttataaatggtgcatctctaattccttttccttaagtgagaatttattgacctaataataatatttcagaatgttattctcagtcaagagaattgtatctttataggacttcggaatttttcaatagtggttgagtcaggagcttctcaaatagaagaaacataaacagcataacatagcataaacacatttagttgtttttatttttttctttaaggtccctttatcctgaatcacagtggtgtaacatcattgtgatttgggctatgtttctggagcactttatgcagttagctgtctctgtatctcctctgcctgctgcaagaagagtttatatgaatacattcattacttgcagatgtacaaaaagttaccgaggaaattaggactaataggaagcattcattctgtttgaagtagatgccatgaaatgtaataggatggtcttctagataaagaaaaacctgggtgccactctcaggatacagtattggctggatcgggggaccatctctctccttggttgaatccacattaaccaatgtctcccaacttatgttttaactgtcactgtacttccaaactggcctctcatcccataatctatcctctatcatttgccagttaaattcctaaaaatgcaactctttttgtctcaagtctccacttaaaatctttaaatggcaccccaaattccaagcttcctcatcaacccttttgtggatctcagtgtcagaaggagtttaggctctttcctggaaacatgactatgataggagtcagcctgacttcttattctaaggggtgagagagtgaaccaggcctcagcagtagaatcagtgtcccctcctcagaatctgtacactgtgataagagaggcttgaaactgacttgcaagaagtagggctgaagcagctttcacagatttaacgggagactggaatgagcagattctgtgatgatcaaagatcaaacggtgctgaattcgagaaggaggtacagacattaatggataaagattgagggccactctggatcctggcacccacttccttgctcatagtaattgtgcactacatatttggtgacaagattagctggcccacagcagcagttctcagattatattttttctttttgttttctcagacattctggagagaggataagggggatagggaatgtgtcagctctggcagccttgggtgaggccaggatttatacagaagtaccccagccttttgtgggcgccaggtgtagcttgggcagcatgcctgacctgctgcccacttgtgccccttaagaactcattttcttaaatctgttcttgctggacactcattgtgtgtcttgtattcagcctatcttattcacaggccagtgacctagtcactattgctaagatataattttggcattgaaacagctcaaaggaggaaaggaaaatagacctctttactttcttttattataaaaaatttatatgggccacactgggatttttagaagggctgtgtttgtagttttttgtatatggtttcagtatatacttacctcagaactcacagaataatggttcctatactcttactctatggcacattccatgaggaaaattgttatatatagataactataattctagaaagattaccaaaggaaacagcacatcagttgtactttgagattacataatatcttaacattggagcaatttttatattggtaaattatacttccataaagttaacaaatacaccactgtttgaggaaatgattcagagtgccagagtagggagttttatctctcctgttgaatgtgtgagtcatgtgctgcacttttttgagcaaagtatagagaacattggcagcagaatattaaaactacatgatggtcaatgttgactgaaggcttaatacaaatgagcccgtgaatgtattataaattgtcagggccattttataaagcattttggcaatatctttcaggagctgtactaatatctgtgccctttgactcaataatttcacttcttggaatctctcagaggaaagaatccaaaataaagtgatatgcatgaaaataatcataatcgctgtagggttaaataatagtagcccttgaaatgatccatgtgttcaacaggaacagaattaaatgagttttacctatgtaaaaatatgattatgaaaaacctggagcgtagtacatctgaattacaatagatgtgctaagatggtatgtgtcggtgtgtattctttggttgcaagcaccaggcatgagttttggtgaatttaatcaagagagtaattcgttacaagaacttggggtttctgtgcaacccaagaaaagtctgaaaataaccaaatttagaaaatgtaaggaatcagggggtttcaagactctagatagcaagaagtggaaaatcctgtctccagggaacctcctcaggggagaatcagctccagctggtttatatccaagtgccattctccccaacctccaggagtgagagtttctttagtatgtcttggatcctatgcccactttgtgaccagggcaagagggcaccttgattgacagccccacccagaccacatgcagaaggaggggtggctcccttgggaattagggtgatactgcacacagagaagaatggatgctgagtgagccagaacaacagatgaaagtacataacaggatttcttggtcttctctttataatttaaactttcttatgcctttataatcaatgaattttaatcaacaaaatttgtgtcttagaaagtcagtatggatagagatagaaacattcttctttatattactgccacagacaacactgattatgtgatggcatagcatgaaaacaaatatgtgtctttaacactaaattaagcagaaatattttaataatgaacagaaatacctgatagaaataatgataatgaatggaaagaactgatagggcttttgtaaggattgaatagggtggcatgagactgtattttgcacaatgcctagcacacacacaaaaagtgcttattaagccaaaataagaactaagaaatataagagaataaggtcgcaatagctcttcaatgttaatcttgtagccaaaatgcaactggtaagttctacatattggcaggtaatactaattataaaacgtgtgaattatggttcaatttaggctttctttgccagtactattaatttgtataagtaaaagtgtcagcacttgaatggattatctgagtgtgagcccaagaagcacaattcataaagtggctgattaattttctctcctttggatttattaatatgccttcaaccatggcatatatattttaaattaatttagaacagttccaagatgtatcacataagataggaatcagtatgtataaactctagtgaagagccctgagatatatatttgtgcatatcaattagtcatggccatctacagggtaacaagagggtcattctgcttctaacacatatccatgtggcatgaccagggtctgtatgtgggacggctctgctctagaatctaaccattggcctggcctacgcagtggagaggagttggtggttactgacaggtgggctgggactaggatgaggcaagccaggtacttagggtgtagcatgtaaggaggccctcattctccagttgtacgctcattgaatatgagcatcttcttaattctgtaccccatgtgcctcatttgtcccagtcctggtgacagaaaaactgggctaaaatgcagattcagaatttttactttctaggaaaaagaaatcaacttttgactggtgtatttctctgtgtatgtgggtgtatgtgtatatgtataatttttgcccaacagatgtaagaatacatgggtcctaacaatacatgagacccttgggcgattgttaaaatcctttctaccaacggacttatccaaaccataaggctagttataatgaaaactaatgaacagttattgagtgtttattgtgggccaagagtggagcttagcattttacatttcatcctcaaaattgtctgatgaggtaactatttattctcattgtacagaaaaggaaactgaggcataggattttagataatgtgaccaagattccggagtcaatagccaatccaggacctaattccaaagtttgtgcttttaatacaactctatggtaccaccatcctggcctttacctggttatcctcagctccgcttcctctcctgctcattgtccgaagcctctgggttcatgaatcctccctgaggatgtcatgcgatacagggatcctccctttcttccaatagcttatcttccttttgctgatttctcttccagtgctttccattgtgcacactgaaaactcttttccattgtaaataaacttccccacactctctgacatcagacagtgtgctgcctttacctccaggccttcaggaaatctgcttctcccctaagaacatttctctccttttactcctgtcaggtaaagatggagaagtctagggtacctcaaaacagagttaggaagaggtatcagcattatcctagttccaaactgcttctcccaagctctccctcctcctttgcaatgggcaccgatcagttttattgcctttaacatgttttgtcgtagctgtctgctatattcaggtcacttccaggctctgacagcttgccaaggcttctcatcttcccaactcctgccatcatcctggcagatttcaatattcctgaaagaaagacttcaacactccggctatttctttcatgacatcccagtttcattagcattcacataagctccactgagaactaattcccatggccttacctttgaccttttcatcaactccaactgtctacctatgagagctcaaactcaagtatcacacaccctcttatcctcttccaccctcccaatttccttactctctctgagcctcctgttcttttcttattaaaacctctattatctccactgtttgttattctccctacctcctcttaactttggttcctgctttcccaaaactaaacttcatggttggcagtgaaattaaacttaccaacactttcagttcctggacttccttatcccttttccccattgttttggttttgattccccagaagtggactttgaggatttcagtacgggtagtcagctcaggaggcgattctgggaagtacatataaagtcatggggaattgagacagcaaaggggaggaagctactgcagggtgtgctaagcagcagggcacttctgtgggcaagggctggatctgcctctgagcgtttggacaactgtaaggaggagcacgtctcaaagtggtcctccctccagaggcaccggagctagggtgttcatccaccaacattcatgggtcactggctgtgggctgctcccaggggaacttcttccttaagagcttctcacctcccttttgtctgagggcgaggcctgctcacacagctagagaaaaaccctgaggtggagagtctcagctgctccagtgaagaaactgtcagcatgcacaggaaaggtgagtgtctgggaggtctgggagggcaccggcagcctctgcgacttcatccaccaggcaaacctctcagtcctggattaatcctaagagctgccttctgcttgccaactgtattgttgtgctgttatgaatatatggtttccaatcttggcaggacccataaatgacattttatgatgttttaacttgtgcctctctttcattttccttagtacttatgattagtgtcagacagactgaattcacactcagcctctaccactttgtgaatttgggcagatactgaacccctctctaaaccacatttccctcttctgtaaaaatcagcacattaataccaacttggctttgtgttacaaactgtttggtgaaattttatatatatatatatatatatttttttttttttttttgagatggactctcgctctgttgcccaggctggagtgcagtggcacaatctcagctcactgcaagctccacctcccgggttcacgccattctcctgcctcagcctcccgagtagctgggactacaggcgcccgccaccacgctcagctaatttttttttgtatttttagtagagacggggtttcactgtgttagccaggatggtctcgatctcctgacctcgtgatccaccctcctcagcctcccaaagtgctaggattacaggcctgagccactgcgcccggcctagaaatttatatatatatatataatattatgtatttaatatatatatatttatacacacatacacacatatacatagaaaaatgtatataatacatattgtgtatatagtgtaggtatagatatgcaacctagcacaatgcctaacgcagagcagaactcattacctctttgtttgcttggttatcttctcttatataacccagcactcttagcaaatggccttgtctcatgtacctcacaaagaaaactccacaactcaactcctaccaacagagaatacctacacctatgtttacatttcctgagtctcagaggaaaggatgttcttcttctggttcaaggctaaccttcaacttagctcatttctacttctccaggaattcacatcactggttaccagcatcctccaccaaacctcagccattccatcctcactgtttctctgcaaagaactttcttgcatgattataatcacttagcacatatgcatttcatttttactttaacctaatcagaacataagcatgctgtttgcaatagaagatatccttaccgtggatagctgcaaagatggatgtcactgttgcagaaaagctatgctgctttcaatgtggtcatgcagacttgggaagaaaaaactaaaatatttatatttcctaagtatagtgaatttctgggaaattggggggaatgaagtgggagatgataggatataaatgataggtacaaggtaagggttagcaaggggggtaggtgcagaacttattttgatcctgatttcaactattcaactctaataaaacaatttttgaggtggcctggtaaatttgaattggctgtgttttacaggataccaagggattattaaatttttaagtataatagtgacattttggttatataaagaaaatatttttagagatgcatactaagtaattaggagtgaaattatggccgggatttgctttaaaatactttggcagcaagaacaatgtagggaataaatcaagtgtgacaaaatcttgccaatttttgaatctagttgatgggtatatgggggattattttaccattctctttaatttatgtatgtttgaaattcttcatactaatcttttttgaagagaaatggtcagaaatatatctctacgtttgctgtttttttgtttttgtttttgagatggagtctcgttctgttgcccaggctccaggctatagtgcagtggcgtgatctcggctcactataacctccacctcctgggatcaagctgttctcctgcctcagcctcctgagtggctgggaatacaggcatgcaccaccacacccagctaatttttgtatttttagtagagacggggtttcaccatgttggccaagctggtctcaaactcctgacctcaagtgatccgcctgccttggtttcccaaagtgctgggattataggcataagccactatgtctggccttatgttctctgttttaattaaagtctcaaatatttaaaactttaaatggaaaacttttgaattaattaaattttaaatgcaaaattgtaaatgaagatgtctttgaaacctcactccggaattttcatttcctctgtctccccatcatcagctggggtcccagcccagctgcagcctttcccaagctgaagtggtcattgaggtcaatgatgctcttaagccaaacatggctgacagtacctatgatgtgcacaggtgggtggacaagactcattacttttagttacagaagagcctgacaaagttggctgggcaccacagtaaggattcaattcacatgataattctacaggagactaaatgactgagcaaacagagcatttgtcctcttttgcctgtgtttcttcatctgtgaagtggatatgacattgtttttccttatcattcaaggtccaattcagatatctaggatactttcttggcccccaacccaaagaactctttttccctttgcctgttaagatgcaatacaattaggaagacttctaatgcaaatcctgtgttctttaaacattacttggaatttaacagtagaatttttctctctgcttcttatttatttatttatttatttaattttattttttggagatggagttttgcttttgttgcccaggctggagtgcagtggcacaatctcagctcactgcgatctccacctcccaggttcaagcaattctcctgcctcagcctccccagtagctgggattacaggcatgcaccaccacacccagctaattttttgtatttttaatagagacagagtttcaccatgttggtcaggctggtctcgaactcctagcctcggatccgctcgcctctgcctcccaaagtgctgggattataggtgtgagccaccgtgctcggcctcccttcttatttttattcttgttttatacttcactgtgaacttttcctctggaatttaggcactttagggtagtattttttcaacttgtattccatgacccattatttgctcacaaaatcaaatttgtcagttgtacctaacattttttaaaaaagaaataagctgagtatgatggtgtgtgcctgtagtccctgctacttggaggctgaagcaggtggattgcttgagcccaggagttcaaggccagcctgggaaatgtagcaaggcctcatctctaaaaaatttaaaaagaaaagaaaatgtactttaaaaaatgaaatagaatgagaaagaaaatgtactgcatacagtaggagttttatttgctgaaacattagtttcgtgtgtgtgtgtgtgtgtgtgtgtgtgtgtgtgtgtgtgtgtttactgttctgatgtgaaatggatttcttgttgtgggttacaggaagaaagttttacatccacagttttagggtgtatgaagcctataaaaagaaggttgtggatgaatgattatgaatttactttaatatgaatatggaagctacttctttattgtttatttttaacactaccatcaggtactactatggtacatgtatgttcatatacatttatgttcatgcaagtgtgtgtgtgtgtgtgtgtgtgtgtgtgttacagcagcagagcagtagtaatttgattgaaccacaatgtagtttaatactcagttgggattttatcaaataacatggctacatatttaaattactattgtgcctccagggtaagtaataacatagccttctgagggtcttgggatgaaacattccagatgataggcatttcgtcctcatagcttacatttgaagagaactcttaggccttcagcagagtaccttagcgtgcgtcaacttctgtttatagttcatctcatttaggcgtgtaagaagtggttttaaatgcacttggtgtgaatctgggcttacaaattaatttgaaaaatgctagttcattcctatgtttctaaatatagaaaagcattttaatcctgactgtctgtttttattgaaagtttatttgcctgtggttttttttaattactcttcaaagctcccttaagataccagtgtttccagaaaaactctgaccattgcaaaagtgaattagtaatagaaattaaatgtgcatatttcagagttaatttcaaactaaatgagactttcattcacctggtgttacctcagtgttgatgttgtctgactaaagtttagcagaggcaagatcatttgaaaatgtgcttctatacctgggagaaattcctaaatatgcctttatgttgatgctgtggtcattttaccaaagtcaatgttactggccaaagagaacaaaattaatttgtattcaaataccttacttcctagtaaattttcttgatggctacatgcatggaaccttggaatcagacagcctgggtcccccaatcccatgctgccacttagcagcttggtgacagagggcaattttcttagcctccctgagcctcattttactcatttgtaaaatgagaataataatcatgcttattttatagtgttgataaattgggacagtgtagaggattaagcatggtccctagcataagtgttcaataaatgttacctctttgtttattccaaaggtgattctgttcttatcaaaattatatgggaattataaggggtaagaattcgttacatgtgaaatatttgtttactataccactaacagtgagcctcttgagaatagtgatctctgctgtctctttcctttggaacttcctgcagtccttgtaacaattcatacagaagctgcttgtagcaagatgtcaatcatttagctacaactggtgaaaatgcgcaaattttcacaaaatggttatctgtttctttttcttctaccccaaggtcaccatgtggtcttggttttatgggcgactacatctttagaactaattgatgatgtgcattttttacaaaatcagtaattttttttttttttacaatgggttacctttgacatgagaacattcttgtttctaaaggagagaaaattcacaatcccagctgtttgtaatgtgtttctggagccagcattgtttgcaaaaggaaaatatttaagcttggcatttgtctaagtttcctttatgatgtacttattttttaggggacagaactgctttggggcaaagataattaagaacgaacatatcagtcttttgaagaacggtttaaaaataaaacctaactaatgctgaaaataatacttaaaattcattggcctctctccagaataatttctgtactttgggcattcagcatttattttccaactgcaattgaatagtcagctctggcctgaacagccaaggttaaataaagggctaagaattatttaaccaatcactagactattagactctggatgtttgggccatttagaattcgctggctctttctagagttttcttccctgcctctctgctacatgtataaaatcttcagtctttcagtctttatgtgaaacgttgaccaatctctccagcctctgtgagtctgtttcactttaacttcctcagattgggctaccacatgaaaatggcatagtatcaaaatgattattgttctgcatactgtttccgtgggctgtttggctgtgtctcattttttcagcctgacatttttgagggtccctactgctggagtcttcaagattgatattttgctgttgttactgttgctatttccttttagtttgctgtgcttcaaactttctctttttagtaaagtatttggtatttttatagttatcttaatatgcatcaaaaaagttgtatgatttaacatgcttcagatgaccaaaaatgcaaccttatgcccttactcccttttagcatatgaaagaccgaggaaaattattcattctgctggatgatttcaaagatataacataattttgtaagatctgattacagtgaattttttttcatatcttagtctgccacaggctcacacttatattgaataagtggattaaaatgctccaaatctttactgtctctaacattctcagtgaacttggcagaaactttgattaaggatgctttaatagtaacaatgtagatagttggcacattacaggggtaatatcatatccattttcattagtgattctttcgaagagacacatggttgtccatgactttatagctgttgttttaaaaatgtatgcatgtctaagatgtggataaccttttcaagcatagtctatgtgatacattttttactttccatttgaaagacagtatactatttgaagacatcaaatgtcaaatagaaaatccataaacaatgatcaacccatacatcagatcttttttttttttctaacttgaattgacctacatatgcctcttttgtggtctagggctgccttctgtgagacagctagactttgctccctatttctctccttgtttttatatcctactctcataaactcacactgtgctgttaaaagaacagacttattcatgaatatgcctaccataatgatagccatatagcaatgccctgaaaggaataaaggattagaaaaagattctattgttactgtaaagaataagctagtcttacagtattgctgtgaatgactaacccagctaaatgagttttggacaacagataaaaaaggaactttctacttaggagagacatggtagagaagaacaatggaaagagtatggcctttagggccagggagacctaggtttacataactgcttgactttaataattttaaggttgggcaagatgaattaacttcttggcctcagtttcatcatctgtaaaatgggataatagcatacactccataggattggtgttacaattaaattaggaaaaagtatctatagcatttagtctagcagccaaatacatagtgagcattcaatagataaaaattcatttccttcccttcacagaactcttctttttatggagtctgcatattcctgctatccaaagtgttatttttaaggcctcatataatgctaaaatgttatgattctgtgataaagccaattttttactttggaccacttccatcatatgctgctgtattcaatagtaaatatgattactagaagagggaggaactaacttagctgagttctatccaaggatgacagcagtagttatgtgctacaaggtaaaatggtgtatgacaataacgtgcaggaaatcatttgttatatgcatttgctaagttatgagacaaatttagtactcaggtatttctaaagattcctaagaatagcatgattcctaatatatgattgttcaaatggagactcacatgctgcataaagatattcctgtggaacatggatctatggcagcagacagacagccaccccagagtccagccactcacattgcaggggctcctgggcaaaggtgatatacatccaggaggcaagtgattgttctctacaaccgcagacatacttataccttccaaggagaccatggttggcagagtattctatgaataaaaagatgatgtatgcatgtgtgtgcgtgcacacacatacttacacgtgcccctttgtgtgcatatacaatatcacacaaatacacaaaagagaaataaggcaagtataaattatatctccttccaaaaaggatctgaagaggcttctgtaaaataataccaatacaagagaaaatagaatctctaaaatgagaagagaagaatacactaaaagcagagtattatgtcacatgaactaagatttacctcatctggacgttacttttcctaaaactccaacaatataactaagactataactaagaagcagggaggaataaacaaaggcttatgaaggccgggcgcagtggctcatgcctgtaatcccagcactttgagaggccaaggtggggtgaatcacctgaggtcaggggtttgagactagcctggccaacgtggtgtaaccctgtttctactaaaaatacaaaaattagccgggtgaggtggtgggtgcctgtagtcccagctactcaggaggctgaggcaggagaattgcttgaacctgggaggcggaggttacagtgaaccgatattgcgccattgcactccagagtgagcagcaacagtgaaactacatctcaaaaaaaaaaaaaaaaaaaaaaaaaaaggcttgtgaaaaactaacacagatgtcacatggctctaagaaaatcctttaattctatttttcaagtctttatttaccaactttttttcaagtttttttgcctttagaagttagacagattcacctctagaaagtacactgctacatacaaaaagtgacaagcctgataagatgaaggagtcagaaacattctaaaatcaaaataaaatgaaacagaaaaacccaacagccaaagactatggcacatagcattatatacagagtgacctttgggagcctcaccactttacaacacagtgccataattattgttaagaatggtaattctgagttatacagacaggagttggatcatgatgaagatagtctttaagaaagtaggcagtgaataataccatttcatgaaggttttcattctaattttcgaaagtaagaaaaattggtacttcaaaggggaatatcaaatatcttaaaatttacttacatgaaactgtatctcattaggatttgtaaggatttataatgcatttgtggattaaggaggtagaatgtggttctggcaatgtggatcatatgagatcttgaaatcttgattgtctcaccaatcagtttggctactcaatgcttctgggctagcctgtcaattgaccttccatgggaatgaactatgctaattctcaatcacatagaagaagcagaatagaagcaacacagttattttagcagcaatactaacattagtagtagcagcagcatcaattactatttaatgagccacattctccccattgtctctttcaagccaccagggtaccattttgtgcagtagagtggtaaatcaagtggtctctactggattgaaagagtaactgtatctctgttagagttcagcttattacctgggagtgagagaagctttggggagaatgaagaccattaagtgccctcaaggagtaagatattgccaaaagtaccaacatttccacatgattttataggacaaaataggcaccagccattaagaagaaattgtccaaagatactcaatgttcattctctgccaacggctaacaaagtaataaaaatacactgcttataaaaagcagtgagagaaaagtgagagagcttagaggatctctaaggccctttctaactgattttccctgattgtaatgattaatttagttgatatttattcccagtcccttcaaaacatcttgagtagttttacattaaaaagtgggcatttggtaatcaaaagactttaaaatgatttttttttaagagagaacattctgcccctttgaatgtatgatgtgtatacccagttcactgagaatgttaggcacaccaataaatacatgatgccaaataaaatacatactctaaaagtaaacgtaatcatactactctattctacctacactttgtattgcacatattcccttaaaactgtcgcaggttagctaggtttatgaatttttattaatttaaataaatacccagagcaagatgtttaatgattataaacatatcattttcttctcttaaattaggtgcctctagacttctcacagaatcaagttaggaaagttacatttatagatgcattaaaaatctggactctatttcaaatccatcagcagttgcaggtcactcattcattcgtgagttatatgggattctgcaaacatttatgaagtgcctacgaagattctaagcaatgtttaagtataaggatctgttccttgacaataagagtctgcctattgtagttaaatttgtaatccggataattatataaaagcacagttatccttgaagactatatagactgaagagttaaataaaagtggtattacttagactttgcatagagttcaaagatttaactaaaaatctgtggtctaaacacaatagtctttttcccagtcgtatttttagaaagccaagtttcaggtagaactaaatgctttgatgtccctccaagtctttttctatcattctgtcatttcatgactaaagtactaaaatttaacatagttctcaaagatgtttagaaaatgaaacaggctttacacataccatggtcacctttcccctttccccatgacggttttctgtctctaagtacactgcgatagccatgtaattggaaaaatacaaaattaattatcagagcatacatattaaaaattcaacatgtgctggcttggcttattagtagaaaaattatatttttgactttaaagatgtgattctgtgtttaggtatcatcattccagaattaccttaatttaatgtatagtagaaaaaccttttgagtttcgccgtgcttctgaaaataattaaaattaatttaaatgtataatacacaagtgtttgaatgccacatatttaccagctttataccttaatttaaattcacattggaggctaatgaagagtcagaattaatattacgtgaataataatggtattaccatttgttgcttggcagtttgattttcatcctacaggtcatttggaaaatgtgcttatctgtttttggttgtttttttttttttttttttgagacagagtctcgctgttgtcacccgagctggagtgcaagggcacgatcttggctcactgcaacctccatctcccaggttccagcaattctcctgcctcggcctcccgagtagctgagattacaggtgcctgtcatcatgtccagctaatttttgtatttttagaagagactgggtttcaccatgttggccaggctggtctcaaactcctgacctcaggtgatccacccgcctcgacctcccatttatctgttttataccttgttctagatagtagccaattaacataatctgcaaaatcagcagatatccagcttcaagtaacagttaccctgatcatgttaaaaaatattgtacatttgctctgagatctaatttttttctacttctgtttctttttgcatcaactatttccatatattgaacaaggatagaatatttcctgtggtttttcaggtggtttccaagatttgtcattcagatttataatacccaacttaattatttcagtgacatggtgaaagtgtatcaggataccatttcgcttactctcagagtttatgtagggcccttttgggattcagtgtctccgttccactgcacaaaattgcaagcaacgtgtatttaatgattcagctgataagcccttccttttatgaactatgagttagtattaaaatgaagggttgggatttcttaactttttagccatttaatcttttaacatgggatcaagcaacagaatgtagcagaagagtattatgaaaatgagaacattgaaagataatgttgatgcttgattctttcacttaataaggtgtctgagtatttaatgattttgttttgtagttcaattaccgtagaacaatctacttaacgctagattgtctgtcgggaccatgatgattctcaaataaatattgtatttaccaattctactcttaatttttttaaaactaaagacaagacaaaaaagtagatgtctctataatacatttatatgaaattaaattttcttagtttatttttgctttagaatgccagttgtaatcaaaggaccattggcaagacactggccattagtaaggcatcaaactttgagctttgctttactttaaaaaagttataccatgcaaggatagaagtagacataggcattcacataatcccctgtacatcctccagaggggttttgtcagatgaatttcccccaaagggcctcttagttaccatcagcttctctttgggacatatatatttctgactgtggtcatttgttaaggagaagtttagcagacgttattaatcaaatacatttaagagagctattgcttttcactttctcccatgatgtaatgctcttataataacaggttttgtggggtcctctttatacaactatctgatgacaatattcttcattcttgtaagctcagttaacatcttttcacttcccatctgataagtgctagctgctgatttttttgctcagtatctccatttatatcaatttattttcatctctagagcagcgcatcaggctgctctctcgtgaatatattgttacttttttctggcactggaatatacaactatccatgacagcaaaatttgagggccatattgagatcaccggctgatatggtgaccatgtaaatataagtttaaattgcttagttccacgttagaatagtttaatcaatttctgtcccagaaactggatatgaaacaggttagatgaggaagcttatatggaaaaaaattatctttcatcctctccacatatacatttttcctgagactaggtcatatgtatattcattttgtacacattggggaattggcatagtaatttattcaacaaacattaattagcaccttactttgtgacaaatctgtaaaaaaaaaaaaaaaagataaaaagaatgataatagctagaatttattgaaaacccactatatgcaagattctaggcccttcttatatactaatactaacagtttaagaacttaaatctctttttcccctagtgggattcttattcctttctttttcttcaatgtttgagttcaggggtacatgtgcagaatgtgcaagtttgttacataggtaaacatgtgccatggtggtttgctgcacagatcaacccaccacctaggtattaaacctggcatccattagttattcttcctgatgctctccctccccctgctccctccgacaggactgactctgtgttgttccccgcaatgtgttcatgtgttctcgtcattcagctcccacttataagtgagaaaatgcagtgcttggttttctgttcctgcgttagtttgctgaggataacagcttccagctccatccatgtcccggcaaaggaaatgatcttattcctttttatggctgtatagtattccatggtgaatatgtaccacattttctttatccagtctaccattgatgggcatttgggttaattccatgtctttgctattgtgaatagtgctgcaatgaacatacgcatgcatgtatctttataatagaatgatctatattcctttgggtatatacccagtaacgggattgctgggtcaaatggtatttcagcttctagaactttgaagaattgccacactctcttccacaatggttgaactaatttacattctcaccaacagcatagaagcattcctttttctttgcaacctcaccagcatctgttgtttcttgactttttaataatagccattctgactggcatgagatggtatctcattgtggttctgatttgcatttctctaatgatcagtgatgttgagctttttttcatatgtgttttggccccctgaatgtcttcatctgaggagtgtctgttcgtgttgtttgcctactttttaatggggttgtttggggtttttttcttgcaaatttaagttccttgtagactctggatattagacctttgtcagatggatagattgcaaaaattgtcttccattctgtaggttgtctattcactctgatgatagtttcttttgctgcacggaagctctttagtttaattagatcccatttgtcaatttttgctttttttgcaattgcttccggtgttttcctatgaaatctttgcctgcacctatatcctgaatggtattgcctagattttcttctaaggtgtttaaagtttgggattttacatttaagtctttaatccatcttactttttgtgtaagtttgaaggaaggggtccagtttcaattttctgcacatggctagccagttcgtgggattcatattctaagtaagggaacaagcacaaaggcaaatatttacaataggtgctacagtagaaatatgagtagacgtggtttcatatatctgttaagagaagagagtcatgtcaaaatgttggttttcatggtttgaatactcactcaatcctgacttagtagctgtgtgactttggacaagttccttaacctttctctgtggctcagtatcttcaactgtgaaatgggtcttattggggcaagagatatggttgcatagactatgcactgcacaactccatccagccatatacggcacaattcaacaatcaatgatgagtacttcataggatagtgaagaggattaccatataaaacatttctaaagtgattagaatgttcagcacattacaggttctgagtaaatattattatagagtgatgagttagagtaactgaagagactgattcttcatgggagaggaatatttatggagattttgtaagaaagataagacattgatccaaattcatatttttctttcatcaattctaaactgcggttgctaatattcctgaaaaactaatggtgttttgctagcagagttctggtcttacacagtaggagctcagaaactatttgtaagccaaaccaaatggtgtcacagttactttagcaccatcagactgatgttgacacctcaaaacccagtattgcaatcataaagaagaattgcagattcactgttaggtttccaaatctcacctgtggaaaagagcttatcaattcagtgttgagaaccaatgagaagaaactattgttaacttggaaagatgaaaccattaaaagaagcaaaagcaacagaagaaaaacaggctgaagatggtgataagtttgatacggactatgttgttagagatattaggagataaaatatccaaatggaagtgtttattgggtggttgaaaatatggacctgcacctctggagaggattcatattcaggaacagtgattttgaaattacacatatgtctttgaggaagaaatttgtgggagtggaagatcttgctaaacagacaaattgaaagtggtacacatcaagaaatggctacattttgagtgtatgagtggagaaacgactttccttcagccagttggcaagggagaaaggagttttaagaatggaagtgatattatatagtctcaaatgcagcagaaagatgtaagaggatgagaactgaaagaaaagtttgatagaaggatatagttgattatctagagggcaaaatgataagtactttcagtaaagttttgaaaaaggaagacaattgtggattaagtaggagatgaggaagtggaaataacttatatatggtatatagaagaaagtcgtccattagaagaaagttagagaccaaaaaatctcaaatttttgttttctaggttaaaataaccacttttataaagcagaggtaaatcagcaagtagagaggaagaggtcgaaaatgtaaaagaaagcaggagtgaatcactagcatataatagctcaatgaggaatgatcagcgacccttgtgaatccagctggacttcagaacgtagaggacaaatgttggttggtctagtgggttcatgacttaatgtgttcctcttctctttaaattgtaggccccagatacatttctcacatgtttaaagatttctccagttagatacttcaactaagaaatttttagttcttcaaggcaaaaggaatcattcattagtgtttattttcacttttggagaaaaagattgtagcacacaaagcctgcattttgtttttgttggtataatggcatctcatggtttcttgatattcttctatttcccatgtcaagtgttctaataaacgttgtagaaaacagtattaaactcacacatctacaaaaaaatgtgctaaagagtgagtgcccttacttaatttctggttaataaactaatgtgagattaaaatagacaaggagaactgtaattgcatttttggtgtggacagcaaggtctgtagagagcacaaagtttaacaggtctgcagtgaatgaaaaagaaaaacccccacaccttgacagttaacatcactttagtttatggcttgtttagttttaaattttataagtgatcaaaagttaaagtttgtggattacacgatctttcattcgcccttgttgatggattggttcctgctttcctgagtttttaatggaaacaattatatcatataagaaactatctcacttgtttctattccctggcatcatatatggaaaaatacagcagttagttgaattgtctgctagaaagtggcctttaaaggaaaatataagtggaagaaaatttgcaagtgtgtacattaaggttgaagtgaaaaggggaagggagaaggaggaggatgactgaggtcacattccaatttttgaagattatttgctaatgttcatgaaggaagttacagttgcctctgaaatgtagtacaaattttttgaggtcatttaaacttgtattataaaattcaacatgattagagattgtagggaaatcatatctgaccttggctatattgtcaaaacagaattttctatctaatttgaatcaagaaacctcactttttcctgtgcaattgaagtgagtatttctggcaaaaagtatgtcttctaatctaacagtaagatggagagataatttaaacaaacagcttcaagataaaactaaaaaattagaaaaattgccgcagatttcaattctgctttgattttgaagacctggagagtggacatcagcatactttgttctactcagtagctatattcttgaaaagttgtatctgaaaccaagttccttactgaaaaataatttaaatccactcaaattgcttgagctaaaagaatttcattgtgactcttcttgtacagtgaagaatgccttcataatgatcatgccaagtacatacatgcagtcattattattattattattattattttttttttgagatggagtcttgctctgtcgcccaggttggagtgcagtgacttgatctccgctcactaaaagctccgtctcccgggttcacgccattctcctgcctcagcctcccgagtagcttggactacaggggcccgccaccacgcccagctaattttttgtatttttagtagagatggggtttcaccatgttagccaggatagtctcaatctcctgacctcgtgatccgcctgcctcggcctcccaaagtgctgggattacaggcatgagccaccgcgcctggcctacagtcattatttttcaagttctgatttatttgtgatggtagtttgtttgctcagtagatcaggtcttttttgtttttgttgttttttgttttgttttgagacaggtcttgctctgccacccacgctggagtacagtggcacaatcagagcccactgtagctttgacctccctggctccagtgatcctcccacttctgcctcctgagtagctgggattacaggtgcatgctgccacatccagcaaatttttaatttttttgtagaggtgggattttgccatgttgcccatactgatcagtaagtcttaaactggtgatcccctctacttcattgcaaaactcattgatatccccaaaaatcaaaggcatattttaatatttctcaaaaccagggctgctaactcagctgacaaacagggaaaaaaactattattccttttccctcaaccagtgcctcccactaccctgcccagaccccagggattcctgggcagataccactgtgggctaccctagccagccttttgcagccccattcctgcttgcttccccacacctccccagccagagcagacctggaccccaacagaaatattcacccctagcggcaacactagcactctcttggacaaatgtttagtgatctatccatcacctgccaccagaccccacttcccttccatcagtggctattctctgttgactgactcttccctggaatcaccttcacatggtgatttgtgggaattacagctcccatgttcttctgggttgttaaatattttgaatattacccccatacatacactttttatgataatcagcttgaatgttcagtcttttgatacattttaaaagaaaattcttaagtacacatgatttgaaaacttgcaaataatgcattaatttgcattttaatattaatgatgcttaatgtactcactacattggaaaatactgttacaagttttattagttcattcatctgagagttaaactgatatacatatacattgttcttactttgtatcaaagatatgcaaaatacttgagtacagaagtaatgatgaagtacctacccctctgggagcttatagcttaaaatgggatatatatgagataaatgagaaaggtttataccacagaataacattatgtaaatcaatttaaccaaataacaacaccagagggaaaggacttttagctaccactcatcattatgtcccaatataatgttccagttcatgttgcaaatagggcagcaccctggctattgtgtggtagtctgtaagtagtgaaatagctgtggggtaaggcagtgagtctttcaccttagggagggtgcgagcccagacccacttgaccatctatcacaaatcttgctgaagttctaagatccctttcaactacaaattttcatgcttccatagaatcatccctgacctcaggaaaaaatacaaaaatggaacaaacaaaacagaatagtaaaacctgaagtaagaaaaaaagaaatgaatttgacattgtacagatcaggagaaagaaagttcattaacagtttcaagatccctgcgttttcacccagcaggaaacaaattaccatgagttaaggtggggaaattactggcaattcattgccttcttttaaagactttaaaaaaaaatgagtaaataattttagactattaccccctttccatgagagatacacagctagttaaactgccatgcatattaattttttgttttcattttattccacctaccaactacacagtgtctgctttccaaaattagtttgaaagccaatgacctgtgtttgaactgggtgaaatagcatagcagttcacacctggaataaaagaatgattgtgtgtgagtctgttaatggctgtgtagagctatatctctatatggagctatataaaaatatattttatacatgccagattcatttagacttgaattgaccctgtggtaaagcagcaggaataaaatatttttttgataaagcactcactcaaatagagaaatgagctcttgcagttaccatttaatctgtgacttctttttgagatgcagaaaaactccattataaagtgctcagttcatccagggacacagacacactgtgggttataacacaccctcatctgcatggtgaggtacatgagtcagctgctcttctctcaggagggtggctttaaagctccacagtcatgcatgctgccaattccagattgtccaaacctgtaggttagcaaggacacaggtgagccataggtatgacatgttcataaaaagaaaaatatattttaatacaaaacatgtcaggggagtggagagtgtcaaattgaggacaggagagacctagattcaatgccatagttcttggctaatctctgagaagcttgttagtcaccctctttctccttcccttactctcctgtatcttcccttacatactgcatagtcccttgtaatttacaagacataaaatacttcctttgttcatctgtatactgaatgtaagaatgaacaaaaggtcatcataaggacagcctgtgagtttatgcactgcatactgcaaatgacccactccagcaatgggaagacacccctaacattgcttctctccttataacgaaaatattattcatcatcagctttaaaatggatcttctcactctgtgcagtctccgtggtaacgtcccataagcccagggttttaagacctttctcctgtgctctaagcctacatatctaactgcctaatggcctttccacttgaatgacacatcattcagtttcagtgtcctaaactgaagtttcaactccaagtctgtttttttctcttgtagtcttcatgtcagtcaatcagtcttttatcctaaccagaaatatgtgagttctcatggattcctccctctcactcacttttcagttctataatcacccagttcctacattgtttgcatcttaaatatctcttctagtcctcccttctcctttatacccactgccactgccacaatgttagctccttcagatctcatattttctcacttttattgctatagacataccccccgcagttatcctacctctaggcaaatcccttccaaaatgcagctgccagtgtgatctttgtaaaatgcttttatgataaagttcaaactcattagcaaagcacacaaagacctttgtgatgtggtattgctgaattaaactactggcagccctagaaaggtaaagtgtatttgatgcttctgtgctgttcccttagcccagaaagcccttccagtttctgtttagtaaagtcctattcatctttcactactcaatgagtcataagtaatcccattaggaaagcctgtgtgatctacctcctccctaatttgccagcttgagtttgcttcaccccttcataatactcagtcaatcataatgtcttataatccatcatagcacctcacacaatgaactccaatgtctggtttgttgggatgtccgccttactacattgtaagcttcttaagggtagaaaccagttctgataggcttagggcagtgaccaccaacagaaaaagtacttggtaaatgtctaacacaatctgttttactttttccagagcacgaggcatgcatgaaagagattaatttactccacatgggaagttactacccaggcttaccaaaaggtcaggtttatataaagtggcgttcctttttttcccccttagtaagacattaaaaaaagaaaccacaattgaaaagccaagagctatctgtgatacggaatatgaacacagaatcagattctcatagcagctaagctgttccccaggcagtggttctcaaggtgtgcttccaagaacagcagcagcagcggcatcacacatgcaaattactggactctgccccagatccacagaattggagactggggatggggcttagcattctgttttaacaagtcctccagatgattctgttgtgtatctagcttgagaatcactgccctggagaatggaaaaaaaaaaaaaaaagttcccacagaagggttttagcagttctagagcacctactatgtgccaggccatttattttgtttaccttattaactttttcaggatactaaattagtacttcaggatttaattcttctaagatatcttttattccattttaaattattttagaaagttctaatttttttttttttttttttttgaggcagagtgtctgttgcccaggctggagtgcagtggcatgatctcggctcactgcaaccacaagcgattctcctgcctcagcctcccagatagctgggattacaggcgcttgctaccacgccctgctaatttttgtatttttagcagagacggtgtttcaccatgttggccaggctggtctcaaactcctgatctcaggtgatccacctgcctcggccctcccaaagagctgggattacaggcgtgagccaccgcgcctggacagtaagttctaatatttgatagtagaatacagtgattgtacttagcaacaatattttgtatatttcaaagtaatggaagagaagacatgaagtgatacccacagatacaaatggtaaatactcgaggtgacagataccccaaataccctgacttgatcatctctcattctgtgcgtgtaacaaacactcatgcatctcataaagatgtaaaatattatgtatcaataaaagaaaaaaaaatcgagatacagaagtcctaagtttgctatagttcctggcctggtaaaaatggtgtatcctctacatgccttttctcaacacattccgtgggtgactcctctcttttttatactgagtatggcactgaactgacactttaaatatattgccttgtatcataaatatctgagcttatctttcatgctgtgagtttttacagagcatgaatcctgctctgtgtacagaggcctgccgcactcggctttagatagtaccttgcacgtatgagctaaacacttgataaatatcagtgggatgagtgcataaatcttacaatatttatcatagtactatccagatttaggtttcctttaggtttccactataactgcacagagcaaggattaaaagctttttttttttttttttttttgggtctgagaagctatggagaggaggaaatgggagaaataattatgaaaatggggagctaaccacatttttttcctcttctgttttttagtagccttttcgcaagccacttcgacctgattggtgttttaaaggcacagacattgccatttcaatgtgtggatccatttaactacgtggatccaaaaagctagttcttatgctctgcctcaattataaaatcttctttggcctaaacttggccttggaactatggttgtcggtacaggctggcatgaccctaaggtgtcactctcagcttttgagggtgctctgttcaaagacagacaaggacttttctttccttaaatgcggtcctctgtgactttgctgttttagattttaggattaagtttaaaatgtgttgggcactgacaaggataagaaattgttcttcctgtcctctctataggcagaaaaccatcttttccaagagagagagatggcaagggtgtaacagcacagttcagagttatcagtcagcaagagtgaatgtgcatagccttcctctcagtaaagtggatccatttgaaggagaaaaaggaaacaaaagtctctgacattatattattctgtcagttactgctttctctagaagtagagaatggaccaggaaaccggtagctgctttgatattattttacctttttcctttcttgagaattatagattctgtacctgttttcatggacatgagatagcaaaatcccctcaggcacaagcatgtgagggaaaactgatttccctgctatcttcctggctagaacattcttacttagcctactcaccatgctagacattttccagtcgttctaaaaccctcttgatgaaggaatgtaagttcctggagcttggaagtaggaccttctatgggttaaaatatttagctcttacccatagtgaagagctaacgacattgatgatatggctaattataatagatataattaggtaggtaagttaaaacagacatagagaccagctgaagagtctttatttttattgatttgtaggataaggaaatatttttatatgtgctattatttctatggtaggaatgtttaacttagggaaaattaatggaaaaacaaagctttctacacttctcaagtgtcctgcttcaggcagttttacctacaacagcactgatgttgaatttcactttaagttgtcacatggtctgagttgtacaaaaagaaagaaaaattctggccgggtgtggtggctcatgcctgtaatcccagcactttgggaggtcaaggcgggtggatcacgaggtcaggagaccaagaccatcctggctaacacggccatctctactaaaaatacaaaaattagctaggcgtagtggcgggtgcctatagtcccagctactcgggaggctgaggcagaagaatggtgtgaactcaggaggcagagcttgcagtgagcagagatcacgccactgcactccagcctgggtgacagagcgagactctgtctcaaaaaaaaaaaaaaaaaaaaaaaaaattccttagtgtttggataaagaagaaaatgcaaaagttaggatatgtttaagaactcattcattaattatatttttagccattattctaaagggatctgggcacaaaggttattctctgcagcatttttattatagcagaaaggggcaagtaacctaaatgtccacccatagggaatttattaaatatattatgatacatctatacaatggaatattatgcagccattaaaattgagatacaatacatatacattaacatggaattagtgcaacaataaattaagtgaataagtagactttaaaatatgtataaatgagcccatttatgtgaaattatacatatctaatatgcacatatatacattgagattcatgacaagttcatcaaactatttacagtagtgatctctagggtattagattcaggtgatatttattttcttcttagaccttttagcaatatttgaatatttacaaaaagaatgcatttttttccaaattaaacatctaatccagatataaaagagttagacatatgagctatatagctcatgagcagcatctgtttcaacttatgttttatttttccaatgcaattccacattgctagccttttcattagtaatagtttaattaattaataggtttaactaaacctataattaaacattaattaatacctaatttaatatttctggtttttaaagttttcataatagaaataactacataattcataaggaataaggacaaataaaagaaatactctaaaactttatagttaacagagaaacaaaaatacaacaacaggaaagctatagtagagagaaagagacgtgtaaagatgtctataaagaaaaagatgagaaatcctttataaaagtaggggccaggtgcggtggctcacgcctgtattcccagtactttggaaggccgaggtgggccgatcacaaggtcaggagatcgagaccatcctggctaacacgtgaaaccccgtctctactaaaaatacaaaaaaattagcagggcgtggtagcgggctcctgtggtcccagctagcagaaaggctcacgcaggaaaatggcgtgaacccgcgaggcggagcttgcagtgagccaagatggcgccgctgcactccagcctgagctacagagcgagactccttctaaaaaaaaaaaaaaaaaaaaaaaaggaaaaggaaaaagaaaaagaaacaagaaaaagaactaggaataaatgaaaataccaagagagactgcaactaagaaaggagacaggataacaggatgatactatcttataatgaatgggaattacatgttgtaaaaatgtaaaaataaggatttgacccctgcaacaatccaaagagtttagtaaatgaaaagttttaaatctccatttgatatatgaaaaatgaaggcctgggaaaggcaagcatcttgccttatatcacaaatttgatatggaggctggctatctccttacttgttatataccaggcatcctacaaattgtcttatttaaatctcaataatttagggagtatcacccccattttgcagatgagaaaactgagtcccacagtcataaaatagcttgccctaagtcacataactactacatagactaaactggactctaacttaggtcccttattcatatttccgatgatgtttgctttcttttttctttttagcactatggagaataacttgcaatagaaagaaaaaatatgaataagataaacaaggataaggatgaaagctacaaaagaagaaaaaaagttccaaaattaacaaccatttgtttaaacatatgacagtaaattacttcatttgcatgaaattactattttggggtagcctaatttttcccaggtcaaatattggtgaagcccagtaaattgtgttccttttaatctaatttgaactttaaaaaaaaatacgtttcaagagataaactttttttccaaaagtcatttacaacttttatggggaaataagaaaggctgtgcaagacagacaagattattgccttgatttataaacagtacagaattcagattgttttcaattgctgtcagaagcagtaccttactttcaatgcaacttgatgccagttctgattgtgactgtcctcttgtttccatggtaacaaactttaatgtgatcagcattacgtaggaactttttgcattgaaacaggcaagaaaaaaaaattctgattctctgtgcctgaaacacatatagtaggggctgaataaatgtttatggaatgaaaaagtaaaatagaaatagtctcagccttacaactgcgtgctaaacagatgtggtgctaaaatttgcatatgtaaacctcttcatgggacagaataaccttaagtaaaacagaaaggtgtagggtggtttttgcttcactttagacccagattgtagcacaaagagcactaagtcgaaggcttaaatagcttaattgtacagcaagttagaagttaaagggtcagagtaatgttaagtaaatgaaactgttttggagaaaacctgtaatgctgcattccaggtctccaaaggcacagtgccatttttgtgtgtgttaaatcattttaaggccaaatactggtgtttgctgacttccagaacttccttatgtttccagcctttgcaaaacaacatagccaagtatatagtatctaaatctggtgggctgcttctgagattttcttggaaggtatttaaatatatgttggtttttgtttgtttgtttcccactcataatatgtcctgttttctaaaaactttttaggttcaggcagttgaccatttatgtgaaaaatgtctgaaaaatttgaccctgataaggtggatgcctcttgtgagatcacagaagcccttaacctggaagaggcgtgtaaaccaagaggtttcaatatatgtaacaattgaaatttaagcatatttaaatgttatctactcaaatatttattgagtcctactatatgccaggcactgtagtaggcacatgttgagcaaacaaaaattcctgttctcatggggcttacattctagcagagaaaacacaacacaacacaagtacaatgcataggatgttggatggtggcacgtgttgtggtataaaataagtcagagaaaggagtcagttttaaataggaaggttatagaagcctcactgagaaggtggcatttgagcaaggacctgaaggaggtgtaggatagtaccaagcagacatcaggggaaagagcattcttaggcaggctgaagaaaaagtgcaaacattctgagacaggagtatccctggaatgctctaggaataacaaggtggcccatatggtcagagcagtaagcgaaggagagagaaatgggaattgatatcaaagaagtaatgcggtcttggaggcaggttgcatacggccttgtagaccactgaaaagatttcagcttttgttctgaattagatgggaagtgtattagtctgttttcatgctgctaataaagacatacctgaggctgggtaatttataaagaggtttatttgactcacagttgagcagggctgaggaggcctcagggaacttacaatcatggtgggaggggaagcaaacacatctttcttcacatggtggcagcaaggagaagtgcagagcaaagtgggggaaaagccccttataaaaccaccagatctcatgagaacttgctcactatcatgagaacagcatggaggtaactgctcccatgattcaattacttcccactgggtccctcctatgacaagtgaggattatgggaactacaattcaagatgagatttgggtggggccaagccaaactatatcattccagtcctggcccctcccaaatctcatgtcctcacacttcaaaacacaatcacacccttccaacagtcacccaaagtcttaactggttcccactcctggtaccaaaatctgtgttagtcagggttctctaaagggacagaactaataggatatatgtatacctgaaggggagtttattaggagaattgactcacaggatcacaagatgaagtcccacaaataggttgcctacaagctgaggagcaaggaagccagtccaagtcccgaacctcaaaggtaaggaagccaacagtgaagacttcagtctgtggccaaaggtgtgagagcctctggcaaaccactggtgtaagtccaagagtcgagaagctaaagaatttggagtctgatgttcgagggcaggaagcatccagcacaggagaaagatggaggccagaagactcagcaagtctgctctttccaacgtcttctgcctgctttactctagccacactggcagctgattagatggtacctacccacattgagggtgggtctgcctttcccgatccactgactcaaatgttaatctcctttggcaacaccctcacagacacccaggaacaatacttttgcatctttcaatccagtcaaattaacagttaatgttaaccattacaggaaggtactggagggttttaagcagagaagtggcataatctgacttaggtattcaatggatcattctcgctgttgtgtttttaaaaagacaggaggagggaaattttaaggagattatataggaagctattgtattaataagaaatggtggctggacatggtggctcatgcctgtaatcccagcacttttggaggccaagacaggcggatcacgaggtcaggagttcgagaccagcctgaccaacatggtgaaaccccatatctactaaaaatacaaaaaaataaccaggtgtggtggcacccgtctgtaatcccagctattcgggaggctgagtcaggacaattgcttgaacccgggaggcaaaggttgcagtgagccaagatcgcaccactacactccagcctgggtgacagagcaagactccatctcaaagaaaagaaatggtggtatctcagaacagactgctagtgtcagaagtggtatttgttggatactggatatctggtagagactccagcaattttagtggataggatgtaaggtttaaaaaaagagtaatcaacctagatgccaagtctttttactggagcagctacaaggatggggttgctctttactaaggataagaaaactggggaggattgagttttgaggaaaagatcaagagctcagttttggatgtcaagtcttagccatctaaggagatatcatttgtgtatatgactggagttcaggggagatgtctgggttaaagacatacatttgtcagtcatcagtgctatgctaatttaaatatttaaagccatgaggtttaacgagaggtttctgagctctggggctcccaacgtttagaggtcaaggggatagaaactcccagagggtactagaaggagtggtaagtgaggaaggagaacaacctggaagccaaatgaagaatgcacctcaaggctgggcatggaggctcacacctgtaaacccaacactttgggaggccaaggcatgtagatcgcttgacgtcaggagtttgaggtcagcctggccaacatggtgaaaccccatctctataaaaaatacaaaacttagctgagtatagtggcatggacctgtaatcccagctactcaggaggctgaggcatagaatcacttgaacccaggaggcagaggttgcggtgagctgagattgtgccactgcactctgggctgggcaacagagcaagacatttccccccaaaataaaaagaatgtacctcaaaaaataaagcaaaaagaggtttttaatggattatatatatacttactaggacatgccaaagtgagtggaaggaaacagaaggaaatagccttggtcccttcagtaacaaccatgttaataccttctcaggaacataacatacaatagctatttaggctgaatggagagctgaagcataaacctacaatgatgattcatgtgactttctaccatagaaatctcaccagattcacagaaccatagacactttggaaaagagctaagaggaaacctagttcaatcccttacctgatgcagtatgcccaccatgaagtcatccgtcttaatcatcttcaataacaggcaacttgaaatttctcaaaagtctgtgcatatttgattccctctagcagttccaataaaaataaccaagtcatttccatggtatatgaatgaagtggattatgatgccaacattatattgtttcataactttctgagtatgtttctcagttttagagatttattctaatccaaatatgcatttattcgagcaatttagtgtttgcttgatgtatatactgtattaatctcttctcttgctgccaataaagacatacttaagactgggtaatttataaaggaaagagttttaattgactcacagttctgcatagtgagggaggccttacagttatggcagaaggcaaatgaggagcaaagtcacatcttacatggcggcagacaacagatcgtgtgcaggggaactcccctttataaaaccatcagatctcgtgagacttattaactatcacgagaacagcatgggaaagactcacccctatgattcaattacctcccactgggtccctcccatgacagataggaattaggggaactacaattcaagatgcaatttgggtggggacacagccaaaccatatcatataccaattttccttgtaagtagggtttttgatttttcaaatgtttgttccttggaagccacataggtaggaaaaatatttacttacttttttgctttgagacagggtctccctctctcaccaggctggagtggtgtgatcataactcactgtaacctcaaactcctgggctcaagccatcctctcacttcagcctctggagtagctaggactacaggagtacaccaccatacctggctaattttgaaatttttattttattttttgtcaagaccagggtcttgctatgttgcccaggctgctctcgaactcctggactcaagtgactctccctcctcagccttccaaagtgctgggattacaggtatgagtcagtgcacccagcctactttttaagatgtatgcttaaagatgctatggtagaaagggaaatacaaagttaaataaagatatccaaataccattatagcatcaaacttcataataaaatgaaatcatagagagcagagatggcatccttctggttctgaatgtatgtacctgtcaacaaaagaaagccatctccatgtttccagagtcatgatgaaatcacatttcaaattgtttcaacaggtgccttatgtcaaatgcctcttcctataaaagaaactgctgagttgttctaaacagtgcatgaaaatagcaagtgggctgagtgagcaatcacagtgaggtcctgagaggtgtaaaaaaccccagattcagattcagcttcctccagagagtggggttacctcccaccatgcttgagggacagccctcccataattagactctactcacagtctcagcctgaagtgtgactagctgaaactagtgactggaggaattgagcccctgtagggaggtcagaacaggtagcactttccttctcttgctccctgccaatggttacccctacatagaatttttattcctacctctgggcagcaccagcccgttaataatgaacctagaatgtgaagtgaaaatcagcaccatgtgcggtaagcattaggtaattacatttcacttgtttaattaagtttcactttctggttgccttgagggaactgtaggaaaggattttgattttgtttttgtttttgtttttcctgatgctttttttcttttttcccctagctagaagctgaataattccacacagtgttgaaatggatatgctgtgtttgtgttggccgaattaagcatctataatcatgtatttcctctcttttgtctatttgtgtcacagtcttaatatgtgggatagaaattttgtttagtggagacataattttttgattgtcttagggcttatttaaaccagctcatctccattataatgtgtttctgtactttactcatcagcttggcactgactccactattgttttcttcaaatactgtgtattttccctgaaagtccaagtagctgacaattttgctacctctgcaaggaaatctgctttattttctcctaggttttacacatatataaaactatacattagggacatactgttcctcagcaggctacatggcctttcattcactctcttaaaaatatctgtggacctattatgtgaaataatgtatgatttgctcaatgggagatttacttctcaataacgttatgttttattaagcctcacgtatttctaaatttatataccttgaataataattccatcacagaaggggctcattattaaccacatttccatgtgtgatattcaccgaggcatgtccctggaaacatacctaaccacataagagtaaaagcctgtcatagcacaggaagcctagaataagtacatcctaccatttaagcacctaggtcttaatatgtcagttcataattagattctacctttgtggtcagtatttgaaattgagatatagttaatcagttagagaggtagtcaatttcactttgtcagtgaagctcagaatcgcaccaatatgttgtttttctttttttttttttgagacggagtctcactctgttgcccagggtggagtgcagtggtgccatctcggctcactgcaagctccgcctcctgggttcatgtcattctcctgcctcagcctcccgagtagctgggactacaggtgcccaccaccacgcccagctaatttttttgtatttttagtagagatggggttttaccgtgttagccaggatggtctcaatctcctgacctcgtgatctgtccacctcgacctcccgaagtgctgggattacaggtgtgagccaccacgcctggccaatatgttgtttttcaaagactgccgtcctcatacagaccagcttggtactgacagaggaggtgaaatgggaaaagttcctttgtccccctcgcagggtgtacgatggggaagtggctcgtttcttcagtgccctgctgctcaggcctctaagggagcatacatacgggcaggctgtggggctccaacaccagggcagtgtctaggggtgaatgtttacagcttttgaagccccagtaggcatgtgttacagggtgctcttttagtgtagccatccaaaggcagcttgtgttaactagcttaattacaccctctaccttgtggcaaagacagagggctttctgtatcctggggtgcttgctttggtgtagtggaagaatcagatcacacgtgggcttggagaatgagtgcaaggttttattgagtggaagaagctctcagcagatgggggagccataagggagatgattttccccataagttgggccgcttgggggccgagcgctcctccaactgccccagccaaactctgtgttgttttgcccgtcagtggcctgctggtgcctgctggtgagttccactcaacgtctagccgcttgtgtgttcctctgccaatgtgctcctctccacgtccagctgcttctgtctctgccttgctagggtctcgggtttttataggcacaggatgggggcctgggtggtcttgggaaatgtagcatttgggcaggaaaacaaaaatgcctgtcctcacctaggtccgtgggggtggagtcctaacctgggaccatgccttcctctacccagcacttcccttcccctcttccatatcatttctgctgagctgtctttcaccagtggttgtgttccttctcttttgaacaggactttctctgtgcagacttctgtactgttcagttacatcataagccatattctagttattcacttgaaagtttacacaacctgcaagagtaattcatggggaaaataactctgttgtttttccatcacattttctgcctctgccaactctcccctcgtcctccccgcgctaaagccagccacttttctgtccattttcacaggcagaaatgctttgcatcgtgcctgcttgtactggcaattgcttgggcctcttctgtagcttgtcctctagctgtctctaccacattcctaatgaaagtcagctgacactatgtatttgtgtacaaagaataaataacatggtttagttatgtaacaatttgaaatgccttgatttctttaggttaatgttaacagcctcagtattggtaattcctgaccgtctgctaacttttgaaagccagaaggtcttgctcttcaaactcttctcctcacaggatgtagtgggcttatagctgaagaaaggcatatctagggtattaaatgtgttcttgcaaaactaaataagtaccctatgccgaaataagatatgctgtgtggtaactagtttttagagtatttgaagcaatgatttgtactcctttcaacgttttcatttcaggagcattttaagaagtggtttggggtcatgactcctacttcaatacagtagttagtacaatttgtaatgcttaatttgtggaccctccgttattagcttagaagacataacttgaaaccagtacggtagagtggatgaggagacattccaagatggttaagataaagctaaggaaaatggaaatgccttgcccagcgtgactaagagggtcaggaatagaacctgactcctaatagaacacatttttgagtgagtggcacaaaacaggacatgttaacaatcagaactcaagtccagccgtaaaacatatttgtatacactgttgcatattgtgttcaaatgggttatttttgcctcaatctgttccaatgcacattcctgccagaggtaggtattggtttggagataattttttctccagcagcatgcaaaagtcagggtttccagatactaaactgaatgggggtctgggccttataaaaaacgaacacatggatgggttccatactttgtaactaatttggcagcagctgacatcttagtttgtgagggggctttacaaaagttacggacctgtaacctctgcattgggctaggctcccccagttaggttacttggggatgaatagttgctgagataattgtgggtaaatgtagaacaatagcccaaacaagagacactctggcactctagtccatacttggcttttaggctctaaagaagtgatctgggtcttttttgaattataactataaccaacatttatttcagagtgatttctacatatttccttaattttccctcaccaaatccccctaaggaggtctgttaatacactaatgctatagatcttttataagggcacagacaggcccaggaagatggtgacatgcacaaggctacacaaataataaataaggattgggaaacatacatttgggtctcttgactccaatttggttgctcttttaatgataccaaccactttgaccattcaaaggggtcattgtggtcccaccagcccccctccatacctgctgagcccaagtacagactcaaaaggaatttcccttgtggctagaggatgtactgtataaaagatcaggatcccatttcacctttcctttctttcagaactatcttagctttacctttggataaatgtatgtcattagtgggagatcatctgcctcttaaattcttatctttcacaatggacaccagacttccttttaaggtgctatgtgtgactcatcagtagtttaaaattttgtaagatacatgaacattttctgattgagaaacactttagaaatgctgaacatattattgtgaaataacaatgactaatattgttgttaaattgttgaattgtaatagctttaaccttttttgattcagtctgtttattccaagttatcttgccttttaaatggctttgaaacattggcaaacaatgctggtctctcttacagatctcagtcctgcttttaacaatgacaggcagtgtattcaaaacatacctgaattggacatgacattttggggaatattttgactagtttgtaataaaagaaaagttgaataaatcagaattgattaaagaggtgatagtataccaaatgctatggtgagcaaattactcttgagaaatgcattgtttatatagatattacaatgtcatgctgttctcaacccaatcaactatataaactggagtagaaattcctgaacttttttttaactcccggggaagcagtttactattagcaattagtataatgattactatcaaatcttgccaaagagagatcaagaaaaacatgggtgcaaagtaaacatgactcctttgattttattaatggatgataggattgaaaataagccagaaggtgcagaaagctgagattatagtaaagcaggcaaatatggcacttgccatgtttatctacaagcttgccattctttgggcagtaaatgaaacagagcattaaaacaaggatttaaaaaatggattaaattatcccagcactttggaaggctgaggtgggcggatcatgaggtcaggagatccagaccatcctggctaacatggtaaaaccccatctctactacaaatacaaaaaacattagccaggcgtggtggcgggtgcctgtagtcccagctactcgggaggctgaggcaggagaatggcatcaacctgggaggcggaggttgcagtgagctgagattgcgccactgcactccagcccgggcaacagagcgagactccatctcaaaaaagaaaaaaaaaaagattaaattttaaaaataagaacaaatggtgactggagggaaaaacaagaggaaagaaaacgagcagtaatcaaaatcttgggagaattattttcagtttgattttgtgaattttatttatacaataaataataatgctaactgagggtcaaattaatctatgagaatgttataaatgaccttaaatcagcacatttggagaagtaaaaaactgaatctgtgactgaactctgtcttcatttatcataaaaaccgtacacaatttttaatcttccaatgtctcagtgacacctatttccagattagtggtcctcgaactttagtacatgtcagaatgtcccagaatgcttgtgaaaaatacggatttctgggttccatcctcaaatactcaagttcagtagatgttggttgggacccagaaagatgcaaggacttcaggacatcttttaaaaacattaatatggagaataatgagccaggagggaaataactctttgagtcagagaatgccactgattttaggaattctgaccgtatcaaatacaaattttagaatttaaatatttgttcatggtgatatattagaaatctaacataacacatattggtgaaaaaataattataaaattgtctgcagttaggtaacttggttgtttataatcaaactgtttagacaataacattgaaatagttactgaattgaacacttccttattttatagacgaataatatggagctcaggtagtcaaagtaatttgcacaatatcatgtcactagctagggaccaggcaagatatttgctctttccattcattatgttgtgttcctttcaaaagtctctataagtctccaatattatcagaaggacttggggtaagccaagaaccccattagacgataccttcggctcatgtaggaaaataaggttataggcttgtataaacataaatatacttaacaaaagcaattctacggttatagctatagaatacaccttgtctttcctctcaataaatgtcatgaaccactggatggagtgtcttagtttgttttcttttgcttataacaaaacacccaaaactgggtaatttataaagaaaaggaatttatttcttacagttatggaggctgagaggtccaaggttgaggggctgcatctgttgatagccttcttggtggtggggattctgtggcacagggcatcacgtggcggagggggctgagcgtgctaatgtgctagctcaggtctctcttccttttataaagtctccagttcccctcccatcataacccattaatccgtgaatggattaatccatttatgaggacagagccttcatgatccaatcacctcttaaagttaccacctgtcaatactgccagattggagattaagttccaacatgcgttttggaggggtcattcaaaccatagcatagagtaatgatggtaagttgtttcaggcataaaatttgaaataaattatgaggctccatgatatgctatattggttttaccttcagaagaatatttagtttcactcaggtttttcaaagctacgctgtcccccaaaaaacgaaacaaaacaaaaaaacaacctttttaagagttgatggctactcatttgatctgcctcctctgctgaatcaattaggaattttttttttttttgcctgcaaataacagaaaactgactaacagtgtaagaaataaagtgattacaaatagggatttttcctcccacacacactacaatatttctggatataaggtcattatgggtattagtttagtgactcaaataatatcactgctcagggtcagtttgtctgtgattctctatgcctttctctcatagtcttaaactgcaggtatcacattggcagactggagggaggagtgagggcagccctggtgttcctcttatcagaaaagctgaaagtgtcccaaaagcacacccctctcctatcagatgtccatcttattggccggaactatgctgcacctccattccaagaacaagagacactgaagaaaaaaatgtattgctttagcttctaaaaaggagacggccaagggataagacagttgagaagggtgtggcatgacagagtgtctgctgctctcttggttttagaaggaactcctgttattccagtgtcacctgagtacagactgggtctcatggggccactccagattcagacattcttcttttttcttctgctctaccaccatccttctagagtctgccagtttgcttccccccaccccatcccccaacaccacacagagtgactccactcccacacacacaggcattcacacagtccaaccttcatttttaggaagtcctggaactgactggcctttaggaaggtggcacaggtgttccgaggattataaaatgttttattgaataagttttctctgtggatgtccaggaacctttcctcccagcctgtttgaaagaataatgattaaattagaacaggacatactgatgtttaaaaaaaaaaaaaaaatcacaagtcagtatcttgaaagtatatcccaaggctttttttaaggtaacctttatactgaaccataaaaagattaaagacaccttcctctagaatcaggccctgtcattcacattgagattgttcagaaaaagaagagttgacacctttactgaaaggagtcaaggtcttgcaagcaggaaactggttttatgacaattccctgccttgctaggtaagctggtccacatcgagatgactctctccttgacttctgacttactttgtgtttgttggaggaatcctatgagtcatatttagcctttccagcctgattgagtttgaaggagccactggattattgcatacaatggattttgcaaagagttttctccagcatacccacaggagaaaggcaagtcggttcataaatggaaattctagacaaacaactaagctaaagacacctctctgtataaatgcttccagatggagacaagtttttcacttcactctccacagttttcactttaaagggttattgagatggaagcattggagcgaagcacattagaatcacttgccccaccttgccttctgaggaagaatgacttacggttgcaaggggaaaatgctggctaaaaaataaatcttggtctgttccccatagtctatcaacacatgcttttcagaagaagaaaaagaaaaaaaacatctggaaagaataggactgagttggtagaacatcttgaagggggctggccttcacttagaaaattgaaaagacatgcagataagccattaggaagaagagtctgtggttgttaagcagagttacctaaagaaggaacttcaagatacaagtttaaagcaacactctgtaattatttgtattatagtataaggttgttaagtttgtcttcaccctttgaaagagttctgaacagagttagtgttttcgtaaaaaatctcagggcctacaaaaaatgccatttggcctccacaataagttgctcccacccagaaagtcctctcccttctacagcttcctgtataaaaggctgggataccaacatctgcctgaagcaaaaacacatgtattttaaccaaataaataaaaaggaacaaaagtctgagtacatcatgctgctcatagtcttactggctgactcccattggctctctcactgttgttataatttcgtttatgccctaggcagatgggcctctctgctcataggtgatttagaatctgctgatagtggctggaatgaagcatggaggatctggcaacttctaagcacactggcttagaccactgtattcttgggctttgatgtttactccatatatgattcccatcaatggtgatacctgggccattgtccagtgggtgaatgtgattttcttctttggagaagcccattgcaaatcacagctaatagggaccctaatgaggacgttcacctcccagctcctctgtgccagggcagtggataacaacaggatgtgggttttaaacacatgtaagcttcttcaagctgcctctttcagtttcattctttttttaaggcactagaaaatataatccacatacttgaaacaaacattttttcttgctgctaatgttttttgtcgtagttttctcccatgtcaggagtggattccactctgattagtaccaagatatattaattggtacaatatgtaaatgaaaacatgggatatttacaaggtaggcagaagatgatatatgcttataagtttcactttcagtaaatatgaaaatgtattttattcatcctccatggttgttgttaaagccactctgctataccttggacttagcaaatgattttgatgaataggaccaaaagatgtcaagagccacaaacctatcacggtaaaaattaaaggcatttagttccaaattaatttatttaaaaagaagttgtaatatttgaacaggccataaaattaggatcaagtaagcaaatctgtaggcattttatcagagacaggagcaatgagagactgcaggaaatagaagggaatcagacttttattctttataaagttgttattccagtcctcaccatcccctttgctcctcttcccaattcattattttcctttctgttactagtaagtccttctcgtctctcctcttcttcccatcacccccaggatacacagtaaagagagaataccagaaatgggcagcactggtgagcaaagaaatattatagaggtttttttttcattccaagttttaagttgtccttgtgcatgaaatatgcacatgataaaaagggggttgccatcaatgcatattgtcttgaaaagccaagggctctttttcggtttttctctataatgaagactgttagactgtggactctataattatgctcactgaacaaataccttgaaagggaagtaattccaagtcatgtatcaaagattcaatttgacatgtatttactaaatgcctaacatgcctatgcattttgtttattcatttatagtaacaagatatagtgagttcatattctgtgccagcactgtgctcagtattgaaaaattggagtcacaagattcccactttcaagaacttacagtccaatggaggagaaagaagtatgaaaggatcaattgcagggtgacaagagagtgttccaatagtgcagatccagagctgtgattttaaaaagatgatgcaaaccagttatctcttgcttcatggagtggatgggctacaggaaatttgacaataaaacaaagcttaaataaattgcaacatttgtctacaactctactgtaaaattggaaatgcttttccacagaaaaacctctcaaaatgctgaatgcaaaagttgggatcacagaaacattgtgcctatttttggtctgctggaaactgtatttttacaaggtaatccctgttttcaatatagttcctgtcttgccactggcggttttcttgtagcatttttctagttctgagattgctactacccaaagtattcatttctttcttactggggtgtcctctgtcttcacagcctgcttctggattgtaggttttttcctttctttctgttgagatatttatggcatttgatagagtcaaaccagatgtattgcagccggacatacttatgtggcttcagatgtgtaaaataagtaacttcctatctttgtctgtctagctcaagagttgactgtggacgaggaatgcctgtattgattcattaatgtaataactatttactgactgcctaccatgtacaaccagaaacacagttcctaacctcatgaacttaccatgtaacatgggaagacaagcactaagttcttatttgtttgtaattgtgataaggctcagagaacaaatacagattcctatgaacccatgtatagggggaaatatttaggttccatttaatactgacatggctaagtatctcagtatttaagctgagatctgaaggataattagaagattcctcaggcagagggaagagcaaaggctgtgtgtggggcaggaagaaatgtggtcgtttgaggaacttcgagatcagcgtggccactgatgtgctgcagtgtagcaaagagagcaaaagaaagagagaaacagggaggaatggaattcagctcacgggctctggaatcagagtttcaagttggaatcctgacttcctagctgtatcggttaagaatttttttttgtggcatccaaagaacagaaagcctaccttactgaggttcatataaaaaggggaaattggccaggtgcggtgggtcacacctgtaatcccactactttgggaggccgaggcgggtggatcacctgaggtcaggagttcgagaccagcctggccacagtggtgaaaccccgtctctactaaaaatacagaaattagctgggtgtggtggcgggcgcttgtaatcccagctactcgggaagctgagggaggagaatcgcttgaacccgggaggcagaggttgcagtaagccaagatcgcgccattgcacttcagcctgggcaacaagagcaaaactctgtctcaaaaaaaaaaaaaaaaaaaaaaaaaggcggtggggggaaattatctccacaaaacaaaaagtccgacaataagcaataagctgtccagggctgatacagggcatgatgaggtcatcacagatccaggttctttctgtcttctgctctgcattcgtagcctgtggctttgtcattccctcatctggaaatggcggctgcagccccaggcacaatggcccgttgaggaagaagggggacgatgtgcagtgtcaggttattttatcaggaaagttcaaagcttctcagaaatcttctgttggaattctacctgggtgtcataggccagaacacaacccaaataaccaggaaaaatgtgaaagtgagaaaatagatcgtccacccctaacaatggaggcagcaagtgagaggggattgggaatgtgtgttgatttcctcaacagtgtttgacataaccactttctagctttataatcttaggcaagtaactcaacttcccagttcctcttctgtaaaatggggataacacctgaaaaggttgttacaagattcactgaaatagtttctatgctcagtcagtaatcagcattcaatcaatatgagctctaacatgatgcttgacagttatgcaacgaacagttcatgaagagctttgtaagccatattgataattttgtctttatccttagcacagtgagaaggtattaaaggattttatgcagggaagtgacatgatcatatttgtgttttcaaaagagccctcaggctgggtgtggtaacttgcgcctgtaatcccagcactctgggaggccatggcaggcggtgggcggatcgcttgagcccaggagttccggaccagcatgggcaacttggggaaaccccacctctaaaaaaaaaatgccaaaaaaattttagctgggtgtggtggcactcgcctgtagtcccagctgctcgggaggctgaggtgagagaatcacctgagcctgggagaggctgtagtcagctgtgattgcgccatgcactccagcctgggtgacacagtgagaccctgtctcaaaaaataaataaaaaataaaaaaaggagccctcaatttatcctctgcctctgacaaatatattccattttgttacattgcaaaaatttcagcacattgctttgcttacccatctttgctctggaacgacttttaattcttcttttggcaatcttggttgttttgagatgtgtgaaattagaatcatatgcaggtgtttgagttcttttgattttgctttttaaaagagttttttttttgttttgttttgttttgtttttagaatggggcaatgtaaagccagaatatcaacgtccttttgtcaagattttcaaacctatttggctgatagtacacttacaagaataggtaaaaaagatcccaaagattttacttcacttacttgaactactagccctactattaagagccacagcaagcttacatgttcaaaaaaaaaaaaaaaaagagctgcaacattcctttcgcactcccactcgcccctgaggttcttccacttccttcctatggctttttttagaagcgagtgtgtttttctcacgtccggcaacaaaggatgttttgtgctactactgaggtttgtgtgtgtgacttactttagaactctttctagaaaatgcgattactatttgcataggtctggtagaactttgtattgagtgaaagtctccgatgactgtttttgtttttgtgtagatttgccactgcttaacatcaaatcactttcccctgtgtgttttaaaatacctctaataggacctgtcaaaattctcccagaagtctcacaaattcttacctttaaagaaagtgtaagtgataccttcagtgtattgtatttattcttatatacctttgcaaagacttctcatcacttccttaaatatgtctgatagtgccataatgagaaggggacatggtaattaaccatcaactttggttttcatggagaaaatctatctggagcagtcacagtatcctatgctggagctatcagatgccttgacattagatgtttccatctaattgtaattctctgagcaaggagacaaggtgggataaacagaattctcagatggctgagaattataccctaaatcctgggagagaatttacctttccattgtcagataatatgaatcatttaaaacatgtgctggaacagctttgccttttcttgaggaaaatggggtttctctctcaaagagaaagataaatgcgcctcagaagattttagtggtcgatctctgtcagtgtactaccagcaaaaatcccagcaatcaatattacaaagaggcagcactcacttgagtacagaagtaacaacattagctgcttcgtaaacaagatggcatgggagatattctgttttgagtaaatgacaagtcctacagtctagataggaagatttctcctccatatggattttgtgatttcgtcttgtgttgagtaaggaaggggagcttggattccaagatcaatttaatgtctatattccttggcattgtcatgttagagcagcacatctcagatggctttcaatagttattttagcattgattttcctctactagagtaaatcaaaagatgatttagaaaatcaaagtcagttttccttggagttttctcagaataaagggaagctgtggtgttgaagggtttttttggctcctatttacatatgatgcaaaatcaatctgtgtgaatctctttcctctgttgagctctactataggctctactatatgcagagccttgggtatttctgtgcgagggggattatgcaaaagaattttaaggcatgccacttgactttgtgaaaccaagtatttgtttaaagagacacgatattatagtgggaggctgttttgtgagaacccacactttcatgtcagcaccctgagatgggatcccattacgccctttaaccaggcaagggactttatgcagttcttcgtcaggaaaatggagacaattaaactgcttttctcataggttgttgtgtaaaaggcagcaagatgtggctgtgtaagaacatgactgaagccagactgcttatgcttaaaacctaggtgagctgtttacacctgatatgaccttggacaagtctcatctaacttctcttgcctcaggtgcctcatctgaagatagcagtgatgttagtgtctgcctcctgcctcataagcctgtcatgttgagaccatcctggccaacatggtgaaaccccgtctctactaaacatacaaaaattagccaggcatggtgacacgcgcctgtagtcccagctacttgggaggctgaggcaggagaattgtttgaacccgggaggcagaagttgcagtgagcagagatcgctccactgcactccagcctcgtgacagagcgagactccaggtcaaaaaaaaaaaaaaaaaaagagttagtcaaggtaaagcgctgagaacaatgccttgcacaaaacatcacataagggtttgctttcattattgtgaggattagatataatgcatgtgaaatacttgacacatgtagaaggtaactattcactgttatttatatagagaactcagcaaaatgtgtagtacattttcagaacttaatgttggttgacttcattttctattgtacatgtctgtgtgtgtgtggggtgtgtgtgtgtgtgtgtgtagagagagagaagcacatatttcccaacagcataacgagtgtaattttatgggaaaaagtatttagacccaattggaaattagccaggccatacaaccaggagtgtctttgctactccgtctggtgttgaaagggtttgtattgactgggcgcggtggctcatgcctgtaatcccagcactttgggaggctgaggcgggcagatcatgaggtcaggagatcaagaccatcctggctaacatggtgaaaccccgtctctactaaaaatacaaaaaaattagctgtgcgtggtggccggcgcctgtagtcccagctactcgggaggctgaggcaggagaatggcgtgaacctgggaggcggaggttgcagtgagccaagatcgcgtcactgcactccagcctgggtgacagagtgagactccgtctcaaaaaaaaaaaaaaaagggtttgtatttgtgggcctctttttttctgttgatgcttctccaacattccaccatggatggaacctctaacacctcataacatgtttggaaaattaaaagggataatcactgcttattattcctactaccatagaaggttaaaacatacctgtcttttgggcttagctagaactctaaatttagtaatcctacttactactaataacaatacaggcagtttccagagtttccaatttacttacataagttctgtcttccaaaattcagttataaaacaagaatttgaatctcacaatacactttcccataaaaaatgttataagacataattaaaactcaggcctacctatctaattatcccaataccttagagaaaaaaaatggtaccgtagatcaccaatcatgtgtgattcatagcacatgctgtgaattctagctacagagatatctgaaacacagctacctccatgaaaattctagggatgagaggcctcatgcctgtactctaccatctttagtaaaagacaacattttgcgggacatgattttcactgggtaacttcagcctcagtttttgggcaacatcaatggcagaagagaatgagggatggcggggtggaaacagttattgttatgtgtatgtaattgtaaagactactttattgctagcgatataaaattgctaaaaactttggcatttgttttattgctccctcttctccctcaccccttaccatcactccacaaatcaaccaaagccaatgtcctaagggatactttcagttgtttcaattatagttcttcctgcaggtcctccaagtatgaaattaagaggctttcaagatggagaaatcctctttttgcaatatgaagaaaagagtttgtaatgtcattatcaccaaataagttactattaatcctgaatcaagtcgtatttaattgttttgccagtccaaaaagcctccctatttagtctgtatgcaaggacagcctggcagagaaattgaacacttgtcattttaaaatgtgtctatcacttaatgctttacacagaagagaaggtgatagtagcttccttcatgctccagagctgctggtgtgacatcaatatattcattcattcaaaatttactgagctttcactatggaccaagcactactcttctaactgctagatataaagggatagggagatatttattaaatgatacaaaattacagctagataggaggaataaattctagtgttctttagcactgtaggatgactatagcaaacaataatatattgtttcaactagctagaaggcggatagtgtatgttcccaacacaaataaatgataaatgtttgaaatgatggatgtgctaattatcttgatcagagcactatgattatatgtattgaaacatcactatgtacctcatgaatatgtacatttttttcaatttaaaaaataaaattttaagaataaaaaatttttaaattttaaacatttttttaaataaaaaagaaaagcagataatttgtctaccaagcctagatggatgtatactcataaacaggtaatactgtagtgtgccatagggtgataagtgccatggaggggattaatttcatgcagagcgggcctgcaggaagtaaaggagcgagccgtgaaactgtctggataacgagttctcaggtagagggaatagcaagtgcaaagtctctgagcgaattgcagggaggctctagcaggaccagagtaaactaggtgggagtgatgggagatgagttctgagaggtagcaggaacaccttgtagggctctgtagaccaatacgaagatttggtcttattctaagtaagacaggcagcaaagtgttttaagcagaagtataagaagatctagctcatttttataggcttactctgggtctacattgtatggagatatgttgcatagtttattgcatagttgcacaagttggaagtgatggttgcttggagctagttactagctactagcaagctagtagcagtaaaagtggggaaaagtgtggattttagatatattttaaagtcagagccaagagtagtgccaatacgttggatgtagggtgtcaaagaaagaactgaaccaaggatcactcaaaatgtgtgactcgtgcagctagaactgccatttattgagctggagggatattgttggagtgtcatttttggttactgaggaaagaagaggcgagagaactgaagtttcattttggacattttagtttgacatgcctattagacatccaagcggagaggccaagtagtcaggggaataagtaagctggaattcatgcgcaagggctggcttaaaagtgtacatttatgtatttaaggctagaaggctgaaagaaaacacctggagcagaagtatagctaaagaaaagaagaggcgtttgaacagagtgctaacactccaatatctagaggtcggaaagatgaagtggaagcagaaaggagacagaggagaagtgagggagagaacataagagaaaatagtgccccaaaaggctagtgaagaaagaacttaagaaggaggaagagtttatttgtcagataaagagtttgttgtcaaatactgccaataaattagttaagctgaagactgtaattgatcactgagtcaggtgaaagtcattggtgactttcaatcagtggtgtcctggtaaactggctctctgaaaagcagtgacaacagcaaaatcctgatttgtagtgtttactaaatttccctgtggaaatattcccatcatagtcaatttccagctacaaacagtttaacaaccagcttgcaaagttcttgaatatttaacaattagcttctgctagttgcgccacacaccaccttaacaggagccattttgtaggagtggtggagattggagtagatccataagaaatgaaatgagaattggagacagtgagtacagacatttttaaggagttctagtataaagaaataaggtgggaactgaactatgacatgtagtcaagatttttttttgtatttttaaaataaaaaatacagtggcatgtttgtatgcagatgagaatgatccaattagagggggaaatcaatgaaaaaggagaaagcagggagaattgctggggtgaagtccctgggtgggaaagaggagggggttctaatgcatagggagagggtagtttcatctccagtaacagtgtagtaatagcagagaataaaagtagccctgtccaattaagtgtaatgtgagccacaaagacaatgtaaattttctagtagccacattaaaaagtaaaacacgccaggcatggtggctcacacctgtaatctcagcactttgggaggccaaggtggatggatcacttgaggtcaggagttggagactagtctggccaaaatgatgaaaccccgcctctactaaaaatacaaaattagccaggcatggtggcaggtgcctgtagtcccagctacccgggaggctgaggtaggagaatcgcttgaacctaggagatggaggctgcagtgagcggagatcatgccactgcactctgttgcctgggcaacagagccagactgtctcaaaaaaaaaaaaaaaaagtaaaaaaacaggtgaagttaattttaatgatttcatttaacccaatatgtacaaattattattaaaatatgtagtgaatataaaaccattaatgggaaaatttaattttcaaaatccagtacattttacactaacagcacatttcagtttgaactagccagttttcaagtattcaacagtagggactatcatattggtgaaggtgggtatacatatcagttaagtggtcagatgtgttggtggaaggttgttggtgtgctgattgtttctattttctcagtgaaataggaatcaagttcatccagcaactgggagtaagaattgggaagaaggtgctggaggtttagaagagagaggaaaaggtgtgaagtagtcatgtaggagaatgaaagagttaatggaaccagaagaatgtgctagaatgggtatagcaccattggcccatttgaggttagtggtccagaatttccagtgagactaacgatgctgagtttgtttttcttcaccatcttctgcctagcagggacaggggcaggggcagtggcagtgggcgtctgcaaagtggacaaagttgtatttaaacagggtaaaattgattggaaagcagatgccaatctatcattctggtaaaaaatgctaaatttttcccataggaagtttgacctttttctttctgatctaggctttatgcttgtgggttggggtggggatataagatgttaagcaagagtgtgtgggaacttgaaagcatagtgacattttttcgtccactgaactgctatctcagaattcttagcaaattctccaaactgtttctctagagtcacttaactgagctgtctgtgccctctttccttagaggtgatcaaactatttctgaaggtttacttattttttttttgcatggtctgaatctgatatatacttgtcaagactaaatgtgtgtgttgagctgactccatatttgaggctagaaagacattaatgagggctctctgttctctgcttgtaacctgaagctgccagtcaacagaatgaatcagacagtttccagcaacacactaaggtccttatgtaaggaggatcacacgcaatttttgtctgcagaattcctctctgtataattattcttttgatcatgccacacatgaaaagaaaggcaactggagtatgaattatgtccttgtttcacttggcattaacaatagagacagggtgaggagactgtgagaactactggtctgagggaggtggttctccattcgtaattgacaaatgctgtgtgtgtccacaacggtttcctcagagccaacctcaaactgtatatattacattgaacagtcaacatgggtaactacaatcctgggtatgatactgcagtaagtgcagcctgaactgtctctactgtgcatgtgggaacagttcattgtttgtcaccaaataattcagacatttgactccattcatactttgactgaaacaatgcaggagtcttctcactggttttatactaaagagattgagcacttaatctgtagtgtacctgaaatggctttcagaattatcagtttacaaacagagtttttggatatgttgaggaggtagatcgcatgccatctcctctctgacgccctccttgacaccccaggcagaagcaatcactgtgcttgatgatgccttgtgcttccatagcattttgtatgtagttcaaccatgtccccgaacatgaaatccctttcagaacttcagggatttgcatatgatgttcttttgccttttctacttataaacacctccttatacttcagaatccaaaaaatgcctgttgaagggatgaatgatatgctctgtagaggaaatgactttccctgagttaatcactctttcttatgagtctcaacaaactttcttatgagtccctatgcttcatttttgtcacttatccagttcttaggatgtatttacctgttggtctctttcacaagtctgtaactctttccagcatagggaccatgtttcatgttgctttgtgtccccagtgcctagcatagtacctagcacatgataagcctccacgtttttgttgaatgtgaaatataaagaattaagcagctgggcacagtggctcacacctgtaatcccagcactttgggaggtcgaggggggcagatcacgaggtcaggagttcgaaaccaggctgaccaacatggtgaaaccccgtctctactaaaaatacaaaaattagccagatgtggtggcgcacacctgtaatcccagctactcaggaggctgaggcaggagaattgcttgaaccccggaggcagaggttgcagtgagccgagatcgcaccgctgcactccagcctgggcaacagagtgagactctgtctaaaaaaaaaaaaaaaaaattaggtatgggtgtgattcaggtgaacatagaaatagcttgagttagggcacaatttcatagccatacaaattcatattgaagcaagtcagcaaacgtggtgcatttcagatgaaacctcaacgtgaagatatatcagttttagaccaaagcagaagtttatataaaggatataagcttttgccctgtatactcaggaattaaactaaaaagaaatctacaaattcatttatagattatttcaatttgaggcctatagatatgtgagaaaggtttctttaaggtttaatgaccaagttccatgtgagctcttacttgggaaacaaaattctcacatggcattaatatactataaattgtgatttatcaaaacattctcatatcctatctagggtgaaatttaatattgccaataaactttccactcgaaaaaagtggtaaaagtgtgcatgctaagcatgttttgttttggaaaaaaaaaaaaaaaaaaagaaggatgactgttcggaaggcactttcctgaaggctccctgaattaatttttgcaaattatttggaaaattcaaagaaaaattgtcttttgagagatacactgagtattatattttgtatgtcagaggagtattgaatttcttgttgatatcagttgcattggcttttttggttttgcttgtattattcattgtttctacagttcagtatggatgtataatctcacatctaacatctgacattttaagatacagcatgttccttttgtttcaggtggacaaaatagatcctttttttaagtattttgtgcacatcttatgactgtgtctttccaaataatacacatttcatgttggatggcatgggtgtgtgggtgattggatgcatggatggacagacagacggatagatggatgaatgggtggatggttgaatagtgtgtgattgctctgagagtccaggtgctgggttcaagtcacagctttgttaactcactccctggcctatagcaaatgaatgatacaaacctctgtttcttcaatgtaatcatagttctgtagagtcgtaggggtgaaatgaaataatgcatgtaaagaactttgtgttataattggcacatagtgctcagaaatgttagctattattaatataataaaacaataatcgatatatatggctataaccatataaaccatttttaatttaaggatgaataattacaacgtgtagatatcatgaatgcattgattgtaatacacttcagaataccagtaattttctaatcattagagtttaagctcttctatccatatattagaagtgtaacaaccacaagcttccttatctacttatagaattgcaagcatagcttacatatgaaaacgttcttacacgtcataatagggcagccagttgtattaagcaccttgtcttattaagataccattgttgtgtgcagtcaaatgtttgtagtttcttggtaagtgcccttaaggcagatgtcttaccctccagggagacactgaggctctcaaaaggggtaataatatttcaaaacatctggaacacggtttgagccattaggccgcacagccccaagtttttattaatttgtactccagacttcactagaggaaaaagcagcacgatttttaggcgaaggaataagccacttgaggtccgcctctgaatcagtttcacaaagaaaagtccatcagtgcagaggaaggccagcggacctgagtacctatgtcgtggttaaagaaggatgactgggccgggcgcggtggctcacgccagtaatcccagcactttgggaggccaagatgggcggatcacgacaaaccatcctgactaacacggtgaaaccctttctctactaaaaatacaaaaaattagccaggcgtggtggcgtgcgcctgtagtcccagctactcggaaggctgaggcaggagaatggcatgaacctgggaggcggagcttgcagtgagacaacatcgcgccactgcactccagcctgggcgacaaagcgagactccgtctcaaaaaaaaaaaaaaaagaaaaagaaggatgactgttcagaaggcactttcagcttttctcatagttttaacatgtgggtcttccttcttggaggtatgggaaaaacagtctaagcctgatgagaaaaggctgtggatttctcaggtgatggctctcgcgaggtctgagccgcgcggctggggtctggctccgcgcgtgcctggacacgcacagattgttttgaacttgagcaacgcctcctgctagctttccacccgatttctgtctgttcagagctggcctcctctagcaggaagtgcctgccgtttaaggagtgcaggcaattcccgacagccaaccccgcctcccccgcctccttgctctgcttccttctcattggtctggaggccggccgggccttatcctcgcatttttaaaatgtcttcttttgtcagcttgaggttttccagaatttaaaagcggaaaggaagagagaaggacaaggaagctataaaagacacattaaataaactctactgggaacaagtgtgtgtgtgtgtaagagagaatgtaacttttgcaagggaagttggtagattgcttattattttaacaaagagggggtgtgtgtgtatgtgtatgtgtgtgtgtgtgtgtccctgaactggagaagcagatgtttaaaggaggcagcaggaagcagttctgacaaatgaaaggatttttgattgaattcatgagctaaagtttcctgccagtaatgcattcaaccctaggctacataaaagaaaaacctatataattgaggtttaattgcttaacttttaaacatgcaaccagaacaggcaagtgtagcttccacaggtaaacctaagtgatgctgtaagctgatttggggttattatttattggcacttcataaaattatgatcctttcccctttatcatgctcctgctttttcagtgcttgagtgccagagtctatcccttattgtctgtgtaagttaaaatccttggtgcacactttttttttctctttaagctgtttcgtgagcaggtgcagatggctttcatgaactgagccaaatgaaatgctctgtttcagcctgcagaaactaaagtttttaaaaacggaacaactgttttgtgctgtacctataattcaactggaaaatgttttcccccttttatgatgaaaactgccatctctgtttctcttactgaatctggtttatttacagccttaaggaaatcttgtcactaaaatccaccctcaccactcctccagtatttttcagtctgatgatttcacaaccagagccattgcaaaataagagtacatgggcatttttttaaaatccctagtgatttttatgaagttttttcctgtcttgtttctcattgtataattaagtaaacagtttcaggaatactcaaaacattgagagtgctctaccttttcataaatataatatgaaataaatcactttattcatcaagggttttaattttaaaccaagcaacagaaagaggggcatccacttggtttggtgcttgcattgttgaatcctcttgagaaacaaagtaaaaaagtgaattaacttccttggatcatagaaagctctagtggccatggttgtgatgaaccttagctttctgctccaatcacacttgcatgggctctcatgcaaagatatataacaagtaaccataacccaaagctgtaattttgctaatttgctgaaccctgaactgaataaaacccaaatattaatgttgtaactgaagcaaaatatgttcaaaaatagaccaaacaaactaattcaaaccagaacgatacttagatattttctaaaatgattgaacagagcaaaactagaatttcgaaaacttccacaagtctaacctaaaacaaaccaagggcccattggtttgcatcgttttatgagagcccagcaggaagtggaggacttaaattctcctcctctgttgacttccgcaatcaacactgtcccagggacactcactctggcaacaaatgttcacaggcaatacctgttatgttgacagagaagccaatagggcaaggtttcttacccgtggcactattttctttctggactaagtcctttttgtatggggctgtcctgtgcattataagatatttaccagcatctctggcctctacccactaggtgccagtagacccctccctccagttacaaaagttaaaaatatctccagacattgccaaatgtctcctggggggccaaatcaccccctgtcaaggaccactgcaataggggaatagtcgtcagcctcccacattgtttcaaaaggattttttagtagatgttggaaagagaagctgtgcactgatcttcccagaaggaccacctagtaggaaataaaagccagtctcaaagtcctcatttcagagttggtttctctgctaaagcactaaatctttgatgctgagaagacaatgtatggtactactgtgtggcagaactagtgaaaatactgtaagttgttgaagacatttgtaaatatatactataataaaaactctacctcacaacagccgatggtgttggtgatcaaaaaataattgcagaatcttctgatgacacttcaattgctgtttatcttcatattctggaaaaatagcagaagaaatagttcaacctattagtctagtagtgtttctagttcacagcatagggagatgctgtttgatccagactgcctacataccctacagggaattattatatatttgagtgctatttcaggagaattagacatcttaattataacttttttaagtttgtgtgtatatagtatatgcttctgaaatgaaatttatagttattccgtacttcaatgagacttttcatttttatatactgtaatagtacctttctgctggcagttttcatttagtaggaagactaatttgtacatcagagaattatttggaacagtgggtcttgccaagattataatgtggtaattgcatttaaaattgagctgtgccaatgcattgcaaaaataataataagcccactaaatatataacactgacacagacagttcatcagctttcttttttttttttttttttttttttttgagacggagtctcgctctgtcgcccaggccggactgcggactgcagtggcgcaatctcggctcactgcaagctctgcctcccggggttcacgccattctcctgcctcagcctcccgagtagctgggactacaggcgcccgccaccgcgcccggctaattttttgtatttttagtagagacggggtttcaccttgttagccaggatggtctcgatctcctgacctcgtgatccacccgcctcggcctcccaaagtgctgggattacaggcgtgacatcagctttcttaatatggaaaaaacaaaccaaattttctattttttgtatgtcaggaaaaacctggagaaagaataatcacagtataaaattgaacagctaattgagtttttgaaatggtttattttaatggtgatttagcattctaagacacagacccttagcttttgtttagcttttgtctttgaatgtagcttctaaattgaagtgctgtaatagccacaaagaaaaaagttattagttaatatattctcatagactgtaactgatgatgatgcctatgaagcctataagaaaaattcccttaatctcaatgatctctacagccaccctattcagaatcaattgtttccctaatttgccaatgggaatagtccagctcagaaatgttaagaagacatggacaggtcaccacaactgtgtcatagtggctgggagaaaggggtcagggggtgaagaatactaacaaatgtttgagaacttactaatatacctacattattgaccaacattcattctactctgggacatgaccaccactgctgctctatgacatgggtgctattattctatgtcctaatgatacaatagactccaaatggaaactccaagtggacagttagtaaatggtagcccccaaatttgaaaccaaggtttctttctacttttttttttcttgattcgcctgtactttgaattcaaaaacataaactcaagatacatcaattcacagtaatttagaaactctgaatcatgaaaaaagcataatcacattccagcctcagtttttaggacaactcaaactctgaacattcttgatttcgtcctaggaatctgcctttactctgaaattgacgaaaatagccataggctttctatcagtctcttctaagcttcctgagagaagtgctggtattggcaggtacagcctccaataggggtcaacagctattcacttccgtctcttctactgccatcactcaaggaaggaaagaaaagccacctcagtgggctggaacctagagctttttctgtctcctcccaagtattaaatcattcaaacctaacactatataacagccatttagagaacagcaccacatttactttatggcagccagaaggattgggatctgttgtatcatcatgttaaagtttaggaaagtgagtatttaatggaccaattctgactttaaaatgttagtgtgattcccatctttggttgcagctgtagttgtttcaacctgtcttttccctagctggcaagcttgtgcctaatcttaggttcaatcctggtgtcacagcttgcttattacttggactttggccagaatacctcttcattttctattttctccacagacttctgaaacccaaagtggctacttactcctttggacactgatccttcaacaaatccctttttaaattctctcttgcttagttctgtttctccaagaagcttccatcaactatatttcatcagtgactcaataatgttctaccccattttgtaaacacattatttatctgacaagctctgttcataccagacacttgaataagctcacatgcctctacatagctcttctagtaatttctggctcattaaaccttagtaaacccacttctacatatcatatcaataaaggaagttttgtctgcagcgataatagctacaatgggatcaaactttggaaaaaagttatcgatccaggagctaaacctaaatgtcattgtgagggagtttgcaaagtgaaaaccatagcaatcatgggaatgctgcagtagagacagcaaagtttggactcacagcagaaatttcattcaaaattgggttctttttctctggtctcacaaattatttccagaggttagccacttaaggaaaaataaatcttgtctcacttgcaagtaaagaatgtgttatttgacttgaaacataacacagatacaccttggctcagttttgttttgtgtctgatgagcttaatattgctctcctcctttatacaagcccttcactgatttcatatgtgaggtgtcctagcatgaaatgcttaaatcagactctgtaatagtgtaaatggcagttttattgtctcttccatattaatgaaacccccaactaaacaactaaagctctgtactaattgcttgtcctgagagctgggtatttcaggtctaattctctttagaacaccagctggcatagagtatacaaaagctcctttggttactttaaccacttaagtactaatttggtggcacggaaagcattagactttgtccatacaggcagaacaaagcagaatattgagcaatttttcaaattttatcaatgtagtaagtcagctcagttgatgtttctagttaaaacagatgcttgagttgtcaggatgcattcaaacaaagtgtttgttaaaataaacattagcttagcagattcctttcattgcatcacattctaaacaatgagcaaggtgtaaactctggaaatctgtgagccttgaagaaagtaggcgtgcataaaagattatgtagttttccgaatgtgttgtatccacagccagattcaatacacgacaattacatattacattaatgaataaaagtttggtctgcagttgcctgtgacacaactatcaaatctttcaagcaatgtgaaagctgctatagattgaaaaataaatattttttggatgtccactatgtgcctaacagtttgtttagatattatggaaacacagcttcacttatcgggaggtgacaatttaattggagttagaaaatcaactcctgtgaaacaattataaagaagaaatgaaatgtattatgtggtacaggctattagagccaaggataataaggtgttaattgtgcgataggcagtaagtctcaaaggagttaaggaaggtagagatcaacatgggctgaggtcatccaggaagactttcaaaacaaaccaacaatttttataagccccttctatgttcaaagctttgtgagggcgagagagaagtgtgatcacagagatgggacttaagcaggatctgagaggatgagaagaatactgactggccaagaagagaaggtaaattactataaaatacagaactcggggaggggaccggacaagggagaaccatagctacaataatcagcttaacattgcagttcttcctttgaaactgcttagactgatgcagatatgccagcttagattttttaatccattttggctcatgcttggtctgcaaaatattagcatccagttcagaggtttctctgtcagaaagagaaaagcagacagtgctgttctttgggattttggaagatgatctagcagaaatgatagatggcactcactagcatctttttcttgcaaagaaaagcacttattgaaaacaaagctgccagccaaactatataatatgtggtaaaggcagagagctcagtataccatagatatttactaagaagacagtaaccaagctctgaatgttatctgtagggttgataacatccagatatcaatgttattatcaaccctccagattgatgacatataacaatgttatatgttaatatatattctctttgggttttataaaaactctcaagcggcttcatttgatagactctcctttctgttttaaaatctaacattttaaagtgagtacgcattcatggtgctttctaaattccacgtatgcatatttctattcaaagtctcctactatggagactaagaacgaatgatttctggctcagagactcaaagataccccaaaatacctttattttccaggcagaaagaatgtgggaaaaaaatgtttatttgaaagatacagactttcgggttttaaaataatagttattagaactgaggtctagtgcattttctgatctctatttaaagctccgtaggtgattttgtttttaagataacataatatctcaaatcttttattctgtcaagtagcaattgcaaaagattctttgctgttgtgaagattttggaagagaggagacaattcttgctatactatcatttctttaatttggcagctttatgtcatatgtctagaaagaagttgtgtaatgctgcatatgccagtggcacagaagtttttgacagtgagcagccccatttctattgaaaaaagaaagtttcgcctttgtcatgaattcaaagtgctccttcagtgggatgactcctgtcatttccctcagggtcccagagcgacagaggaggtagagcactcacttaccaaaacatgacagaaaagagcattcatctctggcacaagtgatgcaatgcatttcttgggaagggggtgcagtgggcagatgtgctgccttgtctaaaacagattttactgctgtttatagttctctctccagctctaacccgcagctttctggtatgactgtgatacagcagcaaggggttttactcggtactgaatgcttgaaataatgtgaagtgtttcagtgtaaaaccctggtttacattgaaaaagaaagtgtacatcttacaaaaagaaagatgccttttttaattgatttggattccttttaaaaataaactccttttaaaaattgagaggtctcaatccccttagaacacagacatttaaagagaattaataaggaatagatgatcaccagggccagccctccttactttacaaataagaaaccaaacctgaggaaagtaattactggcccaaagtcacatagaagtttactggcaggatggagtgagtctaaaatcaaggtctcctgactttcagttcaaaagaataatagaagagggaaatcattcctctagatcaggggtcagcaaacttgttctattaagagccagagggtacatattttaggctttgtggaccatatgactattggcagctactcaactactcagctctgtccttggagcccaaaagcagccatagacaatacataaacaaaagagtgtgtctatgttccaataaaactttatttacaaaaacagcctgcaggccagatttggcccttgagtcatagtttgctgatgtttgctctggatctaaaggagaaaataagcatggaagtctcgttgggagcttctttatgagccacatcccaaacttggtctgttatggagaatgtcaatttttcataggtccagagggtgctattaattagctaaaattgctctgactcaggcaaaactgactctttttatagccttcttgagaaaaggttgtttatgagaatttcaaagtattgaagagtcatttttcaggattgtctttgtgtcaccattgttccacttaaatgtgaaagatttatgtttctatattccttttagaagttgaatgcattcacaacagggtgttccattatcagtgttagatattgttcacttatctcttaaaaaatttaagtacgtatctttttttcagaaacacaattccagagttgtggcttaacagaagttaaaaaatggaaatgaagttaagttttcctgaaaggcaaccatatttgtacagcaaaattcctcttggaccataaagaaagcttgaaggtgttttttaattttgcaagtatgtgcatgcatatgtgtgcttgtgtgtgtgtgagaaagatagagatacagatagaaaaagagacagacagaaagagagggagagacatctctgggagtgagtcaaatggaatacctacattggtgactgagtgtcctggaattaaaatctgctatcccatttttaaaatgtatgtatgtgtttatttatttatttattttttgagatggagttttgctattgtttcccaggctggagtgcaatggcgtgatctcggctcactgcaacctccgcctcccgggttcaagtgattctcctgcctcctcctcccaagtagctgggattacaggcatgtgccaccacacctggctaattttgtatttttagtagagacatggttcctccacgttggtcaggctggtctcgaactcctgaccttaggtgacccgcccgccttggcttcccaaagtgctgggattacaggtgtgagccaccatgcctggctctgttatcccattttaactgcttggtgtgttcaatgtctcaaggtatattggagttagatcagcgtaccctcacttgggcacacatacagggttctgctattccatatgcataaatgtttgaaaagtgatcctttaggaagtatattgtttttgccagtcttaatccagaagcaagacttaaatataggatggaaagacataggatggagacagtgctgactgaggcaagaaatggagagagggctggatttctaattttggaggcccacctggccaccacttcttctgagcaggtgcagactacttcttcgcttcttctgtttcatctcttcctcttgttcttcttcattcacttcactcctttttctaacactgaataccaactacacggcaggtgaaagaggtgatgtatcacaactggcctaggagaaaatcattttgttttctatttccttcatctcccatatgccaaggtattataaagaatgggggtcaggcatggtagcttatgcctgtaatcccagcactttaggaggcagaggcaggaagatagcttgaaactaggagtttgagaccagcctgggcagcacagcaagacccctgtctctacaaaaaatttaaaaattagctggatgtggtggtgtacacctattgtcctagctactaaggtggctgaggcaggaggatcgattgagcctaggaggttaagcctgcagtaagctatgattgcaccactacactccagcctgggtaacaagagtaagacactgtatcttaaattaagaaaaaaaaaaaaagaatttaagagtagggaaaacacatgaatgtctgttttttttcctgacataaatgttgcatttttaaagataatacttttatctatctgtgaagattgttttttagagtgaatgaaagaaaaattatttaaaagtttcttttactaggaattatttagtaaagcctcctttcctgtggtcatgttagtctctagaacaaatccagtatcagtataataaataatttattgtactctagcactcaaacttgcttttctattggtgacagatattgttttttctttgtttgctttagaagtttgtgtaaatgttttcattgcattagtgacagctttaaaaaattggtcttaagagcaaataattagagtgttaatatccttctctcaaactagacacatgataggatattgggattcattttattttattttgttttactcatgctcacagatcagggcttaaataagaaggctgatttcttacttttctcatcaattttcaggtttcattttgaaggaagtaagagagtatgttggcccaatttgtggttctaatacttcagcaatgcggtccagcattctggcctccatatctgtgaacccacattctcctcttagaaatgccctccttggccgggcgcggtggctcacgcctctaatcctaagcactttgggaggctgagataggcggatcgcgaggtcaggagatcgagaccgtcctggctaacacggtgaaaccccgtctctactaaaaatacaaacaaaattagccgggcgtggtggcgggcgcctgtagtcccagctactcgggaggctgaggcaggagaatggcatgaaccggggaggcggagcttgcagtgagccgagatcgcaccattgcactccagcctgggcgactgagtgagattccatctcaaagaaaaaaaaaaaatgccttccttttctttccacccacccacatcctacccagacatcaagttccctcttaacaccataggcctttaggaagctctccttggataattgcccaccacagtgatccttattctctcggaatttctgtagcacttttagtttatgccaaacaatttctcacttaattatatgttctcttggatcactctctagtggtttaaagcatagtgttacgcacataatctgtgcagccgtttgaagaaaaggcacgtggctcatggaggagccaaagacgtgatgcttagggaagaccacaagtacccatagggaggaatcatcttggggggatctaaatttgcccctcagactcacaagcacagtgatgtgaatggcaggataccacatgttactacatcagccagaggcaaactcatcttcctcggattcatcagattgattctaatttattagttttcaaaataaaatatccctatctagcataactagacacctacgtcctcaggtaccttcaggtgagctctttgagtttagttagaggcatcagaactcttggtgagcatggaatcaaggcaaaagcgactagtcaggtgaatcacaggtttaaggattagaacaagaagattggtgacatattttttaacctaaggagattcctgcccacaagactgggtaggtagtgtccttctgtacgatgagcttggatagtggacagtgcttccttgactgcttactgtcctggcaaagtgcttacttggaggattactctgcagctctctcattgttcccatgagtgaccaactctctttccaactcatacatttgtttttcataaggtcttaaatatagtcggcagtttccagtcaagtcctattctctttcagttgagttttacaaaaatccctctcttgtatgtagaacaatctcatttctgccattcccaagtcctcagggtgcatctcattgtcgtcttcctttacatcctacagtaggtaccactaaatattacgtgattgattatctcccagctccagtataaaatccttaatggcgtaggctacagaaacatttattttatcccacatttatgaaacaagcatatttagcatctactgtatttcagtattattcaagttaataggaatacagaaatcaatacaacgcatttcctttctgtagagactttacatttaaaagacaggtgtgtaaaactagtacaataaagtgttttcggagttgtgagggctacagatggtgatacacgaaagaggaaataattttacctgtgggaatcaggagagtttttatatagagagaaatatatttattaaaaccccctatatatgattttttcttataaattattttagataccaatccagattattcaaatcttgacctctttctcattcacatctattcgcttgtcattaaatactcatgcctagtctaagtttggaatgaaaatgtcacaagacatatctttcactatttcctgatttactaaacatggaaatgtagctcaggacctgagcatttagtcatctcatgtgaccatgaggacattaaataaggaaggaaatgcagaagtgagtgtgatgatctcttacaacaccgctatttgggtagagaagtagagttttaattagcgagacaagtgtcaaatatattctacacacatcacagcacattaggcttcgtattgttccctcatttcctgaggactatttccaaagataggtatggatgaaatcagagaacgttgggactctataggtctcagactggccagaaaagaatcaacataatctgatgtgggctgtcctggaaatcaggaaactcaagaggcagtcatccctacatacattttagtaaattatttaacatttctgtgtattcgtttacccatttgaagaaagggagctagtatgtctagtcttcaactctgcatataggatgctataaagtagttaagttacaaccttgttcttctaacatttcagctgcttcatttgcctacatcaaaaagcactgtgtataaatcattgaaaaaagaatatgtataaatccttaaaagagcagtaagtgaagtaatgcatttaaattgagaatcaagatgtacaaatatatatagatatatacaaatatttgaatgagcaaaacatataaatctttgaaagaggtattaatgaattttgatgtatttttataaactgaaaatttttgcacaaatgttgtcatcatcatactcatattctatcctagactattctagactagccaggtctatccatattcatcattccatattctaaatagctcaggattttctttctaaaaatgggaccagggacagtcatattgtgggaaatttttcattaaacatcccacgtttcgttaaatgttttttcttaaagctgtttcaattttcagcttatcctattgaggataacaattctgaaaacttaacaactggtgttaagtttaataataatatttgcataccaaacatagtacttttctgtgtaagaaaaagtttcactggttctaggataccaaaatactgcaaattgatttctgttttccatatccacacccaccttcctgcttttgatatctgtctggtattttgcaagacagaatgttatgtgagagtgagcaccaagcaatgatatttctctgcagcccaaagagtctacaatttcctcaaaatgtgagtaatttcaaatttatggtattgccagttctgcttttatactggtataatgcaatgaagtactcattcagatttttattctctgttggtttgaagaaaacatttagaaattcttaaatgaatcaatcgatatgtagtcaaggcaccatggtagcttctggggagatcatgtgattatatttctgtatctaggatgcttgcagtctggttagaaagactagccacattgtgagaaatgctttacaacatgacacacgaggtagtatctggtaagggatcctctaggtaggtagagagtggagattcagagggcttcctggggctccaggggtgtgaaaggccttgggggaagagagggaatctctgcaggatctcaccaattgttttcagaagaaaattaattagaaaacactcttacgtataattgctgttctagaaaatggttacaatttacttctttaaatgtttaacaacattttaaattatgtattgttttctttttgccattcattcatctcttggtggtttggggtgtgatttgtgtttttcccctctcttgacttatctgagaaattctggcactagccaggtttgggatgtttttgttcagacattcttaagttatttggtaagaagaaaggctttgttgcatttttctgctgagaaacaactttctttttctttgtttcaaccctgaacttcctaaaagctctttatttctatagattgttctacaaagctatgcctcaggaggtgagagactagggagcattttttttttgttcaactagaagtagccacattttcagaaaacaactaataagtttaaaatatgtcaaagataactttacaagagaccgcgtgaacatagatatgtaaaggagagcctagtgctctcaatgcccatatctgcaggcctcaaaattgcttatgaagtctagaaaccatggccatctgccagccggaggcagcatcaccacaatggaattcacagtcactctgttaagactttataaatacagtgagggtccaggagccaggaccttcaggcgcatgaggcttgtctggtctggtctggccgactgagcaaggaaaccctgtccttgaatgaggacttcctcagcttcagtgactaaatgtttgttctcaaaagtaaaatgtcccaatggaaggtggacagcggccatcttcttattttatttgtttatttttagccaggcactccattagttgtggcaggaagtcatcctgagaggaaagtcaaggtgtatgtacatggttgacttggggaaagtgtttggaagttggaaaagtggaaccatttttgagtgtgacttcatttctcttctgacctagctctacacagtgtcatatcctaggaactgggtgctagcatgaaggagaaaagcaagataaattaaagagctttacctctagatagtaataggaaaccaagaatccagcctggtgatggctggagggagtgattgaagttagctgatgccatggggagttagccaggcagcaaaaatgtctggaaacccgatgtggccaagactgggctgtccagaagctcatcagagatagactcaatcagtactttctctcccaccttcctgaacaagaagaaaaaaatatgagagaattgagtttgtagtgttccctttttctccccccaggctggagtgcagtggcactgtttcagctcactccaggctcagcctcccaggttcaagtgatccttccacctcagccccccgagtggctgggactacaggtgtgcaccaccacgctccactatttttgtagtttttgtagagacaggggtctcactttgttggccaggccggtctcaaacttctgggctgaagcgatctgcttgccttggcctcccaaaatgctgggattacgggcatgagccactgcacctggccgagtttgtaatgatttcattcgatggcgacagagacataaataataacagcagcaacaacaataaacacttgttctctgccaggtgttaagcaaaacacattgtatgccttttctcatttaaacttacaacaaccatataaggaaactactattattattatttccattttacccatgagaaaactgaatgaatctcagagaggagcaaactatgtcaaaagtcacataattggatagtgagattatggtgtttgtactgaaatatgtttaacttcagagctcatgctctgaacacatactatactgctcatttattcatttattcacatatatattgtgcaaccacagtgtgccaggcactgggctgaaacaggaggatgagagaaccactccctgcattcttggcatgaaacttacagtatagctgtgaatgagacttatttatgaaataatcacataaatgtataactgtgaactatgaaaagcaatattaaggaatggatcactacaggattatgcgtaggtactagggtaagtatatacctattagaaggaaactatgaactataataagtgatattaaggaaagtttagagagtcagaaaacttgatataattttagggagtcaaggagaacttcccgaagaaaggggcacatgctttcagatctgaaggattaacatgatagctaagcagagagaacttgctgggtagggaaaggctagcaggtacaagggccccgaggtaggagacagcttgacatgttgctgattctgtgaatacttattgaggcatagtgtagctactggtttgtcacttttgttgtgtttcatattcctccattgaacgtaacattttttactgtttcactaatgaattgatgtgaagatattctattttatgcagttttgatttgtttgttttctgctaattttatctgacaaatttaaagtttttaggggaataagggctacatctgtcattgctgtatcacagtttctaagatggcatgcagtttaggtacttaagtgcatttttatagtaaagaataagaataataataaatgtcaattcagagactaatagaatttagttgcttttagctgatatgctcaattaagaattgacactgtctgtaaaaatcttatctttatatataatatgagctaggaaatagattcatttctaatttttgctaagtgaaacattttaatattccttgaaactaaatggaaaattttccaaagtaatgcttggcagtttggcatgtggagaaaaaaaatctttcctctagagcagcttttccagggaacagattagaattaattaggggatgttttactaatggaatatttttcttcccattaatgtcactgtccttcatgcctgaggatggcattattggcaatgattgctcttatgtgtgagagactatatagacagacaggccattgcatagaattctatttgtcacacaacctgagaccactgtctttagtttcaaagcctgaagctgtttgtctggtctggcattgtttgggaccttacctgctaaaactgtaattggcccagagtcttttcttgaattccacccaaattctttccctgtgacataaaatcattcttaaataactttttaggcaataaagcctcctcagattcaatccccatgctatctgtggtggggaacactaggatattgagcctttaaaaacatgcaccatatcttatttgtctttgtatttctaagatgtagcatagtgattggctgataggagacaataagtatttgctaaatatgtaattaattgaatgaatggtgatcaactaaaggtgggttccagattacaatttttgataaccagctcaaatttccttgctaccttggacattaatgatcatagatttaaaactatgaataactacaatgagaatgctcgtacgatctctgtacaatctgtattggttatctaattttttttttttgagatagtgtctcgctctgtcacccagggtggggtacagtggcccatttttggctcactgcaaccttcgcctcccagattcaagtgagtctcctgcctcggcctcccaagtagctgggactacaggtatccgccaccacgcccagctaatttttgtattttttagtagagaccgggtttcaccatgttgctcaggctggtcttgaacttgtgacctcaaatgatccacccacctcagcctcccaaagtgctgggattacaggtgtgaaccaccatgcctggccatggttattattctgaataatgaattacctcaaaattaattaacatttattaccacatatgctttctaagagtcaggaatcagagagcaacttagctgggtggttctggtacaggtctctcctgaggtagcagtcaagctgtatgctggggctatcatctgaagcatgaatagagatggaagatctgcttccaaaggctgttgacaggtgacaccatcatgtgagcctctctgtagggcagtttaattgtcctcctgacatggtggctggcttccctatagcaagtgatcaaagagagaaagcaaaaattaagctgcatggtcttttatgacctagttccaaagttgcacaccatacttccttcccctctattttgttccttagaagctggtcactgagtcaaacctgcactcaggaagaaggtagttttcaccttttctgaaaagaggaatagcaaagaatttgtagagatttgaaaacactaaaatacctaaacattgaaactcccccagagtatttacatgaattgcatgttttctaaagtagtgcaatgtatcacaatgttcaatttgtcaataagaagtgcttttagacaaagtgcttttcctggaaattagctaactgtcttaaagtataaataatgtcattttgaaaaaaaacaaaaatccttgtaaccatgaaaacaagaatcaccagtacttgaagaatccaaataatgacctaattttgtttttattttctttttattcctctgaagtagattcaacaaattcaagtaaagaacattatgtgcatctactttgtgccaattactatgtcatgtgctctgggaaggggatacacttatgcagaggtgacaaagatataatctgtcccagagaagctgagagtataacagagatgatggacacatacacaaaacttaatatgatatgaagctcactgtattgagttttgtgagagagctacagaggaggtgttatgggggcacaaggagaagaaagttaattaacattgaaagatgagaagacatcttggaagaacttgaattgggccttggaagaagaacagccattcaaatagatagaattgtggtagcaaaggcatagaggtaggaaagtatagatctccagggacagtagtcatggggttggggcactgttggaatttaaggttggaaggatatattggagccccttgaatacggtaacaaggcacaccttgggcagtggagagttatcagagtgtttgaaaaggagggttattgagtaaataaatagactggtactttaggaattttaaaatgtggatcattgtactactaataactatttattttatatttactatctactaagtaatttacatgtattttcttgtactgactgtaaaccttctgggtgtgggtgttttaagtgccattttactgataaagaaactgaggcttaaatagttgaaataagtcaccctgttagtgagtggcagaatgacaagtcagatctagggttgtctaactccaaagataatataaaataatgtatctctcttttcccttatgcataaaatatgggagcatattaaatcatacacatagattgtcaaaaaatactttgggaaactgattataatatcaaataattcagtgctgctgtctcttacacttttatccctatctgtaaaacaaactacaaattgagagagtacattccatagcttgggaaaaaacccaattgtgttgtacctaaactaatcatcttaaggcagtagttcagaagaacagtactactataagcctcagaaagaggaaactacctgggtatggcgggtgggagcggagagaggatccgaaaaaaatacctatcgagttctatgcttattactggggtgatgaaattatctgtacaacaaatctctgtgacatgcactttatatataatacaaacctgcacaaaaacctaaaataaaagttaaaaaaaatgacaatcaaagaaaaaaagaaaaaaaaagaaaatacctggctggatctaccctctaacatttttaggactcagggcaagacaaatgaaagcctacatactatgtgtctaaatattaaacattataaataggctaacaaatggttaagtaaaatatgctttgtctttctaccttgacaaataaatgttgataatgacaaaattgaaaaatatatggaaagctgtcattcttgaagtcaacaaaatgtccatgatgactgtaatcattattgtgtacatctgaatattctgttgtggggttggtgatgtttccatgagtaataaaattaggtcatacataattaatatattattacttaatctgtaaaatttatttttgctttcatttctgcaattccctaattatgttgttataatgacagttttcatataacgtgtcttctattgacagtaatgatctaaatattagattctaaagtattaaaaatgaagtgtaatattaaagtacacacaatttgaatttattttcatcaaaaatgtaaagtaaaaataaaaatccaaaactaaaggttagcttttgtgctactaaaagttttcttctaaaatcttcagttttctgggaaaaaaggcaaaattcaaagtataactaatgaatataacattcaaataattatttaaatgaaacaaattatattttttgaaaatttaaatcacattaaatatttttataaaaataaaactggtagtaattctagtgttcaatggtgatccaattaccaaagaatccctagcacactagtcactactagacctgcatatatttaactttaagggccataggaattgtttaatattacaagatgttctttggccacgatatgcaacttttggggttatcaaggtaataggtgagtacttctggagcatcgaattagaacatgaaaagaagtagcaaaatggaagcttggcactcctgggaaatgatatctcattatcccttgcattcgtgctgagaggaaagacttgacaagttaattaatttgtctttttcttaactgagtgcttctgctgctcaactcctccctgctctctaaagaagtgtccttctctgatatgggcagcatcacaatccagcctcaaaagaagccaccttgggcttccaagacacaaagcaggggatatggagaggtgtctgcactagagtctggatggtgctactgacaacagtgagtgttcagggtgactgctagtgctgtgcagtgctgagcgccacattccatgggaccacgtgtcctttaataaacatattcagcgtgcgcttatggaactcatggcttctaaagcacaaggcgtatgtttcaagcatagtgctatccctgagcagcatttgtaagcctccagtctgcaacagtgggattacctaccaggctcagctgatggaccgggatgatattggaagagaggctgccagcctgaagacttacctggaaacattttctcgttggtctggttttaataaaatcaccagattccactagaaggaaaccaaagattacaaaggtccaaattaatatatgacaaagtagaaacggaaactgggaggaaatgaggtgaaacacaggggatgatgtattggaaatagggaatgaaaaccgtacagagtagaaacacctgaaagcagttctggaaactccacatgctcctgctgtaccaagacctggtcctatgtgtgctgaccttgttcttctgctcacatctgccacatctgcaaatgtggcaacattttagctgttttctattaacactgaagtactctgagagcttggaaattttcaagtgcaaaatcaggtccagagaacagtaaaaaaaaaaaaaaaaaaaaaagcttgactgaactgccactcacatcttccctatactgtgcagaagcaaagagctcaatactgattttggttttgtggttgaaggcaactgctatgaaacttcttaagtggttcatagttgtccatattttatccttatgattgaaacaatatttcctgctttccccagagtaataattttaaaggtggggtctctaacctcgggtatagcctggcctccacagtgttacactgttcccaaaatgacaggggatacaaaacagatgggtcacactgcaggctgcagaagtgggattttgttcctgaagacaaaccccacactacaggaaaggcccagcgctatctctgagtcttgataggtttggaatgactttaaagttattaatcaagaagtgaataggtggaaacttgggaacatgtccttctctgtggttaacagtgggaacagcaaggctaattgctttaagtctaaataatcagaagctgtaaactctgtcacccaaacttccagtttatgtcactggctttctggaggctgcattacagtgttgtggtggtgaaattattattaattaatgaccatagtattaataacactatatactgtgaacttattttatagtaatacatctcctcagtgctcaataaatacttgttgaataaatactttctcattagttggttcaacaaatgcccattgaatacctgttatgaaaaaggcactgggtactgatccaaaaatgaatttgttttagccagagtcttccaagagattagagttttacagatattatcctgatgaatgaacaacccagaaaggcatcctcctttcagtttgatgatgctttttttttcactttttatataaaagattttgaatttgctattttgaaaaatccagtagaggtttcagaggatgtatttgaaacttgtatttttttaaatctatgtctgactgttaaggaaattgtacttttttccaagttactctattacctataatacaaccagaaataaaatgttaaaaactcaagctcatgcatacccaaggatgacaaaaaaaattctgcatgtataagaacactttacattgcattttgtaacaacttgcaaagaagataaataatatgtatgactccagattgcagtaaacagactcccacttagcttagcttttaagttatgcaacttcctcactgatgacttagaaaaaaataaagaggcagcaaatagtcaataaagagtaaggcaggaagcatgtgctgactctgagtcccaggagggctcaccatgtccggtgccactagggaaacaaatctctaaggcagttgaaattttcctgcttctcacataatcccaagcagagcacaaggcagtggcttaaatctgcaggtttaaaggagcacagagaaagagaaataagagaatgaaatctgtaccctaagagagtgaaggagggtcactcatttgtttacaggcagtgttcccccacccccttctctagacagcaaggaatttggagcctctgtcaactctcaggcaaagatcctttgatcaattcacgtagggcctgataacgcatggacactgtgggagattaaaagaagatagtaatattaatataaagatcatggcaatgataacaacatgccaccatttagtgtctttgtgtttcccaagagttaacactatacatgcatcaactcatttaatacaacatgatgaaatagtctcattttactgagggattaaaaataataaactgatggctgagtatgttggctcacacctgtaatctcagcactttgggaggccgaggtgggcagatcacaaggtcaggagttcgagaccagcctgaccaacatgatgaaaccccatctctactaaacatacaaaaattagctgggtatcgtggcaggtatctgtaatcccaaatgctcaggaggctgaggcatgagaaccacttgaacccaggagggtggagttgcagtgagccgagcttgtgccactgcactccagcctacatgacagagtgagaccctgtctcaaaataataataataatgaactgagactcagaaaagatgtttgttcagggttacaaagctcagacaggacagggcagcattggaaaccaaaattggtctgactcctaggctcatgctgtaaatcacggtgcaaggcttctactatctatgtttttcctaaaagaatgtataaatgaaaagatggttaacatattaagcaaaatatgttaaacgtcaaatgaactgtataaacgataaatgctggagagttgaggtggcaaagaactcatgcccgaggtgatctgggaaggcctcttgaacaaggtggaattatagctggtttttgaagaatccgaaagtgcttagattgaaaggtgagacatgtacaggaatggtttctaagatgtcatattttatctctgtcctcatcttgactggcactaatgaacatcaaagatttcaacctaaatacattgagtgcccagtatgtgaagggccttatttatgttgttttaaagctttttaacatactttaaagaagggactggttaatctccactgtctagatccattagacccggagccggatggccccaggggcctttgggaatggcgtggtgggacagtctccacttttgcacatacccaagaaaagaatggtcctttgggaattttgcagacctacaatctggagataatgtacttctgatcataattcaagtgcccccagatatagggttgccagatttagcaaataaaaatataaaatgctcagttaaatttgaatttcagataaacaatgaattatctttcagtacaagtatgtttcaaatattccatgggacatacttataacttttaaaaacttatttgttatttatctgaaattcaaatttgactgggcttttacattttatttggcaacctacccagtcaggaattggagggaaaattttgagatttgaattttttggcatacataaatactcttctatgtgaagacctcaaataaactaaaaaacaaaaagaaaaagtgtcagtattatacattcccataaaatatgctccattttaaaatgagaccaatggggcaggaagttacctcacaaaagtaattttgtggaaataatataaaaatctctgagtttttatactttatttattcaagaaattctggccttaaaatagtagtcagttgacccaagtaagtcacttgctctgcatcaagataaaaatgcatttcatgctgtgtacgctgaggataaaaaaagacatgctgaaaactggatttccaagtagtgcccctattaaagatgacaattaagtggggttcaccgaggatgcatggtgccttaggattgaattataagaatgatgattgtttttggagttggagtcaaatatcagcctttaaaccaagtcaaagccagggttacagctgcgttacagctgccttctgtcactgacactgctgtggaaaaattcaaaaggcacaccaaacgttttttctagtgcatttttcaaagcaacttggaattagtacaagtacctcgacgcagaaagcaaatgtatttacctatgtaatatcaagcttgcctggaatcatttagtaggaaaaagtattctgcagagaaatgtactttgagagaatgcaaagcatgaaaggtaaattggagtcttgaaggggggattttaaatcacatttagacataaatcctttcaggtcatgattcccatagattaccagcatctgctaagcctagatagttcataatcactaaaattgtcgtaatcttcctatggaaggtttaccaaagaagtactgaattacactgggttaatacttttaaggatgaatggtcaagacgatgatgctaaattaatgcagtggctacatagtaaaatctaatactaataacatatctgaacgaagctgtggtttcaaaaggcgttcactccatcagggtaatgtattctcaggtatatgatcaactagaaagttgccaaccattattcaccttcacctactcctacaagcttctctgtcctgtcttattcttttctactgtcaaaaagagagaaggacttaaaggttgggtctgtaaaataggaaaccatagagcaaaaacacagataacacagtcaaggaagatgctcgaataaattatcggtggacagtgttctctggattgaagcatggaatctaaatatggtgtctcatagagtctactgacataccacgctataagtggaaacagtgcagggcagcatctagtgctgtgtgaactgtatcaacagcaccgtggagtgacagtcaccatgtcctattatatttttggttatttagatggacagtgcatttgcgcttgtgcagttacttttagtaaatgcacaggagtggcattctcactttccttcactgcatttgcaaggatcaagggaaatatttccagtgacatggagctagtaaaaattgatcaattgtgaaatagctaagcaaatacttgttatactttaataggaacagcagtgtaacatgtaatgagcactgagcaaagtatgttggatgcgcttatgcatccactgaattcgaacatattggtctgcttcttcattccacatccccaccatcctgctctcacactccctggtctccagtcatattcctaattctctgaatactttgcttcatggcctcttacatacctatttgcttgtgcacctcctcctgcccctggtggaattacccctgccctttgtctcctggtgaacctttgctttttcaagtctcaattcaaaagtcaccctgacttctactccccagtgtcctacccagagttggatgcccctgcaccgtgttgctccagccctgaattcacaccctctgtgagaaaacacattacgttggcttctaatcagttgcttccctgctttcttctctcaatgggctgcacgcttcctgagaacagggactgagtctctttctgcttttcattttcagaacagagtgtctgtaatacacagcatacctaaatgatccataagcattttattacaagtaatctggagtgcaccatggcctggacactctggggcagtatggataaatagaataccaggaccagacatacccatgtaaaacttccaaaatgtctacatgtaaagctacaaatttaatggtaccaacaataaaaattggtgcaatcaagagaagtgaagtaaaattctctgggaagaattgaggaaagccttatgagaaaggtgaaatttgaggtgggacttaagagaggcattaaaatggaagaaagcagtggcttcctcttcctgggagttcatcagggccatagactttagggcagaaaagtcaaactacagactgaaaagaaaaggccaagtatgaatggagggtttaggttgaggagtaggctaagatcttcctggttcttccctctgtgcaacactgagaatctttttcctgtgtccaattttacatcttcttcttctggtttaagcatgcctaaaagagattaccaactaccaacttctgaagacacagtttgtgtagttcctgtggactgggacatgtgactctgcaaatatgatactaaatactctattttttttttaagcaaattgagtatgtaactctgtctcaaaatatgcagtacatgtctcagccttaaacttgttcccctgtgcttttagataataattttttgaaatgtgtttggaagtctttgggggcctaagtttagaaagctagaaagacattctcattgcctttgttgttccaatctgttgttctgtaatttctggacttggatctatcatttgactgaaaaggataaaaggtccaagagtgaaaagaaatgggttaaagagagggaacaaccagccaaagcagtggcagccagcacccgaggggggtggctgcagctgggctctgcccagctgcaggtgtggaggaggaagtgcaggaacgagcccaggacccatttccaggtggcagcagggttcagtgggcttaattaaccggtgaactgctcatgaggtcggtctgtctctacctttctacaccacactgaacaagccactgaccatttcctgcctcggatttcctcagccccaaagaggggacaacaatgtgtattcgtcagagaaattactggccactgtctcattcagaagctgcccctagaagtgttagtaaagacttttaaaaacatgaaacaaagcagagaattaaaaataacaggaagtggaagagagagcacactatgatctgaaatcttctgtgttatatgctggtgttaaagaggtcgtgaggccttgatgaagatttgttacttggaaggatgtcagtgctggggacctgctctctgtgaacccagcaacctgccccagcatttcaaggggcatacagtccactcagatgatttatttctgagttggaattaccccattccccagcccaccctcttttcaactttgtacaaatgtaagtggccaattcactttactacacaaatgactcatgatttcatgagctgcaagcagcagtttcttaagcagctttcccatattcctagtgcaagaaatggacacacagacatctcttatgggctagatctttttaatttgtgaagcaaagaaagtgagggaaccactggacccaatctcaagtatccaaggtcaactagacgaggcacatggccaatttccaaagacacatggttctttcctaatcctcagcctctacttcctcactggatctgagttcaaatctcagaaaggtcagagcatgtgcatttttggcatttttaaacaaatggatgcaattaagaacttgaggaaagggtgactttctatagttttcagcatacatcagctacttgacaacttctactaaaatagagctgctttcagagggtaatgtgagtagccaatcactgccactcaggacaaaaatgttggccaatgacctagaagtaagtgtgtggtgtatttcgcatgactataagtgcttctcattaggaaaataatggcatcagttcctggagttttcttggttatttaaacctcctgctttggagttgagttcatggtttaccaacatcagcaagtgtttcctattttgttgtacatgatcaccaaaggaataggaggcaataaaggaaatgagaactaaaggttctagagagattacattctttatcacatttaatctttataagaacccccaaaagttggtgttctttcctccatcttacagatgttttgaaaactgaagctctgaaaagttacgtaacttggatctacagagctctaagaggacgtgctaagatttgaatccagaatttcgtgactcaaaaacgttttctccacaatatcagtttaccagaataacctaggcatggcctcaaaagacctatattagaaattagctatatcctagttctaaggaagtattcattttttattattcaactgttaaaactgcacatatattatattccatagaaattctgagcatcaataataggagatactttcactatttgtatatatgtatatgtatatttgtgtatatatacatacaaaatatattttacaattgtctctttgttccaagagtgggaaggaaaataattagaatttgtagttgggcatttgtgtccactttaacctgatccattctgtctaacttttctttgcaagctctcaaattcattgttagcctatctgatcctgtcgtctggagactgccaagtatttcacatcttacccagggaaccgaccacttttaagggagggagggcactctttactgacttttcctaatttaaattcattgaaaattgttaattttaagggcaaagacaaggcaatgcatctgtaaagagctctgtcacttttctccaagtgatgactaatggtggggaacttaaaaccttatccttggtatcttttggagtccagacaattcagtggtctcctgggatgagtaaatatcagcccgttcccaggaagattaactagtaagatgatgtaggaaaagctgctactttttagagggctatacttaaactgccatctacacttcttaaggcagaatctcagatagtttacttccatatgggatgctatgatttctagaaagaaaggatattttatacagttataagagtaacagtggtttctttccaagatgttaaatttggtctcaaggttagtgtttgttaatgtaatgtaattactggtctttaaaagatcataaagtagagtagaattaggagacctgaattagggctctccattactgggcgtatagttgtaggtaaattcccagtttctttacctgttgtgcaggtagcaatacctatccatattccctcatagcctcacatttttaaaataggaagaatgctgaagtactttgaaagttctaagagctccaatggggtcctgtagcacatgggctttgtagtcagaaagccccaaattcaaaacttagcttttctactcttttcctgtgtgggtcagttttctaaactctctgtatcttggtcacctcacctgtaaaataggctaaaaatagttcctaccacatatgatacttgtgaggaccagatgggctcttggtatgcttgagttgaaaaggctcatagagtttatgttacccattcctcctaattgtaagatgaggaaaccgaggccctggctggtagagtgtcttacccaagttcattcatcaataatttttgagttataccaagcaatttgcctgcagagattcaatgttgcttaaattaccatgttgcctcaattcttaggaagacttctttttaattgagaggtcttcttgctcctttatgtcagaaggaatggtcacattgctgactttttcttgtttatggactgatgactcatttatgagttatctaaacgtcttgttccttctttctctcttctgccgtctctatcatgggactattttctttctgctagcacttctactagagattgtgaaagggtggtgacagtgaattaactccttgttagcagccttgtctcttgagaggaggctcacccactgctgctgactgataagatgatgacaatctctgcttcctaaaaaatcttctctactattaagttggtgcataagtcattgcagtttttgccattactttgccttccagattgcctcttgcttctctctgctctacttgctccttctttgctggatcctcttcctgggtaaacccttaaatgtgttacattctttaggatctgtccttgtctgtctttgattctgcctgctcttctcggtgatcgcagacactcttgtgtcctcagttaccatctatctgacactggctcctaaatccattatctttaacttaactttctcacttaactgccagatctcattgcctcttgaatatctctgcctgtttcccacaggtacttcaaaaattgtatccacaaatgagattacgagtcccccttccacacacacacacacacacacacacacacacacacacacacactttgtcttccttttatagcctaaattaatcaagcattctcagctccttgcccaagttccatatctatccagttttcaaatcatttttattttatcttgaaatatctcttgaacccagcacatcgctttcctattttactgatacagttgcgtcagttcagcactcatcttttttcaccatagcttcctaacttttctctgtggcctagttctctccattctatctaatcttccctctgtattctgccacagataactttcaaaactgaattttatctttgttgatcttctattaggaaaaatgttagatcctcaactagtgcttaaagacgaatccaaactattgtaatatattagcaatttccaggattagagctccaacccctttccatctgctccactaggtaccctgtgggcccctgtgattcatttacaataaacttgtcacatttcctcaagtacttgcctgacatcagatgtgtgacatcctcaaagacgcccccatacctctgatcttcccttctcttacaactaccccttgggcccctgcaagtcagtatttcattcttatttttatattatgatatctttttacatctgtctcacccaacagactttgagctcatcaaattggataacaggcttttctttttttttttttttaatttcaaagaccctatcacattggacaatgtcttccactcaaaaggaattcagtaaatagttgttgaagtaatgtacttacgacaattattaagatcagaggaatattgtttatcattcaatgtttatagttaaatatttgatttttgataaccatttactgaataattcacctaacaccccataaactaattaacaaagagtgtcttcataaatggtgttgatatcacatcaagatgctaacagtgtaaaattaggattttaaaaatatgtatgtacctttaaggcttctgtgacttttaggtttctctaaagtttatttaactttaatccacttaaatttctttaaaagttaaccattatacataaggtaatctgactccaaatttctgattattatataaaatccaaagataggtaaggatataaatctaaatgtagtccaataaatggacagaaaaatgtcagcttcacatgtagtttatggaagtagtgcatatatgaagccacagaaaaggaagagacaaaggaatttcaaattttggaatttataattaacaattatattcacatatgctatagagtaaaatagtgtgaaaagttgaacaatatatctatatattggttttataaaagtatcatggtatgcagttaattgttgaacactatgcttagagataagaaaatattaataatatttatagtaacatttattgggcacttactctatgctctatgctaggtgctgtgctaagtacatcatatgcataatttaatccccccaatatctctttgacacagttcctcttgttactcctgttttccagatgagtaaataattcttagaaagagtgattgacttgtcagaggacttaacaagttttagagctgtttgaacatagatctgatgtgttgttctatattaaatgaatgaataccttttaggtatctcaattctatactaattagtaagtaactgataaatcatttggtaaatttctataaactgtgttttggacatatctaaaatgataaggcaggtgggcacagtggctcatgcctgtaatcccagcactttgggaggccgaggtgggcagatcacctgaggtcaggagttccagaccagcctggccaacatggtgaaaccccatctctacaaaaatacaaaaattagccaggcgtggtgtcgggtgcctgtaatcccagctatttgagaggctgaggcaggagaatcgcttgaactcaggaggtggagattgcagtgagccaaaattgtgccactgcactcactccaaactgggcgacagagtgagactccgtcttaaaaaataataaaaataaaataaaataaaatggtaaggcacattttgtagtcattattgagaacaaaagaaaagcaaaattaactgagaatctttgaagttaggtattgttaactactgattgtctaaatccaccacttcagtttgttttaaagtctgcttttctatcaaaattttgaacattcaccgtaaagtatgcctccagaaatgaccactaatatattattaaactattcttaactattccatgcatagtgggagatattgaggtctattgcttgatataagaaattaaactgtatttcttctttcttttcctgctggagggtaatttacaaaataatcgatagtttcgtggcactgttaaagtggaaatgcactcaaaataattacaattaaaggagcctacagattttataatgcccaggttaattatcttcagaatatctgcccaatacagtatgttacaggataccaataaagaatacaattatttttttcttgatactttgcttttttgtttgtttgtttgtttgtttgtttgttttagagatggaatttcactctgtcacccaggctggagtgcagtggcgccaatctccgctcactgcaacctccgtctcccaggttcaagcgattcttctgcctcagtagagacaggtttttaccaggttggccagtctggtctcgaactcctgacctcaagtgatccacctacctcggcctcctaaagtgctgagattacaggcgtgagccactgcacccagcctttcttgatatttgatccctagagtccaatgcataagtagatgaagatggagctgcttttattataaaatttgagggatgtgaagaaggtacccttgtcccaaaagactgcccccccaccccccacccaaaaaaagttacaggttttcaaagttttcaagtctttggttgctctctgtgaacaagtaaatatccctgggagcactaaccccttatgtcttttgtcacacacttaagtaatcaaactgggaagatgacaaaaatgcaaattcttaggggtacttcatagattctgatttgatcattctggaaggagactgagaaactgcattttaacaagcactttgatgattctgatgcaggaggtcttctggaccacattttgaaaactcttaacagataactgacacatcgagttgttaacaaactggtaagttacatttctctaaatgtgtccttcatttccagaagttgttattggtttttatttatgctgtctatttcactgaagatttttccattcatatcctgtatgatttttttttaatttctttaagttggacttcacctttccctggtgcctccttgattagcttaataattgaccttctgagttctttttctggcaattcagagattttgtcttggtttggatccattgctggtgaactagtgttatctttggggggtgttaaagaactttattttgtcatattaccagaattaataaactagtaagttaacaaactcaaaattcatctcatttaatatatcatccagggttagccctgccttaattctcaggtttacctgaactttattacttcaagtatctctacatgaaataaatgaaacaagagttcctcaagtgactgtaacaactaaagaaaaatacttctgtttgtttccaaatggttcttttttaatagtcccagaaatcaatgctgaaatgctaaaacattagagcagaatgtacaaaacgttcttgaattatatttcattcttgggtgccaggcacactgggtttgtatctcacaacactgaaataataaaaagcaggtgccctgtcaagttgcttttgtaattgggaagctaggaggtgatgtattttgctaagaattttgacagaataaccccattggaggagtctaatgcccttattataggctgaataagatagagtttgggaggggacatagtacttgagaatacagtagatgaaaaattagactaataatactttttatgacttacagaaaataaatcttttttaaaatcactgcagcaaaaaatgtggcctgttgctaagaagagtttgttccatatgatggagactctgagtttgggagcttagaaaaaaacccagcaagtgtgttagtatggagaaaacaggaagacagcttcctctctgaatatacaccatttcctggagaggaagtgagggcttaaaaaaaagttctttgttggctctgtaacagagaggcatctatttagtgatgaccgtatatgtttacacaagccaggatatagatcttaaaaacagtaaagccttgaaagtgccttctttattcgataatggcaagatgcagagcccttggattagttggtgtgatatctgttgtattttgtaatcatcactggtttactcacagccatgcatatactgcctggacaatttttaagggacagcagttatactccatacggtaaagtggatttcacctctgtttttcttttgactgtgttggcatatcctgaggcaaccacactatctcacaggcagagcagcagagggcctgggttttattgccctgcatgccagaacacagtctcacctaagatgtgcataggtaaaagaggccgccccaggcaggcagttatgtagttgcacataatctgtgttgagtttggctgctggctgcaatttgtttataatcaacttcattgaaggatgaagcaatatcattaaagagaccacaatttaccaactaatttggggaattggatctaagatggtaccttaccttgacttttactgagtgtttagacagaatttgccctataacctttaagaggcttaaaagatgggccagtgaataattaaaatgacatcctttgcagcacagtgttgcccagcagaaagagcacacaacaaaaagctatgcttggaggaccccaaagccatagatttccagattacaatagagaagtctaactggtgcagttacaagaaaacaagtccttttatagagggcagactaaatctcttgtatgaaaacaaaaagggaagcagacttaacatctttccttaagttaccttgaaagaatgttatggtttaaatttactgcgtttttgcaggaggttgggcgatgatatttccctgccccttttttatgctggtaacacttcatcgtggtctatataacttttgttttttatttaccaaacatgatatttttaaaagattcttctaaaaccatttgttttcccggtgctccttttcatacctctatttttccagaaatttccaaagtatttgataaataataatatggagttgcagggctgctccaaaatccataaccaaagcagcttttattttctcacatagttgactttatgtgtggactttgcagacaagaataaaagaagaaaacatctgtactcttttactttaggtctgaaaagcacaaaatgaaatgggtttcctgatgaacctttactcactggcagccattctggcaatttctatttttttgagatggagtctcgctctttcacccaggctgcagtgcagtcgtacaatctcggctcactgcaacctccgcctcctgggttcaagcgattctcctgcctcaggctcctgagtggctaggattacaggtacacaaccatgcctggctaattttgttttatatttttagtagagatagggttttaccatgttggtcaggctggtctcaaactcctgacttcgtgatctgcccgcctcggcctcccaaagtgctgggattacaggcatgagccaccgcacccgcctatccggcaatttcaatatctctgcaattataaacacttttcagcagaattgtttactttctcttgtattactgatactcaccccaaatattcatgttgcataaagaaactcatttttgataacatataagctatacttattttccatgttcacaaagcattttgaaaagatcaaggaattatttctagataacacataaaaacttctattgcttaaccttctcaataattaaaaaaaaaaaagagtcaatcaaaactgaaattaagaaagcttttagaaccagaaagttcatataaggcatcatttttaccaaagacatcagtttttccttaggcacaaaagtaaactttgtttcttcttaaacgtgtaaaaatttgcatggacaacatgagcaaaacacctgaaagtttgaaaacaaagtgcagaaacaaacctcaatgctcaactgtattagctgtaagccagacgggaatctttccaaaggagcaacaaagaaggtagggatggatgaaggaagacacatctttgacctttgagaggaaagaaaagaaaagggttccgatggccaggcaacctccagccatcagtcccatcagttagaagagcagaaggcagctcatcagaagcagcgacatttgggctactgcaagagcaattattttgcttgccaagtcaattcagcctgtgagctacataggctctagtttaagcaacatgaatcatacaactgctctcattatcatgtttgaaggtgtcccttcacaagcctgctgttttaccacacagtactggtctgcctaaaaaacagtaaaattgaattaaacttagcccgagcctcttgaaggcagtgactatgtcatatttatatttgtaccccaagtgcagtgcctgaaatgtgttagacattagatgctaaatgcatgatgctaaatgcatgttggatgattaaacaagtatagagcatctgcaatataccaggcatcatgttaaggcccggggatggtccctgggagttcactcacagtcttgtagaaatgagtaaatgaatatattggtaagtttgctgcattcaagtagactgaataattgttactaacaaaacaaggaatggcaacaattaggtcactacagtaattgctcaaagcacaattaacagactggagcattcaattatgtggcaaccatatggttatgcatttcaccatgttgacatcatactgtaaaattcacacattatatgaaaagaaattacgccaggaaagtacaggctaccacaaagtaaagtgaaaaacacattactgaaatttactgctaagcaacagatataggactctgagctttcgattcttaagaagttcactgatgccaatttcaagaggccctccgatcaatgtaataagaatgaaggataaagagaaatgaaatgtagtagagcaatgatgagaggagaaaggcaactaatttaatttaggtgcacctaaaattacatcgaaaacatgttacaccttcaagattcaccttggcagaaagccaggaaacctgagtccttgtcctctctctctgctactaagtggctgtatgaacttaagcagattccttcaacataatgtgactgcaatgcgctatttctgatataaattgtggtttaaaaaaacaaaaacaaaaactcttggagtctttggtgagacctcttaatgcatatgcttttatctatgtaaatatatcagaattataggcccataaatcagtgacctctttattatcttgaatacaattaacctgatcttactggtaaaggctgtgtgtcagcaattccctagtaatgtccctttccaaaggatagctctttctcaaccctctttgttttcacaacacttttgcaaatttctgttacagaacttgcctgaatcaatgcacattacttagtctgtttgtaagtctgtcatctacgctaggctctgaattattgagggcagacacaatgacctactcttcttttagcgtccttccatagtacaggggttggcgcgtagtaggtgctcaataaatattgaatgactatttaattaacttgggtgggcaatagtatatgtggtgcatgtcacatgtcttccatttgcccctccaagtgcacctacacccttttgtccctgctggtcagaaggcccatgcttcctttcaaggcagcctgccccacaggactctctctcctcagttccagaaacctctccctccctcagtccttcaggcctagggatgctgacagcatctctgtagttagccctgggttcccgctgtatccctggagattcccccacaccctatttacacctggataattagtccttaaccccttcatgaattatcctaagtcaagtgcaccatctatttcctgtgagagcactcactaatacagtagattagaaaggagaaagatttctgtttaaaatgtgtttttgcactcatattattgagaataaccgcactgaattttttgaaaacatttaacaaatagatccttgggtaggctaaatattttcatgcatggctgacctgcactgattcactcattccaaagtatgttacagattcatttccgtttctacaccatatatgtattttgcatttgaattagtaagtatgttcatgtttggtcatttgtgtttaagtgtatttctctgtgacttgcgacttcttgcattagaatataagtgcctcaagagaaaggatactatgtttttcttttacttttttttgtaaaggcttgctcctagcagcttgccggctgacttatatctaaaaaaactaaataaaatttgttaattatgaatacagcttaataaatgtacagccagatctgacaacaaacattttgcacatttttaaggcataatctgataggacttgttgcattcttttccagagccagcaattcttaaggaagtgaaatacctagtcaattggtgtattcatggtgcaattatttgaaaaatcattaaaatatctgttctttagagaatgttaaacatattaattcaggtaattgtccagatatgctgtgcctttgtcactgatgtgtaaacaccatgaagtcagcaactttttctgttttgcatatgtctgaatgcccagtgcctaaaacacagcctggcatctataaggtattcaataggtatttgttgattaaatgaatatatggaggcttggttatattattgtagcctgatatgttacatttgcaattgctgtgctgtcattcataaatgattttaaaaggcaatttagattcctttttttcaacatatttattgccttgttactgtgttcaaaactttactaggtgtttcctttgggagctcacattctataggtaaaaaatatcatctgaggctagacgtgatggctcatacctgtaatctgagcactttgggaggccgaggcggatagatcacctgaggtcagcaattcgagaccagcctggccaacgtggtgaaaccctgtctctaccaaaaatacaaaattagccaggcgtggtggcatgtgcctgtaatcccagctactcgggaggctaaggacaggagaatcgcttgaacccgggaggtggaggttgcagtgagccaagatcgtgccattgcactccagcctgggtgacaagagcgaaaatccgtttcaaaaaaaaaaaaaaatttcatctggaacacagcatagttacttaatggatcctatctctatggcttttctttcacatcacatctttacccaaagcaagctttactaaccttcattctcctaatccctgatttttgcaggctttgaagaattatattgaagcaattagcactttcctaacgcattcctgatcctacctgggattccataactggtgaccatgctttgcctttcatgtagacttggttactccaataaaactgctgaaacataatcaattttttttttttttttttgagatggagtcttgctctgtcacccaggctggagtgcagtggtgagatctcggctcgctgcaatctccacctcccgggttcacaccattctcctgcctcagcctcctgagtagctgggactacaggcgcccgccaccacccccggctaattttttttttttttttttttttttgtatttttagtagagacagggtttcaccgtgttagccaggatagtcttgatctcctgacctcatgatgcgcctgcctcggcctcccaaagtgctgggattacaggcgcgagccaccatgcccggccgaaacataatcaattcttacatgattttttctacttcatccacaatggtagaaaatagactctttttcctcctgtgtgtgattaacatgaggccttcatggtactatacttccattagagactttttttttttgagatggagtctctctctgtcgctcaggctggagtgtggtggcatgatattggctcactgcaacctccacctcccaggttcacgccactctcctgcctcagcctcacaagtagctgggactacaggtgcccgccaccacgctgggctaattttttgtatttttagtagagacggggtttcaccgtgttagccaggatggtctcgatctcctgacctcgtgatccgcctgccttggcctcccaaagtgctgggattacaggcatgagccaccacaccccgccccatttgagacttttaaaatccttttcttaggtcttcatatgactccacttggtctaagcttttatactcatagacattttgatatattcacaaatccttttacttttttgtctacaaataggtccttgatataagccattcatgtggaatagtcctagtggtctcagaatttgaaacatattgaacaaaactccaaactaagcgtaattgtttcttaatctaaatagacttctaaagcacccagagcctatgatggaattgtacatggcaaaatgctgttataattggggagggaacggtccttttaggcaattaaacatccttctcttcttccctttcctcctccccttactctctcctactctttctccttttcttcttgaatacccagagattcacttccctttgtaaatatttgagtctacatagtagaaatgttttatagatctatccatcaagtaggttcaagtaattatggtaagtagttatatggaactacctaaatatctattgctctgatctgtccatgaagatcccttacaatgtatttcagatttcgtggcctaagtaaatgagacttttttttcttttttattaaaaaacagaagcttttttttcccccaagagttaaatgtcattgtaatcttatgaaatattgctttcaaaacataaaaccaaagaaattcagaaataaagcttatcatcctggttgtttttgttatatagaattgtctttactatttttcccctctcattgtcacctcttggttcatggtatgtgattaagagatggtaccattgccctctgattgccttgcttctggtgctccctctcctgaagtggccctttttagtcagatccttaaagctatttcaacatttctccacccgtatccccccaccaccctccaccaaatacacatgctttgcactattacagatgttaacttgtcaaagtccagaagctcctgagaagtcagcaggaagacatggtggattgaggcatagccatgacctgaaggaaataattaaaatgcaggagggttgctgtgagggacacactaacttagtacatctttctctgatgaaatctgtcaggctcttagtttaccaaatgtgggaacttttgtgcttgttttgctcttaggcacaggataggtcccaggagagattccattcattcctcaaagagaaacagaagaaaaagaatgaagtctcactaatagcttgttagaagaattgtgtttactctgagatctgactcaagaaatggacatggaatctcagcaaatccaagctacagatgatatctgttttgcagctgggccatgcagagctcagccatggcttctcctgaccaagggatgttaaagttatctagaacattaagagtgttaatgagtatatacagagagactaattgtgagcaaaatcattaattagggtcatgtttacatttttattgtggctaatctttcatctgttcggactaaggttcttactgtgttccaaaggtgataataatataactaaattcctctgatactaaagtagtcacacttttatttcttaatttacctgagttgattcctggccaccctccccctccttatcacactagagataattttcagtaatgttttctttatgctgttaagtgattcccttcccagtggagcgagaaggtgaatgtacttaatgaaatgattgatctgcattttggcattcgtccaaattgataaaatatagagggacttttccattcattattttgttcatcatttatagaaaatgcggaaacttttgggtaggtttggctttctgccaattaatgttgtcactgttttcctctgatgcatattcacatgagtcaacagaaaccttttcgactaagcagagttagatttagcgagactgcgtacatcacggtatttattggatgtggaaacctaaaataggaggggcgtggtaaaacctcagacagaagtactgacaaagagtttccccaaacaatagaaccgccatagcccgcacacattcccaggacacattctacagaatggacaaagaaatactcatctgtgtcatcacttgctcaaaaaaaaaaaaaaaattatctgaaacatggaaggtatatcaatcagatttgcatttggctgtgagtgatagaaaatgcaaaataatagtaggttaaaatacataaattttttttctgtctcttgtaaaagaagtcccagagtaggtaaaccaggagggagacacttaacagtatcagggatccacgttccgtctcttctgcggttctgcccaccttatcatggggcttccctgtcacggacaagatggctgctagtggtccagctgggaagaaggagaaaatacctgcagcaacagcaacaaggactacccctctcttttttttttttttttttttttttttgagacggaggcttgctctgttgcccaggctggagtgcagtggcgccattttggcccactgcaaactctgcctcccaagttcaagcaattctccatctcagcctcctaagtagctgggattacaggcgcccgccagcatgcccggctaatttttttgtatttttattagagatggggtttcagcatcttggccaggctggtcttgaactcctgaccttgtgatccgcctgcctcggcctcccaaagtgctgggattacagacgtgagccaccgcacccagccaggactacccctctctttaaggacccttcccagaagtcacacacgatacttccaggtaaatcttagtcactctgtcacccctagctgctagagtggctggaaaatgtagcccttattttgggtggttatgtgaccagccaaaagtaagggatggtacgactcatgaagaagggaagaagggatattgttcctccttccggaactttgccagtgttctcaccttttcccggaagcctaatcatctctccgtgggcagtgacagactctctactctgtctgttcacagaatacctggggtaggtttttcagtttcaggagccacactacaaaatagatacatgtgaaccagtaaattcaagagtaaattaccagaatggttgtgaggactgggaccctccatctacccccatgatgattacaaaacttgaatggaccatatcatctgaggaacaaatgagggaactggtgatgtttagctgggaatttctgtatgcctttctcagaaaagacatagggaggacatatctgactcagaatgtttgacaagcgattctgtgtgttcctagctggtagaattagaacatgccccaaatcagtgagcctaacttcaggcaacacgtaaaggagcattttctgtttctcacagcagtcctgaggtccaataagctatctctggggaaagcaaactcactgtcatcaaagggattgaagcagtgtctttagggtcaattgatagccttctaacatgtcttcctggctctagtcttaagacctatccagaccattctccatatccccattggtgatctttttaaatgcaaaagagaacatatcacttcccagtttaatccttttcaatggttttccattgtctgccaatctctcagttcctcttgacctggtgtttacttactcattgcaagtttctagataaaattttcacttcctcaaatatgtcaaatctctctcctgtccagaactttgattatgttgttccctcttttagaacactctcctccatccttacttttacacttcacctggctgagtcctacacatccagaatcattacttcccctctgaagtcttcacttctatcccctcagaggagggattcttatgacttctggtacctcccttggcccagcacttaatataattgctgcaattgcttatttaatgatgtgcctgttgagctagactgtaagctcccagtaggtagggtctggtatcctcacacactgcacacttcctggcacatagtaggtgactgatcataatgttgaacatggtagaaggtaatcaggcatcagctgaagggagatacaggttaaggatgagagagaagcaataaagatacgagaaatgagaaatggaaaacaaataagagattttcttttgccctagtcccccttatattttttctggagtggcaggattgaagcatgtgaaacaattgcttctctggctacttggattgcctcccagcccccaaagagtcagagcaactgttacagtggaatttgaaatactagctatgttaatggaggtcagtattactaaggctggatttacagctacaaaaaagtgacccagatttattttctattactcaaaattagttatgtcgaaggaggagcaaggggcttcttggtctatagactattgctaatgtgtctctggacataaatcttctttggttttcattatctattctggagaaagcaatggtgactctgagtaagtggggcagcaattcaggtctttaccacaccacatgcagcatttgtacaggagtagctttggcctcccagaccttagtgacctgggcaggccacccatctctgccttttcttggagtgatttttacaggcacagagtaaactcctgccctcaaatacctactgccatttgcttcctgatgcttaacattccacatttatagaaaaggcctcaaatataaggaccacaataataacacgtgatttaaattcacatagagatgtactggctcctattgaaaaaaaaaaaaaaaagccgagggtggttgggggagaaccattggactatagaaggtataggtggggagaacaaaaaaagaatggtttgaaacagaaaagactatgaattctaagcaggctgaaaagatagagaataaaatacatttaatttataattttgcttagccttatttaccctagacattacagacagaagtgatttcttgtttagggtttaaggggcagccgagaagtaatacagacctaaggagtgaacctcctgctaccagcatggggagggggcatcccctgttattcactagagctactgtggtattctccagcctggtattgcccgtaaatgggcaagacacacagctttgcatttgcattatttctgattgacttcaatggtcaatccctgcatgtgatttttttacacgtctccttttctgtatccacggatcatcagaaagtcgatatccaggaaaacaagatagcatttccccaagaggaggggttttatgttcatgcagcccaaaacagtggtcactttgaaaaaggttttttaagccgagtccttgtctgaagctgactgaaaatgacaaacctttcctaaaatgaaaatcaccgaagcaactgggatgaactatttatcttcctgatcactgcaaggaaacacacgaacaatgatctcattgtatcctccattttgatttttaaaggcatgcattcactaataatgtgtgtagaaaacattaattaacaatagtcacttttacttacatttactctctaacaatgtaattgttagtttacttttttaaatgttcagtttcttcatctttgttgcagatatgtatctatgcaaggaaatgatacattttaaaatgtatagataatcagagaggtttaattctcttgacatatacaataacagtgtttcaattctataaacacaacccactggtactattaacctacttgctttagggattaagggagagagagaacattaactcttttgtgacttactgtaaatcagcacgagaggaaaaaatggtggaacatgtcgtttttgctacatggatagtagtttggtagtcacagtataattttctcataaactgctaatagcccatttgcaagtaaacagatctggcccttgccttttgaccaagtctaaaagactttacaattatatgcacacaggtcgtccattctatggaggtataagtcctagttggttacctggtgcaagtttcaccttgcttcttttggatcatagtatatcatgcctcactctttttctgctttctgcctgtatgtttcgtagcagagattgagtcaatattttcttggtgaaacagacacccagaaggcacagagaatttatatttagttttctgagtttttgaactgatgaaagaatcacatttgtcttcctctgtatttttctggatggatgaagaactctgcaatccctgggttcttgatggaagttcttcctctgagctttcctccttcagccacttatcccctttgggtgctcttgggaaaatattcttaccccacactgaagctccccagtactatcaagcagtgaatttaggtgttcctgtaaacatgggtaaaatctaggagagcactgtggcttaatgtgtagattcatagggctttgcagagagtgacactgtttttcttttcttttcttttctttttaatttgaatgcatgaatattcagtaggatgacttgtggttctatcagaggtcaagtcaataggagaaagaaagcctatgactgaggtaaaatgtgaagtagaaagacttggtttatataacttagatgtctatactgttcaaaatgcttagctcttctaatttcatttgccctcatagacacagtcagaaaaacaagttcaagatgtgaatatttttaatctgttttccaagcatatgtatcaaagaatggtatctattgtcattaagaatttttaagcctttcattctaaatataaagcctcacctatttgacagtgttcctttaaatgtcagagaagctggagaggttgaggggcagggagggatcatgaattgaacctcagaaggattttaatgctttcccttcggtggtgccttttcttcctgagaataaagaaagggaaaggagccagtggactcagccctatagcaacatttttccccaaggaattttgtatttagttcttgtgcctttggctaataaagaagaggcacatttagctcctgtgaacaaaagaaggcaacatttcaaaatgtggttattttgcttgtagattttctagattttatctcatccaactcaggttgtaaactaaagagaataaattatttaatccaacaaatttattctttccctgcagtaaactgttttgcataaaggaggcttgttttttgctcagacaaaatgaaacaggaaattatctagcagattcaaacagaggagagagtcactctacaaaatttgagcccctagctacttccttttccaaattatctggagagttctctaaacactcacctttactttattcatatgtaagcttcaactatgtatacacagtattgccagttcagacactgggactgaagtgacccattaattgaatagcccgacctgtctagttaatcaccacttcccactccccagactgcccaccccagcctccagttcaattgaccatttgtttgcatgaatgtattgaactgaccacctggccagctattagagtctcggcctttcttttatttctgcaactataattttttgtttcttattttgaggccagttctagatcgtttaccatttgacggataggcctatgctttgtctcattgagttccacttagacaaacagtaagaaggacataaaaaggatgcttggatcttgatagtaggagattgggatcctctccactctgggcactctcccctctgcagacactgctacagtgagaagtaaaaaggaacaaagaaaagagaaatgaaccatatggtggtagaatttgtcagctacttttgatatgtttcttaagatgcaggtcaaagtagtatacacagacatttaaaaataaggagactgtttggctaaagtaaatggataagtcaaatatgtgtttcttgcatttcataagaaaaaggataaaaactaaagaaaaataaagcatcttgctcttcaaagaaaaaattcctttttttttgttacacgggagagcacttcatttgaaattggtaaatatattgctgatttgcatatgttccagaaaatacaatttgtctttttgaatcacacagaattcactgttttattactgtgtcttcttatttctggagctaaagatgttatacagataggatagctcactaaaatctatcagcatatctttaacgtagtgttctgccaagtagagattgcaaactgatcaaactgatagtgtctttctagctgtggaaacacaatgccacacaatttctattccccagacacatttttttttgttgttgttgaaatggagtctcgccctgtcgcccaggctggagtgcaatggcatgacctcaactcactgcaacctccgcctcccgggttcaaatgattctcctgtctcagcctcctgagtagctgggattacaggggcacccaccactatgcccagctaatttttgtatttttagtagagatggggtttcaccatattggtcaggcttgtctcaaactcctgaccttgtgatccgcccacctcagcctcccaaagtgctgggattataggcctgagccaccgcacccggccccaacaccatactttaatcagtggaagatggcaagagccagagaatgaataaaatgtttcctgaaccacttatttgggtattaatcgtacacccacaatgtgattcctagagttcacagtctaataaattattttaaggcatacgctccaccagaattttgattttaaaatagttcaattctgctgcacacaaaggcagtgtcagatagcttgcacgaagcaaaccaggtaaatctccatgattcacggtcactaggcaatgtctagttgcagttgatcattcatgctggcatatgtcccaaagatagggcatcctaagtatagataaccggcctgcccttaataagactggaaggcagtcttattctgcctccagataatttgaagactgagagtagttagaaggcgtcattccaaggaatgctagcatatagacaaatttcttcctgatcttttgaaaacaattatcttcaaacagtttgactgtgctagcaagacttaagatggaagacagggacatgattataaaatatcaaaattcctcatcatagatcacctccatttttcttagaatcatagattcttatgattggaagcatccttggaagtctttgtacatttaagaaatctgtgtcccagtgatattaactcctgacctagcattctgcacctgatgggctccttcttcctgggacacaatttagggaaacagacctgtcacagtgacgttccttgttatgaaggatcacagctgggaattctaagaacttggtcttggagagctagcaagtgttgcatgcaccttttctcaaaagtgagagcaaatcgcattcttcccagaaaccacatgattccctaactgcccatccaacccaccatgttttagtgccccaggttcccagccctgttttccagccagcctcgaccctcggctttgcagaaagctcaccctcacttgacttcaaagcctctactttcctcctttagactctgcttatccatgagatgggaaactgcagacgtgtaaccttcacatagttaggatttgtgggaaaataccttgtatactacccagttggaaagcgttcattgcgggaattcctgccagaacagcccaatccagtggccttccagctggatttcaacactgtcactgacagaactcacatgatgatccatttcctgagtctcttctcttacaactccatgtgttggtcctagacaagaacttgggtctacatccagttagctgaacctcctttcacatagtagaatttcaactaattccattcttttgtggttttttttttttttttgagacagagtttcgctctgttgccaggctggagtgtagtggtgtgatctcggctcactgcaagctccgcctcctgggatcacgcctttctcctgcctcagcttcccgagtagctgagactaccggcgcccgccaccatgcccggctaattttttatatttttagtagacgaggtttcaccgtgttagcaaggatggtctccatctcttgacctcgtgatccagccacctcagcctcccaaagtgctgggattacgggctgagccaccgctcccggccctttttttttttattattgttatttttttgagacggattctcgctctgtcgcccaggctggagtgcagtggtgtggtctcggctcacttgcaagctctgtctcccgagttcaagcgattcttctgcctcagcctcctgagtagctgggactacaggcatgcgccaccacacccagctaatttttgtatttttagtagagatggggtttcaccgtgttggtcaggattgtctcaatctcttgaccttgtgatccacccgcttcagcctcccaaagtgctgggattacagtcgtgagccactgcgcccggcctagttccattcttatgcttcccctttgatgactcctctactacctaaaaatcctcacttctttgcatctttcttacataatagtagtttagactctttctgcatctatagcctggtatttcctctgaacaggtatcagtttggcaatcctccttctaaaagggggtacacaaaactgaatgctatgttgccaatatggtgtgacaagaagagattagagaaagactaaccttataaatgcaacctcagattacattaattgttttggcagctacattgattgactagtattgaaattactgtcagctaaaactccctgtaccccattgtctctttcacaataggccctcagtaaaaatttgataacttgagttacattaaatgtttttacacatgagaccccctgctagatcacttctctccaattctgctcattttgtacaactgatattttatgtccatgaagagggatttacatttatccccgttaaatgtcatctctttagggctggctcatagtttcagtttgttgagatcatttctatcctgattgttaccccaaatatttttattggccccagttccaggtaattgataaatttattctgcatgcgttcataaatttcactaagtcatcaacacaaagtcttctgtaagactgggagacatcagctccctgccttaccataagtgacctgtggtttgtcattctttcatggattggctgtagatatggatgtataactcattacaaatccatctaaaagaggtggctagtaacatcatggattctgtgggccagtaaaccttgatttcaaaatttcattcttcccctcattaaccttccctgggacaagttcattaaactttctcatgaacagatcccctcatctgcaacagtacttcctttctagggctgttgggtggattaaatgaggtaatgcctaagaagtctggatcagtgcctaacacatgtatatccaccatcaatctctccccaaaaacctcacctcacatcaaatgtccacattttgtatactaggatattgcagactccatgttcatcactaaaactaaaaattcagtgctctattaacatgtcttcatccatgttggcttttaaagtttcctcttaacaaattttcagtgtgaaatcattccttgaaaaagggagtaaaaaaataggaattaagattttttttatctttgtgtcatctagtgacacctacttttaacttcagccatatacaatcctagattctttggctctgaactttagaagaaaaattcttttagtcctcttcaatattttagaataataaattaagccaactgaataaaaatataagtatcccagttccagtttttaaagctatttcctcttgtgatggattcttttctgaatgaagaattagcttcccacagatgttcctgaatatttcagcaaggacacctacaatcagatctaaacaaccaaaacaaaatgcccaacaaacaaagtagcaagtagatttcacattctaatagcttatgttgtatgtccacagaatgaatataatgaaacatgacatgaatgagtaaatctgtcagaagaaaaacagatttgctgttgcaaattaactagtagtgctgcagtttcaaagctgtagattttcagttacctgaaattagtcatagtggtaagagactacttttctttctagtctatcccgcaatagtgtttaagcttatttcaggtatttcaaatggagaattcaaagcatccactttaaatgagtcttaaaagtctattctcttctaggagtaactattggtatgtaaaaacactacattaatacataaagatttcctaggaagtaaattataagcacgaaacttgtgccatacaaaatggctacttgtttaaaaaattgttcagagaagtcagattaggtcctattggctataattggataatggaaatccattttatatgcattaccaaactctcatcaaatcatacctcaaggcaccaagaggcaaatcacctcttgtattaaactagatatggccggtgaataatgggtgcagaggtggtcatttccatgagtggaaccagatatagaaaaaaaaaaacaaaacagtttctagcattgagctagaagcttctctttactaataagatgtgactgaattccaggaatatttgttcagttaaaagagtaatggtttctcctcagtggctctttggacatttgaaatcttttgcttatttgtttagcagaattttttttttaatgttgaacaaatgcacagcagctttggtggtgctctgaccagccccatagaatgctgcctcaaaagtttttcctgtgacacttcctttcagagatgtttcacatgtgcttttttccttctgcccacactctgtgttcaccaccaactttccattgtcagtcccctcccacacacaatttcactctctcatacactccctgaatcttacagcagctcaaactaccactcacgttttcattacattatgggaaaggaaaaaaaaaaactgacttcctcaaaaaggacataaagttcattttttaaaggacttaacgttttcaaaaagattttcttttgtaagatctcctcattcctgcctgttgtacttgccataatagggacatacaggctttctctttgcttgtgggacccccaagccatttttctctgttgactggttttctcatcagaagttcttaattatgagtcaataaaataatactctacagtcacagccccagggaagggaaggattgcttaagtatctaggttattcagggaaggatgggggtagagagagatgtgttggctttccattttctattcaagcaaaagcagttttaaaatctgaaattagaaaggttataggaactgcttaaatcagactttcatgtctgtgttataagcttccaacttgggaaagcttaagaaaaagaaacctaaggtttcaaacatgtgcttgtttcaaagcacaaacttggcgacttctcacattgctttcactaaacctaagagttctcatacaagtgaggtctgttttcatcactttccagcaaagattaaatagcagggtgctgtagtgatgattctggttactgagatttcattgccaagtcagaaacatcagagggacaactccatttaaccataggccaaagatacctctgccacatgaaggccaggccaaatgccagccgaatgaatcagtatgcacagtgctggagtcagaagcagacacctcttctggagtgcttagtccatagactggagtgaaaaatatcagagcagaggagaagaacagtaataggtggacattcctaaacacgacagttatttaaaactttttttttttttttgagacagagtttcactctgtcgccaggctggagtgcagtggcacgatctcggctcactgcaacctctgcctccctggttcaagcgattctcctgcctcagcctcccgagtagctggggttccagtcacatgccaccatgcccagctaatttttgtatttttactagagatgttggccaagatggtctccatcttctgaccttgtgatccaccaccctcggcctcccaaagtgctggcattacaggcgtgagccaccgcacccggcctgtttaaaacttcttactcactttggataaatgatgctgggagttcaagcatttacttccaagacaacctgggataggatcagcagtgattccttaagtgaagctacgtttatacctcaattcttttgtttattcattcatctgtttaaaataaaatatttctagaatacctactaagtgtcaagaaaataccaaatatatttcttttggcatctaggtaatgagttaatttgaaagtctgagaaaaccagcaatctggaataacagtggcttttattaatcatctgctatgtgccacattttatatgttatctcatttagctatcacacttagcttctaaaaaagatggggagaaagtatccaaatgaatgtgcagagacaacttgattcacagaggtaagaaagacccctcagacacccactgaagatactgggaatttcaaataaggttaaaggtacattactcagggcaccaggaatgttcaaaaaatggaccacagttcagtagcaaggaagcctctaggcactattcacatttgtttgagtcacaattttaaaatgagtgaaacttgtgtctttgaattcagtatcatttaccaaatcatactgtgcttgtgatatttgtgcatatggtagcctctgtgtaaaaagcttctctctatgagatacactggctaatagttgttaaggggcccggctctaaagccaggggctattgggttcaaactgccactctaacactcacctactatgtagccttgagaaagtgatttcaagctctctctatcggtttctcatctgtaaaatgaggataatgctacttcctacatagtggagttgtgaaaataaaatgcatgtgagttacttaacatagtagccaacattcacaaaataattatcattgcatctgcccctcttttcatcacatttttttttgagacggattctcactcttgttgcccaggctggagtgcaatggcacaatctcagctcaccgcaacctccacctcccgggttcaagagattctcctgtctcagcctcctgagtagctgggattataggcatgcaccaccacgcttggctaattttgtatttttagtagagacaaggtttctccatgttggtcaggctgatctcaaactcccgacctcaggtgatccgcccaccgtggcctcccaaagtgctgggattacaggcgtgagccactgcacccggccttcatcccacttttatagtacacttttgtgtatctgttctttctagggactcaaaaaagtactttgattctcctgtgatttgataggcaatttgtaaaagctaatatttaattcatttaggagcaaaacctaattatgctttattgctgtataatttcctctagtgtgcaggtatgtgatgcagcttattaaagtaagaaagtaaactatgctgtctatcagaatgggagaatttgtgggttctatacacttggggtcctcaaactgtaaggtgtaaataaatcctaggtctcgttaaaatgcagattctgacccagtaggtctggggaggggctgggagtctgtatttgaaaggtgctttctgttggtacctatgctgtggatctgtgcaccacgcattgatgctatacatattacattaaactgtgcctcatctggattgtggcacaaggtaaaatagatgcaggctatcaaggctgagaaaaatgtataaaaacaaagaccagaagactggagggcccaaaagaggtgatgcatacacaaggttctaaagcccaagtctggactccatatgcacattcaaatttgaggaacactgagcagtaacatgcaaatcacctgagaatcttgcttaatcagcttctcattcagcaggtctgggggagaggctgagagtcagcatttcttgcaagttcccaggtgatgccagtctgcggcccacatgttcatctagaccccaaactagtagcaatgtgtgtggacaaggctgggtaacaggcatgaacaatcctccagtcatgagtaatttccttgagagcagttgttttctgtggaagacccagcgctcagcctccatgaacatggtcgagcctccctggaaaacactgccctcctatgctagcacctgtgaaaacatattggaaacaggctataaagagagaaaaacctacagtgtgacacctggtcagcccacagctgtgcaactgagagaaagcagactggttttaacacttcactgctccttttctagaaaggcagttccaccaaagtcctgttatttctgacaactgcgtgtaaccaaaagtccctgaggtggttgtaacacagatggagttttgtcctgagttttgtcactacgataaggagctccactgagagcagctcagcctcggtggaccatttctcactcatacatctcatagatttctttaaatcagagcactcaaagtctttatgtagtggattttgggtgccaattggatgaataaaatctaaacagtatgaggaaggaactcttaagtttcttcatttcttcctatgatagttcttctgagagggagaaaaatcacaaaccctccccaaatgacttagtgcccaagagcgaatcctagacaaatttaaaaaacattttttgggctgggcgcagtggctcacgcctgtaatcccagcactttgggaggccgaggtctcacttttggatcacgaggtcaggaggtcgagaacatcctggctaacacggtgaaaccccgtctctactaagaatacaaaaaattagacaggtgtggcggtgggcgcctgtagtcccagctcctcgagaggctgaggcaggagaatggcgtgaacctgggaggcggagctagcagtgagcccagacagcgccaccgcactccagcctgggaaacagagtgagactcatctcaaaaaaaaaaaaaaaaagtaaaatgactatattcagagttgcttgcattccatttggaatttgaataatccataggctctgaattataaagggttgaaatcgccacctttaccattgttcatgcattatttttatttatttatttatttatttatttatttatttatttgagatggagtctcgctctgtcacccaggctggagtgcagtggcatgatctcggctcactgaaacttctgcctcctgggttcaagtgattctcctgcctcagcctcctgagtagctgggattacaggtatgtgccaccacgcccactaatttttacgtttttagtagagacagggtttcaccatgatggtcaggctggtctcgaactcctgacctcgtgatctgcccacctcagcatcccaaagtgctgggattacaggcgtgagccgccgtgcccagctttatgcgtttttttctaatgttgctttttagggctttgcttggcctgacccagtgacaagagatgtagtgctgcccgggagtaccatcctcaaaggacagaactgagtgcataatctctccctgttcagtagagtgcaaatgcaaacttttggcctccacatatttgaggtagcttttccatagttggtccaaaacaaacctgcagatttatttctgagtcccacatctaattctagtaaatgtactgggtatgctcatttcaattagataatatattagtaaaaagttcagtaggaaggtaggaaaagcatgcttattaggttatagaaatagagaaaaacagtcatgtaaaaatgcaaagttgggagtatgtggaactctgtaatttcttcacaattttgcagtaaacctaagactgctctgaaacataaagtaataataaaagaaatgggctgggtgtggtggcttatgcttataatcctagcactttgggaggctgaggcgggaggatcatttgagctcaggagtttgagaccagtctgggcaacacagggagatccccctgttgctacaaagatttgaaaaaaaaaaaaatctagctgggtgtggtggcatgtgcctgtggtcccagttatcaggaggctgaggtgagagggattacttgtgcccaggaggtcaaggctgcagtgagctgtgattgtgccactgtactccagccctggcaacagagagagaacccttgtctcaaaagaaaggggggggggggaggaacggaggaagggaaggaggaaggaagagagaaagagaggaagaaaaaagaaataaaaaatctaaaattcatgactttggaaaatataagcaaatatgctgaatatagaacatgtatagacatgatgttcaaggccaggtgcagtgactcgtgcctgtaatcccagcgcgttgggaggccgaggcgggtggatcacttgaggtgaggagttcaaaaccagcctggccaacatgatgtaaccctgtctctactaaaaatacaaaaaattagccaggcgtcgtggtacacgcctgtagtcccagctacttgggaggctgaggcaggagaatcacttgaacctgggaggcagaggttgcagtgagctgagatcatgccactgcactccagcctggtgacagagcaagactctgtctcaaaaaaaaaaaaaaaaaaagaaaagaaaggatgtccaagaagaagagcttccaaaagttttctattgctacatcataattaacgggtatgatagcgacaacaaaaaaaaactctgttcctctagtggatggtaaggagatctccatcccattccttctccagcgagagcaaacatcttgacaaggagcatgttgaaatgaaaagaacaatttgcttagagtgagacctgagtttgaatctcaggtatgccctcttactagctgtgtggacttgtgcaagctacttaactactttgatcttaaactttctcatctataaaacagtaataaggacatacacatgatggcattattatggggattaaataaaatattgttaatgaaaacactagccagtctgtgcttagctaatgtttgttgaatttaacctgcttctagtagcaataccctgcctttgtgctttaattctacatctagtagcaataccctgcttttgtagtttaattctatgatgagggaaatcatgtcaatcagatgagaggtcaatttgtggggaaggaaaccagggaagacatgaaacctgttggtacataggcaagtgcctagcgatctgcctgatacacagtaagccctaaatagatatttgttgaatgcgtaaggctctggactaggagtacctaaaatttcatatagttggttgtttttatcctcagacccattgtttcgatatttgtagaacattacattttccaaagtgcttttatacctatttaacaaagcaaacaaaccaaaacctgggaggcaggtaaggcagaccttatattcaattttatagaaattaaaacggaggcacgcagagaatcacacaagaaacttcagcaaaggagtaggactaaagctcaggtctttgaatttacaatccattttccaccacgtcttttgaaaattagtttgtcttttttcctcatacctactgcaaatgaaaaagtaattctaacatttaagggagccaagatgagacataaaactgagtttaggaaatttacaataaaagggaagattttcgctgaattagatagtggttgtgatattatataaagaaaaaaatggctgaggacaaatgtagaaaagaattgatcagtgatcgtgcatttcactaaagcgttctattgctttagtgaagcatactcagtatcttcagtatcagtagaaaagatactcagtatcttttcagtttgggatatgatggtcactgatggccatcagcattcattgcccagtgtgtgaggccactatggatgagtgttgactattaatgaccattcttctatatgatgtcagctctccttgacacttggccaaaagctgtaatttttttgcatcttaggagcttattctcaacgttgtaaagacttgaagggggtgggagggcaaggagaaaagaaagtaaaggaagattttcctattaatagaaagttttttggttattaatatagttgcacaaagtatactgctgatgtttgcataggttcaaaagaaaggcagagattttaagttattgtgaaggagaaaaaaatagtctcgatctggagagccaactcccaattatcctctcatgaagcattgcagagataagacaagtagtagctaagcagctcctgccttatagggtcaccagtatttaaccactagacttgtactttttctggaggtgtgtctgccttcttcttaggtgaaatttgtaacatagtggaggtactgtcaggcctctgagcccaaaccaagccatcacatcccctgtgacttgcacgtatacgcccagtggcctgaagtaactgaagaatcacaaaagaagtgaatatgccctgccccaccttaactgatgatattacaccacaaaagaagtgtaaatggccggtccttgccttaactgatgacattaccttgtgaaagtccttttcctggctcatcctggctcagaaagcacccccactgagcaccttgcgacccccactcctgcccactgagcaccttgtgacccccactcctacccgccagagaacaaaccccctttgactgtaattttcctttacctatacaaatcctataaaacggccccacccttatctcccttcgctgactcttttcggactcagcccgcctgtacccaggtgaaataaacagctttattgctcacacaaagcctgtttggtggtctcttcacacggacacacatgaaggtaccagttcctataactgcataacaaattgccccaaaacctactggtttcaagcaatgacaacatctgttttgcccttgagcctataatttgagcaggagtcagtccagattggctccctttggcttctgatggagcagcttacagaccaagggactggagtcatatgaaggttctctcactcacatgtttagtggttgctgctggctgttggctgagatcttaacttgagcagtcagccagaacacctacatgtagtctctctctgtgacccaggcttcttcacaacatagtggctggattcccagcataagcatcctgaaaaagagagccaagtggaaactgtatcctttttataacctagccttggaagtcacagagcattactgccactctattttgttggtcagagaagtcacacattctggctctgattcgagaggagggaacgtagacccacctctcagggggaggagtgtcaaaatcacatcgccagaagagcctatgaaatggaggtattgctgtggtcctttagaaaaacaccatccatcacaaacttacagcagccttttttttggcttctttggtatcactactgcccacactaggtcttcagctatgaccttcttaggcaattctgcattcttcagtattactccagaaggggatccaaaaccttatttctcaaagtcatggtttcttagtttcgaatggaccttgagaatagattttgaaaccactatggttatagtacctgcttttccctactatccttttctgattgatggtcctgtctggagcccttgtggctagaaagcaatgtcagctcctagttggccaaggtggccactggctgaaccatggattggtacctgaaccaaggtggctcttctctgagaaactgacaagttggcagtgaaaggagaatggagcatcaagggaaacacagatgtcctgagagtggcatgaaagagtgaaagagagttggaggggaaagcagcatcttggaccttggtggcttcccaggtccctcctagaccacatatactaaaatggcttgaagtaggagtgatggttgctggctttttgttttttatttttgttttgtggccagaagagtctgaaatatcatctaaccttcagagacctggagcaggatcctgacttttgcagagtcccaagctgattagggaagcagcctggacttaagtctcggccatctgatcccatttttcatcttacattctttcctatatgtaggtttgagagggaagaaacagaaatcttgacatcattaagagtttgggaggagggggttaaagaaataaggaaggactggaaggtaaagaacaaaaaagagaaggctgtggacctcgaagtcatatttttctctttgatattgttacttgatcctgtgtattttctccattctctggcttctgtaacatctattcatatccttccttttggacatctgaactatttctctcttttcagattgaaggataacagttggcatatctagttataatgagccggggtgaaccagacattttgtttgaaaggtgtttggaaggtaaggtcattgtcacaacatgcagcactatgttgctgggcagaaatataatgtgaggcagaataattcagacttgacagacacttgcacagacgtaatcacccagagacaaaagcagatgaaccctttctcgggatgccgtctaatcaaattcaggcacgtgtacagcctgcagcactgcaagggtgaccatttcatcgggcaatgattattaaaattggattcctttttcagaagagggtcaaaattagaattctgcaaagcattatcttcttcccccaatagccatgccattttataagagattgtgttgcctagaaatcctcctgatccttttgttcttcctcacatctaatccgtgttcaagttaacagcaaaaccggctaccagacatacccagagaagcacaagagacaattaacacctacctcttggaacactggtgacgattaataagatattgtgctgcagctgcgtatgtttttatgttttccacaatcaagcttgattaaagctggcttttgtgacatcccctgattccatgtggtgttggtagttttaggcgattggttgtacagctcccttttccccctcagaggcaatcactcctgcagccatttcctgacatatgccagggaggaactgatgtttctctgtggctggtgacctagtgcacagtaaggtcattcctaaaaagctggctgagggagaatttaactcttcagatcaaatatatttgttccacccctggctctgcctcctgatcaaagtcaggggtgatttcagagaggtggcccttcactcagtcagatgctgtgcgcctgctctctctccacgggcattaaaaacaaggcactcatgtgaaaccatgtcctcatcatggcagccgacctcggtttatcacagagtcgaggcccacatctttgatcctcctcataaaactgtctgagagagttgcacaaacccacggatgtcttttattgtttttctaatcacttttaatgtgttttcccacagtttttgtaggtgttgatgtctcagcctggctgtgtcagcaaaaaaaaaagaaaaaaaagaaagaaaaattcccagaaagaaacgcttatatgaattgtgatatttattttttttttaagttaaagagtacaaaattgtagatctcatcaggatttaaattgtatcccaggtagaggatcttatttaaacacacacacacacacacacacacacacacacacacacacaactaaggtctccagatattcaattttttctacttccctcaaaaattccctcaaaaacgccactgtctgtgaattccaacatgaagaaattaattattcccaaactatatttccactctcaaatgctcacttctctcccacaccccatgccttatcctatctttcatggaaatccttttgacaaaatgtaggcttggagttgctaataatttcaggacaaatgtttaggtcagacacaaaggtatttgaaaataatagaaagagactgaatgtgattgcagcttttctatgaaaaagagtatatttctaggtgtattttatggcctggggaagactcagccccaaataaaaacccatcccccaccacattgtcagatttttagtattaaacattgacataccttgtaactttggcagtggcctgtcacttggacggttgtctgcaagtactcctatgctattttggataaaacctacctcattaccacgtatgttgtgaaaaggaatgattgtacatatcacatgcatgcctgcttctttcccggtgacatgcctgtcctcttgtgatgcagttcagttcccaggggactgtaatgcccctgaaaattgacagtcacattctattagaacatatttttcccatttaataacatgatacaggtaatgattcataatcctcaaagggcctcctgccagtgacagctgaactcaagtaattgagaacaccatgcagtttgggggtgacttcacttttatggttcaatcaagagttaaaccagcagtatatctggagagactttcagtaaaattacattctcctgatacattttcatgtctgttttacatatgtgactctggcctctccaggcatggtgacctgaaaaaggaccatgaatggtatatttattccttattagaccctaagtcctacaaaggtaaaaatatgttctcctttttatctccgtatttttagtgcctaggatggtgcttggcatatagcgtgctcagtcattcttttccctgcctggtggtatgccgatcaggaaaattctttgattttgatctcacacctatcggtatcactacattgaagctcctccaagcccctttaaaccctggaaagattaaagtgcctgacattcatccagccctcaacaaccagagctacttccttcccactacctggtggccttaattaggagcccttgatgccatttccataactgccaacacctatcctcctcatcagacatggttcagttacaacaagactaggcttcgaaaaggtggtctcaccttttccattttctcataggcccctcacaggaccagagctgtgttgaagggtttcatagagtggcaagaagactctgtgccccatccaaaagcggtccttcctactgaccatcagcagcaccgcagaatagatccagggtaccttagctctctcctacctcaagatgagtcccctgctttactccctaaaacacttaattattttctcagaatcattttaggattaagtgtaataatgtatataaatcgcataatatagtatctagcatattacagtaagcattcagtgattgacagcttattcagttttctgagttaaacattgaaatctatctttccataaagatggattgtaacaaatattaagtttttatatggagacaactttgtggggttaaataagtgtggatttcccaggagatttaaccttgctttaagtactggctttgacaatgacttcttcaaggattttgggctaatgacccagcatctctgaaccgcatcttcttgagtaaaatttgggtcctcatacttacctcaaaaggtagatatagggattaaaggagataattccagtgattgcatattctaaacaataaagcactatacacattgaggagtctttttttccctatgctcctattctccaatgtgttatgtgaattagaggcaacctatattttgcattcacaataggtaagttatagaactgaggtttaaggccaggcgctgtggctcatgcctgtaatcccagcactttgggaggcagaggtgggtggatcatttgaggtcaggagtttaagaccagcctgaccaacatggtgaaaccccgtctgtactaaaaatacaataaataaataaataatagccaggcatggtggcgggtgcctgtagttccagctacttgggaggctgaggcaggagaaaagcttgaacccaggaggtggaggttgcagtgagccgagatcacgccactgcactccatcctgagtgatgacagggtgacactccatctaaaaaaaaacaaaacaaaacaaaagaactgagatttcagaaagtattgctacatgcattaagacactgactttccatgtccttgttatgctaaggacaaatattgctaaagtggagaaagatggtggtaaacccacgtcttctgattttttagactgtatgacaaggtctgtggtacctctatgggtttttgcagccaggggctactacagtggtttgctttgcacatcatacaaaaattaatgcaactagacccagggagatttttgttggcttgcatttgagatatgtttttaaaattgcagaacaaagtttaatttggtttccatttcccttgatgaggaatagcatctctactgcaagaaaacctgacactcctttattcttgcaaggatggtaaaattttctgggtcacaaaataagcagtagaggaagaaatgaagttgcatgcaagactcctaaaataaatattcctttgtggtaattattagaaggcttagattaagaagtcagccccaggagtttgggccatccttccctctagttttccccttcctgctttgcttaacgttgcttgtgtaacatgctaagaaggagctgcttcgcaccatgttttccaaagtgctcggaaatgctgaatggcgattataaaacaatgccttagggtttctgcgctccaagaatattactctagccaaaggccaagacaagaagatgtcccttaaaacagatccactgtcagagggaaatagtggcaagagatttgaatgatcataggtgccacaagaggcatttattgcaggttaacaattgcacatgcttcaggctttgtgggtatcccacaagtgtatgtcacagttgctcttctcaaggagattgtttcacttgggcttgtgggtacttaagtaataaagtgaaataagtaggctgggtgtggggttcacacctgtaatcctagcactttgggaggccaaggcgggtggatcacctgaggtcaggagttctagaccagcctgaccaacatggtgaaaccccgtctctactaaaaatacaaaaattagctgggcatggcggcgggtgcctgtaatccaagctactcaggaggctgaggcaggagaattgcttgaacccaggaggcagaggttgcagtgacccgagactgtgccattgcactcgagcccgggagacagagcaatactccatctcaaaataaaataaaataaagtgaaataggtaatgtctaaatgttggctggagaatttcagatgagggaaatcaccatagatggcagtgtcctgggggagtgttcacagaggatatgcgattggtaagaaccttccaggacagaaaagcaaggcatccccttaacaggacttcctattcatgcagcctttagatcttatgtgacctcatgacaactggctgagccaggaagggttttccttctagggtatgaaggaaaggagaggcgaatttgacctgcccctcatgccatgtggaaggactgggatgggaggacaggccatctgctcccaagatcaactcctctgccttgacgattctgttgccgccttttgtgaagtcattgctgcttaaatgttttcatcaccgttttactccactcagtggttagcacatgggggatatgccacaagtgtttcctgctgtccccttgtcctgaagagaaacaggtgacaaaatggccatacttctgaaaaataaaagagcaaaaacaatagtacatatcttttgcctccttcaggagaagcagttctaatcagaatgttattggagtgaggcaggagctggagaaagtgaggagtacataatgatgttgggggacaagagagaagaaacgaagacaaagaagtccctgtccttaccttctcgacgcccctgtggcctctgccatcgctgagggtccacttccttgcttcctgaaattctgtctcctgtggcttgcatggcattcaatgagcttgtgtacttcctcttcctcttacgagttattctgcccctttcatacttcttcctgtaccctcctagaggtggatgacccataaagctcagtctcagctcttagtgtcctacccgtttcttcccccagaattgccatttctgtgtggatggttctgaaaatcttagtctttccaggatggacccgatttctgccctgagctccaggcctttatctccaggacttcccaggcccctcaaactgaacctgttaaagatggaactctgtcccactgaaaatcagctcctccctctggtttcttatttacaaaaccattttgtttagaatgctttttcttctttcttgcttcctgtcatggtagaaagagaaaaaatatactctacatttgaggctcttcctttggtggtgaaacatttcctccaagatatttgtggttgatagctgtagtcttgtgtccaagtgctctgggacacatctccccgacagcccctgggtcccagagcccctctgtaaaagggaaagaggagtagtatgtttgcataggcaagaacctggcaagagatggcttgtaaatgccaaaaacgatcatgatggggtgcaaggaggagaacgatattaggaaggaagtagaatcttatcatccatggcaactggcaaaaagggtgcatgcccatttgaaaggcactttggctctgattcagtgtgtggtgttctacatatcgagaggctggaaaacatatgaaagagaactactcatgtttttccatctgtacacatgtgttctgctggtgttaaattcttgttggaagagtctctcattccataatatacacacagaaaaatattcccaccacttaaaaaattattattaaaaccagctgagtaaattcatagagcattgtagcaggacaagtgaaatgtaaactcacattctctgggattgtaaatgcctttaacacatatgctacttcatatgaaatttattccactactcatattgtgttttcatgtcattgatttcaagggcaacatttcaggacaaaaatgcatggctgcagacactgaatcttactctaaattctgaaatgtagcattaggcacagagccctccttctcgcgtaagaggacgtgaacagaaaccaatttgagaaaagaagctgttctcttgctgctataacttacccaaatcttgtaaaaggagcaggcttagattgcttcagaaatgagcaaagaagctacctgagaaggagactctctgaacaccaccagtctggctctgatgcacttcatcaagtgatgaatccatatgcattaagatttagtatccacttttgctttgctgatgagccataagctaccttgttgagggttaattagaaatactactcaattctgaccacagggagaatggcctgcaatgaggttttaagcattcatgtattcattcaaaaaatatttattgagcaccaactatgtgataagcagaggtctaaactttttggatacataagtgtacaaaagaaccaaaaattccagccatatttatcagaatatactgtgctttgtgttttagttgaatcagggctttgcccaagtgtcgctctctacaaggcactgtgggacaatattgttggaatacccaagacatggaaggcatggtctctgatatcaaagtagcaatttcaccaaagttgtcagatttaggggttagcatcccagcccttgtgacaccagcagtgcttcttctgagggacactgctgagaatggagaaggtggcaggcaagggccttccacagacgcctccctcccctaaagaatgcacaacctcctttgcccttgcttgcttcctgggttgcctttaactggacccatatcccttggcatctgccattcattatttggtttctactatcaccctgtctccagctctgatttggctcttcattactgaactttggcgtgttgtttattctctcactggagtttaactttgggtggtacctgttttctgtttcattagtcccatgactgcattgacaaccagaaggaacactgtcctttatctgacatgtatttacacatattttcactaatatattaaaaatgtatttattgaacacgaatcacatgcaagcattttactggggccctgggaatagagatgccctcattggattgcagagtggagtgggaaggtcggaaaaatgaaccaataattaaatataatatcttgaacacagaagaggagcacctacccatactggatggagtcttgaaacacgaggggaataagacagagaagaacgcgcccggtcttggggaggtataacacatatgcaataaggtgatgacatatcaccgttagataataatcgcagacaatgaagagtgtgtattcttctcagctcacatacaatctgatagcccagttcactcttccctccaatggtttttactccatcctctttctggtcccaccatcaattaccttggagacagtaggaaatgaaaaagaaaagaggtggaggtaagagagaggaaagacaagtgggaacccagggctcaactagtctgcacctcctcaaccagtagtttaaaaaaaaaaaaagtagaggccaggcacgttggctcacgcctgtaatcccagcactttgggaggccgaggcgggcggatcatttgaggtcaggagatcgagaccatcctggctaacatggtgaaacccaatctctgctaaaaatacaaaaaattagacaggtgtggtggcggtcacctgtagtcccagctactcgggaggctgaggcaggagaatggcgtgaacccgggaggcggagcttgcagtgagccaagatcacgccactgcactccagcctgggcgacagagcaagactccatctcaaaacaaaaaagtagaatctacacacagaagccacccttctccctcatcctttctctccacagcttccagccccatgcattagccaaggcattcttctgtcctttgctgcctgataatccacgcatcaaacatctaccccttctttgtgaaggaatagaatctacactcttcttgcttagcttcctgtcaaaatgtagtgttcaaggaataatcgaggttctttgagctaccttcaattttctaaaaagcttatcagaaagcaaactgtatctgtgataagactgaataaactcactgagaggccaattttctgtgcttttcgctggtatgataaaaataattacactggtactctggtgaagatgagaagcatggattagccattatctgtgtctgattaatttttaaattccattaattacttattaatgcaatttggaagaaaaatctttcatcccatgatatgggcagaggagggagaaataataaaaggctgggattcccttgtttgtgaaaaggttggaaaataccacccaagtggacattggaatgtagaatgtgagcacgatgctgggcaggtgcactgtagcacatgatgtgccctgaaccagtggaaagggaccgtgtgatgctgtgcattctctgaacctgtatcctcttgaaaccaacaaacagaaggcatttttgttgtggagccctctgtacaatgtacagcaaaataactcagaaccagagatgttgctccatgttaggtaatactagaagaataaagttttactggtcgggcacggtggcccacgcctgcaatcccaatactttgggaggccgagacgggcagatcacgaggtcaaaagattgagaccaacctgggcaacacggggaaaccccgtctctactaaaaatacaaaaattatctgggcatggtggcacgcacctgtagtcccagctactcaggaggctgaggcaggagaatcgcttgaacctgggaggtagaggttgcagtgagctgagatcacgccactgcattccagcctagtgacagagctagactccatctcaaaaaaaaaaaaaagtttactttcttttctgtttgtcttttcttaccccattctgctggcataacagaaatagaggttaagaatgggaattggctttacagaaaaccagccatgaactcactattgctagtgcctttcaatttgcgtcccaggacgtgaccaggttacttcctacagatgacctcagcaggacttttttagaaggaggagctcgagcacccacctcctgggttgcccatccccagggcctgggagcaggaaaatgcagcatttggagaaagtgctagatggaacaggtttgctgcaggcagagcaggaggaaagagaatgggtctttgtttcaggtgtgctttttcattcctgttacagctgagtgctggataaggatgcacagtggagctggcactctctcttcactttaaaaaatccagttgtgttgctattgattgacatttggaaactgaagctgaggttaatacagagtaaactattctctcttatgaagggttattaactcgttcaggccttctgtcagtggtatgtaattccctgcatgggagtcagaacaacaaagttggaaggttaagagaaacttaacccacccatcgtagaaagaagaggccagaaaagcaaagtggcctgctaaaagtcacatcagcaatttatggcagattaataataataaattaagcctacatgaaacttatggtgtagttcaaatctgaatagcaccactaggcaccctaaataccattgctgcgttgccaattcttgtgaaataacccaagtggattacacagaaacgtttctcaaatccccacaccagccagcacaactttatgactcatgtgtttgtagctgatctcagcatagtgaattttatgtacttcatttcctccctgatgttcttccatggaaggaccctgaggttcacagggcactatgccatcttgaacagcaggatttctccagtccctgtgcaggggacagtgtgtcattctgggaccctcaatgaggaaaggcatctaagagatctctcaaggactagtatttttcaaaatgtgatccaacaaccctccatccacagggggctcattagaaatgcaggttctgagatctattccaaaattaccaaatcagaaatggagcagaaatatgaaaatttaatgggtttcctaggagattttaaagcacactaaagcctgagagccactgccctgggctgcctggacttcatctctcctcaccattttcattcctgggaatgagatgatatggtctttgactagagttagataggtagatagatagatcttacatttaaataatatctatctactaattcagtcagcttttattgaaggctttctattactaggcaccataatggaattaataaaggtagaacacctaccatattctatactgattgctttcataaattaactcctttgatccttacaactttatagttactactgttatattcattcaacggaggagcaaaccaaagcacagagagattaagaaaaattttcaagattagagagcctgtaaatggcacagagtttgaacccaggtagtcagctccagaacccatgagcttaactactatatgatatactcttctcaaagctggagaggaataagacttggttattgcagcaaccctcccagccccaaccgcaggagctcacagtctcagcaggaatccagacttcagacatatacataggtcattacatatgcttgttaattgctatgataatgtatgaacagaatgctatgagaattaggaggaaattattaactgccaacggtgtcaagaaaggcttccagaaaaatatatggctcagtgagaacaggatttctgtctctttagcttcttctagcacagtattttacaaatattaggtgctcaaaataaatatgttgaatgagtgaattaatgaatgagatgattcattgcagctggtattgaagaatcgggaggagattttgtgacaagtaagagggagaagcatgcacacagcctggaggagtaaatggctacaaataatttgttttggcaaaagacattaaatgtgacaggagcaaaggtgcctgggagaggggtgatgggactgatgtgaggagcagggacaaagaggaggctgagagtgaaagatcttctgctctgtgcgaaagaatttagattagttctctgggcagcctcctcaggcaggggagtgacattatcagatttctctgatgggaagacacctctgggggccagtgtggaaggcataaagtggattagtgtgaaggaagtctggcaggaggaaggccagctaggaagattgaaggagtaagagcaagagatttggaaggtctgagctaccgcacaggccaacaggaatagaaaaggaggacccattagagacacttgtttgaggcaggagaggcaggattcaagtgagcagcgagtgtccagattagactttattttctaacacaaatggcaatggcattaactgaaataaggactccaagaaagggaagtatgaggtggagagagttaaagagctcagttttaaacaggttaggttgcagtcacctgtcagtccttccagggaagagaaattcccagcaggcatttattaagatgaatgaacagcaagttttcaaatggggacatggtgtttggtatcatcagcatcagggagggaggtgaagccatgggagcagagaacatccctcaggaaaagtgcataaagggagaagagagaggactaagaatgtattcatgaaaagtagcctttagcgggtgagcagtcagtagggcagaacaagatgctgttatttcaaatcagggtggtctaatagaggagtcaccttgtttttattcagaagaattttaggaaaatgaaactcctctaaaaagttctagataggctgaaacctaaaacagacagtacctttgtattggatgctttgggcaccagccctccttcacctgtgacagacacataacatccccttccccatctgggtgaatgccagcgaacctcagaatgcagaattcttcaccaatgctttagctattgacattcgaccttaagccttcggtggcagcaagttaggaaacttcaaacatcagcaattacagctgtctggttgggtcctctttcttctaacttccactgtgcaaggggaacgtctatcagtctgcacaccctcagagcagaaacaataagaaaacaagaaaataaggaaacaataagaaaactatttaacttaacgaaaataaccactttcttttaaaattagctaaacaaacatgatcacacttatcctttaaattcagttggctatttgcagaaaactgactcactcaattcagttgggagtttttagtctagcatgtttttgcaatccctggggcttcccacagcctgaaagtccttcataatgtggggtgtgtgtgtgtgtgtgtgtgtgtgtgtgtgtgtgtgtgagagagagagagagagagagagacagacagagagagagagacagagaaagagagacagagaggaagagacaggcagagagagaaacagagagagagagcgagagaaatgctggcattcaatgagaattgtagggaaatgatattgtacaaaggatattctctgtgtccattagtctgtccataagatgactgtgtcctcatggtcttgtgctgtgcatgatacctgcacaaatatcctgcctaaggcagagcaatttacaaaatcatagatactaatgtcaaataaatatatgggggaaatgttcaacctcaattgatgtcaaagaaatacaaataaaagcgacaatgtgatactgtttttctcttttaaaattggtaatgctgtttttaaaattgtaataccctgggttgcccccaggaaatcagaaaatgagactctggtactctgctgtgagagcgtaattatgtataacctcagaggacaatttgtcgatatgtatcaaaaaccttaaaaatattcgtaatctttgacccacccagcaattcttctttttagaatttatgtgcaagaaacaacgaattggatttttatggtatgtgaaatatacctcaataaagccatttttttaaaaaaacagagatatgtaaaatgtaaatatttattacagtattatttataactgaaaaattggaaaagccctaatgtctgttgtatgccacatctgctcaaaagaatatagccattaaaaaaattacgttaaggtacaactttggttcttaaagtgtgtttgccagaccaacaccatcaatgatatctcctgaaaacttgttagaaatgcaaattatggatctctgccctaaagccaccacatcggaaactgggattaagattcagcactctgtgttttaacaagcctttcaaggtgattctgatgctcactaaagtttaagaaccacttgcaaaaaaaaatattcttaataaattgcaacgtgtagggaaaaaaacacactacaaagcaatgtataatgatgtgaggtcaatttatctgaaaaatattgtgcatatgcatgcctagaagaaacagtggtgagatatatttgaaaaattaacagaatttatctacagatggtagatagatctctttcgttttcttctgtataatattctgtattttccaagttttctataattgttgtctattatttatataatggaaagttcttgcccttgaaagttctggccactaagacatttatggaaatatattgcacaagttcaatgaagaggaaaatagaaaggatgggtgggtttctcccctaatcagtcctgttgggaggctcattgcccttgaagcagaatttgacattttttgtgcttgctttacttatgaaagtgacacactatctgtcttaagcattgtacatcaaagggtacatggtccgcggtgcccatcagatctttgaccctactttctttgagatcacgatagggtggtttttcttcttttttctgtgttgtgttcagggatttgttgtatgttggcttgtgcctcctgctatggaataggtgagtttggggctttggcacaatctgtatcactctaaaaagaagatcaagagcatgttcttctttcttgggaatttcttatagaatcctaaatagcaacagtattattggtaaaatactgggatggaaaaaacactgggtatatcaggtgccataggactctgttactacactgtgtgatagggaaaaaaggacaggcccaggttccttgtaactagttctgtagccttgggcaaatctttagtattctctgggtcttgctttcttcacctttaaactgaaagagttgacaagatgatctctgaagtccctttcagctctgatttctatgcttttatgactagattcacagagatagactgacccataaccagaaggcaatataatgctctttcatctgtttcctgcagcttggatttgtgaaagcgcagtattggctgggcacggtggctcatgcctataatcacagcacttttggaagctgaggcaggtggataacttgaggtcaggagttcgagaccagcttggccaacatggtgaaatccccatctttactaaaaataccaaaaaaaaacaaaaaaaaatagccaggcgtggatgggtacctgtagtcccagctactcaggaggctgaggtaggagaatcgcttgaacccgggaggcagaggttgcagtgagccgagatcacaccattgcactcccgcatgggcaacaagagcaaaactccatctcaaaaaaaaaaaaaaaaagaaagagagaaagaaagctcagtatttcttcagaagatagaatatcctttaatgggcttctgcctgctctggcaatgaaaatctattttgagatattacctcagcaatattatcaatacgaagtggtatttggtattcaggacccttccagaacagtaccaaaggtttggacaacctacagataaaaatgatcattgctgaaaatgtagagagagactagatagatgtcacaggtcactggagtaggaactatttagtggagaagatggagtagctgtataggtcagttaggagacttgggttctaatcctagccgtgaccttgtctaagtaccttgtctttctcagcttcagttttctcatttgaaatatttctggttgatctccagggttattttgtttgtgaagataataagagcttatgattggaagaatgatattgtgggtataagatagttgacatacctaagggagtctcccaggaaatagccactgtagacaaatagaaaagctggaagagttgatagaactggaaggagcctcatcaactctactgaaggcctgaatcatttctacagcatccagcttttttttgacagggaatgagagatgaacacataccttgtctggggctggcaactgccaactttttcttgaagggagggaagtgtatacttaaactgccgagacagtctcgggtttgggaaagagatttctgttcatctctttaaactacggaacgtttatagtgtgcactccactgtaaaggaagcccgtgaagtttgcttggcataggagtaatgtgagtaatgaagtcttggctccagccaacattctaaagctgggttttgcaaaagttgcaaatccccagaggaaatgctggagcacagaaggcctgcatatcatggattacactaatccaagcaggaaatgataatgacatagctacacaagcagtgtttttcatggctaattgggaaggatggtcatttaatcaaactatgccagactccaggcttttcgcatctagggcagcctaggaaagagccctcctcagacccccttgttcagggtagttaagctcaactgtaagttccatgaggacagggactttatctttttattaacttccttttttttttttctttttttgagacggagttttactcttttggcccaggctggagtgcaagggcgcaatctcggctcaccgaaacctccacctctcgggttcaagcgattctcctgcctcagcctcccgagtagctgggattaccggcatgcaccaccatgcccggctaatttcgtatttttagtagacagggtttctccacgtgggtcaggctggtctccaactcccaacctcaggtgatccgcccgcctcagcctcccaaagtgctaggattacaggtgtgagccaccgtgcccagcctatctttttattaacctctaatacctaaaacctactacaattccgggagcatagcaatcgctagatctggtctggaagatctctgagtatctaactagctttttaataaaatgctttgttttgtaccatgtcgaggtaccaggacttgactttatgagcctcttatgaattaaaaaaaaaaaaaaagtcagacctgattctgcatgtaaagaactggatatgttcattgcagaaaaaaaaaaaaaaaaaaaaaaagttagattgataaagtaaaattaagagaatgcttccatgtgtgaggttatgtacatgccctttaactttatttttcttctgtctctaaccagacagaggctggggtctgggatgtcttctcagcatttaaatgcttcttaatttaaaacatgttttcaagagctgaaaatgaatatgatggctgcatggtatagtagaagggagtaatgtgctgagggcctgaagagctagctttcagcccacaggtactggcaccaacctgttgtaagatccagctttcctccgctgcaaaatgaagggcatctattgccatgattatatttcctaaaccaaaactcatcgtccagttccttatgatttgggagacaggaggcaaactgggagatatatctggaaggtaaaatgtggaaagttcctggacatgttgatgctgtgcaaacggtggagtcgcatacgaactctatagttgtggagtaaactcaggacataggaatgctgaacgtgaaacaaaacaatcttaaataagatatagaatagaccctgagatcatgtttttattgcctcacattcttcttttggcatggaagtaaataattccagtatctggaagacagttggagggtcagctgcacatcccccattctcaatctcaagtgacctccctgccagtctcttaacatgcgacttccccatctgctggatcccgagattcctctgtccgttttacagggtaaaaaatgaacctattaagagactgaaaaagatccgggctgttctgctcaagtagtcatactagcagggaatgagatttatgagatgaggtaatagacatacaaatagaaaaatacattctaaaggaacttttccctcaaatgcctatttcctttgtgattgatttgtgtgggggaggctgaggaaatttaattcccttgccttccccaccacattcctcccgtttcagggtctaaatgttcctaattgcagtacagaggcatcttctcagagagcggtcctcagggacacttcccactctcctcagctctgcagtttctagtggcttccttcagtgacattcctacttttcattgactcttgagatattatattaaaatggaagatttattcccctggcagaaattgaggtcactgatattcagggaaaggtgcagtgcctctccagttatcctgcaactctttgtcaaaccctgcagagtgattaataggaaagtgttcgacaagggtcactcgcagagggcggggactctggttcaaaccacactgtgtgctctcacccaagtgcgcacttataatcaataatagatactgcaagaggacatactgtgtagcaagcacagggctacatagattctattccttattttattgaatcctcaaaacgaatctttaaattggggagtgttagtccctactttaaaaatcagaaaactgggttgggctcagtggctcacgcttgtaattccagcactttgggaagcagaggcaggcggatcacctgaggtcaggagttcgagaccagcctggccaatatggcaaaaccccatatgtactaaaaatagaaaaattagctggacatagtggcaggcgcctgtaatcccagctactcaggaggctgaggcaggagaatcacttgaaccctggaaggggaggttacagggagccgagatcatgccattgcactccagcctgggtgacagagtaagactctgtctccaaaaaaaaaaaaaaaaattggaaaactgagacttcggtcaacctatttgctaaaggccataaaatttgtaagtatcacagttgggttcaaatccagctttctgattcggaagcccattctgtcggccaggttcgaatgagaattcagaataccttccaagggaagagacgaaataggaggcaacctgaagagtgcattgaagaataaaggatcaggggctcttcccccgtgccttgatgtaaataactctgtgagatcatctaaacataagcaccccagggctttttgtaggctcacaagacacatctcttctgcctggtttcctgctgatttaacatacaagtgcttattaatctctttctataggggaaaagcactgtggcaggcaagagagatacaaaacttattaaaacatatactctttcctgattcaaggcaataaacactacagagcacgcagctattaataactataataaattcggaatatgatattactctaaataaagtagaactagtatatagagtagaggcagtgggttaggagtttttaaattgtagttttttcccagaccagcagcatcagtatcacctcacctaggaacttaatagcaatgcaaatttccaggccctactggagaaacggggctggcagcgtaagctgtactttagccctacaggtgattcagattctccgtgaagtttaagaatcagtggtttaggccgggcgcggtcgctcacacctgtaatcccagcactttgggaggccgaggtgggcggatcacgaggtcaggagatcgagaccatcctggctaacacggtgaaacgccgtctctactaaaaatacaaaaattagctgggcatggtggcgggcgcctgtagtcccagcaactcgggaggctgaggcgggagagtggcgtgaacccgggaggccggagctcgcagtgatctcggctcgcagccgagatcgcaccactgcactccagcctgggtgacagagcgagactccgtctcaaaaaaaaaaaaaaaaaaaaaaagaatcagtggtttagaggcacggttagtaactgaattggcttcacaggagatggggtaagggactgacaacaaatccgcctggaaaggtaatttagggctgatgatttaaaggcattgaacttactgctgtggagacttcatccaacagtggatggcaagccatttggtaagctttacattttagaaagattactgcttggcagtaagtttcaaaagggactgtgccatctaagtaaaaactgaccactgatttctcctctttttcatatttctgctgttctttccactcaagtttctatgacaaaagttctgatacaacttgtctttatgaaaatcatattaacttcactaacccttcagggattccttgcaaatctatattttccaaatctgtatcataagaaacagaagcagccctttccccactagttaataggaaacagaaggctctactccggtgttagaggggcccaaaggcacaccttttgggattttcacactttctcctctaccatttaccatttctcccaaagattttattctcttaacacagtagattttatgtcctttcctgaaaggtaagtctgggacgatgaagccttatccacatcctcttaccaaactctatctttacccaggcatttgggtaatacttgttgtaaataataattttaataagagctagggggccttcaggcagcaaatgcccagactagtagttctccacatggtagtctcagtcttgaccattctttctagaacctggtgacagctcctctgtgaaattaaacaatagacttcatatataaattaggacttgtcagttctagcctccacccaggcaaaagaaatctgctgtgatttcaggaaaagcttttctatctcttgaagttctcagaggctttaggagtagagatccatgccagttccagactctcccttgcagctcctcatgagctgccctttgaaggccactctggacttcccctgtgccacacagggaaactggggcagatggtcaacctgggcagcatattgcttgcagagcctatctctatgtgtgggcctggtcaccccaggaccaacaaaacaaagctagagaaggacaactgggtggtccactgtgttagggaaaccaacacgtgtcaacagactatgagaattaggactctttcatctgtaaataaactatgatttttcaccaaatcttggagtgtataggactcttgtagcacctattatccatgtaattcattttagcaagaattatactctctcaaacactttttctgtttagccttgccttccccacaggacttggaataccttgagaacaggaaatatgatttatatttcttttgaatactaaaaccacagccctggaaacacaatagataattctccttgaactgaattaaaatggaaagggatataagaattagagaccaccccttgaagcttggaaaaggtaatttgagggtaaaaataatgaaaggaaaagaaaacaaaatgtaatcttaaattatcaggtagcaagtttacagaagttcttacccacaaaggcaatataaacagcaaatacatagttcccaacctttttatttggattctttctggccatggaaatcttttggaacccacatgtacaagctttatctatatctatatctagctatcaatcatctgaatattctgtgtagggattagatatatctaatattgatgtagagataaatgggtagatcatagatacatacagataagtaaaatacccttttacttgcaaaagtcaaattttgtataagagatacttatcagttatttctaatgattttcatgcatactccatgagcatgttattcttgccagtgaactgacaagaatggtggtggggagaggtaa[450 bp omitted]catctcagcactgccagggaaacaatttgaacccttttgccttctgagtctgccttgactgcctgaatgagacatggctggggactttaaaaccactgcagttactgagtccaccacccctgcaagtgagacacaaggccaaaagaacatcgagtttaggattctgctgtgttttgtttttattgcttcataatactaaagttccatctcagagatgaaacattgtataaagagacctaggtttgctttcactggtaatttgcttttcctccccaacaaaacagatggaattgttgttgttgttatttaatcttagtacttctggatgaaccatgaccattctttacttcctctggtcaaacttaaggtggctttcagaaattggttaatatgtcctcagattacctctgtgatctgaaaagtatccttgtttttctagttggaaaaaatgaagcatgaaaggcttaggcaatcgccttatcctgtcaaggatggaagcatgagtggtcactggggaactgacttcctcctcagtgtcttggagggagctcttgccttctagttggagggcagtaaacgggtgctatccaggggcagccatcccaacaatgagagttagcctccctctcaaggagggagaccacagccctgcaactccccgcagagatgcctcttccctggctgacagttaaagcaagtgaccttcagcgaaaccatggaaagtccaagtgactaatttcatgaacctctggtgtgtgaggggcggaggaggaggaggaggctgcctgggcacagggccagcatgagccatctccagtccttgcagggggttgaggagaagatgagagcagaaggggtcagaagaaaacaggctcctctgtgtggttgggggagagagtctgaccatgtggacagatggaagccctgggttacggaggcgaagcatgttagcaaaccaggagcatttcctgtctgcagacaggcagagggccaattcttccatgagctggaaataggaaccagtggggggcggtcagcacaacacttttcctctgtgggttttacgtagtgaagtaaagaagcttgttatgtcagtgatcctgggagcttgtttatgtgctgtgttttcttttatgtttcctcttgtaatacttgatggttcccaatccacagaggccacattgcagttacgtcccagacacacatcaggcgacagccattattcaggctgtaatcattttgcccagcagcatagctagaaatgtttagaccatgagttagcttgttgggcctttgcttctggaatgtacacattcaaggagagcaggaggggcggggcagggacagttctttctctttcccttgctctgaagaagtgactaggcttccagtaagcattcatcactgagcaacttagtagaaacaaagcactgtcctttgcaacctggagaataacagctaaacattggaccagggtgttctaggtagccagagactttcctcatatatatatatatatatatatatatatatatatatatatatttgaattgttacagcgcccatgaggtgggtagtattgtttagaggaaaatagggctcagagaaatgtacaaggtctcatcatagaaaacctgaccctgctttaaaggaccatttcaaggaatgtgatcagcaagaaggcagggtggaactaaatatttctcagccctgtcagcattcccaggaccacttcctttatgggaatctcatcatcatctgatgcattctcttcaccctttctggcccagcttggatactatcctttcttgaagtttggaagggagcccaatgtagagcatttctttttcccacctgaattccaaatgaattaagaaacttcgctgttcttcattttaaaaaaggactaaggtggaagatggagcttggcaagtgaagtccccaattaggcagacttatttacccagtcataggcatctaggagggcctgcttgatgagacttaccgcgtggaatagcagagcactgctccctgccagcaggcactccctgggagaacggggaggatcaggacccagcacacgtctggcacagtgaatcaggagccaagaggccggagtgttacagctactggggcttcacaggctgctggcagtaaccctcagatgtggagaagagtcacttcacctaatgcttcctccaggacatcttacctggcacctttaggataggttaaggtgccctttctgctcctccatggcactctctgcacgttactatcttgtcacatcctgaatcgtaagttaatgttcatgtgtccctctccctcaaaggactgtgcactctgggtgaatatcctgggtccttccatctttttattcacagtgcctgctacctctgagagtttgttgaactgaactgaactgagatactgggcctctttaccaaccaatactgaaaatactttgttgttgggtggtcttattcacttctgcaatgttattctaagtattcatttacaaagtcaggataagcactgataagacagcctacaagttctaaagggaagactatgatatgcagataaaagctgcagaggcaactggcaactgattctatttctcaaattgaacctggataatgtctgagaggaggttggtaggagcagctattatttggagtaagtgtatgtgctggtagcaaatcaatccaagatttgatagggagccctccagttgcattttctgtgttgcagactgctcaaaagttttgtccccagagtagctaccgcacctgggagcttgttagaaatgcaaattctcaggccccacccgagacctactgaatcaggatttctgggagcagggtccaggaatctatttttaacaagctctctaggtaattctttgttaaagttcagtttgagaagctttgttaaagtagtcctccttctctaatgtaggaagaacagatttgcagagtcaaagaaaatcatagtgagagctcacatattttgcaaagtgttgttttaaacactgtaagtatattaccatctttattccttgtgacaatccagtgacatcgttactatttttgttttatcatatttatttatttatttatttatttatttatttatttattgagacggagtcttgctctgttgtccagagctggagtgcagtgatgcgatcttggctcactacaacctctgcctcccaggttcaagtgattctcctgcctcagcctcctgattagctaggattgcaggtgtgtgccaccacacacagcaaattttttgtatttttagtagagatggggtttcaccttgttggtcaggctggtcttgaactcctgacctcatgatctacccaccttggcctcccaaagtgctgggattacaggtgtgagccaccacacccagccactatttttaactttcccttatagatgagacaactgaaacacaggccactacctcacttgctttgggtaaaaaatttgagagaatgtcaaaaacctcagtaatcaagattaataatattttaatgtaatcctttaaaaaaccaaaattaatcctaataaattcatgatgatcaaaataccaaaatataaaagaaaggcaagattcaataggcagaatgttacaataacttgccaggatgatacagttaggaagaggcagggtaaggacttgaacccaagtgggttgaccccagggaccacatgcttaactgccatcgtgtggtcctcctaacaaataataccactacaagtcttgatgttttgataggacaaggaaaggtacaggcgtaggagcaagcgtcatttgggattaagggatgcctcattgttttggactaattgggacctcatgcaaaaaaaaaaaaaaaattctaaaaacagaagcagaaaatccagatggggcctaaattttataccttgaccatctatgaatttaagtatgaaaaaagaagatttccaaagcatcctcttaatttttcttctggctggctcctgctgggagaatcagtgggtaaaactaccctgcattctggctgtagaaatgtgataattagaatcacttaatataactgcagtgtcctccttggttcctccaccttgagagagatagatggagcatttcccttgcttgcatccaatctgtgagattctggcaggcaggctgcttgtcttgagggcttgtcattgagagctggtcacctagaatgccccgacatgtttgagctgcattgttaaactacattggtattctcccagcaaaactcctctccttcttttaccaaatcagcattctgtgaacacagtatttccttgcctggaaacattgcaagtttctgctacacccaccatgactcttccttgctttatacaaattggctctaaggaatatttctggtaaatgtgttcatgtgtcaggagactgaaacaaatttcacatgatacactgaagaaaatgatcaaagggtttatggctagcccccacggtccctcgctttagttggaagaaaagagagaatgagttttatacacctagaattcttgctggccatgtgctatatgatatttaaggtaagtgagaactgcagagttttaacacttaaacatttggacagaacttcaactggtgttctatcttctctgtcgattatatttttaatagctgtagtagttgggaataagttgtttctcgatttgtcatttaaatccagtagaggtcatttgttggatgttaccaagtgagtgctgaatgagtctacatttcttttgctgttgataacaatatgcagttactctttttcacctattcttttagacagaatctcactctgttgcccagcctggagtgcagtggtgcaatcatagctcattgcagcctcaaacccctgggcttagtgaacttgccacctcagcctcccaagtagctgggactataggtgcacaccaccatatctggctaatatttttattaatagtagagatgagatctcaatatgttgcccaggctggtcttaaactcctagcctcaagtgcaagcagccctcttgccttggcctcccaaagtgccaagattacaggcataagtcactatgcctagctataaacattttttcaacaatttatcttaaaaatatgtattgatcacctatgaactaaaatcctaagggctgtattagtctctcactgctataaaaaatacctgagactgagtaatttataaacaaaagaggtttcattggctcatagttctgcaggctttacaggaagcatggcagcatctgctctggggaggcctcaggggagttttattcatggtgaaaggcaaagtaggagcgggtgtcttacatgccaggaacaggacaaaggaagagggggaaggtgctacatacttttagacaaccagatgtgagaactcactcaccatcatgagaacagcactgaggagttcgtgctaaaccattcatgaaggagcatccccacgatccaatcacctcccaccaggcctcacctccaatactgagaattacaactgaacatgagatttgggtgggaacacagatccaaaccatatcaagggccggttatatgagttagatatagtttctgcccttcaggagctttcggattacttgctgtcaagaaatataactcataactgtaatgcaagatatgacagactaagaagaaataatggaaatattttggatgcccaatgatgggagaggcaccccttggagaaatcaagaaagacgctgcattttagctcagccctatggatcagaaggataaagagaggtgaaagagtgtcccaggcaagggcaaaggcaggagctgaggaaggatggatggagcatgttctgaaaaaggaaagtgtcccggtaggctagaagaaagtgaaaattagacgagggagtttgaagtgtattcagcaggcaccagtgagcaacagaaggttttgtgtttcagcaatgatgggagataagtagagctatgcttgaaagcaatgcttttcagactttaatgtgcattcagatcaccaaaagagtttgttaaagtatacatttagattcggtaggtctagggaggggcttaagatgctgcattgccaagaagttcccaggtgatgctgatgctgctagactgtagaacacgctttaagcagggagacttcagaaaaatgctgtaatgggaggcaaaataaactagagttggggaggcctggaaactgtcaagcaggggttagtatggtggccctacaagggtaaagcaggtctgaactagagtagtgaccacagggatggagacgaggactatctggtggcagtcaaattttcagggcttaatactatcttatgtagggtgagggggaatgggtcgctcattaatgactctaagaccccaaagctgtgggtgtgggtgctttgagcatgtccctgccctaactctctgctctcatcatcctgaactacttgcaatttcctcagagttgccaggctgtctgtctgggcttgtgtactgttgccaatgcttcaagaaatgctgacgtctctctccatccccttactagattaactcctacacaacccataggattcaaggtaagtgtcactacttcccagaagtcttcccgggcaccctaacccactccctgctcccagtctgggttaggtatccttcctatgtgctctcactttatcttgcaaggtctcatatccaagcactgtgtattctgattacacacttgtcattgaagctgagcttcgtgagagcagggattatctttttcagctttgtgacttcatcactcccacatagtagagactcagtaaatgtttgatgtatgaatcaggaggaagagcaaagcttttcttgctgtgatggcaataacttttgtatttgtcaaaaattgttaacgaaatttcaagtcaattatttagatattgaatttaatttagattggtacatgataatttgaggggtagaatattcaggcgaagatatccaacaagtagttagaagttttggagtacaaattagaagacaatttagtactggccatgatgactcaggagtcatatgcattgaggtgacagttaagaacatggcggtggatcaaataaagacagagagacaggcagagccaggcagagacaaaggaagaaggagagatcagcagagaaatttagaagagagaaggagaaggagaccgagagaagacagaaggagacaaagagaaggagacagagagcagacagaggcaaacagagacagactgaggacaactttacttttctttttttgagacagagtctcactctgtcgcctgggctggagtgcagtggcgtgatctcagcttactgcaacctccgcctactgggttcaaaagcaattctcctgcttcagcctcctgagtagctgggactacaggcacatgccaccatgcccggctaattcttgtatttttagtagagatggggattcaccatgtgggccaggctggtcttgaactcctgacctcaaatgatccatctgcctcggcctcccaaagtgctgggattacaggcatgagccactgcgcctggctgaaaacttaacttctcattttttttttttttttgtgacggagtctcactctgtcacccaggctggagtgcagtgacgtgatctcagctcaccgcagcctccacctcctgagttcaagcaattctcctgccttagcctcctgagtagctgagattacaggcgtatgctaccatgcccagctaactttctttttgtatttttagtagagacagggtttcaccatgttggccaggctggtctcaaactcctgaccttgtgatctgcccacctcggcctcccaaagttctgagattacaggtgtgagccaccacacctggcctacttttcaattttgaagagcttctgtgataccgtggatgaggcacatgactgggttgcatgtcacagtggaaggcaatgttcgtcacagagggctactggaacctttaagagggagatcctaaagtgacgaggtttaagatgccgccttaagcaatagggctatatgtgaggtcaggattcagaaatcaatttcacatccatgctaactgggcctgttttacgcctttctagcttcctgcctgggcagaatccattcgtcaaaatgtagatggacttaaagctttgtctcaactcctctgtcctttggtttccaaaccactttatgagatcatctaatcagctcacacatgtgctgtctgtctttctcatacacacacactacttcttcctgccttctcctatcaggtagtgtgcgtgcttatgtgtgtgtgtgtgtgtgtgtgtgtgtgtgtgtgtgtgtgtgtgtgtgtatttttcagaattttcagacttttcaggccagaaggacatttccccacttcatattgatccccaacatttcagggaaagcaatgcattaaataaaataatgttcagcttcaggcgggtaggcaccctgcaaatcatagtgtagacaggcacctaccaggcctccagaaagaatgaccacacctaggcttttttttttttcatgttacccaaagcagcattttaacagacttctattgtgttttctccattcagttcacttagagggtgacatttggccctcaaattcatatgtatagttgctctaagagactttcagagctgcatgcctgacaaaatcagaccttctgttttatctgaaacaaccccccaaagaaaatcattgaatctgaatgaacagaacaattctttatgtccacgggagacaggcagacaaaacccaataaaaatgaagaaagaaagagacatggcaatgatttgtttttcataattacttattcagagtagaaaggagcaggggaagagggttccttttaacatgtcccgacgtgacagatgaggtgtgctcgtcgtgtatacgcaggagagatgaatgcaccacagtcttgttaaaggagatgcttctcattggacagagatatatttctatctggaatgctggagataaacacccagcattttactcctcattttcattatgcctaaagcccctgactgttctttcagagtggcaggtgatgtgactagcatgcatcagaccattcttttctatgtcctgtggcaaaaacaatcccccttttaagacacaacacaggggtaccccaagtgcatactttgctccgaacaatacccctacaatgtgcatgtgatagattcggaaatcatactggagtgtaaaaaactacatcatctctaaattcattttcctttccttataaccagtttactttggtgcaaaatttgcccaagaagggttttagccagaaatcaatggagagaaagaaaaaaggaaagttttagttaaattgtctttgtttcttcacctacgtggaaaaggtaaagaaactttttctacttaaagcacatagcctttgctcatggaagagtcgaatccaaaagtttctgacttgaactataaaagccataaatcagatctacgatttaaaaaaatataaactaacactataatttttcatgtatctgattaagggagggtttaatgcattcatgaatcatttcctaagactgttatgaattcaaggataaaggatgaaaaaaatgataagtgcaggaagtataaaaataagggttatgctataaacttttatgtatccatattacagtcatgtagggacctagattgtatctaaagccatgtaaatatataagttaaaacttggggatttgtgggtagctgggagattatagtccacatcactcatcttatagaaaaggaagtattgaggaaaaaagtttagctgtatagcatatatagtattatttcttcagtcatgcatataattacttattacaaattttcttgcacctacaatgagccagatactaagtacactacaatgagtttgacactaactcataagtgggtattctataaatggtttcttaataaatgaaggatagaacatgatctcactctggggtagctgaaaggttgaactcaagtctcatgatccccaggagatcacatggcctttcattttcagcaaagagtgtgccaaaacaggttggtctggcaccatttttctcagagcttctgcattaaaaaaggctgtcaactgcctcttttcacttttaaagaatctcaacaaaaataagtaaccaacagcattttcaacatcaaactacttctctcttacaaacccaaatgaacaactgtcaatagatgaggaatcctcaagtttggatgacacaatcctgcctcactgctgtattcagagtccatgttgtaggatgaggagtgtagaaaaccctgatgctgccatttactgagtacctatctcatggcaagtatttgaggtcctttacacagagatttcatctaatcctcaaagtaaactatgatatggtgtgatcagctcacacagttgaagatgctgaaggtcaaaaatgttagacaacagactcataacagctggcaggtgatatatcttagatttggactcagccctttctgactctgagtcccatggtttgtcccctgtcctgcctccccgattcactgctaatagcaatattgtatacaattcttaaaaatcatttcaactatgagcaagtagtgagtacatatagccagactggccctgagcatggtttctcattttctcttgtcaaaacctaccagatctcatggcctgctcaaggatcccaagagatggaattccttataagaaacctatctggtttccttcaaatagttaagctcctgctaccaataatattataaaaattatatcctgagggtgctcttatgtaagataccatgctaccacaatgatatggatatataaaccttttccctcactttgtggttataggagtagattgaaaatcatccatattttatgtgatcatactgcatgtcacaatgtttgtgtgtggcacacacacgtgtaagtatacaatttttttttttgagacggagtcttgctctgtcacccaggctggagtgaggtggcatgatcttggttcactgcaacctccgcctcccaggttcaagcaattctcctgcctcagcctccctagtagctgggattacaggcacccaccaccatgcccggctaattttttgtatttttagtagagacggggtttcgccatgttggccaggctggtctcgaactcctgacctcaggtgatccgcctgccttggcctcccaaagtactgggattacaagcatgagccaccacgcccgaacaagtatacaatttttaaaagccctcacacatcatgattttatcaggacagtccctttaataacttaggaaactgttagaggatttattttaacacaacaagtaacaggttacacagctaataagtgaaagagacaggaccagaacccacacgtcttaacacctagacaaatatttcttccactgtgccaggcagttgaaaattcccagccttatcatgtgctcttcatcttttccctaaaaattcacaaggcagcatgatgttatctgacttatcactcactgtaaatattttagcatttaaatgaggaggcagagtaaagagaaaaatgtttctgtagagatttttgcagagatagagagttcttggtctccatccaaggatcttgagcgtttaatgagactactgtccacgagttggtacagggtttagcaatatcatggtagctatttggcggctcatggtcttcctcaaggtctccaaagggaaaacaggaagcaaggcttagttctaacagaagctggactctggtcttagccctaaataaagcatgccacctctctgagcttcagtttcactatttttaaaatgaaggtaataattcctgtttgcccaacccacagacttgtttttgagagtccagtgaggtaatgcatgtgaaacttccttgaaaaccattagtattaaatgccatacaaatgtagggattattattaatattattaatggatcacaaagattccatagcactgagaaaatgatgaaatgaaaataatccaatgcattggaagttgatcagggcagccttcactccaaattacctttgacttgtcccctgtcactccctagaatctaaaatgaggaaagtcatttctcttccacgggatttgtataagagtgaaacaaaatgtctgtgaaatacctagagtagtacttggtatatatctggcctcttttctaaaacttcccgagatgaaaccctatctctcatcagatagcctgccagatgatctaacacaggatagcaagtattcttattatttgttactgtttctattattctcaatttaaaccacttcctataatttcacagtaaaaacagagccattcatcagataataagcccagtggtctctctcttctaatcttctaaggtcagctacatggaggggaagggggcaggtagcacaaatatctgaggaattatatagggattgagggccctaaatccatgaaaaagagctgattaattcctctacatatggttgaacagaacccacttctaccacttactctattcgtcccaacctgcctccctcttctcccctcattcttggcttactggaagatttaaccatagctaagcatgctagtcagcaatggattatagacactgagtttctttctcaataagcattcttaactacattataaaaattcttctctagatgtacgtatttgtttaaagtcctttgagactctaattaatgttactcagcatcttcccagcaatgtgatcccagttgctaattgttttacctggttagtaaaaggtcttatcagttaggctgcagaattgagacgagaactcccagctctgaataaaaagcccaagctcatttctttatgtcatacttccagccatgaaattattagactcctataaactcatcatttcaattgctgtcctgttccttcattctctaccagacctcccaagcaagaactccaggatgatacttagtgcaattgtgctaacatcttcaaacactgcagtgaggtgtttgaaataaaatgtgtaattatggtagtggaaagctacatctgattccaaacaaacctcacgttcccccagctataattagagagcaaggttcgcggcacagattttcccatgaaatccagttcaagtaaggcttctgttctttcagaggggctcctggaggtggagattgtgattaaatggtttgacattggtcccccttccacattctaaagagattgtctattatcattcttggagtctaaaagcacaaaatatgtgcaaggaattaatgttgtttggagttttggataataatcttccaatttatttgtctctgaacagggacaaattagaacagggaaggaaagttacagacacacacccacagaaacccacggaccaaagtgtgcagaagtaaaaaaccgcctcttaaatgtctccagagaaatttatggaaatcggaaatccctgcagcttcggataaaactagacattgttttgaataatctcacaggcccctgcaacttaaaatccataataataggagcaagagcgacatgaccgagggctcaaagattttcctgtttcctattaatatttgaggactgtccatctgaatcttctcaaaagcatagatttcttgactgcccttggaggacttttgtaattaggcatatttaagctgtaccatgttatactgctacaggaagaatcccatttgtcagcagttttaaactttgccaaataaaggcttattggcaaacggcagtgaacactctgataatgacccaactttagaaaacacacaccctgctgtgttgtattcaagccacagttctgttgaaataaaaaagagagacaatgcctgctttcagacactagagatcctttgtattccaataaaagtctaaattaatgttttaaaaggttattgctattttttcccatttagctggcatcagttgtaagtcttatttagacaaggtcctacgttattttactatttctttttgcacaaaagctagtatttgattgtgttagatcatcagcttctggttttcattagacaaacctgaaataccctattattaagattaaacaaaaaaatagttgttttcttattctgaaacctattattttgaggctgctctgaccagaggaagagaaatcagttttgcaaaacctgatggagagatacgtcaagaggagaagcaataacctcatcaatgctgcatttaggttgcttttgtaaatgagatcccttcctggatctgacaatgggaaggaaggataatttcgttctttggcattggcaatactttctttagtataaaaggactttcaaagtgcaaaatatagggcaaagaatactgtttgcctatgtaatgtcagcaaactggtgaggtgctgcagagaatctgcaataacatcgtactggaacctgagggttatgagatcttagatctccatgtcatttacgcttaccatggtattttctcaatgttaactctcagaataagcccttagcaagtggtgggtatttttccagtcataccagtttaacagggaaaaagagagtcagagtaacattcacaaatcaagatttccctaattcttccatcattcagatgggaactctagccccttcagatttctcccaaatagatgagaaattttctaggggcacctcatatggactcttcctcctgaattattcttactggtcctttgggtttcaacatagaagtcatttcttcagaaaacctactctaccaaactgaagaggggttaggtgcccctcatatgtgcttgcaaattattatagctctatccatacaatattgtgattgtctctggtcttgttgctttcctgcactagattgtgagcaccatgacattagggatcatatcttttcattgtactgttagctacacataacagactgcatgctatacgttggtaaatgttaattaaatgaatatcttctcaggctagcttttttgatcgccccaacgccttggctagttttctctcatcctgcctcagattgctgtggtgatgcgtcccgctagcacctgcagagacagccctgttggtaatgttggccacagtgccagctctgctgccagtgcccatcgatgtggacatggaggcggtcctagcttcaagctgacggtgctcccctgctgatacagaaactcctgattccaaagctacattattttgtttgttttatgccctgtgtctttgtatcaccacccccattgctaaggcctggtccttatgtgtggagaaggaaggcaatcggagggaggaggtcttctgtgctcagaatcacccctttttctatgatagtgcctcaaactcatttaccttggctctcatccctgaggatgagttttttcttgcgatactctttggttcctcatttaaatggaccctggtgggatttctcttctccatctgacagacctaaatatgccctgttctcagggtaagcacaactggggctctagctggggcctcttacgtagtataaagataaagaactatctgtgcatagggaatcttttgctcctttgtatttcaggggagatgtcaagggtcctggtagggtttccaggtaaaatacaagatatttaattaaatttaaatattaaaatacaagatacttaattaaaattaaatatctggtaaacagcaaataatgttttgttttgttttccagtatgtctcaaatgttgcatgggacatatttgtactaaaaatgtgctgcactccagcctaaaagtaagcacctcaccagaaggatgtcatgtcatccttcttcccccatatacctaggcttatcttaagcctttgagtattggataactaacaataaagatatggtcaacagtatggtaaagacaggccaaatattacatgagacatacttatgctaagaaatgacttgtttgtctgaaattcaaatttaactaggcatcctatatgtttacttattacatctggccaacctagtcctgagtcaaaagcagcaaataaagccatttgaaagacagagacagtgatgttcctgtgtgtccctaaaatgacagctcctagcatggcccgtgatggaataaatggagccagtcaagtgtatttgacctccttagcccataggcttaccctaatccagactggtgggctctagagggaggaagagccgcctgaccctcaagttctagactctggaggtatctgtcatgtagatctggagtggtggaaggtcctttgggaactactgaacgatggagagagtgacgtctaggggcaacactgctacctctggcagcactgctccaggctatatcaactggagctgagaagtgcctctgcatgtaagagctctggtataaagtcagcaaaatttagagagtagcttcttatggtttgctcaaagaaactccaagatcttgtcttctgctggccattcatcaaaattggcttagattcatctcagcctgttcatgttgggcagaagggctgtgccttagcccaaaactacatacctcaccagaggcaataacagtggttttaatgctgtcttttctttctcatctatctgggctgatttttagcttttgaggatcaaagaactaacaagaaaaatataacttgtcaacagtatggtgaagtcaggccaaagcaagaaggtgaaaatgaattgatattagcagggtaagcaattaattttcttcctttagtcctggcttttgtgcttgccacaagtctaatggagtaccagatgaaccatgccaatgcctgggcactaataacaaaacaaaagctgataaagatggataaaatcatctatggaggcaggaagcaattaaccacataaagaaagtgaaacatcatcaatgataagcctcagcagcaatttacttgggtttgagaacttttcgttctgatggttttcaataagttttcctcattttctgcagcttccttaattcaatagatttttttaaagatagaattatgcagtcattactacccacatacccaggccttcattgcatcacggagagtagatgtgggtggaaagagtgggaataggcaacagagacggaaatttcaaaggcccttaatgtttgcctttgcttgagtattttgtattattttggtctttgccatcatctggtattgccctgagcttctgcactgtctttatgaaaaacactgaaaaacaacagttgttgctgaccaaaatgattatgagtaggtaaaggggagaggtagccccagaggtcagatttcctgctgtcaaatcacctttctctagggatcaaaaaattattgtgattcttggtaaagaatttaacatggttggggatttcttattctctcttaaatatatcaaaaaaaaaaaaggaactgttatatatcaagtatttgatatgataattgttggataccactgtcttttttttttttttaagacagagtctcgctctgtcgcccaggctggagtgcagtggtgggatctcagctcagtgcaagctctgcctcccaggttcacgccattctcctgcctcagcctccccagtagctggggctacaggcgcccgccaccacgcccggctaattttttgtatttttagtagagacagggttacactgtgttagccaggatggtctcgatctcctgacctcgtgatctgcccgcctcggcctcccacagtgctgggattacaggtgtgagccaccactgtcttttttcagtggtgagtgataggcctaatgtatctgatcgctgtacaaagttgtattaggaaagctgatttggtttgtggaacattaccaatatatatatggaaaaaggttttattaccacatggttctggcatatcttccttgtaaggtattgtaagtatcaaatgacaagggagttctggaatttactacatgagaaagtataactagtgacttttcatatttttggaagactaaagaaaaattaaattttagaatgggttgtgaaatctctttcttaccagcattttatggtagaagacaagcatctgccctcaagttttagaaaactggtctatataaaagtaagggactcagccagataaatcaagcaccctaggacaatacaaagttgtcaggaggattcccaggttctggggatcatagaaactcaccgatctctacctggaaagctttttggggccttcctggactatgtctcggaggtgcttcctgctcaggcatttccaagtgaggatgcattatcaaacccagtccctggtggtttacccggcaatcattattcaccaacccccccatctttcttaccctctctgaatgctggctgaccacttgggggtaaggaaaacaggaagagtgcaataagatcgcccattagcagccattaggagttcaacattcatatctcagcagtcactggaatagatttttcataaatttcctgagcacccttgtggaacacaatataagaggcagccattttgctccctcttttacagatggcataaataacttcctttggccacaaagcttcagagttaggagctatacaaagatctcctaggcaaggggcagtaatatgagctcaggtggcggtcaggtggctgtctggaaatcagtacttgaagagggagacaaaggaatagctttcagggattcagccaacaaacacaggtatcagcatggacgacaggaaagtatatttttcttcattttttggcattccaccttgcttcatgtcaccatttttgggtgttcaaatctttgattacaaaaggaggatcttgaggtatacaaaaaaccggaatcctgtgttcttattagcctaaatatgtgaaggacttcttttggccctaataacgccaagttagctaacatttaccacagtcattttttaatcatttggttcaaaataggaatgacagaggccaaaaagcctaccagttataaagacattgttcttgatggatacaggaatattgtggggaaaaggatggaaagggggaattatttcactgaaagagactaccctttcatataattagcacataaaaaagattgttaaaaaataacagtcttaggaaccaagtattaaagatcaatatatttaataattttcaggtttaatgcaattataaaattctaattttctaataataatattcattatccaagtgattaatattaaccataaacacccacagtttcttctgtctcccctgcccaccgtctttcagacacactcacacagtgtatgtgtagtatattaaaatggagactgaatggtcaatgagtttgtggacaataccatacttgttattctttttccatctgaaaggcaagaaacaaaggaattccaaagcttagatcatgtgaggaaactctttctggctcccagtacatgtgttgtccagttcttaaaatgcacaggctaaagcaaacttaaactcttattcaaagtctttgttgaagagacaaaggaattgggttttccctaaagatttttctaaactagtcagatttgcttcttttgatccaggcgtgtaagagacagtaagagaaatttagtcttgggaatcactattttaaacaaaggccaaaaacagtggtgtctatttttaaagcctcctcatttctccccagaaccaagtgcaaggtaatttgaattcggtttccagtcaatatggttaacctgatttcactctacaatttagcagtctgttctttatacttgatttctatgatattaagtgcatgcaacatttccttcccttttaacccggtttccacttacagttttctgtgtatttgagatctgtttggtggcctgcctgaactcatggaaaattgacgacactgaaagagaattgttgtagttaagcttccctgatggcattttttaaaaaacaacagtggaaaaaaataacaaggcactagtcagatgtgatttttggcagatacttcactcaaagtgctcagggcatccccagaaattataacccctcaaagatgttcagggtacagtaaataaagcaagatacaattattttaatgttcatcctattgattcagttctcttctctgcaaggtcttagtaacagggattttgatctaagtgaaaggtcagctttgaagtaagtgtaaagttatttacaggaaatgaagcaaaaagtgggctttcatgcattttgaaatttctttattattgaggagaaaatgaactgtgtcatcagctgaaagaaaaacagatgcctaacttctcatattaaagttaaataaatacctaccatactagaagtatgctattagctctgaaatttgaaattcaccatggtctgttttccccaactttggatgtgaaagcaggaaataaacaactgtgaattaaggctctaagtaactatgtagcagttgtagtttggggggtgggggaagactgccaacatgagataatcatggtggggttttctttccaatatgggatgctaaatagacatttgtgataactacataatcaacaacatctttaaatatttaatttcttgtcagttgttatcttaattgacttcaactcatatgtatgtatgtgtgtatgtattacatatatacatataactacatctgtcagagggaagtggcaaattgaagcaattatgcggctcattctgcaaagaaaaaaaaggaagaggagaaaactgatggtaagtgggaaaagtttagataattgtgacttactgtatagatttatatttagatataacctggacttcttcaaataatttatgtctacctatagtcttggatttcttcatactctagatcaaaacgttgattcctagatgtgtttacatatcacgtataattgagttcactggcacctcagtgcaggtcggcttggtgccatgctggttttcacttaatgggattagttactaaagtttagttcaaaattaattcatttcaacaaaaatctattaagtatctactgtgtcccaagctcttagctgggtgcaaggagtccacagttaatttcaatataatttttttttttttttttgagatggtgtctcactctgttgcccaggctggagtgtagtggcatgatcttggctcactgcaacctccacctcccaggttcagagatgtatgtcactattaggaattaagaatgcagccttgagcagcgagccagaagaatcactcctctaaagataggaaaaaaatgccaatttttaggaaataaagctacacaaattgtaagaaaaagctgacctttactgtaagtaattattcagttttgtttcattcagttatctatttccagcacaaaaatactataaaatcattaccacggtttaaaaaaaaaaaaaaaaagccttggattgggacctctcttctgccacctactagctgagtgaactttaaaaacttaacatctctaagtatcagcttcttcctctgtaaaagtgtaataataagaagaaatatcaggcctaactgataggcctggtgtgaggatgaaatgagataatgtattgtcttagtccgttttgtgttgctataacagaatacctgagactgggtaatttattaagaatgaagatttatttctcacagttttggagactgggaagtccaaggggctggcatcttgtaaggtgccatcttgctgtgtcataccgtggtagaagatggaaaggcaagagataaagggggaacagagacaaagttattattttattaggaacccacgcccatgataactaactcactctcacaataacagcattaactcattcatgaggactgtgcctaatcacctcttaatggtttcacctctcaacacttgctttggggattaagtttccaacacatgaactttgtggggcacattcaaaccatagcatgttgctagtgcaataccaggcattgggtaaatgctcaatatgtgtccactgttattatcatccctacttctgctatagctgggcaatctaatgaactgcagaagctctggatgtaatgccctacacatgcctgcaactcgacttttagaaggagagtttggtttattctcctaatacatgatagagtagcaaatgaggaaatagcagtcagtggtatttatgactttccatggtaaccatttctgtttacccctcttagcttgaggaaataaaagcaatactggctggattagttgaaacatgccacttactttttaccacaatgtggtaagtaaaagtagagaatattattataaaatttctatgtatcaagtagctggacatgttgaatagaatttgaaggaaagaagtatagactaatttacatacagcaaaacttctttgactctttttatttcagtatagtatttgaacaagagtttgactgccttcaaatatatgggaagcatgatcttctaaacaaataaataatcccagaatcctgaagtactcactaatgttgtataaggaggaaagcactagaatcagagacatttgatatcttgccttaattcattaaaaatgcatcaaaaatgtattatgtgcaaggactattccaggcattggggtacaatgaggaataaagcaggtgtggtgcctgcttacctggaactttagtagtggtgagtaacacaataggtgagaaacacagtaaacaagtaaacaaagtagtttgtatttattttgtaataaggactttaaaggaaaaaatagagtcctgtgtcctgccacttagctgtataatcttcagtaagtcatattcagagactaatagaatgtaaagaagtcttagagaaccattacaaagaccttatgagctataaagcactaaacaactacaaagaataattgtcagcaatgtctaattataaactgttctttctttcttttttctgttttcttttttttttcttttcaatgaggcagggtcttgctccgttgctcaggctggagtgcagtggcatgatctcagcttactgcaacctctgcctcctgggctcaagtgatactcccacctcagcctcttgagtagctgggactagaggcacatgccatcacgcccagctaatttttgtattttttgtagagacagggtttcaccatgttgcccaggttggtctcaaactcctgggctcaagcaatctgcctgcctcagcctcccaaagtgctgggattataggcatgagcccccatgcctggcctataaaccattcttatctggtaatatacacagcctttaaaggtttctattgtattctcatactcctcatctgaagtacaaatatgtttcttaaaaacataaaatatatttcaattaatattccatattttaatatttttattttcttaaactgtttttctgccaagtcgattgaccaagagaaggctgaatgttcacacaggtctttcatagggaaaataatccaggtgtgtaatgactgtatacgggctaccactcccatgcatgaagacatgtaaatggctgaaaaatagcagatctgggtgcttgcgaaattttaaaatcgataagaaaatgataataatgactaataaaaaatgataagaaaatgtaatatattttactttgcttaccgatctacattctcccaaatggcattcaacaaaaattgaaatcagaatataggttgcagaacactgacacaggaatatatttattttatattaatagaatgatttcttttaatggttccttttcaatgtgttcattatgtttgaaatttaagtaccttggataaaagttatcaagaaatatctttatccaggaaagcctacttgagggcgatgttttctcttacacattctgtatccacatatctccttgtagatatcatgcaatgaagaaggcactcactatatattattgaatgagatgtaacacttaagtagacatattttaatttttactctaatattgtatccataagcatcagaaagtagcagtatgttgggcatggtcatcatgttacagaatttaatataaatgttatcaaactttcagaaatagctcacattgccaaactcagaagagactaatatataagcccaaataccacttggacttttacaatgagaactgtaacatacagcagtccagaacacccaaatacactgatgaattaatcctttcctacaggtagagaggacaaattacaaggtaagttacttgttagatatggaatcagagctacagtatttggtagaaatattgtcatggctgttgtcagaacgctaagaacacgctatatccatctccactataggtttatgtttgcagaatgactcatatctgtctgtgaacaaggcaaacacacatgaacagattcctatttttgagttctactttcttgttactgtcatgctgacctttctgttgtcattcacatattgtttcttcagagtatgtaaatcaaagaattactctataactttataaatgcaaaaataactatctttgccagtttgtacttgatatctaaaatctaaatgtggttagttctgaggtaattagacttactagggcatgcactctggcaaactattgtctgtcttgttcactgctgaatccttactaccttgcaggcctggcacacaataggtccttaataacttatttgttgaataaatgaattaaagggtaaaaggtactgcaacaaatgcctcacctcattttgcatattcattttttcctaatttcctgctcataggctaactttttggagatctttttctgcacgtgacatgggtgagaacaaaatatgtacgtgcacacaccatgagctatgtattctatttctgtgcaagacagatgtgatccttgcccactaggaaatttttaccttaaaatgtacaattcattggctttttagtatatttttattttttgagacagagtctcactctgttgcccaggctggagtgcaatagcacagtctcggctcactgcaacctctacctcctgggttcaagagattctcctacctcagcctcccaagtagctgggattacaggagtgtgccaccatgcctggctaatttttgtatttttagtagagacggtgtttcaccatgttggccaggctggtctcgaatgcctgacctcaagttatccacttgccttagcctctcaaagtgctgggattacaggcatgagccaccacacccaggcaatttttaaagttgtgcaaccatcaccactatctaattctagaacacttctatcaccctataaagaaactccacgtcccttagcagtcactcctcatattcctgttttcatggattcctgtaactactaatatactttctgaatctatcagtttgcctattcttggtatttcatataaacgcaattgtaagtatgtagtttatcctggagaatgtttcatgtacacttgagaaaagcatatattattttctcaagtgtacaacaagttgttgttaagtatatgttctatatatgtcagctctacttggtttatagtgttgtagaagctttgttttcccttgtttatcttatgtctagttgttctgtgcattattgaaagtagggttttgaaatctcaaactatttttatttttattatttctcccttcaattctgtgattttttcacatgtttttaagctctgttttcaggtgcatatatatttataattgttatgtcttctaggtggattaagccttttgtcattctttgcctttatgtatgctgttctctttcccaggaatgtctggagtatctttttatttctaccctggaccctgctgatattttacccattctcccaacatacatcttaaatagtgtttattttgaggtagttctcagactttctggtagttgtgattactctcgctacagattttgtatagctctgttatgaaatttatgcttttgtctttctacccctaattaaagggattgtttcatctttgtacctcattccatgcctagtatggtaggcatttaataaatatttctaacatagaaaaagaattaggtttttttggatggtcctagacaattggtgtaggacaaagggtagaagttaataggaagcgtattttagttccattttttaaagaaaagaaaataacgttttaattactaaaaaaaaaaaaatcagaataaacaatttggtcaagtaaaatatttccctccaagtagttaaggcaaagactgaaggaccatttgtaggaaatggagaatctttctatttagaattttaaaatcttaaatttttttccttgtaaagaaatctcaagccttgagtgtaagaatggcagatgttctaactatagcaaataattcttaaacgcaactaaaatccaacttatagattttacttcatctttcgtgtccctagattggatcctttcttcaagattaaaacagcaagccatggtacatattatggcttggcaagcttagagcattttggaatcttcttacttatccctctctaacttcttgccaactggaagattgtgatgagacaggaggtagagaaagctgttgagtgaggaagcagaaagaagtatcacatatccttcttgagtttctgaaccatgttatgatttcactagaaaaatgacacccttttggaagtccccttgagaggagtggacttagtgaagcaggtggatcctctggtttatcttctgcacaagaagccctgcctgggagaactgacagcctttttggagtccaagtgccaaacacccacacacacagcaaatgccaggaagataatcttcacattaggtgatagagctgaaatattccacaggcttatatctccatagctgtggaacattttatctgcccattattttgttcagttatggtctcagaatcattataatatacctgggctagtataatcttgaggtaatgtccttgtactcagctgcaagatggtaactttccattatacctagtagttcttagccttggctgaaggttagatccaaatggggagctttaaaaattactgatagttgggaagcagtaaaccaaatattgcatgttctcacttataagtgggagctaaccatgggtacacatggacataaagatgggaacacaccagggactccaaaagtagggacagaggaggaggagtaagggctgaaaaacttcctgttgagtactgtgttcactatctggatgttgggatcaagagaagctgaacctcagcataacacaatatacccttggaacaaatctgcacatgtaccacctgaatctaaaataaaaatttaaataaaaacaaaacaaaacaaaacaaaaaattacccatagttgtgtcccactacccacccctccccctatttggatttagtttgtgtggatttcagcacaggtgttggtattttcaaaagtgctcccagatgattctagcatgcagccaagggtataaagtaatgatctagaacagtggtttgcaaattgtggttcctggatgagcagcatcagcatcacatggaaacttgttagaaatccggattcttaggcccacctcagacctgaaactctagaggtagagcccagcaatctgtgttttaaaaagtcctccaggtgaaccactggtctataatgaagagacctcttctttacttatttttagaacatcttttttgaaggaaaagaaaaagtgagaatctgaccaattcagtgtatgtatgttcaaggtggggtgccatttttcagactggtatagaataatgcaaatctctaagttgaacataacggctgccctgagcaccttttttccatgtatgattattggtaaatcttgagttagatactgtccagtagatttgtgccatgtagatggctaatctggctaatgtatagattacccccatcccccagatacatgcacgcaaaatgcctaacaatggattgtcctcaaaaatagactatactgtaaaatttcagcctgagccatactgagactccatgttttatataaataacaattttggacttcactcatactctatacttttttcgtcaatgccacctgccagtagaattctggtttgccttgagttgacagatttacatttgatttatgcttcattcattgctaaagagtaaagatcacttaaatgccattttgccctgtgatgaaacatgtcactaactctacatttgagctgtttccatgtttacttgtttattgagttatttacgtgtttatgaagagtggtaattgtaaattgagagcacaatcccacaaaaggtattggagagccctaggtgcaccatgccatgtaaacctgataaataggaagctgtgtaatatcttagtgtcagcaaactctaacaccagtgtcagtgggacagatcatgtgtgtgtcaagcaagaagatggtgtggcatataaggttgatatgtatatgatgataccaataagcaaatgatgaaacaaacaaaggccttccttctcaagatttggtgtgtgaactaggagtatttttttttcccgagactgagcctcccactgtctgttgcccaggctagagtgcagtggcatgatcttggctcactgcaacctccgccttccaggttcaagcaattttcctgtctcagcctcccaagtagttgggactacaggcatgagccaccacacccggctaatttttgtatttttagtagagatggggtctcaccatattcgtcaggctgatctcaaactcctgacctcaggtgatccacccgcctcggcctcccaaagtgctgggattacagacgtgagccactgcacacggctggattaggagtattgatagcacctgggagctttttagacccagacacccagtccgcatcctgtacctgctgaatcagaatctacatggtaacaagatatccaggtgacttgtatacacactaaggtttgagaagcactaagctagtgattgtttcataaacagtgtctattttcttcttgcattactggatttgaacatgccacttctaaagcaagcagtctgtggttctctccattctgacgtttccaatggaaacagtagggccactaggatgggaagtcagcaggaacagctgaccaagaaaggaagtttaggttgaacaaaggtttgcttcatttttattgcccctggaggaagaacaatactgtacagaagctgttaatgatgggctggattcgaaggcagtaatctgtgccaaaatccaaatgtgtttttactctaaacttctctccagatgtctagttatactccaaaatttccagctggttagaaccccatagaaatggctggtcactaaaacatatttaaatataaaatatatccctattaacttcatttgcaatttcttctactcttttaataatttcattaacttccattagccagcaaattatttggcgctgatggaaaatgtctagttgaccttgatggagagattttagtggagactctgctctgtttaacagctcactcaggtaactatggcaactctccatttcagttatgaacatgtcatacaaatcctaagtgaaaacagcctcagcctatcaatcctttttaataagtaatctaacaatagtggaccattcaatccagagaaaagactttcttttaactgagcaataattgaaatggcactatgcagggagagctatgatcttaacatattggccaacctgttagcatgatttccttgtgcacacttcaacaaatcacccatccagttgaaacagataaagagaaaccacatgtaactgcttaggtaattttgcccatcaacactctgcacctttcaagctgaactttacgaatggtttcaagaaacagtgggtgtggtttccctaatttgcagatggaaacaccaacaccgggtcaacaagtgatgagactgtgttctatggcagcctgtaggaaccgcacctgagatgactgcactggccatactgctcaagcctttttctcatacctaccatttgaccccccccatgtccataccacatgcactgtcatcacgcttagttctccatgtttttttgtgttgttcaccactatatcctaagggcctagcaaggtgtccagcgcatgagaactgctcaatgacatttgttgaatgaatcaatgaatatataattggatttatattgtttttcagccaatttgcaatagttgtcctcctctgtgctttcaaagcgcttcccagtctctaagatccaattcaagcacaatgtgctgcctgaagcctctttaattttcagtctaaactaacacctcgtcatcagaatccggatacagtacttgctttctctactattctatttttttgttttgtgagatggagtctcgctctgttgcccaagctggagtgcagtggtgtgatctgggctcactgcaagctccgcctcctgggttcaagtgattctcttgtctcagcctcccaagtagctagctgggactacaagtgtatgctactacacctggctaatttttgtattttcagtagagacagggtttcaccatattggtcaggcttgtctggaactcctgacctcaggtgatccacccgcctcagccttccaaagtgctggaattacaggagtgagccaccaaaccgggcctctctgctattgtttttactgctgtcattttctctcagaaaatcttacattcttgtttctatactttatcttctcaacactctgagttccagaagaccagtgacaatgtcctatatccctcagatctcccagcataacaccttgcacatccagatgctgactacatagttagggcttataagtcagcatgtcacgaaagtattacgaccgtatcagaaggaaagctttttcctggtgtaccaggaaaggctccacttgaagtctgagttcttgttctgaatgtgaatttggggtttctgtaggccagggaccataatgggcctctttgccactcttgttctgcccactagcacaattacaaccagaatctacgccctttgcttctcagcaggtaaatgtcccataaagaacgctttgatccctaactttctacatcagcctcatggccaaattcatattattgctgggtctaatgctgtacaaaaaaagcctttctggattatgacaaggaaagggaagaggagatgattaagagccttattttaggcttctctcactggaggacctttactcattgcctttcacttcaccattagtaacatgtcaagagctgcttggatcataaataacacgaaccgttcatggcacggagagcagagaacaggcagatagtactgacacacgtaggatttcgtaatatgtgtgccaacccagcacacacactgcagaacctgcttctcccctgtccacttgcccagaccctggagagactgggtacacagatgtcaggattctcttttgtaaaactgacgtttgtctggtgggggtcagagccttccagcggtagccacccacttgtgttacagatgtcacctcatgcctctcctgcaccttcccctaacaagtctcagatgctgagacttggagatgggaagagtatttttgcaccatctctgcacagtgtggctcagggacctcacagcctaaaggtcaccctgtgcaaggcaaagtgctcctgcttgaataaccacagtctttgtccagtgtctatctcttccctctcagtttatttgcttctctgcctctacccctaagaatctgtataaataatgagcttctcaggtcattcaagggcaactcattaactcccttaggaaaagccagcaatgtcttttcttccaaagtggtggcttaatggccacaagcagataatgctttataaaaaggtaataataaaataataaaatgactctcatgtgatatgtaacaaaaggcccaatttaggagacaggtgtcaattaatgcggccatcactcattcttaccagtggatgacacaggaggaaacagaagccaaagaacctaggattgagaatatcttgagaaagctgcatctgagcataatacataagcagcttctttttgcaaatcatggcaggttttgcatttgattcctcgttctacatggacccttttaagtattttcctgatcggtggtccttcttccctcctctcatgccctttcacgaggtgtatgcacatccgttcatgtgcagtctctctctctctctgtctcacacacacgcacacacacgcgtgtgtttaaatagacaaaatcataatgatggtagtgatgatgatgatgataaggagaaggaggcctggtgtctacagaactttatcctttgagtgtgcattttcatggattaactcaataaatgtttaaaacaactcaatcatctttgttaggtaaagtaagtgttatggtttacatttaacagatgaggaaattggggctgacttgttaaaaaaatagtagtaaagccaggatcagactatctttctattcttcttcttaggtggttctcttaccatagcacactggaatcaaaccagagaacatcctgtgtcgtaattactggctaacacaccactcctccccacctagctgtgagtgttcaaaggcagagacaggtcttattcatgcctatctcccacttccaacacagaggaacgctgtgtatggaagagagggagagaagataaatgccttctggaacattggtagaaacagaacctagaggaaatagtgtaggaatcagtgggccacagaactgtgacagccatttctaaatcacgacacctgctgggtttactcctttttttttttttttttttttgagacagagttttgctcgttgctcgttgctggttgctcgttgctcgttgcccaggctggagtatagtggcccgatctcggctcactgcaacctccgcctcccggggtcaagcgactctcctactacagcctcccgagtagctaggattacaggtgcgtgccaccatgcccggctaatttttgtattattagtagagacgggttttcaccatgttaggctagtctcaaactcctgacctcaggtgatccacctacctcggcctcccaaagtgctgggattacaggcgtgagccaccatgccggccgggttactcttaatttctgtctgtgaagccgatgtcctcctccctcccttccccatctgtgcacactgttcctcagcttacagaagtctcttatttataaaggctgcagtggctgctaattcccttgtttcctacctcaccacttggtgattccagaggaaactctgaataactggtgcaaccttactataaagcaggctctaaaaatgtcatcatatctgaattcagacttctctgtacaggacggaagcaccgtagcctagttgggggcactgcatgtgaccacaaagctagacacgtgtgggctattaaccacatcaaaggcaaatggtaaattgccagcccctttattcaacaagcattactgggctcttactaggtgcaagtctctggatgagttgcggaggactccatgaacacccaggtgagctccctgacctggaggagctgtcacctgtagaagcaggcagatacgtgaaaaaaaaaaaagactgtaaatgtctctcaagcacaccttgctcaggtatattgtgatggcatttttttggagatctagtggttcctgcctttacggggctgcttaggagctggctatgactgcagtcaatggtgtggaaggatggggattgaaagaagaatgcttccagcagtgggggcagtaagacagtgtgagagaaacagacatgggcatctcatcatcttagatctccttccttgattgtcctgtgcacaaaagtatccaggagtagaaggctggactctcagcattgaatggttttgaatagatggattcagccagcccatgagtcaactacagtccctgaaagggaatgacatcactcagaaatccttgctcatcatgcccatcaggcaagtgggtattagacctgctgttccagcaccaacaccttaaaggatattcactatgcataatgcaggggcttgcagcttgtatttcctctgccctggccatgatcgtggatcacatttcacttacatggggctttctgagaacgagactgggcatgtaaagaatggtataattgagcttttccctcttggctggaatctgtggttgcattccctctaaaccacacagaattctgatttgctgccttggattttacagggtcctctgtgaaaaataaaagcctacaggtgtgatagtttactgcagccttggagatagaatttcttatgactgaattgcttatattttctatggggaaaaaatctcatacacaaacatgcacgtgcacgtgcacacacacacacacacacacacacacacacacccagcctaaaagatttgtatttgtcctacatccatttcttatgcaactcccttctttgactttctttcccgttctttatgactgctccacagaacccatatacagtagggcacttaagtaggctgaaggattttctgcagctccaggggagagcagaagagtttggagaatcaccctagaggaaaaaaaaaaaatctgcaggttttccacccctttagtagagaattaggttttagaaattcagagagattatctgcaagtcaggaggccaaagcatagctgtatctacatggctggagaattgtgagcttttctgtgctgtcgccccagggcagtagttaacatacacaggtcagttctcaggccagttaaaatcatagcagacaggggccgggcggggtggctcacgcctgtaatccgagcactttgggaggccgaggcaggcggatcacgaggtcaagagatcgagaccattctggctaacacagtgaaaccccgtctctactaaaaaatacaaaaaaaaaaaaaaaaaaaaaaaaaaaaaaaagccgggcgtggtggcgggtgcctgtagtcccagctgctagggaggctggagcagcagaatcgcgtgaacccgggaggcggagcttgcagagagccgagatcgcgccactgcaccccagcctgggtgacagagcaagactccgtctcaaaaaaaaaaaaaaaaaaaaaaaatcacgcagttgggaatatggaatggacacaaaattaagggcattgctttcccatttctgcctttctagtcttctctcttttttttctttatgttgcgaaaaagaatgcctcactgtggtgacctgaaagatgccagagcactagcccattaatcagaacaattttatattaatactggatgagttcattatgattaataaggaatactttgataagctgaaatttaaatttgaagcaaggcaaaaataatatggtgcttctctgaagcatgtttattgagggtttattgacacttcaccaaagtacatgtctgttaaatgttttttgccatgtgctaataatatccactggacaaatccaattctttccttcctgttactggggaatcatgtctccttgtgttaatggcttcccccatagcaggcagttcaagctataattgaacaaatattgaacgtctatatctcagtggaaatatactgtaatgaatatccctgggagtctgcttatttctgaccaagatctgagaccactggggtgccagagactctgagaagccagcgtctcccagggccaaagatggggtttggattctcttcaaggctggtgcggagtaggggatctaggaacctttctctctctctcagaaatgagcctgtgacctggaatagcatccaaagtatccttcactcccccctgactctggctgccttcagattactactttttcgttagttatgaatctggctacctcccaagggactgttgcaccattttcccatcttgtaggttcaaaatcacagcacttgccctagaattactgagtagagcaagacactatcccttgagcgatttggaggcaagaactaaggaaacatgaggatctttgtaatttaactgcattcttcggtttctcctttagactctgagaatcctcatcctctaggtcagtggtttccaaacctcactgatcatcatcatcatcatccagggactcttttaaaaatacaattcttggtccccacttggccgatattctaattcagaaggttagagggaggaggggaatgaggacaaagaaagggaaaataactgacaatttgcttaccctagcgtcttgctccacagccctccacagatgtgatttattttttattattcattacaaagacttaatgatataattatccaaaagcaattagatgcagagtggaaacaaagtgcttaaggagctgggaggtagacttactaacaaagaggatggaagagtaaagtgtcaccgtggtgcgatctgtcaggatctgggcttctggcttcatacctgagcatgtggagaggacctctgttggggtcatcagggacagcaactgatcacacagtttccatctcaacttcccaaagaagcaagtgcatatagattactcctgatccttcagatctgcagtggaccatggaccaccatggcagcctctctgcctctactcagctgttgcatcctcataccttaagaatctgaatcttcttggccggacgcggtggctcacgcctgtaaacccagcactttgggaggccgaggagggcggatcacaaggtcaggagatcgagaccatcctggctaacacggcaaaaccctgtctctactaaaaatacaaaaaattagccgggcgtgctggcaggcgcctgtagtcccagctactcgggaggctgaggcaggagaatggcgtgaacctgggaggcggagcttgcagtgagctgagatcgtgtcactgcactccagcctgggtaacagagtgagactccgtctcaaaaaaaaaaaaaaaaatctgaatcttctcgcaaatatatatttgtcagactactattgtaggcattagggacttaatggtgagcaaatttagggcctatgccctctcattgaacttgcattctgttaggaggagagctacaattaatatttaaataaataaaattattacaaatcatgataagtgatttgaaagaaacgaggcactgtgatagaaaagagggtgtgtggggaaggaatagttaattaaaggaaatacagtagctctaagagagagagccaagtggtaaatagagccaggcttacaggagttctagacccagctctgataactgggttatgtgagaatttcagcaagtcgttaaactgtgactgtattagtttcctattgttgccataacaaattaccacaaattgagtcgcttaaaataacttaaatacatcacattacacttcaaggggtcagaaattgaaatgaacctcactgggctaaaatcagtgtcggccgggctgccttccttctggaggctctaggggacaacctgtttccaggtctgttccagctttgaaaggctgcctgtgtgccttggttcatggctcccttccatcttcaaagctaatgtagcatcttcaaatctcattggctctcctgcctccttccttgtaaggacccttgtgattacatgacattcacctggataatccaggctaaacacctcatgttaagatccttaactaaattttagaacacagtctcttttgccatgtaagttcacatattcacaggtcccagggattaaggcatgaatgtctttggaggggatattatcctgcctaccataatactgcttttctttctccttataatagggatactgtgattttcctgacccacctcacagggctattatgagaatcaaatgcagtaatggacataaaaatgtttttacaaatggtaagagtcaatagatgtagaaggagttttatccttcttttactatggagagacagagggttcagagtaaaagaagcatcatggaatgaaacaataggaaaaaggtactaagagtaaaggttaaagggggaggttgtgtttaacctaaaggaaaaaaaaagaatttttttttgtctttgattatgtagaaatactatgacaaggctgttcatcggacatactcatgtctactacagaccaagcaagaggcaggagatttttttgcatcacttcttgacttattctgttcctttcctcccttcaagacctaaatcagagccagaagattgttcctaccttcattattgtggatccatctctccatattgttttctgttagcccttttcatgtctttcttagttcaacaaacatttattgagaaattactatatgatgagtgtgttagtccattttcacactgctataaacacatacctgagactgggtaatttataaaggaaagaggtttaattgactgagagttccacatggcttaggaggccccaggaaacttacaatcatggcagaaggcatgaatggaagcaaggcacgtctttcatggcagtagaagaaagaccgcaaagggaggagtttcacttttaaacctgagaactcactcactatcaagaaaaaccatggggaaaatgcccccatgatccaatcaccatggggattacaatgattacaatttgagatgagatttggttggggacacagagccaaaccgtatagctggacattgcagttgggaatttgcagatgaaaaagacagtcttttcgtgcaagtagcttgtagtttagcatgctctcctagagcccctatcactcactgccttgatttatagttattggtgtatatgtttgcttcctctaccagatgatgtgcttcctgaacactgaaatcaaatataagtcaactttgcatctgccatgacccaagcccagtgtcttacaattacaggtttcacagatgttgggtgaattcaacagaatgatgaattcttattcatcacaattatttcttacaaaatgagggtgcttttggaagtctttgatctgtatatatataaagaagagaacagaagtctttctgggatagtttggagtcacctggtaaaaggcagagccctagaccaaattattttttagttcttttccaggcttcttcttataactctgattgtcttgattaagtacaatttttaagtcctggggtgtggtgagctttcagcagattgtagaccatttttgttctaagaatcttctggtctaatctaagtggaagattgtatattgtcaaggtagtgaagggttagttgttaatgatgcttatttgcatatttcattcttgctgcaatacttttctcagcacaagagctttgtgctgggcatggtggctcatgtctgtaatcccagcactttgggaggccaaggcaggtagattgcttgagctcaggagtttgagatcagcttgggcaatgtggcaaaaccttgtctcaacaaaaaatacaaaaaaaaatcagctgggtgtggtgacatgtgcctgtaatctcagctcttcaagaggctgaggtggaaggatctttcgaacccaggaggttgaggctgtagtgagctgagatcacgccactgtactccagcctaggcaacagagcgagaccctgtctcaaaaaatttaaaaaaaaaaaaaaagagctttgcagcatgacagatactgggtatgtcaaggagtccagttgctttgtgaaggtaatccagttatggaaatttgcaaggctagtggtgtgcccgtaccttattgacttccatattttttttatttcctttctgcccacatttgctgtagattcacttcccttgggatgccctcccctcacatctctgcttatctaaattttatctatcttaaattgtccctgtttaatctcacaaagaaaaatactgggatttaccttctggagatagttcattcagatacctgaattaatggctgtcaattcaattcatcatttgttattagtaatcattaacttcttgctgatgtctttgcctttgttctttataaaacgctacttagcttttgttgtcctcctcatgtgctacgtattttatttctgtgtgtttctcttacaggctactatagtactttgcacttagtagatactcaatatatccattattgagtgattctcttgataaactaaaagttgaaatcctcactctcttcgccatacatatgaatcatcaccatattccactgaggggaacacattcaagctaaaggaatccacttgtttagtagaagcactttggaaacctgatttgttttcccaccttcttcctcccaatcctgcagagattctgagagttcagctccatatgtcccagtggctgaacaccagaaagcttagcagttgagtacaaaacctgtctctaaattacacacacaagccaggacctcctacttgccatgttgtcagaccagagtagaacacagaaaaggtacatcgtgctacaggctgactctgtttgcgtcccactgcaatacagggagccaagagaatccaaatcttcagtgttataatatggcccttctgcaggttgggttggaatatctgagtgttgtctttgtcgtctcttgtcagtcatccccagagagagaagcatagagtacattgagtccatttaagaacccacccagtgagaagggacatatgcaaatgttagtgtacagttagagtctgatgaggaataaaaagcatgtagaatttcaagcagaattgcattattcacacttatagcggtataaagagaaaccaaaaagcactgccctgcctccaactaagaaaacatatgttatttacaggagcttaatgcccctctgctgtctgtgttgctacattagaatcccagtagatacctagcttcctggcctcagacttgtcagggtggggaaaaaaaagtttaccagctttggagagaccctctcagccccagagtctgattttcatagatatgctgagatagctcttcaggttcatcaaagccagtttctttggggacctatgaaaacattgcctgaatagacactaagatgggatccgaacacttggtccattccacctctcagtgcttcaagttgagatcctgggacctggaatgcttgtagctaccttcttctgattcaggtatctactccactatcaccgaccatcctataaaacagaactctcccttcccttactgtgctttatgtttctccagagcattcatcacttcctgacattttatgtattcattgattgtcagtcttccccactggactccagtgactccttgaacacgtgtatgacagagcccagcacagaggtattcaatatttgtcgaatgcttatactgatcagaccctgcaggaggtaacagatgagacacatattggtcagttgaattaatttaatttctgagccaggattacttggagtatgaatggggtttaaaaaaaaaaaaatccgccaggtgtggtggtggattacatgtctgtaatcgcagtgcttcagctgaggcaagagatttgcttgagaccaagagttcacgaccagcctgggcaacctacaaagacgcccccatctctaccaaaaaataaataaatacatagccaagcatgatggtacacacctgtagtcccagctacttggtaggctaaaacaggaggatctcttgagcacaggagtttgatgttacagtgagctatgatcaagctactgtactccagcccgggcacagagcaagaccccatctcttacagaaaaaaaaaaaagcaaaaaaagaccaataatctacctcacagcaccaaacatttaatatgtaccccttaaacctcactaccttgtatctttggatctttgtatgcaattcccatctgtgacctatgccagcccatgaacttccgtgtcctctcctgaagaacctcagcagaaacgtacttctgacagctcagtttctaaccaacctccataccggctgcctctgcctcactagagatcttgacaacagtctttttgatcccagccagctcacctcttccctctccaccctccctactcctgtttatttctttgcctattgggatcagagttcttggctctgttccacattccaggtatacttaatccttgccatggtagctcagcagatggggcctgagccttttctactgacaaagacacctatgtggggccctcaagtctgccatttaaccagttctcaaggagttcagaaaggagggaggccggcaacacttttcagtattcacaattccctttcatggtgagagcctctctggtgaaactttagatgctacttctttatttccaaaaatattttgggctttcccatcagcacagccaacaatataaatcactaagagtctagggagggtgtgagtatgtgagatcacaagctacagaagccagaggctgtaaagtgggacttgcaaaagcagagataggtggggtggatttgcatgaattcatttcaaactgaggttctgagtggggagggaagagggagtgagaaggaacaagagctaaggagattaggatcaaacgatgaaattaggtgacagaaactgaaatctggtacctctagactgatttctcaccaagactcttggtacctttctcagtctggaatatttttgcccatagcaaagtctgaaccatcaaggaatggtcaggatttccctcagaagacatgattcctggggccaggcatgatggctcatgcctgtaatcccagcactttgggaggccaaggtaggaggatcacttgaggtcaggagttcaagaccagcctaggcaatgtagcaagactctgtctttgaaaaaaatttaacaaattaaagataattaaattagatgtttaaaaaaccaaggcctgtttccctgattttttttttcttcaaattctccaactctggagatggtatgtcagtttcctagagcggggcttcatcaaatgttttatttttatttttatttttaatttttccagtaggtgttttcaaccacactctctatgaatgacttcaaattctctccatgaataaatgaagcattgtgtacttaaacttatacaaccgccttcatatgctttcagtggtttcaaggcctcagtagagcttaaaaatgtatagcactacatgccccctttagggagttaagagatgggggagagagtagtctatgttccctaggggccaaacaccctggattaaagcctcctatttttctttttcatcattcgtaaccatttcaaatgcaaacccatagaaaaacacgttcctttctcttttttttcttttcttttttttttttttcaaacaacggggatggagaaacattaggagcagagtaaaagctgttcagtgtgcttggatgactcagtctaaaatagtattatagcttggcagcaaatctacttcagggaagctggtgggagactaaaataaaagttaaattgagggggtaaatcattttatcaggcttaggatttttacttgatgtaatgagattctcaatgtaaaatgagttaatatgtctgcctaagggcataaatattcaaagaaagaatttgaaaatacagactcaaagtaaagagcagtctgaaataaaacaatgcaaggcagtgaaattttcctcatggaaattttggcacaatatgcttccttttgaacagcatgattaaatgtgagtagccctagcttgtcgctaagaaaaagaaagcctcaaagttttttttttttttttttgtcttttaaagacttttctattgggttctattttcctcctcctcttcctccttcccatctattttctagaaaaactatcctttttttttgccctgcaaaatgcaaactgaattcagattgttcataaaagatgaagccaaacatatttctgtattgttgcctttttgctcactgattttctgtgactcaaatgcagagagagcccatagtgcagagggcgaacttttgcttagcccacaaccagaaagggaaaccccagtgtttcttctcagcagttgaccaagtggccctcacactttctttcttgcctttctttttctgtttctttctgaaaacactttcaattaagccacctatgttccttatatcacaaaaagtaatgagtcaatcaagcctgtattatcagttattctttcaaattaataggcttatggaagaaagggatggctaatgcatagatatcagacacataatcacagaaggtgaagttggggcaagagtgggaggtcagaggcctatcctcctcttacctagaaagtagaatcagaggggagggaagaatggtctccttctggttctgtgatggctttttatatcctgttagtacttcgtagactgaaatgatcttcacacaaatactcctggtgacatttgtgtaagtcaagaagcatacccagcggctcaggcattttagtccagctactcccaggaaaaggaaatggatgtacacaggttcttgggcggagccctgctttcactccagggcctctgagaggcaggcccgaggccatgctcctgagatggacactgccccaggtcatgcttcatgccacacaacatggctgctgagttttgagcaaaaaccagacatcagactgtctttgggaatggcctaagcccatttcctcttaattgctttcttcaaggccctgtcaagtctgatcactatgaaattgtttggttggccttgtggtagagaaatagctgtgttatgtatagagtgccctatccgatggaagcatccactgatgcttctgtttccatttttaaaaatcttttattttcaccatttaatctttgacaatcttgatatactgatgtttctctctggccttccacgtggcacaaggatctgcttgtttaacgagcagcatttgtaagtactcaagtaggggccctgtgatagatgattgttactatagcaactttcttttttttttagaaaaaaagaaaactaaccttgtgaatggacacataagaaatcaaaagaaattaaaatgtttccctcagagcagaatatagctggaatgctgaagtctccctcaacctcatgaaaagatttgtgtgaacaatttccatgctttggattgggcatagccagctgtgggctctgaattcccagaataatgttttagtgtgaaaatcaaacacttgtattcttttttcaaagcttttctttaattatggaggagatggccaacatgtgggacaatgtcactgtcaagcacctagaggttatgcgtatgcagcatcttacttaaaaacctcacattcacatcttttaatgtgttccaccaataaagatgtgccatttccttttcagagctgtggtcttagcaacttgatgtcagctttttcagctctcccagcagggaaattcaggtgaattccaaactgtgattagagagatctgagtggagttaaaaggagtcaaacaatgggaaagaagaacactcacacagacacacatgcacacagaccagctgcgcgcaaagataaattgcatctgcgtatgactgttggcgcttgtcatgaagcagtgaatttgctaggaataggtacaggtcaatgggagagaaaaaaaatctctctgctgccaaaaataataaaaaggaggaaaaaagcacctgtgacactagctatcatggaggaaaaaagggtgttacttaatgatattgaaagtttaaaaatatgatgggaagcaaaagcaagaaataaaatgatgtgtgcttactatgtgagcacagatagtggagaatggtctcaattgatgcagagatggatcaagggttgttggattgctctgtccttcccactacccctccccactcccttattttctgacctctgactatattttctttgatggagaaaatgataggcttgataatacatgataggcatccaaagatcaaactttattagagccttcttattcaggagcatgaaactgtctggtcaaaagcaagtcccatatgtgaccttaatttaacaagcgattagacccaatcctgatgctttgaaatatctttggttatcaagatcaaataggatactattttaaataggcttttagtatcctcagatttcctgaaaatatatgctgccaaaattttcattcaacccactcaatgccgtccatctcttttgtaagtctcccatggagtatttttttttgttgttccttaaataagattttgccatatacgtatatttatttggaaataaaacccaaccaaaagaatacctgaatgcaacaccgatgctttctctgtaatatctgtgtttattgtggcctggcttctttcttatcttttctgcttcagatgcatacggaagttcctattacatacaacctgtttagctactgcagaagaaacaaactgtatgccttccacctagtatttgaacaaggaattgcagcctctctgcatttcctgttgggatagagaaaaggaggaaaatttggaagactaggaacaacataaagtgaaagaattaggcaagatggcggaatcctccattctagaatgtttaactttgtacctacaaaataccaagtattgtaccaactgctgtgaagtatttaaaaatgatgaggaagtcttctaccctgtaactctctctagccactgtcctctctctccttcctccagtagagcttttaagaagaagaatctacctactttgtttccctttttttaccttccatccactcctcaaaacattgcaacttggcacctgcccccaatcacaatcaaatgccagatgccaccgatatggctctgccctatcgcaggtgacctctgtagcatttgacgaggttgctcactccctccttgaaacactctcttctttttttcataatcgttcagctcttcatctcctccactttattcctttcctcctagctccttaaatcttgatgttccccagagtttcattcccacccttttctcttcttgttccttgcaatccatttagacactcacagccacattcattccttcaaccaatgcttatgtgcatttcaacccaatctgcacagacagaccaaagttcgctcctgatctgtaaacctgaatatctcactagcaggggatgtctccacttacatgccccacagacatctcacattcaacatgcccaaacttgaacccatcgtttgcttgcctgccatccccatcatgaaacacactcctctccctacattcctttactcagcagcaaataactccatcatctacccagtcactaatccggaaatttgtatttagtcctaattcctctctctctgttacacttcccacatggaattaatcataaactttgtttggtttctggttcctaagttctttctcattctctccatgtctgctgctaccaccttagcccaggtccagctttcactctctcttactgagtgctgacacctcatccatcttcaggcttaagctatcctatctcccacccacacgcaaatatttggtagttagagttatttttccaaaatacattactgacatgtcactcccctgcttgaagtccactaatgcctacccacgatcttcataatgaagcccacgttcctctgcatggcgtcaaagccagaccagacttctgcatctcactgagctcacttgtacccattcttcccaggcctgcttgactctcatccctgcccatgatgtctagttctctgagggcctacttatcactatagtggttccctggaataaccctccagaatgaaatggatgtttcctctactgaatacattttgtagagagcatggattttcagtcaggaaaatctggttcaattactgactggatgaacttagtcaagttgcttatacatttttttttttttgaaacactcaaactgttgcccaggctgttgtgcagtggcatgatcactgcagccttgttctcttgggctcaagcgatcctcccaccacagtcccccaagtagctgggactaagatgccaccaccatgcatagctaattttttgtattttttgtagaatctgggttttgccgtcttgcccaggctggtctcgaactcctggactcaagcgatctgcctgtcttggccttccaaagtgctgagattgtaggtacgagccattgtgtccagcctgcttacacttttatagtcttatttttctcatctataaaatgaagtttcttttatccatctctcaacgttgttgtaaggatttaatagcaataatagctggtattattggtcagtttctatgtgtcagaaactgctttaagcagtctacgtgtatttatttaatctttatattaccgcagccctataaggataatgattatgtgtattttacagatgagataactgaggtacattagttaggtgacttgcccaaggtcacactactagtaagtaggggagctgggattcatgagatgatatttagaaagtgtcttctattaagtagtcacccaataaatgccgttcactccttctctttcttgctgcatgctgtgttctatgggagaccccgaagactacataaaaataatagctgactattaaagatggagacagccaaagtgtgttttctactctcgctcaccacagaatacttctgataccaggagtttggtggtgatagtggagaggtccccacacaccaaccaagcaattttccagctgacacgaactgggtgtttcataaattaactcaattattacactgtctacctgagatagcaccagatttcacagattaagggctcagtcccataagactccctctcacttcagatgccagtcacaagccttaggttgtgacctgtgcttctgaccgacaagctataaattggggttcctatcacctcttcttcgggtttgattcatttgctagagtagctcgtagaactcagggaaacacttaacatttaccagtttattataaaggatattataagagctacacagaacagccagatggaagagatgcatatggcaaggttggtggaaagaggctcaaagcttccatgccctccctgggtgccctacctctaggcaccctcaggtgttcagcaacctggaagctcctgaaccctgtccttttggatttttatggaagcctcattacatagacgtggttgattaaatcattggccaccggtgatcaacgcaacctttagcccctctctcctccctggaggttgggtggtgaagccaaaagtcccaaacctctcatcagaaggctggtttccctggcaaccagtcccgcctcctgaggctatccaggagcccccagccatcagtcatctcattagcttacaaagaaacacttatcatgttagagagtccaagggttttagtaactgtatgccaggacccaggggcagagagcaaatatgtttcttattatatcacagtgtcacactagcatttattaaacatttattattggtcacattttgagttacagactttatagacattatcttatttgagactcactacaaccactgaattggaactattaaccccattattcagaggaggagactgaggcccagagagattacataaactacccccaaagctcctatctcatagaagacagaacaaggacttaaattcagatctctgatgccaaagcttgggctcttaaccactacaatatattgcctcaaaagataataggagacacaaaatggtgtttataatcttgccgggggactgcaaaagacataataacagttacaagccaaaaacatgaaatacacaaagaaatcaaaccatgaacagaatggctttcaggggcacaaataatagagcagtgatcagaattaggctctgaggagtgagttttgagctgagatttgaggccagtgaagaaaatacactggtcaaaaaaaaaaaaaggactcttttcatagttacaatggcatgtttagagtcttgacaaatgcagcgaagtggtcatgtgtaaggaagcactttatcctctagctagcaatctaacgagtggatacaagatattaatcatgaggcaggtacagcgaagaaatgtatgttttgggtaggggggagttaagtcccagtggcatcaatcctgctgacatcttggattaaaagcaatttacaaggctgtagctggtgagctttctctgtttaaatctgtcctgcattgtgtctgaaaggcaaatgaaataaacagcagtaatattttcaaggattagggactcactgagttaaggctgtgcttttgaaattttaagcagactcaagcaacactgtaaagtgttctttaaggaatgatacagaatgaggtccttgaagtgtctgattatctcatgcccattcagaatgggtggatatttccttctaatcaggggcagtcagttagcagatacccaaggcccaggttagtgtactctgctgtctctcctttaagatgatgaattcatagaaaggaactgtaacatattcttgtttaaagataagcttcaagaaattcataagcgtgttctgagaaacagtgattctcatcaaatgaagagggcttactgctttgacaaagagaattaccattgattcacaattttgacctgccaaaagttttatttttcaatataggtgaggtggtatttttttctcttcaaagaatatggccacacatgaagaattagaatctgtcaggtggagaattcatctcagtcatataattactgagctgagcaagtcagatcaaagtgagggcattgtattgctataggacattgcttcaaagaagagttgaactgcaaacaatataaaggctttattgtcctccatcctaacgtcatttaaataatcaagaaacattttccataagtggcaagtagtgggattttaatgcctggttaaaaaagtctgcattcaggccttatagaaagcaaaggaccttttctatcagccattacaaattctcatttccaggcatgaaaggcttaaattgcctggagtgtaggttttggtttttttttttccattataaccaaatatcttagtaaacttcttcatatttcatagagctagttaggcaatttccccttagatgtatctttgatgtgaaaataaacatagactggagtgaaagttgaggtaccttctaagagagtatctgtctaaatggttcatagttactcaggctaacattagcccagagaaaacacatatcaacactttatattgagcctagatacagttgctataagaaaaatatttcttcaaaactttcaaaagaatgatgacatcaatgccaagaacatcaaagaagctgtttgttgctttcaggtactttgccaaactaccttctaaatgctgcttaacattcctttgtaatggagttaaagatgagcctgaaattgcagggacctcttaaaatgtctgatcaccctacctgtgtctccaggtgattgtatccaaaccagttaacacattgcagtcctgggttgtccaaacatgattcagattgaagttttactttcagaatgcttttgtgcattgaggggagaattggtggagatgtaatctccagacctcccctgggaatgccatggagagagatgtggaaacaatagacatgctgttggaattctgctgtcatggaacggcacctctcagtcttcattcataatgctcttctttcataaaagatgtggaagagtgggattaatgaccacacgtggaaagttgaaagagaaaccaaaataaatgtgtccatttggcctctttccagcatttcaactttaattaatcaagaaaaatatgaatttatcttatgaaaactttattgagtgtgattattggttttattctttgttttagttgggaattatttgctgcagctaataaaagccctcttgaagtatctcaagcaaaaaagaaaattgggagagggggagatttattggaaggttatgggttgtttctactgtagcagatataattgagtctcccaaagttctggaattaggaattggaaagttttcaggatatttttctccctccccctttcattgcccctctccctcttcacttcttcctctccccttctccttctttcaatctagtttctcattctagcttctccttgtgcaggagttttattctcttatctctttagacttgctttccctgtctgttgctgtgcacggctgagaatgactacaatataggcagccttccatatctcttaattcaaatgcctacagatactgttaaaaagaccttgtttcagttctggattactagaagagcatttaaaagggtcagcttgagtcaactgtctactttgatccagtctgctgggacaaatgaaatgttccacttcaggctccctctactaggaaatgtggggtcagattatcagagaaggggagttagcaagggcagatgtattcaataaatgttcatttcagtcttaattatttaattaatatatgttcaatgtagaaaaattggcacagacatatgagcaaagtagaagagaaaaatttatcatcatgccaccatcggaaagtacttcggcatctcgacgtgttttcttctacacatttttatttgctttaaataatcttttttattttatatttatttggattatattaagaatgagatacagtggtcaacaagacaaatgtgactcaggcttccctttctagggtttattttataacatgtggagacagacttaaaaattggaagctaattaataaaaatatttggaaattatagtaggtactgtaaaggaaacaagagatggaaaacaaacatgaacatgtactttagatggaatggccatggaatatctctgtgagggtcacattaagtcgagacttaaggaaaagaaggagctaactatgataggagaaggaagagttacatgaaggcagagcatatccggtgagaggaaacagtatatgcaaaaggcctgcatctgaaacggaaatgatcttttgtgttcttagaatgaaaaacaaacaaacaaaaaagtagtgtagctggagtttgggttgagaaggagatcccttttgttgctatccagagaacacagtggggcagagagaggcgagatgtggggtcagagtcactgaatgtagatggagaatacttgattgcttaccgcgcttaaagcagaaggagcctgaagaagaatgaagaatgtgacctgagagaaacagacagggaaggacaggataggggcctttcatacccattgatgttgggtaaaccactgaagatgaagggagaaatgctgccatgaggttagggatggctgtgtttcatattatttcccaaaaagaagggacctttttggtagccaagtacaaacccgaaaataatgaataaacaaccctcgaacactgttagggcactctccctgccatatgggatttgctgatatttaaagtggtccctctacagttggacaaagagttgctaagaatcagctatatggcttataaagggggcatggttcatggccaatggcagagaaacatagatgctccataaactgactcatctgatgttcccaggccactaggtgcctgataagtcacattgtcaggcagtcattgagcactttcctggaatagagtttggaggggcatgtgggagtggatgagaagtacaagatactgtctcttctgttggcttctataatcatactgaagtcaaaaacttacagacctgaatcaattaccaagaacaatataagacagaaagtgctaaaatcattaaagcagggagaaaaaatatgagggaaagtaggatggaccttgaggtatgccctttagagaaagctttccagactgggccctccaagcaaaaggagagagagaagccacttgattaatgatacttaatgcatcgtaaattctgctgaggagggcatttagagatttcatgagaattgcaaacattttagacatagcatttactttggatttgcttcgatatattttgggcaaaaagtgagtcatggttaaagtatttcatgcacaaagcagctggatttttcaggcttttacagaatattatgtgcatttctctgttaaacacaaagggtccatctctgaatgtcccctcagatccttgctttataacaattgcagtaactagtcaggatgactaaggatatagtcagtagggtcatcctattggttatcactgaatggatctagaatgatattgtttaatgtagtagactacatgggaaaataactctactttgaactttttaatttaatataaacatccccttgttgctggacaacaagttttgtttacactgccactaacagaatatcataatatgaaacatgatattcatttgaatatttgaggggtacttcattataagggagtgggattccttttctagctttcttaggcagagtctctcccatctacaacaataaggccatgctcaagtctccagaacaatgatcatactgtattactatttttcactatgtttccagacagactggtaaattcctttttgtttgtttctttttgttaattctaacgttaattgaaaacagtggtttttgttgttgttgtttttgtttttgttttgagacagagtctctctctgtcacccaggctggagtgcagtgacgcgatctcggctcactgcaagctccgcctcccaggttcacgccgttttcctgcctcagcctcccaagtagctgggactacaggcacccgccaccacgcccggctaattttttgtgtctttagtagagatggtgtttcaccgtgttagctaggatggtctcgatctcctgacctggtgatccgtctgcctcagcctcccaaagtgctgggattacaggcatgagccaccatgcctggctgaaaacagtattttaagagcaatgttctgagctctttttgagctttagctacatggttcttgcattaacctatgatgtaggcacccttatagaatatacagctggtgctaaataagtatctgttgaatgaatgggtaaacaaattcagtgttacagatgaggagaaaaaaatctggttttgttaccttcattttctctttttctagcacatgccttgtccataggatagtcaggatgacagtgggaagtgtcagaccagcctaaggttcaagttcatctctctgactgaaaaagagctgccggtgatggagctctgctttgagcttggaataatgctggtgctttacatgtgtgttgctaagccccactaaaaccctgagacatggggtattattgtccatatcatacaggtaaggtaagtgactagtttagacttgtacagtaagtaggaacagagaagcatttggaacccaggtttattggcagttgagtcttgtgctctttctagatcccacagcttcccatttgtcttgataagagaagatgtctgcctctccgaggtagtgttgtactggttcccttccctttctcctcaatgactattttgttggttaaagataaacttggaacattctccacagggaagtgatggaagtgtccacgctgacaaaatgctatcatgaaatgccttttttctgccctgtaatgaagagtgtttccgaggcaaattccaagtcgttgagttactcttccacaagccaaccattaaatctaagaaaggggaggtggggaaggcatcaaataaattttgaatacaggagagcttggtattgagtaccttcagaagggcagtatgttgacttcttttctctatatagaacctgaatttgcattgctcctgcttctatataaagctttatcttgggcttcataaagagtagctattttgggctagacacaatggctcacagctgtaatcccagcactttgggagatcaaggcaggaggacaccttgagtccaggagttccagactaccctgggcaacatagtgagactccatctctacaaaaaaatttaaaatcagccaagtgtgttgtcactttcctgtagtcccagctactccagtggctgaggggaaaggatcacttaagcctgggaggttgaggctgcagtgagccaagattgtgccactacactccagcctggatgacagaaccagatcctgtttcagaaaaaaaaaaaaagaaaaaaaaaaaagctattttgactaaactagtaacatttctcagggtccaaaccttatggaacaaagttatggaacaaattttctagaaagatctaatatgcctcctctgacccttacactaaagacaacaacaaaaaggccaggtgtggtggctcacgcctgtaatcccagcactttgggaggccgatgcaggcagatcacttgaggtcgggagttcaagaccagcctgaccaacatggtgaaaccctgtctctactaaaaatacaaaaattagccagatgtggtggtgcacacctttaatcccagctactcgggaggctgaggcaggagaatcacatgaacctgggaggcggaggttgcagtgagccaagatcgtgccactgcactccagcctgggcgagagagtgagactccatctcaagaaaaaaaaaaagaaagaaaaacaacaacaacaataacaacaaaaaaccctaaaacataaaacaacaaacaaacaaaaacacctcacatgttttcttgaaggagtgaaagtacgagttactgaaattcataaggaagcatgccctggctccatgtctgctccagtgctttcacccaggaagggcatggagtccagatggggcttcaacttgcatcccagctttgcagtcccatcaggaggggcaacaacactttgtgtccatcacaaagcttcatacaccccttcacttctggttcacatgagtgacaatacattttcttcacagttccggttctcagggcttcacattctcgtgacttcagagtttaaaggaaaataatcaatgggcaagtatggtggctcatgcttgtaatctctataacctttgggaggctgaagcaggaggattgctagagcccaggagttcaagaccagcctgggcaacatggcagtactgcatctctactaaaaaatgtataaaaatgtctttaaaaaagtaaaaacaaaaggtaaataatcactgaagcaaaattctggtggaaccattaatttgcttgtgaatttggtatgaaaatattccccacaacccacaacctcctttttagcattgttttactgctcccactcaatagttagaaggatcccgtttcccaggcactgaggtcaacgaataattattaaaacacctagaatatgcccagcattgtggtaggtactgaaagaaacttggagaagtataaggcaatgaatgcccaccctcaaagagcttaaaatctggttgggcaaacctaattactgtgtggccataaaataatatctagtaatacaaggaagctcagatcttggtagggccaaataagaagtgaagattctttctgtgtttagtaaaaagcctgacaaacctattttgtgctaggactggaaaggcagaaaggaattactctcacctccaagtacttgaggagctagaatttactattcctggatcctaaacatttttacttcaagaatcaaatcaagagtcatatattagctttcggattggtctctttctaatgttatctatccccagtcctatctctaatcagccatgagtaaaatagcccgaggaaagtttgcagatgatggaaccaagatattcccttgagtatgtaggcagtggcagatttggttcttgtgtttatgcctggttgagaaagacagaagtctacctggggtgaaaaaaagtgacctatggactgaattgttacctttgtgtggcacattccctgtttctagggcagcaccggagacaaagaatgcatttattttgtggaaagggatgggggcaggggaagaaacagaaaccagaggattgtgcaataatggcattttcaaatccctccagaaagtttatgtttcaagtcttttggaaaagtgaagcatagctacttaaaaagaagcagtttactgaggaccccagccccagttctgctgtgcaggattttccttgttcctaggcgttctcataccttcaaccccagctgttggggcaggcaggctactgtgtctggaaccctgccccggacaggcctatgcctttccccagcagagaccgcaggcctcaaatagcatctaggtgtccaaatggaagaatgagaacaaggacgggagtgaaaagaaacagtttgctggatctcagcaaaagaaagtacagtgatttctgtgtcatctgcaaaccagactggacttcccttgttgaaaatcattcccaaaacaagccccttcctcggatggccagtgaaagggtgatattaaatgcacagtctcatgaattaaacgtaattgtggggcacagatttatcatgcaaaataaaaaatgcttctcacccacctaggtagtgggaaaagtgcaaagattgagtgtagtgctgattggaagcctttacatcctgctgctggcttaatcatctgcatattttccctcatgccagggatgatttgataggatatggttcagaactctctctggtgcttagtaaatctttttgactgaccgaatgacctttgtctctttcctctcctatattggagcctcaggagtgatggcctgaactttcaccatcaacctcccaccagtgatgtcatcattctctccttgccatccaaccccctgtgtcccgaatgcctttacctctgccctgtgctcacaaggcatcttcattctattggacttttgtcttggctgtctgggctatctgtgtccagcacactgtcagcatttggcaaggtagaggccgaaagggaagacagcagtatggctagtggttcagaattaggactttggaacgagacatgtctgggctggcatcctgcctccatatctttactgtgtaatcttaatgtcaggaacctcaattttttcacttatgaaatgggtatataagagcacaagcctcagagagccatgagattaaacaaggacttacaccacagagtgcctgcctagaataagccttcagtatacaatagttaagaggtgagaggctttcatagaacataggtacccttgcctttgaagccccttattccttaaaaaatattaaaaattatattttatgaccgtgttggcaaaaagataaattaatatattttgaaacagttctttaacctaaaatcttatttttttccttctgttctataactgttgtgagccctgggcactgtgtgtcccatgcctaattggtaggtcagcccttgggtgaaagatttgttttggagatccttccctttacctttccagtatcattaactgttttctggaagattcaggccctgcagcccctcaggatattactaccctaatacttctcctttctcccttctcttttcttccagccacccaaaaggtccacagtgtggagctcccaactcccatagtcctgcccccatccttctctatttaaacccttgcctttattctctaccattcccctggttaggtcttgttcccttagagctttattcttgttctggtaagttggctttgaattttctcataagctatttgtccttgaggtattattgactgttttcctcctctgttgcttctggagtatttgcatcttgagagactctataccataattcaaaccatgtatctaatgaaagaattttagtccagcaaaggagatatttcaaagcaaaaagtgatccttgagaatcatttagattgtatggtgctggtgccagtagcttggtgcctactgcatgtaggcattcacagtgggcctcggtgatataactagattaaaaacttctagaaggcagggcacagcctatccccaaaattctcttggtaaagtatcatgcccagtgaagttttgatgggtgtcttttatcctaatggaatcacacatgacttcttctgtcccccatcttaaggaatccctccagctgtgcttggtggtgaccttacaccaccacacatagtgcctggaacacaaacttccctcctttagtgcttgttattttctggctttgggcaggataatgatctcagagataatcccatttataaaggagaagaaaactgtggcccagaaaagttgagtattttccctaaagtaacaaaacaaattaatggaagaatcgggacgagatccctggcttcctgaagacacaggtgtaggtaccatttacctctgtcagggcctagggtgtcacttactacagagcacaggctgtgcagtgggaatgtgtggtttgattcctgacttcattgcttactctgtctgtcctttgaaaagatactcaacctctaaacctgttttctcatctgcaaaagcggggaggggaagaaataatatcaactttatatagagttgtgaagattctgagagttgtgagagttaaataagattatccacataaagtgcttagtacgatgtctcacatgcagaccttcaataaatgactcattattatacaattatcactaattctattactgtctctacactcctcatagcctaaagaaagtgtgagtgctgtttcccagagcgcatactgcactgcccagggagtggccagagcagtgagagaatctggctgaacaggttttttcaaagcagtggaaaataaatcaaaggtgataacccaaattcggaaaaagaatgtactcctttgtttgttctttcctagttgtgaaagaaccttcaaaatgcaatttatgctgaaataaatcagaagcaacatggctgactctctctggtctgtgttcttcctgaccccatgaggatagacagtggtaactctgagtttctgctggatgtggtgatagctgaccatgttctgtgatgatgtctacaccagtgagtggacaagattaggagtcagcaaatcatgcagagacagcagagatgtggggagaggggaagcttcacacccaggtacaaagcatgcctagccccttgctgcaaattgttcatcactaaatgtgaagtctcaggcaacttggttagaactctttgttgaaagtaacagatgcccaatttgtattagcttaagcaatagggaaattcattataaagattccataatgtatcaaagaaaacaagcagagctgacctgggattggaaacaagcccccgaatggtattaaaacgtgtctctcctctgcttcatttttctctctttctacagatttgcttcctctatggctctagttaacacaatggaacaacagctcacaagttctgtagatacagccacctaaagagagcctggtctcactttctccaaatccaaaattcccatggaagggagtaattgccctgtcttgggtcaggttcctttctctgattaccaatcagcaatgatataaggttataatctgttgtaccaacatgacacattcaccataactatttaccacctgtgagtgagaaaaactacaaataagggatgattgaaacaaatattgatgagccagatgacaaaaagcagatttttcccactcagctctatactgcatcctggccattcccatattcctcatcattttacctgaaatctaggatgtctctgtagttactgcccctggcccctttatactaggttgatcctagccctgaacaaactaattagagcatgttagagtgtaaatgacatatgctttagaaccacacaaactttgagttaaagcccacttgctagctgtgtgaccctgggcaagttacttagtctctctgagtattgctttccttatttataaattaagggtaataatacctttctaatgggattgttgtgcagattaagggaaataaagtaaccatattcaagtgtttgatatgtaatatatactcagttatgttaatttccttttcttgattagtctacctagaaatcttcaggcaggtgagagagcagccataagtgagaagagaagataggagaagtgatagaattttctatctaggaaatgttttcttgcctcgtgtattttacagttatgctgagaaaacattgaataatttcagtgggtctgcagcactgggaaagccacactttggtagatatggtctctcacttcagagacaaatcaacaaggatatgaggacgaatgatgaatgctttatgtttcttttttaatgtattagtgtgcttatatggcccttaagactttctctgtaaattttaaggctcataaagtataatctgattgctagtttgtgaatgaagtactttaacagtcacaaaaaaacttaaacatgttgctgtttagacaagctcccctttcagcatgtagtaagccatactttttctacaaattgttgtttattgagttgttactgtaacaggcactttctaaacttttatatgcattatctcatcccttcctgtgagttaagtgctattgtccccattttctagatgagaaaattgaggctcaggtaagttgctgaggtcacatagcacccagtgacagaattggcacttgagctcagttttgtctgcttccagagcctaagcaattaacactttcgttttggtaacgagatttagttacaggaaacagaagaaatgaattcccaggaaaatcagtgcttaaagtatctcatatgaggaatgatcatctcatgacttttgtgtgtccacataaggttgctacataggcttggatgcaaagcagtggaattataggaagaaaagtagatgaacaataatagcatatctccttaggcctgagaactattctaattacttacttagaggataatagtgatgaaggggttgggtctgtgaaaaaaaaaagaaactagagatttgttcccagctttagacttgtgagtgttttctatcttgcttaaaattgtgcacactctgatcatctgtagctgcgaggagttgtgtgtgcatgcatgtggaatattttggcttgctccagaaaataacaatgctttaatcttaggtactgtgaataacttcttatgatatttgaaggaatctgtatccattgacctatgaaccactcatgggaaccactgatctctaacctaattgatctgctcctccagaaatattttattttgttgtgtttgtgctactgagagttttattataatccagattgtgcttcatttgtgctctctctgtgccatttttttaaaaaactgaatcttgtgtgtaaatagaagaaacatttaaatatcacatcactttttatgagaagcatcattggattcatatttcttatttttcctttttattcccttctgtctttcagctccagggttccttgaaaagaaaacaggtagttaacctatctcctgccaacagcaagcgacccaatggctttgtggacaactcatttcttgatatcaaaagaattcgtgttggggagaatctctctgcaggacaaggtggcctccaaataaacaatggacaaagtcagattatgtcagggaccttgcctatgagccaagcacccctgcgaaagactaacactctgccatcccatacacattctcctggcaatggcctgtttaacatgggcttaaaggaggtaaagaaggagccaggagagactctgtcttgcagtaagcacatggatggccaaatgacccaagagaatatttttcctaataggtacggagacgaccctggagaacaactgatggatcctgagctgcaggaactgttcaatgaactgaccaacatatctgtgcctcccatgagtgaccttgaactggagaacatgatcaatgccaccataaagcaggatgacccatttaacattgacttgggtcagcaaagccagaggagcacacctaggccctccttacccatggagaaaatagtgatcaaaagtgaatactcaccgggcttgactcagggcccctcaggctctcctcagctgaggcccccatcagctggccccgcattctccatggccaactctgccctctccacttcgtctccaatcccttcagtccctcagagccaggctcagcctcagacaggctccggagcaagccgggccttgccaagctggcaggaagtatcccatgcccagcagctcaaacagatagctgctaatcgtcagcagcatgcccggatgcagcagcaccagcagcagcaccagcctaccaactggtcagccttgccctcttctgctggaccatcaccaggtccatttgggcaggagaaaatccccagcccttcttttggtcagcagacattcagcccacagagctcccccatgcctggggtagctggcggcagcggccagtcgaaagtaatggctaactacatgtacaaggccggcccctcagcccagggtgggcacctagatgtcctcatgcagcaaaagcctcaggatctcagtcgaagttttattaacaacccgcacccagccatggagccccgtcagggcaacaccaagcctttgtttcattttaactcagatcaagcgaaccagcagatgccttctgttttgccttcccagaacaagccttctctcctacactacacccaacagcaacagcagcaacagcagcagcagcagcagcagcagcagcagcagcagcagcaacagcagcagcagcagcaacagcaacagcaacagcaacagcagagttcaatttcagctcaacaacagcaacagcagcagagctcaatttcagcccaacagcagcagcagcagcaacaacagcagcagcagcagcaacaacaacagcaacaacagcagcagcagcagcagcaacaaccatcttctcagcctgcccaatctctaccaagccagcctttgctaaggtcacctttgccacttcagcaaaagctcctacttcagcaaatgcagaatcagcccattgcaggaatgggataccaagtctcccaacaacagagacaggtaagggctctactactccaaatacagagttcccagagaccatttagcttgatctttatgctgtggttaccattatgtttgtattgggacaagatcaagaccaaagacagtagtggtcttgatggagtcatatgaagacctcataaagcctggttcgttgagggcatctagaggcaaggactagtacttccctgtagagcattagtatcattgtgatctgtaatgatcaaaggttcttgcttactcagaatagagcattataatgtatgctgttagtgacatatccagttgtcaatcagatggtcacttatccaagcagtaaattagtcattaagtcaatgtgcacttgctgagtacctaccatgtgcaagatgttgttattatgctgagtattgaataaagctggaggtgggattgagtattaaatgactgatctacacctgcaccaaccaactggaatatttaaatgcccaatgatcataatgatcctgcgatgactccctgtgatgcatgtggaccgaatatcagcctgaaataaaacatgatccctgtctgcaagcacagtaaggaaagggagacgggatttttaaactaccatttcaatgctaggtatgagagcacagagtttgggtatcttacccggcaaagggaaatcagggaaggcttctggaaaaccaaagtctgagttaaatgttaaaagatgaaattatcacgactacagataaaaaaaatctctggtaaccttacatcgtttggttaacataaaacagaggtttattccgccccaaacgtgaacaatatgaaggcatagctctgtgcctccagagcacatattgatgagtaagtcctgatccccagggaacctaaaagaaaaaactctttctggaaggaaggaaggaactttgaatatagctttgtgcgtgtaatttgacaggtctgcgttatctatctaagcacaaagatagcacattatatgtcaaaaaattatctcaggacagtgcgatggtgcagatcctaattccaataacattcctagagtagttttcgtggctattgcccagaaaagaatgccacaaacaccacaaactctgtccaagctaacctttgccctagttgttggccaagagaacaccagactcaaagaggattcaaaagttatgcactaagcacagctttcagcccttttctacttaagaagtgtgtttttaaaaaattatagattttggagaatggacttggagtacagacatatatatacacacatatgtttttttacaaaattccttttttaacccagggaattttgggagcatttaaaaacaagtcgtagaactattttctaatgctatatgcaggcactttgatttggatgaatgtaggttcaaattcttactctgacagtcttagctgtgtcacctcaagggactcactgaacttctctaagcctatttcctcacctatcaataggagtgaaaagaaaatctcctaggagtgtattgaaaataaaatgaggtaattctcagtccagagtctagaataagttgattactataatgattatggaaagagccataaatcaccaaaatgttatttttaaaaaagcactgctattttataggagaggcattggagtaaatcccaagttctaacataaccagtatcggggaaataaataaaagagaattatctctaatttttcactatccagcagcttgagtgtattgcagtttaccctttctaggcccagacttctgaccataaaaatggaaattataaataatgagatagcaatgagttagcatttataaccggcatgacttctgcctcccttacttgtggcatctcatttcatccgtatgagggaaatgccattatttccatgttacgagtaagagaattgaggcacagagaggttcaatagctctggtgctgacggccaaatcaacaaacatgttccaatgccttagataattttttacattctcctagggcatatgacatatatgatacagaggtaattttcatctcttccaaaaggcccttaaaaagtggtggaaatgtggcagtatttcaagttaagggcctctcttcgatacagggagtagccacccatttaaagctttatcccagctttatagactgaaccacattgtcccttccagatcaataattctataacatatgatcccaaaatcatgtggctgagttttaagcaagtatacttcagctgtgtagtcaagtaagtattgccctttggaaagcattcacatttaggagggaagtatacacattctgataatgatgctattgttcaatacagctatagaattttctctggggattgtctctagggcttatagcacatttggtagattattaccaacacagtaacattcatcctatcagggcaatttttgcaaacagtcaagtcaggtaatgctgctttgggtcaaaaccaaggggtaactatgatgtgacaaggctgcattgcaagtgtggtgtgtgagctttctctgaaggcagttaaagaaagtgagctccttctcaagatgttaattttgggaagcaacttgtatttgatatacatacttctaaggttcttctgattctcgttgtctcatccagtgtgttggcatgtattctcaactcagagtagttttaactcttccatctataatagacagtacaaatgtctgttctcattccagaacagctaaatctctgttaccgatgaccaaagtcatgggtagggtgggggatttggagttaagcaactcttaaatttatcaactgaaacatcttaaaggaaaacactagtcatgtattttttttttctgcttgtcatactcactttgtgtcaaacaggacgatttactgtgggatttgttacttgaagctctttagcctgatgaaaatcttggttctctgctacaaattggtagactaaatttgttgatcagttgcttgcagttcacctcatagatatgcaaggtgaccttccctttacctgtcggaactctgaacccagacagatccatatttgcagctagagactgaatgtgggcaattcctgtgccccttctcttttactgtgtacctacctctattttcctacaggtaaatgatgcctgagagatggatgcagcataataaaattgtttaataaatccttattgctccatgtttggggtggttttaagtaacctcttctccagagatggggaaaacaaatgctatttggtgttttacaaaatgtctatagcagactcttgtcttgctaatatttgtagcttggcacatggagatacctcttggctataattttcttcccttcctgatttgaggattatgggatagggcaagacggggatgcaatgaatgcatttctgatttatcttcaagtcagtgagcacttacttaagttgtgaaagagttattggctgatcagggctcatgagggtttaagccaaaagtgcttacctcttgaaccaaaaagtgatctttttcagagctatataatcagtcacttaaaagtgtgaatttttttctaacattggatccatgcaactcaagtggattctatatttggcttagaattctcccatatctaaaacttcttggagggaaggcagccagtgaatggatggtttgttatgactgaaacataaatttgtacattgcctccttagtttaaagccaagttcctcaatcatatattaataacctcaccctactctctcttcctagccaagtttatccttctctacaccatatcaacccttggtgtaaatcaggcacatctcctaatgttctctgccccacttctttaaggtagtattgtatatatctaatcttaaggatgaacacacagaaaattgtttccaaattggcctgggtggcagtggggaaatcaatgtaactttcatatgctgacaatacctctaaatccttataattgtccaatgaaagggccagagaagaaatagaaatcttgtatcagctggaaacgccttttccaatgggaaaataatcatgaatttggtgttttgcaatagtatgatatccaagccactcctttgctggatcctagaggttgcctgaagggtaacccaattaggctggtgccagagtttgggttcataggctagaataggttagaggaagtcaggagcctggagggccaaagtaaaaccaagccaaagtcctaaaaaagctgagaaacaaaatttgtcagtatattcagaacaaagaaggaggctaaaaaaatggtgacatacctgcggtcaagggtaaatataatgacatgaaatctatagtgaagatgggatagagactcgagagatggtaggtgatcactgcaagtgactcttcaccatttgatgatttctttataactcaccttggctgactcttggcaaaagggaacaaggttgatacagacatactgtgggttgtctgtgggaggccaggagcattatgtttacattttcattttatttttgatatttcaccatttatcttttaagttacaaaggaaagaaaaatttgtctttaatactccgtgaaactagtgcttgactagaatgtagagtgaatttccagatacatatgttgatataattagtattgaagaatcataattggaaaattagcaggaggaacttggtgtcttttttgttcttctgtcgttattctgttggttggttggttttaacattagcactaactttgtgccatatacgaataactcaaatggtagctataatcaaccgtttttcacaggtgaggacactgatgctcagaaagatcaaatcacttgctcagggttatggttagtaattggcctgattttacagtcagggctcataattactatgctgcctaaattaaggaaataggtagaggtggtttgggttgtgctgtcagggccttctttatgatatatgtttgaaatttcactgttttctacagtcccaggcaaaatcaccacctcgggaaaaatttaggtcaattcgaatgtagggagggatctttagtcaaattcacactgaccttgccttatctgaatccacagatctctcagtttcctgatatgcctaccaggagccatgagcttactgaatattgctccattcttagctctagctaagcttctattcacttgtttaaaaacatatttattgtgtgcctgctatttgccaagcacagttctggattactgatgctacacctgagatcaaataagaaattgtggtgcagtaatggaagtgtaaaattttcagagtttttaaaaaattaaacaatcagattgttttcaaattgagctattttcatcatattgcaggcatattcttgtttctattgctaggctgatttgctgctgggcttcttggtacctctgttcccagattaaaatgggaaaaaaaaaacacaaggaagtgagaatgcagtttaatttttaaagcaaacatttctggagttttgttaggtattttacataataaagaaaattcattcattctctttctctttaacatcatccattcaaatttaagaatcttttcaggattactgttagagtttcacaatgggatgaaaccataattcttgccttcattcgttcatatgatgaaaatgtattgagcacctacaatgtgccaggaactggggattaaaagattaaatgacccccttcatactcatataatctcaaagatcaggaaaacatggttccttccctggctgagcttttgatctgaaggaggtatctgtccttattactttgtgaattcccattgagtaattacattacgttttctcaatccttaacaatccattctatataagaagtgagcaaaaatcatgtgggcatttcccctaagtcaacaaatttcattttaaacatgttttttaacctttcacagaatagaactctctttgctggatattctactttattttctattttattttgttatcctagtatgtaatagctcagagcacaatggagtgaatttgtgtaaggcaacaattaactcctctttccctccataaagaaatgaacacaataacaagaagaacatgttagccttgggatcataatacatacggttcaactccacagttaggggaatggcttctattattctcattccaaggtctttgtctgtgtgtcacatccatcaataagagctgtgcatttaaagcattagtgggtaagttagcctgttgaataccaagtttccaactagggaaagaaggggtgtagggttaagaaatagatttgaacctggagatggaaatgcaagagggttaatggaaaatctgacagatatttaactgtaatgtgcattaatgtaggtgactcaaacaatcccctttgcactcattctaattagttttgccttttctaatcagatgtcagttgttatcagtttggtagaagggggtggtggttctttttgtgaaatccaaaggaggcaaaaacccatttagccagttcactaatcagtaaatttgcacattaatggttaattaaagttaggcacaaagacttgagattcagaaggtgtttactataaggagttctgggtttcaaacagaagaccgtacaaatgtttagactagtaggatcagagaagtgtaatgtcagtgaatcatcttaacccttttacattgtgtctcaagcaggagaaaccaaacttaaacacacacacacacacatacgcatagcctaggcagctctctggatactaattagagaactctggctgaatgtttgcatttgatgcaatgaatctgaacaataaagtggtgcctaattctccaagcaataaattaagttgaacataatagagggaagccaatgactgcttccctgtgcatcctgctaaatcaagttttcaagatcctcgatgatgaaagaacaggggtggttgacctgtttccccttcattctactgtgagttctctccacccttaaccactagcattttccacagtttgcttttcacgggctcttaagttcagctccacctttatgaaacatgaatttcataaacagggagcttactgggtcctgcttggtagtccacaggtctgtgtgggtgagcacaggagtgtgtgtatcgcactttctggtctttggctcacgtctctactgtgtgactctgagtctttgtccagttctttctccccttggctgtactctctcttctttgaccctttccctgcagaccaattttgaaccagcctctttgccctgactgacttaagactgtttcatcgcaggccttgaaaggtggaagggtggggacatgtagccgctggagttattattggcaacagtggtgaagggatgttcccatgctgggaagaggcatgaggctaataagctggccagcccatctccacatcccccagtctctggatggacatgcccttggataaaacatatccagaacagcttctgaccattgttcctgcttgcctctcatgcttgctaactggcctgcctccttccagtcttgccaacatgaaaccagagtgagcattctaaaataggaatttgatcatgtcatcacctgcataaaacctttaaatggccttcattttctcaggagaaagtccaactccataggcagcttataaagccctgtatgatctgaatcctgccgaagtctccaaagtcattggttttcattcccagcctttctcttcccttgactcctacccattcacccatcctctccccaaactcatatacactctacacttagcaaccttcataataaatgtcctccagttcctgagaagtgtcatgctttctctcacccccaggtcttcaaatacgctgttccttctgcctggaacacttctgatctactcagcttggctaacctaatcctaaattttcttcagtctcagctaagacttcatttcccccagaaggtttccctggtctcctaatatggattagctcccatcctatatggtctggtagctccctctgcttcttctctttgagcatggattacctctcatatatctttgttcttgtgaatctcccccaactacactgcaagctagttgaatacaggggtggcatctgtcttattcaccactgtattccaacccctaacacatctactatgttgcagggacccaaaacttagttgttgaacatgtggacaaataaattataccattgacttatcgtcctttcttctgttctggggctttaagagcccatcccctcccccaacagaagttaggaacaggagctagcacttccaccttcctccataccaagtctgctctctaaacaacatttgcccatggacctagtcttagtttgagtcctagtccttccagttctagtcagagctggaaagcagagaattccctctcagctgccccatggatcaaatctatgagatgtgattctgaagaggccctattgatgggggctggactggcctatatgctggggaaatcatacggataaaagtaaagtaagagagtttcactgaggatactccaagtgactttttttctctcatcctgaaggcaatggaaagtcatgaaaaaaactgcacaggtagtttataagcagaaatataacttgtacctggcaaaaggtaatcacttaattcaaatgcattgaatgtcagtgaatcaaaattgctttgtagaaaagtcactctagtagcaggataaagaacacactggaggggggcagctcctaccgacatcagaatgtcaagaattcacccatcctctgtctcattttctcccttgcaccccacgtgccacttctcagaggccaacattgaacttcagctcttgctccaggagatgtattccatcaatcattgtatcttacatctttactctctcctttctatcttcaatcatgttcaaaccccagcattcttcaaaaatgactttcattaactcttgtacccctttgagccccgttttgaaccaggcttagaaccgttgcagtcagcatacttcctctctcccttcccaggtgctactgccgacaccactgcatgaccatccacgtctctgcctccactgctgctgccttcgtgctttgatactgtaattctcctttttacctccttctttccagctaccttgtccctccagatggtagttggacagcgtgtctaagcaattctgccttgctccatactccttagggatgaggccagtaactggcgttctagttatctctattgcttttgccagacctccttcctggaattgcagctttaccccagatacaatcatttcctggggctcgacctcacagcgtcagctctcctccctatgaatgccttttgccctaccactgtctgatccctactggctgtaacatcctgtccactttgttaggcagttctgctggtatcttggaaccccagcccttcactctctccatccccttccctgagtgtccatgttgctataatcactccttttcatgaaacaaagttagtttcttctccctctagtacccacagcacagtgcaaacctttcagtatagttcttaccatactgtattataatttcgtttaggtctctggtccaccgaactgtgaactcctggagggctgggaccatgacattgctttttcccctctctgaactcacaaagcattttgcatctctcattacattcattgctttctaccttgaattgtagttaagtccataccttaacccatctactagacttcaagctcctggaaaccatgtctgtatgtaattgatctttgtaccaccaagggcaaacacagtgcctgagagaaagtgtcaatatacaggcaaagaaaaaaaggcaggacaaaggaaagaaagaaaagaagttatgcgatgggggtgtgtgtatatgtaggctgtataatcttgaaatcaacgaaaatgaaatgggtttgaataattttatatgaattttaatataaaatatacattattgagaatttatatattacttcaaaactgttgcaaatatcttcatgtccatgtgactctggccaacttacttaaattccctgaaactaagctgtgtcatctgtaaaatgacaatgacaatacctgtttttcaggattgttgaaaattttccatggtgcatgaaataacccatgagatatacaacgaacacagggcctgcgccttgaaggcaattgacaaacgttagtttgcttctcattgcaaataagcaccctccgataaaataatacaaattaaatattagtagaaacttgcaatgggtgattttcaaaactgagccctcatttaactctgagtttccaagcaactaaggtcaaaaggaagaatgtgggaatacagaagttttttttttaaatatatgaaaaccatacacattcattaaatggaggcaaatttttcctggaaataaattcaaaggtacatttatcatcaggggaattaggtaacttgatggacatcttccactgggaattttggaaagacaccatgacactgttgactttgatgtttctgtttttaagctgcattataaaatcttatatgaatattataaatattcatattcataatgaatattatgctttaattcagtattatactttaattcagtaaaggctttcctccaggaagctgagataatgtggttataggtataatgttttcggaagatgtatttcaatagttttcacactttcttttagcaagaacacgtctttcatcccttatcctcctccccactccctcaccccctgccttttcaggattttcctaaggcacctcccagaactttaagttccttcaggacttagtttgcaaaccagtgttgtagcttaacccatgaagagggcatacagaccttataggaatgcataattaaaatgcccattatattgcctcactcaaataacagttttctcaaacgagtctctggcaaacccatgcattatgtaaaatggattagacctgaggagtgtctacctcagaatcaggttcaggtttcagggccagctttctgaaacctttcaatatgtgataatcttactccttcagatagaacaaaactatgaactccaggtatgacgcctgcacttcccagacgaaactcattcaaaatcaccatgaagaaaaaacaattcagcaattggtgtagttatttatcattcggcaaatacttaatcattgcctatatgtggcaaaccatgccaactgcatgagaaatgtaataactggggtatgctgtgtggtaggaagagcatgggaatgagagacgtaacacaagaagtctggacccaaacttgctgctaaggattttaccttgactcatcaggccttgctcactgcctttgttacaattttattctattattttgaattttatgattccaaaatgcaattactgtcttcatgtttaaatttgagtcttacctttatcaaagtaacacgtaaatatagtttgaaaagacaaatcatattaaaatgcaaaagctattccctggccccttttccctcactcttttcagtctcaggaggaaaccactttcatcatttttagttgcttctcctggtatttaccattatgtgcctaaatgcatccatacctgatacctcttgatttattaactttaggccgtatccattacatcttattatagtagatgaagattttagttctattttcaaccctttcttcctcttccctttagccacaatatagtcagataaaaaatttagataagtgttttcagaatttatgaagggataaatagtatttactgctgagataagcagtacactgtaattataattcttatccaggggtcatatacctaacttttctttcatttgtgaagtttccttacatctctggctgtcatctcataccatctaacagctctgtgaaacatttctcaatatgttttccacactgatacatctcatctccacagcagccctctgtgcccagccacagccttaatgggtgttccctaggcctgctgatacagctgtcgtcctacgacttcctgccaccatatttagagtctcttcactcctttccttgatcaggttccctgtttctggatcccttttgtctctctatttgtttgtttactctctcattttgttgcatttcatctgatggtcgcttcctgaccaagggcgtgtgaaggggaaagtgttagaagcttcctaggtgtctttggtgccacagagtatgcaaagaagggataaggaggtaagcctcatttgttgagcacctactatatgccaagtgctttctccatgacatttctaggaaatagaaataattttctcctctttgcagatgaagaggttgagagtggagtggcttagtaatttgcttaaggttaagcaggtggcagaactggaatccagatccatgtttatctgattcttgccattctccacacaccgcatctctcagccaaaaagcttaaatacacaatccttgccctcaaggaatttgctcaatcatgtgtttaatccaatgtcagataattgttatttttctgggcctattttctcccttttcacatgtgtgtgtaatatacatgtgtatgtatataatttaagtctggttaaagacttaaattattttcatagtcccaagtacatcaagttttattattagattttccatgaaattctaaaatagttatttctaaaggagatttcagatttttattcccctatttattaggtattaggcaattagagtctgatctggttacaactgaaaatatgttggtggttttgcccttctctctggtgaattttggtttttatgccaatcagttcatttgctgacatttatcacatttagctcctgcctaaaggactttcagaattacaggtggaaaattcactacgtagaaggaatgaagcacacttcttactgcttgctgtaccagcagactactccaagctccacaccttaaaatttgaattgatatccttgttggaaacaaagcagaatagtaagcacaaagagtagagacataggataggatttaaaatgaatgaaagaaggtagaatcattactttttagtggataatttactgacaggtctcatgtgcaagcaccaacagtaccattgatgtattccatttatgctggcacagctgaagccctctgattgcttttctcacctagacatggctctcattaatcaagggaagttgcatagactagaacaagaagacagttttgtcgacacacttccagcactgttctctagcagcatttcgttcctgttccggtatcattgctctcagaagcagaagccctttcatttagttagaaattagcagtagatacctgctctctgaaccgtctctgattttgagtgttgagttccagaaattcattttgaattcagttgtttggcatttctggtacagattttcctgtaggaacaatttaaagaaagtgcattaagtcctcctgctagcctatccaaagtctgtttgacttatatgacattgaactatctatgattgaactatccatgataacacagtgtactatccatgataacacagtgtactatccatgatttctagaatattacattcttttaaaaagaagagatgtgttcagtgtacactgattgagccaggcatggtggtggaatgagaaatacaatctatttagtgaaatggaaaattgcaggacaagagagaaatgtaagtcccagatgtgcacagagcactttgctatggaaaccacagagaaggggcatccacctcagcctggctccaggttcgaaatggagagactatgagcattttcagctgcactctcatagaagagaggaacaatccttcagaccaggggaagacagaaaaggagactggccagaagaacacctgggagggagcacagagctcttcattcccaggggttctttatagcatggacatttacagtgtaggtactgcccaaatgcccatccacaccagtgttagggactgaattttgtttatttcatttatcaagatataatagttttgagtcatcagttgtatttctatagcctataaaaagagcaccaggcaaggcagggcccaccaccgctgcagccacacccagagtcttccccatcctgtactgtggactccacatcagacctgggaggcaggactcagtggatgaggctgtgttttgcatttctgagtacagtccacaaaatggtttgcttctgaaaaagcagtagtagtcttacatccaagattattcctaaaataaagtttcgacccacatatataatgaaattgaaactgcctacattggcaaagccagaaagagagtaaaaaagatggggtaggccagttgcggtggctcatgcctgtaatcccagtactttgggaggctgaggcgggtggatgacttgaggtcaggagttcaagaccagcctggccaacatagtgaaaccctgtctctaccaaaaatacaaaaattagctgggcatggtggcgtatgcctgtagtcccaactgcttgggaggctggggcaggaaaatcacttgaacccagaaggcagaggttgcagtgagcctagatcgcaccactgcactccagcctgggtgacagagcgagactgtctttaaaaaaaaaaaaaaaaaaaagagagagagagttggggtaaaaagtcagaaagagagatcccaagggagaaataaaaggaaatttgagccaaaaaatgcatttctgatgatctcttctgctgtataaagatactttataaggcaattttaactctgataacttgcccatttctgtttgcagaaggaagtcagtcattctcacaaatatctccatttgtttttcctccttgtatttcattcaattttgtggggaagggttggagggcccaattttgctattgtaaaattgtttctcatttttctgaacacttgaaatggggtcagatctaaatggctatgaatgcaacatggatccaaaggcccaaaggtcaggtcccacttggacaattttgatatgtaaagtgctgctaacattcatttatagacagcagcaagaagtatgagctgtggcctggtgaagattcacatagatctcattttcctcatattcagagcaagacgttcccaactgtctgtgggtctgcatgagttgtggggtgtgggagacccctctattgtcccctttgagtgtacatattctgtagtgaagccagaggcaaatgtgtgagaacctccccaggctgttccttgggagtgagggcagccctgacttccatgggaatgggattccctgccaaattcagatgccgaggcttccctcagggaccacagcccatccgagtggaggaagttgctgtgagaagttaagcaggcagctctgaagggctgtgtgtgtgtgtgtgtgtgtgtgtgtgtgtgtgtgtgtgtgagagagagagagagacaaaagagagcagccttgccccattgcttgcattatagtacacatggaatcaattttaaatttcacagaaagaaaacagtaaacagagtaagaggggagctggtgtgtctctccaaggttggtgtgtctctccaaagctggtgtttctctccaaggctggtgtttctgctcatgcatacaatacatgatgcacaccattcatacctccaggttttacacatatttctttcacccctgagcatctgtgagactcagcttgatgatatttcaaacgactatgaggatcacacctcttggcaaaaggcagaataactttctgttgtaatattttaaattaagagtttcttctatctaggccttgcaggagagaggagaatgtattaacaaatttattctgaaagtagagatgtgggagatatgtgatccacaaagcagggccacccaaggttcacttcagtgttcacgtttggggaagcatgagaatgtcacatagcaaggccaactggctcaaatgtattagcatacaatcaatatgcaaggcgctatctgaatgccgattagtaagagtcacattgaccatggtagcagatgacacattaaacagtatgataccagccacaaacctcactagcttttccagtaacctgaaaagacaaagaaaaagagaacttggggaaactcctattcatcagtcaggtttccccttaaacatcacttcctttgggaagccactcagacaaatccacccccacccgacttcccctagctcagctcttctcttcttttacattataccttccagaattatctgtcttccctctttcagtccccagcacccagcacactccctagcactctgtaggcacttaaatatgtgttcgatggttgatggaatattattggcttgtgttaggtcttggagggtatgaaaatagagaagatagaatccctgccctgtctgggaaggagacagacagataataatagacaccatacaatttgtcagactttgcaatgcttgtaagtacagcttctctaaaggagaacaaaaggaaggttgaacttctgagcaccttagtgataaaacagacctacattagcttcttctctgattcattaattttactggtaagaaataatgaacagaatcctatttccttacatttcaagtttgctaccaggatagcacagtatcaataataataggcaatggatttcacttgggggaatattatgtcaggaggaaaacatgaaatattatcaatatcctctctagggaatctatgtattagctttgtgatgtctaacctcgaatttctcaccttcagaactgaaagcaaatacataattggatttgcattaaagctctaaaaagagtgaaattaagagtcacgctcaagtttccggctatgtttctttgttgcctactccttttgccactctgtcacttaattcatctttttttccagaggaaaaatcaaaagcaaaatatgcaacaccactccctgccctccagtactcccacagtattatttattgaccactctgggtgtgcttggcttaacagacaacagaaaggaagtgaaggctcttccctgagggtttgctgatgcgattagagagccatttagaaagataactcgaaatctcagacagacacaggaatctaacttttattctggtgtcaaaaatgatttgaaaccttttttgtatgatgacgtttgtcagtactccttttattcctctcacagcagccggtgggcgtctccatgcctgatgcagacaatatagaatccaaatgcagttgcaaaggtgaatgacttcaggtggctttgcgccgccatcgtcatctgcacaaaatgtggactgaccatggatctttcctccatattaacctctccaagaatagaatctattgaagacatgaatcttttgatagcatttccttggggttttgggagagaaattacatcttgcagatatctgatgaaactctcatgtgaccaaaaagactgcaaataagagtttgataaacagaaaacaacatgacaatagtttctgggtaactctttgaacttgttaggtacagcatatactgtccttcacacacctgctgtattttgagaatctgagcttatcgaaagccacacggcatcagtggaactgactagctgggtgactgcatgcaagcagttagccactctgcctcagtttccctaaaaatacaatgaaatggatagtcagttgagtggtcctcagacttttacatcttatagtatggaagcggacatggatttgctatatttcatttttctgtgtaagtacattaaaaatcaaaactactgcctactattaccatctttcatgaaaaaaaatattttttagcctgaaagcattgagacgaacataacctcagagtaagcgatggtccttgaaaagtgaataaatttaacggtttggtaaatcccttgcatgaatcttatttttttcagttcctttagcaaacaaaaacttattcagaaatgaacacacgtccacagaacaccattagcctgcacaatctacacagatccttttacctgtacattctaagcacaatactggaacttaccaaataagtaaataaatagccaaccagagccgtatcaccttctactttattacagtgttggtgttaatattttacagcactcggctaactggaatgtggaaggcactgccaaccacatcatactctttccacccaagatagtagatcggcttcactccattaaatcgtcattgtcttcagctgccatgactcctttaattggctcacacctgtaatcccagcactttgggaggcagaggcaggtggatcatgaggtcaagagatcgagaccatcctggctaacacagtgaaaccccgtctctactaaatatacaaaaaattagccaggcatggtggcgggcgcctgtagtcccagctacttgggaggctgaggcaggagaatggtgtgaatccgagaggtggagcttgcagtgagctgagatagcaccactgcactccagcctgggcaacacagcgagactgtctcaaaaaaaaaaaaaaaaaaagaaaagaaaagaaatgaatctgcaacaaggaattctaatttttttaaatggaggaggtgtccaagggacaggagactgtaaatgccaaacaaaagcttttatgcaaggctaaattggtgattttgcacaaaactcacaagtaaaagatttacagcacaaagaatgtaatacacttcagttaaattattcagtattgttacagtattaatgctacagcccaagtttcattgtgtaaattaaatacacagtctgttccctaagattgtacttggtttccataatagtttttttaagtcctcacagattggaaatataaatatggaaatttatgattatcaatagtttgagccaaatcctaagagaaggggtttggactgaggtctaaaagtacttaactgaaatggagccaccatgagacaagtttagtcttggaggcacatgtaagcgggtgacaaatggagtttatcatgttgggagacttgcggatttgccttcttgtttcctttggcagagcagggtaagaggccggctttggcgtcattgctttagacacacagtccttttggcatgaggttggatctctggtcccatccagggttcactttgtaatcaatccgtccttaaaatgaggtaggtctttcagtaagtggccttctccttgacagcgagctctttcaagttgaggggactccgtcttcttccttttcttccttacctgcatgccaccctgtccgttgatgcaaaagagcttactttatgtaaactatgtaaatactcaaatttaggttcagaatatcagaggtggtgtgaatcttagagacgtttctagtaaaatcattattccctttttatatatgtaagagaaatttaatagcttctctctaagttcattcactactcagaaacctgattagaactgtgaacttctgatttcaagatcaatgctggatccatttgtatcccccagtgaatctctagaattcgagtattagcaagtatgcaggtaatattgtataagaaacatgcagtgctccattaacctatatgcagtcaggacataccctgaagcaaagttttaactacacagaaatgtggccttaaccttataacaagagctttttttttggcaagtgggctatgtaagaacactgcatgttggaaataatggtagccagagaggaattagagatattctatagctacttgaaattttcagttttttaaagaataattatttcaaggctgaactaattaagtacatttctacatcctgtaaaatcttacgccccacctaactttaaaaaaaatacaatatacattttgaggatttatggtatatttggctcaacaatcaagataactgaagacggactcatctctaacaatccagcagtgcaattagagaagtctgccttaaggggtgatttttctacaaagacagccaatcttcaaaatggccagtggcaatatgttgtgttgacctgttttaatgtatccctctatgttaggtatatgcaggatggactggggaggaaaaagaaaagaaggcctttggagtaataaagatggagatgagatttggtgactggagaatttaaaaataaattccagtgcacctaaatatccatgagtcttttcagtctaccagtccatgaggttacagaacatcaagaccagattctcacaggttacaacctttctactgcaccttctcatttgagaattccaatcctgttcaaagttactcctaaccctcaactataccccaggtatttgggagtccaaaacaagagtttgacaagctctcctaaataggagcaactgctgaatactagcagctgccactccaggctacactgtgggccgactggccaatactgcctggagctacacgtctccatgggctgtggatttcaaaataattccaagtttagtgtgacatctctttcattttccacacagctctttcctttgctaggtcacatacagccaggatggctggttcaggacggttccaggtgccagtgccatgctggcaaaatcactgccctttgactctgtggtcttatagctgaagcaccctgtttataccagactctacagttcttcatagttttatttcctcgggaagctccagtccctcctgaaaacttggtttccttttgactcttgtcccattctgcatatatgcctaaataactgaaaataaattaggaatacagcttaagcctctacccaccttctccactcagaaggccccttagctttcatgtaaatatctagagggaaggctcatctatttccacctggcaggtgtattcaaatctcagctacacaagagatgctgaagtaacaacaaattaaccagtgaagacagagatacacaataggaaaaagtcaaagaccttttgtagttagtacccatgagattaaaatgagatttatttgctgcctgcactgaacacatagctgtgtgcatcccatagttgtgttacaggatccttgaggtgtggcctttcaggcctgaaacctctggccagtggcacttttgcctgagttttgttcggcccactgggcttgttccgcccactcagcaggctgtgctcagctcacactaccgacctggatcccacacttgccaagggcaagtcgcatggagcagaaaagggtgtgtgaacgagcacggggtctggcaactgtgcaggcagacacgccagtggggtgggcagctccaggtgcctacacaggtaccagctctctgcaaggctgcagctggaccagaggcactgcaagcagcttccctggctagcaccagggaacacagtggtgcccagaagcttggagatgacaggcaccgcaggaccccaaagagggagtcccagccctggcttgggaagctcccaggtctgggctccctaaggggctgcagctcttctctccttctcttcacctgcaatgtggtgaacaaggggcatgtttcagccctgtttttgttatgccttatttatttatttattatttttatttttattgaaacggagtctcgctgtgtcgcccaggctggagtgcagtggcgccatctcagctcactgcaagctctgccttccgggttcacgccattctcctgcctcagcctcccgagtagctgggactacaggcgcccgccaccacgccggctaattttttgtatttttagtagagacggggtttcactgtgttagccaggatggtctcgatctcctgacctcgtgatccacctgccttggcctccttatttatttatttatttatttatttttgagacagagtctcactctgtcaccaggctggagtacagtggcgtgatcttggctcactgcaacctccgcctctcaggttcaagtgattcctcctgcctcagcctcctaagtagctgggattacaggcacgcaccaccacacccagctaatttttgtatttttagtagagacggggtttcaccatcttggccaggatggtctccatctcttgaccttgtgatccgcccgcctcggcctcccaaagtgctgggattacaggtgtgagccactgcgccctgcctgtaattagatcttctaaagttacattattatttatatgaattttattatttattcatttatttttgagatagggactcattctctcacccaagctggagtgcactggcattatggcgactcactgccgtctcaacctcctgggctctagtgatcctcccacctcagcctctccagtggctgagagactacaggcatgtgccacgcccggctaatttttgtgtactttttttgtagagatggggttttaccatgttgcccaggctggtctcaaacttctgggccgaaatgatctgcccacctcggcttcccaaagttttgggattacaggcgtgagccacctcgcccagccaattttgtttatcttaattaaaaaatagaaatgcttcaaatagtcactataggtgaaaacaaaggaagaaaaaggagaagaaaagaaagaaggataaagacaaagaaagagaaaagaaagagaggaagggaggaagggagggagggagggaaaggaagaaaataggccagactcagtggctcacccttgtaatgccaacactttgggagaccatggtgggaaaattgcctgaggccagaagttacagaccagcctgcacagcatagtgagaccccatctctacaaaaaaattaaaaactagctgggctggtggcacatgcctgtagcctgtagtcctagctactcatgaagctgagacaggaggatcacataaacccaggagtttgagaccgcagtgagctatgatcacaccaccacactccagcctagatggaagaggaagactgtctctttaaaaaaaaaaaaaaaaaaaaaaaggagggaagaaggaaggaaaaattatcgcttcttttttatctatagttctcaagctaaaatacataccttctttttttttttttttgagaaggagtcttgctctgtcgcccaggctggagtgcaatggcgccatctcagctcactgcaagctctgcctcctgagttcacgccattctcctgcctcagcctcctgagtagctgggactacaggtgcctgccaccatgcccagctaattttttttgtatttttagttgacacggggtttcaccgtgttagccaggatggtctcgatctcctgacctcatgatccgctcaccttggcctcccaaagtgctaaaatacgtacttttaaaaaatgcccaggcttacccaagaccaattaagtcagagtctcttcaggttgggcctctctctctctctctccctccctccctctgtgtgtgtgtgtgtgtgtgtgtgtgtgtgtgtgtgtgtgaagtaagctcccccaggaaattctactgtgcatcagagctgagaactgctgttctaggggaagtaccaaaagtgaagttcataggttcatagacttactttacctctgtatttgaaaagtcagactttcttctgtaatatcaaagacaacgaacccaggtcaattattgtagtagagaaagtcataagggggaaaattattttttccattggctgactaaggattctagtgaaaacagctaatttaattgagaaaagacatttcctaagtgaagtgatatatgcattattatgactcaggatactcagataattaagcagtaacacttttgttgacatttaactacattaagaagaaaacttgttgaaccagaaatgtcagtgggtgagggatttttaaaaaacgaacttgggcaggtattttcttcataaaactctctctctcaggaaaaaattttcaatttatttggccctatttataaacatgtttgattctatcaccaccctcaggccaacaaagcaggaaaaaaatgttagaattctgtacaaaggtcaagaagacctttaaatcagcaatttgaaaacacaagcttgcaaaatataatatttgaagttgttctttgggaatgtataagtaatatgggtttgaaatgaaaattagagcaagagaggcagtcacggatatgcgttgtcatgtctctgttttaatgtccatattaatgtgaaatatcatattcaaataactcaatagaccctcagtagatttctcataacaaatctttgcagcagttctaatgttctaaatctggtttaccaatgacaggtttaaaagatgatttaaaaaaaaaaccaaatgggatataatttccaggagaagtgtttcatttgttgggtcttgacttatcctgcatagagtaagaagatcatgtgataactttgtgttttaaagggttgttactgagatgatagatttactctctgaaatagaaacattactgttataaggctatgctgttggctgcaagaaacacgtttgcttggatagaaatggcctttgttacttctctaaatgtgtgctctgttggcggaagaaggcattttgaaaggcagtccgtgtcttgaagagttgtttttaaaagagtgtcaggctacactggacagatgaacattgattctggagatgctatggcttgagaaaaatgcatgcaaatggtagctaccagcagaagaaacagttctgaagggcaaggctagtgttttggtttgggaaggcatgttaggtgttgtttgtgatatgtcacaagggactctggctatgtgttctgtgatgtctcctccccactcagaaccctccactggtttcccatctcactaggtgtgaaaggcaaagtcctcacaggccctacaagatctgcctaccacatcatgcatgcgtgtgcacacacactgcccactgctcctaccacagctccctccgctctctctatttctctatcctccagccgctcctgccttcccagaatgcaccaagtacaagcccatctcagagtctttgctctttcctttccccctgcacctctcttctttttacctgggtttatttgtctccatagcctttatcacctttggacattctgttctatttacttgtgtttttgttagtatctgtctgtcttcactagaagttaagcaccatgaaagctgcagccttcctagttttgttcactgtcatattcctagcacctcaaagggtttctggcacataataaatgtttaattaatatttgctgaaaaataaaagacttttcatcctactctttattataattcattcctatgggattcaatggactctggtctcactttaggtctaaactcttatccaaggaaacatcattagattcaacatcaatatagagtaagtgtctaaatataggtagctcaaggccaagtgtgtgttgtccagtccacctatataattttattcatcctctgtgtcccttctcccacacacattgagccacagtgggcagagggtcctttgaggatggagaccttgatcttctcccgcttcaggagcttctgtcctcccctggacaaagatggggctctgccttgtgccctcagaatgtcagtgtgtgccagccccagtgagtcatttaacacgatgacactatttacagactcattggcactattggtgacaggacccttcagcactgatgcttagatcagcaaggactaggcagtgataggaagggccagccttgggcttaaggaaaacaagatacctcttcctacaccctgtggaaaagattcctgaaggaccactggtgtggctgcttgttgagctccagagccataagaggggtaattaggtgattagcagtcattgacacttttcttggagcgagttttcagtctttctttagaagagattggggagaaaagggggattcgatgcaggagaatgtgtggatcaaagcccaacctaaccagtttcctattgcgcctgggcccagcacaagagcaggtggaatgctgggagcctgccctatcccagcagcaccagctctgccatgttctcccagtgcaaggcagcacagagcagcaactgacagcctcagctttgtagtcagatgggctctggttcaaatcctggctttgtcaattcctagctgtgtgaccgtcatcaaggtacctaaattctctgtgttccatcactgtaaaatgagaataatacccaccacacatgattgttataaggattaagtaataccacttatgacaagcagttactgtagttcctggcatataaaaaggtcacaataaatggcaactcccagaatcagacaagacctggatcatcctttatgaatactagagagatttatggaatgaatcatgattcttcttgctagattctctaagttgttatccaaataactttgggaagctaacagctaaaccagggttctttgctctattttctttcctgtgtgtgtgtgtgtgtgtgtgtgtgtgcatgcacgcacgcatgtgcactagagagagaaagggagagagtgctgtataccaggactgacacaggagatatttttttaaaatcacatactttgccctgatatgccatggaaactaacaattgctatcctgggtatattacaagaacttctctctatttttttatatttgctttggaataaatatttgataaaacgagggcaattttcatagcaacttttcttgaagctttttaaaatgtaattaagcattttaaaatctatcagatatattcagaacatttcccaaattgttttcttaaagatcaattttgttcagatactttaggttctggggaaaagctattttctgtccactttgacacaaaaacattccttctagttttttaagaacacagtactttgttgagatgttggcttcttggtttatggcatgaattctaatcacttttaaacttctaacttttattctacacttagagttcaagcaaaatgacaatgatcaagtttataaaatataaaacttctatatgaaaagcgagaaaaaatcagttgtttccaagattatgttaacattaataattaaaaccaattgaagatttattttgtgctaggcactgttctaagcactttacattgttagttcctttcaccctcacacgctattttgaagaagatactgttaccctccacattttatgacacactgaagtgcatgtgggttaattaacttacacaaaatcatgcacttggtatagtccacagtctgaatatattgccctctacaaatataatagtgaactttattattcgtagaaaagaatactgaggtggaaagatccccaaagatttgccaaagatgcatagctataaggtcagagtaaggacttgaacttagtaacatctgaatccaaagtttgggctcttcatatatacatatacaactatttttccacattcggacaaactatcagaataacttacataaatgttttatcaaatgttccttcttagagaatctgagggaacattagaagtcctcttgtctaatgaatattttctagaggagacatgaccagtgaacttattattttctagagcggacttgaccaatggccacctagcttttgcttccatccatctgcccaggaacacagatgatccatccaggaacacagatggttcattactgaatcaccctgctggttgggaattttcttatattgaggtgctgtgctgtgacctaattttatatttttcgtaatttgtagggtaaatattgccgtgcttaggagccttggtactaacctggcattacactgaatcatgtatcttcaggaaaatagagttagaaggcactgtacaacaacatcctacagccagccaatcaggaggcttggaaatcttaggtaaaagatgtcctggccattcttggcttattttacagacatgaactcatctcacttctaatcacacagggagcatctgaacagaactgaggcccttggttgaactctagtcctgcagacatcgtatcaacaggcaaaaaagaatatttagactaaatttgcaaatcaaatgcaataacagagagattctcaaactggaagaagctgatatagtcacaagtttttacacttttttgttttgttttgtttttaatgagcatttattgggtagttatttgagaaacaatatagctccataaaaagccataggctttggagtaagcatccctcagctcatttggagctaggtatcctgggcaattagcaacctctctaagatttgattgcctcttttctataaataggagtaatattacatattatgggtaataatgggactactgtgatgattttgtaacataatgtgtataaagtatttaacatgctcatcgatacatagttactactcagtccatggtggttattaatcattcacttaatcaaaaaataaaatttattgagttcttatatagtagaaccatgcattcaagctacatgccccaggcactgtgggtacagtgctaaaaaggcagagacagcccctaacttctcagaacctgcagtctagctgggaaaaccaatactgagtgagtaataaaacaaagaacaagttatgagagggagaagcataaaagagtgtgcagatgcataactctgaggttaaggaaggggcccctacagaagattgtgaaccctgaggacagagtcagcaacagaggtggagataggtgtacagcatgtcccaggccaaggagcaatgcgtgcaaggccaagaagtgagacagcaggaatgtactgggaaagaaaaatcaccaaagtgccagagaggtggacagaggggtggactgagacgggcaccaaatcataaaagactttgtatgagtataagccatactaaagagtttgttttgggttttatcctaaaatcaatgggaagccattgaaaaagctgttattaggttggggggttggcaacataatcatatttggcttcagtataatagagatgagtaagacacagtcccttgtcatcgaaacaatataatctcatggcggcagaagttgaaggggtcacagttaaagaaggctcaggaacaaaaaatgttcttaggtacaaaattctaggtgaaatttttaaaaagggagtgaccacatctctgtgatgtgacatttgaaacagatgttaaaaatggactgggcaccctttggataaggagagctgctggtgggaaggggcgctgcctcctggatatcctgtctaagaggtaaaattagcaggcatactcttaaagtgctcccagctttgttaactggattctacatttcccttccttccaccactccatatttcagaatccctttgagagaaaactctgccacccttattgtagcccctaaaatccacattctgtaaattgtaaatcattaccatgtgtatttccctcctccactgttacaaggttatttccagctggatgcctatgtaagcttatagctttgcagagcacttcctatacaccccctccagctgtgaactttttacctgcacttcactgcagtgtctacatgcttattgagaagttaaaacagtacaggaaatactacatcatctcactggcattaccagttaaatctcctaatgtctgggcaatatgaggttgaggcacttattataaatgccacatcacagttgtagtaattttctgtttcctttgagtcactccatgtaacacaaaccaaggcaaaaaaaaagtaccatactccaaccttccctttcaacttattttatcttaattgattaaatttatcagaaaagactactaaagtggtagaatgttttaagatgattaaaatcatcattttttctttaaaatatgcacttttttctataaataatgcttaaagtggaactcgtctctcatagtatgatagtttcgcattttgctatgtggtttatattcagtgaaatgtctatgctgaacaaagctttcacgttaaacatctgattcaccttacttggaatgtatatctatgaggtgtattaagagtaagcaggataaatttaagatactttcccctaacagaaagaaaaattaagatattaaaaaaaaaggaaaagaagaagggaagaagaaaaaggaggaaagaaaaggaaaaaggaaagttttgtttgaaatggaaatttcttatctgaaaaaattacttttgaaattctgaattacgggttgttatgccttttatctaggaggaaagtggcctgtcttgtaggatttgtggatcttctgctctttattcatgtcatgacattctgatgtcaaaaatgggctggtagtaggcacctatattccaaggaagcaattctgatttctggtttctctctattttaacaattgatgcacttaacagggaaccgtatttatcttctcaaatttattttcacctttatattttcctctcctgagacattgttcagaaaaaggaacctgcattgcatggctttcctgcctccagctcatttcaaacagcattcagtcaccttcagatgcacacactgtcatgtgaacttctgtccttcacccaactgttgaaattgcaccatctctgcatccagaaaagccagaggggaagaataatccaagcagactacttctggtaatcaaaagaataactgtcattttgcttaagacaaattcacaggatttctaaatgaatcccttatgtgaatattttcttgggaattcgacaacctgcagagaagttccttaaggagaaatcatagaacaaacaattattgttcccgatcatcagatacacaggagcacagctgcccttcattttgctttctttcatgtatgtgtctgtttatatttcagagccagaataacttggggattaagaaagctcgttctaggtccactttctcatcagacccagagatcactaaacctcttgagttctcagtctctctttctatgacatggaagaatgcttctttagactggcctcatgaaaaacaagttatgtttttaaaaaaacagaattatattatccattgagctactgctttgttacagtattaaaaggaagaactcttagatctcagccacaagactaccatctaataaactaaaacttggcagtgattttaaagaggtgattttattgccaaagaaccctaattttctcccagggagtagtagcattgaaatggcactttggtctccaaaaagaaggcctcagctttaacgaattgcagcacatttgtactcacagaagtgtgctaccgtgcaattttcacttaaattcccactttcttctcattaggtcttttcatttagatctggggcctctgtgcatgcttcagtgtttctgttatatttgaaatgtcataaaatagatatgtgggtgattttgtactgggcgataacataaatagtgatcttttctggaaaaaaaaaaatagaacaaatggtctaacaagtccggatccacgtatagagacatagggacaaaaaattgtaaattgaggaagtcattttaaataacacaagaataggttccaaatcaattgaatcctgtttggtatattagaaacatcactggtttactgtactgtaaaatttactagtttttctgaaaagcttaactgcatgttttgtctacttaaaatggtgccagaaaatttaatcatacatttctttagttattgcatttataaccttacaaaacgattttcaacttgaacacataaagttcttgcctcactttaccataacagcttctaccacatgaagctcttattccttcatgcctttgtgctgttccctggacctgaagtactcttcctcttccctcttggctttattcaaccaactagacccactagcttattgaacatcttcgccttcagcagagataaatgttaggatcccccagcaccttttagcatatttctcttttagcacttaacacattgatctagtggtttacttacaatcctacatctcccttggggctgtcagatgctcaagggcaaggaccacttttcttccatccttaagtacttcgtgactaggaaaatgtctatcccatgaccagttcccaataaacatttttgaaatgcaggttgagtatccctaatccaaaaatccaaaattcaaaatgcttcaagatctcaaactttttgagtgccgacatgatgttcaaaggaaatgctcattggagcattttggttttcagatttttggattaggatgctgaactggtaagaataatgcaaatattccaaaatcctccccacccccaaaaaagagaaatttgaatcacctctggtccctagtatttcagataagggatactcaacttgtacacgaaataggatagttttattcacttctatgtttattacataacattgacttctttctgttttcctcaaccttacaatttatcataaaccatgcacagagaacaagaaagtaggggttttaaaaatctgactcaaagtctgcaaatggacaaggaatgagctacaatccagattgattttttaaactattgctttttatctactcacctatggccatgcagctcttattttataacctagtgctattatgaagtataaatttaaagtgatcatgaaattctatcatccatttaagtcatagttttgcagaattaccatcttatgcatgtaaatatttgtgacaaagagaaccaagctaagagtccaaggtaccttcttactaacttaccctaggtaaattgcctaaactctctgtgcctcaggttcctcttttattttttattgctattatcatttttgatatagagtctcactctcttacctaggctggagtgcagtggcacgatctctgcccactgcaacctccacctcccgggttcaagcaattctcgtgcctcagcctcccaagtagctgggattataggtgtgcaccaccatgcctagctaatttttgtatttttagtagagacagggttttaccatgttggccaggctggaagttcctcctttaaaataagatagtagcactctcagagatgtaggaaatcctattatagagaagggcttggcataggacttggcagtaggttgcactgtaagtagaagctgggattgttggactataactcatggaacaggaaatattctggcaggcagatgggcagaattctgatggctcctacaacaggaatagaaagaactgggttccatttaaacaaggtacctcaaagaggcaatctcgctcttgtttaaaactgcctgggccggacgtgatggctcatgcctgtaatcccagcactttgggaggctgaggtgggtggatcatgaggtcaggagttcgagaccagcctggccaatatggtgaaacctccatctctactaaaaatacaaaaattagccaggcatggtggcgcatgcccgtagtcccagttactcaggagactgaggcaggagaatcacttgaactcgagaggcagatgttgcagtgagccaagatcgggccactgcactccagcctgggcaacggggtgcgactccatctcaaaagaaacaaaacaagcaaaacaaaacaaacaaacaaacaaaaactgcttggacttggatggcctcatcattgcctccttttctggggataagatgaaaggctccaatcaggctgactggcactggccagcttgccagaaggcatggtatccccagccctctctacattattctaagtttggaagtagtcagaagaaaatagtatggaattttggtccccaaatctactcattaaaaccatgtggatactctacttcacacccttacttgaggccttcctggctctgacacagatttaagacctaacttttagtgaattttctgattcctggtcctgcaaattagaagagttcatgaaaggactgctggaaggaagcacaacttgcagtgaaaagtgataactgctcgatattaaaagagaaacccggaaagttctatacaaaacaatatccctgtccactatgatagtggattttccttaaagatcactctcagttgtgtaaaatgaaaaagattaaattgtgtttggtatattttgtttccaaaggcagagaagtatgaaatgcactttaaggaagatttctgttcagaagttttggtttcagtggtctacagagtttacttttgtggaacacctcgttctctgccaaagccaaatagatgaagtgttgctgtatttagaaaataaggaaagtgaaacatttgtcgtaataatgtgaatctttttaaaataattgttaagaaaaactataaaactggcatactttttaaaaagattattcaggagcaaactcagctctattaggagctttttgaggaacaatactattttattttggttaccaggtctagattaggactcgacactctgaggttgtttgtttttggatggagaaatggatagatgcctggatgtatgaatgaatagatggatagataaatggacagacattgaagagatggagggatggataaatgacgttattttggcttaagttgcatttaggagaagttaaaaggatgtgagagaggcatgcaggggatatcaactccaaatcaggaacgaaatggcttctagagagctcacttcaaagagaataaatttgagagtcagagaaacagaaaggatgcacagcagtagtgagatcctggcatccatggcactcatggatgtataactgattctagtgtgtaagtcataaacaaaaaagaaaaccccaagttcttgtcctacttctgctactgtagatctgggtgatttgggggcaaaccttttatacttctcgggctgcatttctttaatcagcaaactcagaaggtgaaactagatcattgaaagtctacactactgatgtagatcaatacaccaaacaacaaatttcatttcaaggacattggtattcttagaatacaattaacatcctcttgcctttgtctaaagcacttactttgcagtcaaaatggcttgtccacattattattttttgaatgaaaagatttgtgcctcccacacgtagggcttggtgtattgtgaatggtagcctacacatacgcaaatgagaactgggaagataattaaatctgaggtggaaatagagtagacttgtgaatgaacaaagaaagtgtatttctctggaagccaagatgtcaaaggtacattttattgatactgtatactctcagcttccatgtaaatcagtattctcatgcttcaaatgttctaaccttgcatttctgaagaatctattgtgtatattaacagcggctgtggcaggagatgtcaggcatttttaaattccagatttaaagagattcatgaatgtgcatgatgctacacataaagaattgaatggtcaaatgcactttattttgagctaaaagttagaacaaaagagattcatgtcaaagactttggattcccaacctgggcttttttttttttttttttcctcagaaaatagccataaaactaaaagagagaacatgtgacccaaaggattctaaaatgcttcagaattttagaatcctttccaatggctcagtttgggcaaactagctccagaccccaccactatccaagctccaccatcctttcttatgactcacactcacaaatgagtgctaagagcctgccctgtgggggcagggatgccctgttagaacaaacatgagctgaaggtgaacccaaaagtaatttggttccatcctttatattacatagatgaaaaccgccttccagggaggtgaagtgattcacaaagtaacacagcaagtcacacaagtcttttgatttctaacccattgcttttgtcatggccacattgatccctgacaaataatataaaacaaggaaaccagacccttttaaaaaaaaggttataatgctattactttttttcaaatgagccattttttaccttttcactttgttgcttttgtcttgtcagcttcttgtagaaagatgacttagtacatgaaaattcaacttggcattttctttagacaaagtgatcttttaaatgtagccaacatttcttttggagtatgactccatttcacataacacagcctaagattgatgtttactaagttggttgttcaaatcatgttcggcgcttggttacatgggctgtttctttgtctctgtctctccctctctctcctttttctttgtgcttgacacaaaaggatgggggccccaggatcatctggaaatggatcagtgtattcatgtgtgagctttacaaagcactggagcaaaggtgtcattaaacgttagaagtcattcaatcacacccatcttttcatacaaagtatagagagaaaaggctctgtatggtaactatgcataaagctttgtgtattcatttaccctcacttcttggagtagctggctcttttttttcccccctgcctctttcctctcttagaggaggtttgagattagctttgcttgtctaaatctgccattaatactaagctcttgtgtagtgctgaaagcaattaaagtaatagatttttaaagagagcttgtgggtttaattctgattatgtttcctttcaaattattgaggttttcttaggcgtccatggtagtgccatgggcatggcaagagagaagtatgactcttaccaagaaaaagggaatgaatggtctacccttaattatatttccagcaaccttttctaggtactaaatgtagaagtcaattaagggaggtttcaatgtatcagtatcctgtttgtcctgaaatgtaaatggaagttaggagagttttgaagcagatgccatctgctggatagctaagatactgtaaccaaaataatgtgaacagaaaacatatggaacagtagatctaaatgaatggactgattgctaatttaagtaaatactacttcccaggccccaggtagagtgaaatctccctactatactgtctacaatagaaatatttaaaatttatttttttctaatctgaataaagaaatcccttcctgttcatgtgtaatgcagatcctcaaactctttatttagtttgccatcataagaacaaacagaatcagtgcacatcttctgagaaatgataactgcaaaaatgcctttggaagcccccaaaattaaaaccagaagtaatataacaaaatggggaagggttaatatggttatatgggaacaaagggtaagtatatcaaattaaaaccatatgtaagacaaatacaggctaaatagttaattctttttttctctctctctgagggacccttttaaatagaattggtcctacttaacaccgtcacactcccacactgctccctcattggaagaacccatggataaaggaacccctccttaaactgtccaacctcccttagaaattgtttattacagtcatgttctgtataactgctgttgttacaggatcgcagtctggcctccttctctaactatcagaacaggttgtttcacatttttgaaacccattttcctcatttgttaaatatcactcagtgaattttactgtcctagtgagctatttaaaaagttaaggcacaaattaatagtatatccataaacagcattcccctaaaatatccccgtctagagttactacttagaatcaggacactgacaagttagtctgtgaaaagaatggcatttctccacatgtagaaaaatgtcctaagaaataagaacctttaaaattccaatctgcacctggctaagaactcctctggggattttgcagagaggaatgggcaagggacccatgcatagtaatacatgtaagtaagattgttcatttttttttctcccaatggaatataaaacagtaaaacaaactccatatatttcttacatgaagagctctcaaaatggcggcacccaagttgtcagctccatttccatttctgagtcacagatacacatatatggctgaaaggagggaaggagcagacaaaataccaaacagatgaagagagaaaggaaagatgttcccaaacatgttaactgtttgcccacatgacttattggtatgttaatgtctcacatcagccaccgctaaggagaatgtcgccccttccttccctcttagtttataaatggagtcacattatgtaatcaccctaatgaggtaatagaaacataagtacacaggaaaatttgatagtgttttctcctaattcatcctctgttatgttggtcacccccccatcccattaaccctccttctctcttccagactggccccctccaaattggctgagtttcccgtcccaaaggacatattgttggctattgtttataataagtctctcccctcttggcaggatagagaacagctgctggtctattctctgccacaaagaccaacttccttcttttgccctggatgattggaagaaagtcggggagaagagcaatttatagttgtgttacagtacctctattttcttttgtgtttatttatattgcttccatttctgtcagggatttctgagataatcaagatcattctgctacagagttttcatttgagtaggctctagtggcagttggcatttttcttcattgagtcagacattttaggactccaggctagaggaagtagtgaacatttctctatgagagtttgagaatcaatattcctttttctaaaaaaatgaactcatgaatgtattctgtgttacatgaacaattaatgactttgaatttctcaagggaagacaccttgtctttgccaactttctgttccccaaacttagtacagtacctgcttcataatgtttgccagatgaagtaagtggagtgctgaatggagttctggtttgttctgtgaaatgtaagctatgctgacagtccagcacttaagtctcaccctagacttcaggccaggcaaggctcatcacctgaggtgggaccttcttctgagatctttgccttagatcgtttctggctctaggcttcattctaggcaaagaagccagggaactcaatgtttcagaatctaacccccagcaaaagaaacctagactaggtactgaatcttcagagagacttgagcagctctggaagcagaatgtggagagcatttctctgttctttgttaggagcagaaggaaactcacaaaatggaaaattggtctaagactctatacacaggaaagatccaaatggcattgacacagggcatcaatgtgatatcagacaagacagctctggtggataaaaaggaaccacagcctatcattaaggtttctcctgagaagtgtttggaactaaggttggctgatggtgaaggccatgtttactaaaaactgggcagaagcagagtggtgtcgttaagtccaaggagtgtgacaaagaggagagtggctcctgactctcttacttatttctgtatgaacttagcttgataagcattaataatagcaaattttctctgtagtcaaaacagtcccctttctggggagtaagaactggagacctgacaatttccatgtggtagatgcctcatggtaagggttcttaatgcattttcaaatttcctagtatgtgttcctaaatgtatcatatggatattgattaatatggctccctgtactttctgtagtcactaccttggttcacccaacaagcacttaacaaatatgttcctgacagacatgcaaagaatgtatatgactgaaaataatactaggtgctaaagccactgagaggtctgactttctgatagtttgtagcattttgcaagcaatacaggaagaaagaataataatagctatgacttatagagtgtttaagacatgacaggtacagttgtggtcactttacatgcattgtttcatttcatctcatagtctagtttctaaacggaatccttgaagacatacaatgccacaatgctcacttctgcctaattgtgagccaggcccttcagaactggacaaggaagctggtcaagttgggtcagagagtagtttaagccatctctggagacagggaggcataaaactgatagacaattaaatccaggtaaagtttgccctttttctgctctttgcctatctccctggttctcctgatgcctcctgaatggttgcttgttaacgcaaattaattttaactggtgggctttcaggcatttgaggagatgggaaagtggaggcagaagaccctgcatagaaaactgttgaatgaagtccttgatgtgaacctctatttagttgcacatcacactaaataacacactagttgagggcatgagatctagaatcagactgcctgagctcagatgccatgctaggggtgtgaccttgaggcagcttctgcatgcctcaaatttattgtctataaaatgtgtagaataatacacattagtattattagtaggtagaataatacatacttcacagaattcttattaaggattaaatgaaagggtcaaactaaagattaaatgtaaagggtttaacaaagtatctggtatttaataaatattggatattagtattactggtattactaatgatcaatatatacctcttttccttccatagaatgtgaggactaattgagagaaaggaccttgaatatatgttttatctgccacaattcttaccacattgtagattctaaataaatattggacggatggatggttggatagatggatggatgaattaattttaagtttctatagataaaggcactacagaagacctccttgttttcagatctcttccagaaagtcatgcctcacagattatccaaaggaaatgacactaaaccaacatgcaacagccagcagggggatttcttaggctcagctagacatttagactcctaagactatcacacatcacatttgacatcagtctgcccagaagaatataggatcagaactatagcttgccagtaggccagcatcaggtattcttctgcaattagagccatggaagctcgggtgccaaatgatgagatccacactgggcaggtgaaggaattgcctttacttaagagccttatttcccataggagtcagtaactcttgtaacaactccatagacatagtttgcaaggtcctctccagagacatgctagttacaagaactgctgcattcagggaagtccaaagcatagccagcaggtatttgcagttcatttatagttcctcccagtccagatgcactctaccaatgaggggtcatttttaccatatgcaatgttgcctagtaacatagttgacacataccatctttatctgtttccagggaaaccaagttaagaagttaaccaaaggtcagattctcatgcaaaaaggaaaagagtttttgttaactctttgcctgcaccatccaaatagttatttactacatagcctgaaaaacccatccaatgtccctgtgaaggattcattcttacatctcatatatgccacaaatatgtcccagagtggaataatacaggcatggccatatttgccagtcggtgtcctcccttcaacaaccaagagtcaagcccagtgatctttcaccctatgcctgcccttcacatcagcccctaccgacagtcccattcttcagaactcaagtgtagttgactctctcacacatacactcacttgtataaatacccagggatgtcagtttccttagatctgtatgatcttaatagattattaaataggtccaggagccacaccggtaaggatcttttgagttttacccttccttactgggttgttttgagggtaaaatggaataaaatgagatcagagaggtaaaaagttgaaaggaccatggtaaaaatctatggtagctttactgttcggaaagaacgtgagtgaattccaacacggttggatggggtttgatctacttaagtgagtagctcagagaagtcgtgacttccctgatttaaattattaatgataataaacatctttaagtaattagggaaatttttgaccagtgagaaccactaaactcccaagtcattccacattaatgaggtgttagagatttcaattagcacacacttgaattagtaaaaggattaagtactccatttattcttctgcctggatgataatagtagtttctgtttattaaattcttactgtataccagggactgtgcaaaatgctttacttacagcctcttgattagtcaccaagtattattggccttacttcttagcaaaaaccaaagctcagagagattacaacacttgcccacggtcgctcagctatacatagtggagccaagagtttagtcaggtttagtgttagtccaaatcctatgtcctgtgttcagtgatatcttcatggagatgctttataaactatgcattatttctattaagccaatctataaacacactgggaacagattccatgtttcctttaaaaattacttttaccttctttgtcaaaaaaagaaaagggactttattgaaatggaaagaaagttaaatttggatgaaaatatatgtgagacaaagggaaatcttcattttatgtaaatttctctactttatattattacctattctaaaatggagttgataatacaaatgattttaaaaggacacaaagtacaaagaggagtaaagaaaaatagagcatagtatgccagttctgaagtcaccaccctgcagctcatcttgtccaagtccttttaaaggaaatagtaattacaactcattatctaccttgaagacctgctaagtaacatgagaacaggttccaaatcaatagaattctatttgagatattagaagcatcactggttcattatagtggaaagtttaatagctcttccaaaaaattttcagctacatgttttgtctgcttataatgtacttgaacacatattcctgccaagaagaaaaattaaactaaattcttccactatggctagcacttttctactttgttctgattaattcatagatctgtgcaacgaaagaatttgcaattggcaagcaaaattctaaattaggcagtttaattgtcaagtaaattttaaaacttgcatgaaggatggaaaaaatatagaaatgtcgacatgttggcatttggaaaccataaatgggtattttcttgtaggtcatgccaatctaagagaaggaaaaaaaaagaaagactttggttctgtcagatagaataacagtttctttaggaaactttaaaaatctatttcatcatatattcttccaatgaaggtaaatttaatgaaattttatactttatttccttgaactcctcttaagacattttcttagaaaatagccacataaatttaattacctatatgtgttaaaaattttaatttaaaatcattttctttctgcctaaattacagtgcaaaaaattagttgtataaaaaaattcagagtggattttattggcatgatttcatcctcctaaactttatttatttgggacatcaaataaacattgggaatgaacatttatggatttactttgttttctttgatcatgtaattttatactacattttgattcttataaattcttatttcttgatccagatttcattgttttccattaacttgctcacctattaaattaagttagaataatgttaactgcagtgtatgggggtgtcagcaaccttttaaaagtggtgcacctttttatgacacctgatctgaagtgctgaggtaactagagtgggtactggctgtccaaacagagcatggaggatggagatagcacagagtgggtatgaaccctaaaacgtcttggcttctcaaactaccccacctaccacctccatattttctactgtagtctagaaggattagactcattcctcattcataacttaacaagacttgttttttgttgttttttctttctctctctcttttttcttttttttttttttttttttttttgaggcagagtcttgcctgtcgcccaggctggagtgcagtggcatgatcttggctcactgcaacctccgcctcctgggttcaaacgattctcctgcctcagactcccgagtagctgggattacaggtgcccaccaccaccatgcccagctaatttttgtatttttagtagagacagggtttcaccatcttggccaggctggtctcgagctcgtgacttcgtgatctacctgcctcggcctttcaacgtgctgggattacaggcatgagccaccgcgcccggccaacaagcctagttttaactacattttttttctaatacttgatggagattatcagaaggggtgaaaagaagaaagaggtaatcagtctcttttggatgcttactacatgccaagagatggacaaggcattttatttaagttttctgtatataaatttccaatgaatcctcaaagcatacctgtaaagtaaattttattaaccccacttaaagaagaggatactgaagcttagagaattcagtaatttgcccaaggttttttattataaaatgacagaacaaggatttgagataaaactgcttggagtttgggttgggaggtgagttagttgagcaacaagaaagtgaaaggaaatttagaataggggcatttgaagggaaagcactcatttattcattgaacaactatttaattagctattaagtgccagccctatgccaggcactaggggaagcaggagtaaacaacatctatgtggacactatactcctgtcagttggaaactgagtggccaggaacaacacaagcaaacttagacatgtaaaaagaagatagaaggtaccaaaggcaaaattttgtttctgtctatttattgatagcctcaacttaaaaatacagtcttctcattgtaaggtcctgatctagtcttgggctaagctcttactcaagagtcaattctaacaaacttattgttggaaagtagggactatgattctgccaactaaacattttgagagagctttagtgtaggcctctgaaggaaagcctctgtcaacttcctgggtgatctggagggcacaggttttggaggtgatacctagattccatttctccaccatatcttttcctaaacagactctgacacttagaagatactttacaaataatttggggaggaaggaagggagagagagaaggagagagggtggaaagagaaggaaaggaaggaaaaaatcttcctgggcctttgctctgtttctacctgtcctcctcagggccttctgatgtaagcagagttcacctgttcaaatccaggggctagaattgtcctgtgtattcagaatgtcccaagttgctcagagctgctatcatctaagtctatttggtataggtattacctttaatttgaaggtaactcgtatcttacagtatctgaggtaaaaagaaaagcattagtctgacagaggtagtctaccattcatagttttgaaactagaacattttgctgacaaagagaaatgtatttttaagcctgagttcttaaaagaaaaaaaaaaccaacaacaaaaaaaacccttccatcctagtcctttagctgggctatttctgccagctccccggctatgaacacaacacattcttgcaattcatcacgtctcttggctcgagcctgcctttaaaatggttggcggcatatgcttctcattagctctgcttctacctcacctgcgctggtcagaatcctccctcctgccccctgcctgctcccctctctcctcctcccccaactcagacgcatactcctgccagtttctcttaccaagcagcgctgcctgctggcatggcaggaggcaagtgaaggagaaggagaaagaaatcgttcacttctttcaaaagtaaattctgtgggttagcagcctttcgttcagaaataagacctaacaaaacagaaggccaagggcaaaaccaaaaacaataacaggaatgggggaaaaaaaaaaaaaaaacagaagtgtgctgactgggagaaaaataaagaggggcagcaaaaggttacgagggaaaaaaaatcccattattacatcactttggcaatcaaatgtttcctgaggtcaccagtttgtctcgatttatcttctaggctctacaaggaagtttcatccacttggagggtattctctgtttaactcagttatctgagtgacaaaatattccttttatttggtgaattgttttctctgtgacctgttcttaaattaagaattaaattgaaccaaagaattttggttcagcccaaacgttactttctatacacaccaatttttctttctgattgttgttttgttttgttgaaactggttttgaatggcaagaaaggactattgaaggggtaaaggacttaatctttgatggcattaggagagaatcatagacatctgaggtttggggagatctcagacattcccaaatctgtaacattaatctcacagatgaggaaactgaggctgagaggtgaactcccctctgccacacaaaaaggaagtggcaggactagggttcacccaggtcttcttagcctcagttcttttctgattccgtaatatgcaggcaccatactctctcacagcagataaagaatggctttttgttctagctccaacagttaatatagaacttgatgaacaaaaatgactttgctcagtacgggtgaccagggacatccatatgacctaaatcaccagatacaggaaaacctttgagcaaattagaaaaaggctgctcttccttagggcctatccaccaccaccacccccatctccacccacccaccctgggtgcaaggcttggtgaagtgcaggatggatatatttcagtcttaacttgctttttcaaccaagtgctcttgtgtaggcaaaacctccatgagtgtatctgcagtggtcctgtcctaagagtgtgcatgatcaagagactcacactaagtgcaggcatatcctgattcacgaaagtcatcctgatacttttatctggaacaagagccctttcattacaatggatgaagacaaaaatacctcatcttcaaggagttgaatgacttagtttttcgtcaacaactttcatttccaaataggtgagacagattcatctctgaacaaaattgtacagtcagaaaaacttgccaatggacctctttttctcttgattcacttcagcagctaatgcttgtatatcatcccagctacctgcatggttgctctttcctggcttgcagtcacaatcctttctaagatgttagctgatcatggcctcatgcattcattccaaatataattattgagcactccctctatgccaagattaaggtttctcctagggtatttgtgttttaataggaattcttaagcctagcacaatgcctgggacataatatatactcaataaccatatgaaaggagaggaagggagagaatggggggaattttatacccaaagaatggttgaatttgtgcagtaggcagggaagggaaaaactgggagcagagaacctttaccaccaccctacatgtcatgacaaataggttgtgtgtgttctgtcctatattctacaaaatacttaaggcatccatgcaaccatgtgaaaaactgctgctggcacctagagtccaccaccaaaacccttccaggcacgcctccctcttgcccagccagataccccagcacttctgagacccaagaattttcgggccctgttcttgttccacagcttggttcccattgtttatccagtcccttggttagcaacacagtcttggattcctaccttagcttgtaaccttcatacaaggtgtgatttccaggatttccctctggctttgtgtactccacacctgcctttgtctccatgggccataggccctgggccattactcacctgattgacatagatgattaccttcatctacttattttaagtccattatggaagttactaccagagttaccaccagcacttagggaaccctttctttgaatgcctctgttggaaggcattcttattttcttcttagtaggatagttactgtgtgtttttctaatcctttcaactgaaagttcctagaaagaaaacactgccccatagtcacctctgtggcaccattattgcttagtgcagtgcttcatgcagaataattgcctgcccaaaaaatattttgttatagttgaattattcaaccagacattctatcatccatttagtttttgttgttgttttaaccagaggaaatgaacagggatttctcatcgattctggtcttcctctgatgggaaaatttttatattaaatgcaaattactttaccatctgtgtgcagcataagttccagaatcctttccctttatatggggagaccaggtttccaccagtgaccattaaagtatatttggcagcccttgtagctctttctctgtagcccagatggcagagtttttttctcatttccatttgagaacttttataaggcttctttatgttgttccttcttttgaagtacttttctgttcctggacagggggattggaccttctgcctggacctccctgtctgtactctctagtcatagtgctgattctgggacaggaagcaaattttgctagttagaacccaaatccattagctaatgtgtctgatcttttgtgttcctgtttgtaaaatgatatcagtattagctgttggtccttccttccgttgatataaaagtaaagtaataatttagctgatctaagataaagatggtgttctttgtgtgttccctggagaacccagtactaaattaaaggtggtacccagacaagagaatgttaaggattcgccgggtggtggctcatgcctgtaatcccagcactttgggaggctaaggcgggaagatcacttgaggccaggagtttgagatcagcctggccaacatggtgaaaccccatctctactaaaaatacaaaaaattagccgggtgtggtggtacatgcctgtagtcctagctactcaggaggctgaagcaggagaattgcttgaacccagaagttggaggacgcagtgagcagaggtggcaccactgcactccagcctgggtgacagagctagactccgtcgcaaaaaaaaaaaaaaaaaagaacgttaacgattggttggtaacaagcatcatcttaacaaggacttcattgagctttgtgacattaggtaaataaggaagatggagaaaaggcttcatggggaacaggcctggcttaaagacgaaaaggtaggatgggagccaatggtgaaggactttggttttcaggctaaaggctttagactttatacggtagggagctaaattgggattttaaataaaagtgtgacatggttacgtatgggtttgagaagggtggctctgacctcagtggggaagaccacgggaggttactgcagtagtccctgagaaaaaagagaaggcagctgggcacactggctcacgcctgtaatccagcactttgggaggccgaggcaggtggatcatctgaggtcgggagctcgagaccagcctcaccaacatggagaaacctggtctctactaaaaatacaaaaatagcctggtatggatgggcatggtggctcacgcctgtaatcccagcactttcggagaggccaaggcaggtggatcacgaggtcaggagatcgagaccatcctggctaacacggtaaaacctcgtctctactaaaaatacaaaaaattagccaggcatggtggcgggcgcctgtagtcccagccactcgggaggctgaggcaggagaatggcctgaacccgggaggtggagcttgcagtgagccaagatcgtgccactgcactccagcctgggcaacagagcaagactctgtctcaaaaaaaaaaaaaaaaaaattagccgggcgtggtggcatatgcctgtaatcccagctactcaagaggctgaggcaggagaatcgcttgaacctgggaggcggaggttgctatgagccgagatgcgccattgcactccagcctgggcaacaaagtgaaactctgtcccccaaaaaaaagaaagaaaaaagagaagggctagatccaggcagacaatggaaactgggagaaaggacagatttaataggcatttcagaaaaaaaaaaaatcactcactccagctagtttggcttccttacaatttctcatacatcaggcacactcttgcctgatggaggttcctactgactgaaacgcaatggaacacacttcctccagatgaccatggatcacctccatagactcttcaagttttgcttgaataccaccttcttttttctttctttctttctttcccttcctccttccttcccttccttcccttccttcctttccttcctttccttctttctttctttttatggagtctcactctgttgcccaggctggctcactgtaacctccacctcctgggctcaagcaattctcctgcctcagcctcctgagtagctgggaccacaggcacccaccactatgcccggctaaattttttttttttttgtatttttagtagagagggggtttcactatgttggccaggctggtcttgaactcctgacctcaagtgatccacttgcctcagcctcccaaagtgctgggattactggtgtgagccaccacacctggccttgaatatcacctgtttaatgagccctgctgtaaccaacctacttgaaaatccatacccttaccaaaatccatgtgttcagaatgttcatagcagcaatatttaggatagccagcaactagaaaatacccaagtgcccatcagcaactggaagggtaaataaattgtggtataatcacatactggaacatactctacagcaatcacaatgaatgactgatctacaactacatgcaacaacgtggatgaatctcagaagcataatgttgaagagaaagaagcctgattaaaaatacataatatacaattccatttatataaataaaagtacaaaaacagtcagcactgagctttgctatttgaaaacagaataatagttatcttaggcagggtggttagttatgagaagtacacaggaggtttcttttgttttgtttttctttgagacaaagtctcactctgtcgcccagaagggagtgcagtggcacgatctcggctcactgcaacccccgcctcctgggttcaagcaattctcgtacctcagcctcctgggtagctaggattacaggcgcccaccaccatgcccagctaatttttgtatttttagtagagacgaggtttcaccatgttggtcaggctgttctcaaactcctgacctcaggtgatccacccgcctcggcctcccaaagtgctgggattacaggtgtgagccaccgtgcccagccaaggaggttttttagactgttggtaatgttttgttttttgttctccaagctagttacataaaggtcatatattgtgtgcaaactcagagttgtacattaatgatatgatacttttctgtgtgtgtattatactgcaatagaaagtttagaaaatgcaatttttaccccaacacttttcatctctgttactctatttttctgtaatgcttgccatcttctaatatgtactataattatgacatttattatattatttcctcattagatgtaagttctatgaatgccaggatttttatgtctgctttatctgtcaccttgaagtgtacctggcacataataaataatataatgaatgaacaaactattgaaccaggaaaacatgaatagaataggccaggctcagacatctaaagggaaccccggtttgaggacttgtgttgctttggaagtgtctcattcctgagtgcagcgaataggctgctagccccaggttgtgatgatctttttttttttttttttttgagacagagtcctgctctgtcactgtcgctcaggctggagtgcagtggcacgatctctgctcactgcaagcttcgcctcccgggttcacgccattctcctgcctcagcctcctgagtagctgggactacaggcacccgccactacgcccggctaatttttgtattttgagagacagggtttcaccgtgttagggtttcaccatgttagccaggatggtctcgatctcctgacctcgtgatccgcctgccttggcctcccaaagtgctgggattacaggcgtgagccaccgcgcccggccgatgatctcttttcctgcctgtctaaaggttactttttcaaggctacttctgggcctttaagctttctttcttatcctaaactatttattctatttgcgccatgtcagaaaccttcccatattcaatgcaaagctcaaatgtcatcttctccataaagcctttcttagcagcctcaacccaaattcctctagctcctcctatgttacttttatggaattcttttctgttccctcctctcctcttccctcctcccctctcccctctcctgtctcctctcctcccctctcccttatccccctcccctctcctgtctcctctctcctctcccctcccctcctctcctcctctctcccctctcttctctcttctctcacctctgtctcctcctctcccctcctctcctctttttctgagttggtcttgctctgtcactgaggctggagttcagtggtgcaatcatggctccctgaaacctcaacctcctaggctcaagtgatccttctgcttcagcctcccaagtagctgggactacaggcatacatcatcatgcctgactaattctttaaaaacatttttgtgtagacagggtctcactatgttgcctaagctggtctcaaactcctgggctcaagtgaacttggcctgccaaagtgctgggattacagatgtgtgccaccagtaattccgcctggcctagaattattttcattcatttatttattcattcattcatttgacaagtattattaagcacctactaaatgccacatactatactaagtgctgaagatacaaggttgaataaaacagttatgtctttgatagggctaggtttcaatagagtagatgaacaataagtatataaggaaatacataaaatcattttgggtactttgaaaaaaattaagcaaggtagagagttagagagtgatggaagtgctattttagataagttatgagggaagacttctctataggcaacactggagaagtgacccagataaagtaaggaccatgaggaggagcattccagttagaggaaacagcaaatacaaataccatgcagtaagagcaagcttggtatatgggtctcttgctgtgaattcctccagatagggcttaagtgcctagcacattgctttggatgagaaagttctaagcgattgaatagttgaaccagtttaaaacattgaatttattcaagatctagtcataatttttatctattttgcgtttttccttagatcaacatttcctaagatgtgttcagtagaagacattccaaattgatttacgcaaaatctagtttcaccacatacaccaaaatggttctgtggttaaatgagtataaggaacgatgaagatgtgtatgtcgatataatacaggtgttgctaagacccacagtaaaacaaacaagcaaacaaaaaaatgtctagtacattattttctaaccacaaccttcctttcccatagaacacacattactaatgcacaagacagtaaaattccatagaattcaatttggtggagcatgttcctcagattccttcattttatattaagtatatatttattaaattcttaatatttacctgctttcatattttacgagtaaaatatagatgccagaatattacaatgttattctaattatggcacaagaatgtggattttcaacattctctttagtacgttaatgtaatacctattttcacagccccaccctgcctaattttagcctatatctagtgatctttattagccaagccatctcttggggtattttgtcactgtcaggattgggagttaaaatatcaagaggcaagtttatgagccttgaagtaaacaaatagcagtcaaggaaacagaaacaaagcttagaatgcccagcgagagctcctggctggtgacacatccaggctctgtgggtgaattgcctttgaacacagctccctctgggagaaaagatccagccaattgctggttctaacctgtgtgtttttggtttcttcccctttgcacgtcctctctgaattggcctgttctatgttactggtgattgcctcaaaactcagaagtcatagtatcaatctaagcttctttgctcactgattggagacctctttaagtatttattagttttccatggtcaccagccagctggtgaatgcatgcttcagtaacagggctaaatttgcaaacagctgtcaaataaagttgaaactgtcttacaaccgtgtataagggtgtttgtctcgaaatgcatgtgtatatatcagagaaagagcaagagagagaacacctggacttttggacaatttagccaaagatcttgtagccactggtgatttttaaaaggagaaaagagcacttattcttattttattgtgggcacgtcatttagcattacaggtttaaaggcagcagggaaactgcaaagccagagttattttttttgttgttgttgtttttttattttttattttctgaggcattagttgctgtgaagaaaaacaagccaaagttttgcttgtgggcagaaacatcccagaatgcatctggtgactgggcagaaagcaagtactggcaagagcccaggtgcgttggctcccgacggcagtgcaggaacaacctaggcggtattctcagactccgatcaaatttccaagatggatccagttcaaaattatctactccgctttcacttatctaagatggtgctccaagtttaggattacagtcctctgagctgggagtggagactatagggagaaaacccactggtgtttttaaataccatgaaaggtgttttatcttgtttaagttagccgcagcacacctggaaattagaaatatactgtcattcctggggaattcaaggcagtaagaattattgggggttaacaattttcaggaatttggatcgccacatctcagccccggagttatttttacaatgggacttcttggttaaatctctaaatttaaatagataaggattcaacatattcttgaatcttgagatctagtttccctcatcatgggccaagtaggaaagaaagaagtgaaaccctcaaatcacaatgtatccctatttgccatcctatcgtgagctcctaaaatcttattttcacaccaagtgctttttcaccgtccactgcaactgtgattgtggtggtgaccagacctgttccaggggctctgagtcaggaatggtgatcatgtgttctttcccatcatattcctgcagagagtagtgctaaaagagtttaaaatgaatgaaagatccacctctcctagttgttagaggaaataaaactctctagagtgaacttaaagtgcccttctacccctacttaaaacctgagacataccatcttttttcttgggccctatacctatatcttacccccggctttttgattatgtccgtttgtatgtgtcattccggtggggttaagccactcattagatgagagattttctgtgtgtcatgtgcctactttattatagaattacatgtgtagcatctcaaagaatagctatgttttccacaaaaatctgttttaattgaacataatactgtggtaaagttttttaaaattgctatacttgtgcattattttattcagttatattctgttttttgagggtttcactgtatgacaggcacagtttcagaccattttcacatttaatccctgtagcctcactgaggagtctatatcctaacccttagttcacagatgcccagcacgtgtatcagagaggttatgtaacttgcccacggtcacatggagctaggactcgaatggaggccttttgattttgaatttgtttgtcttcctttcatctctctgtgtgtgaggcactgttgcatttcatggaacagaaatctcctcagtctcttttgaatatatgaagatttcctggaagaatacagtggagtcttagagaacccaatgttgggagaataccaaaaaatgggaaagcacagcagtaatcttccctgtctctgtgcttccttccttctgagatctcatgatctcttgcttcattcctctctgaagtttcctctacaaagatcttagttactgttgcccagtgatttcagcctgcacaggactttgggttaccacgatactatttcttgctctacatgactttccagtgccaggagctaacacctgacagacccagtctcctatcttccgtagaatccacatcctcagaaaacaagaatttgattgatctaggcagagcagattgttccaaaagaaggtgctgtgagaaaataatgggcatacctaaaacacgcactacttttttaaaagacactctatttgaaattttaaaatcagaattacttatggttggcttcgcatagctttcttccagtctagcgtggtttcttttccacattcctgccactgatatgtctaccctctcttgacctatctcacacttgccctgattgcctttctaaagggtaccacacaattccagaattctaatcttttatctttgtggtagttatgcaaattcttttccttctttgggagttaaattccacctccacttcctcaaggtagctttcccatattacccagtaattatattagtctgtccttaattccaggacctttgcctatgaggacgggttcaaataattcagaaagcagacaagccttttaatcttttaaactaaacctcttggacactcccatatgcttccccatgtgactaagggcatatattgaaaaccatatggttacaatgattagagtccaagaaaaagctaactggccctatatgatcaaaccaataactctgacccccaaaaatgccatctagacaaaatatgacctcaaatttatagtggatagtctgagtccagtgctcagagatgccatgtattttccctttagaatatgcttttaagatttctcgtgatgctaaatgattttgaatgctcaataaagtatcaaaaaagattaaagtatcaaaaataattttggtattctgggcagaatttgaaaagcttcaagtcttttcttattactttgctacttccacaaaatttttttgcattagaaatggagctttatagtaagttgatggaattatttttaattatgtggtttcataaataacaaatgtttttaaacagaagaaatctctctctgacacacacacacacacacactctctctctctctctctctctctcacacacacacacacacacacacacttcaaagtatttgaccaactgccctagctggctgactgtgctgttttagaagcaatgaaaggacagggagatgggggtcatattctgtgcttcctggattggttgttagtcattagatacaaacagtataaaacccagactttatgagtgatcattatgttattatatatctttatgagacgcattcccctcaggccacctaaagtactacaatgttttagatgttgaactatttaaccataattattacaactaaaacctcattaaatgtatccaataaagtagattcaatgcttccacttagtttagtttagtaacaagagctataaggaacgttgttctttccccaaagagtttaaaatttgaggattggccaacaatagggagtgggggataaaaataataggaaagaaaagattttccttaaaaccctttgtaaagtgttttctattttcatgcctaacaaatgaagccttcatcatctttgcttctgggaagagtttcaagcctaagaaacacaattggaaacctgccgtgttgcagcccatcctctgttagtaattccaactggatccaaatggaatatctcccttccaagagctctctgaaaaaaatctcgtgatgagagatgaaacccagccaatgcaacctggaaggtttcacatttaccctctgtcactaggttttcccagacgcgacccagggtacactctcctcttccatgtgctctctcaccagaccacaactttcaccccaagagtcaattcctctgccatgcaccatccaaaacaaaattaatcagaatctgctggaatccatttattcaaaaatttttgagcatttacagtgcgtcaagtctagtacaagattaggtatgcacaatccctgtcttcaaggagctcacagtctctgaaggacttacagacttgaaactattacctaagcatagattcatttatgtgttaaacattctttatggcattcctgccaggcattttaacaggcactgtggtagatacaagtaaagcatggatttttattgtatggaacttacaatcctaagaagataagacagagaaggaactctgatataaggtactacatgataaatgttgcaaaagtggaagtagaaataattgtccccagggcaggtaagggtttggaaaccacttggatacaagataaggttgagcaatgccaggaaaaggaatttgagggaactgtgaacagcagtcatcttaggaggttacactagcacattccatgccattttgtaaaaagtgcttaaatagcatgtattagttttgttgtcttaagaagtaaaataagctgtagaccatttcaagggagagtctccctgttttaaaaattaagctataatttacatgctacaaatttcactttttgggtatgtaagtgccccaagttttgacaaacgcataggtatgtaaccataaccacaatctattaatagaattttcatcacctttataaatttctgtgtctctttgtattcaacctcttcccccaccttcagtcctggcaactgctggtgtatccctgtagtgttgtacagaattttgtttaaatgggatcagacagtatatacccttttgccactggcttctttcacttagcatagcgcacttgagagtcaaccttgtgatttaaatatatcagtaattcaattctttttagtgcgaagtagcatcacattgtatgaatctatgatagtttgtttatctattcaccaaataagagacatttgattgtttccaatttgatttttgtggaaacataacttttttttttttttttttttgagacagactcttgctctgtcacccaggctagagtgcagtggcatagtcttggctcactgcaacctctgcctccagggttcaagcaatcctcctgtctcagcctcccaagtagctgggattgccggcacctgccatcacgcccggctaatttttgtatttttgtagagatgggtttcaccatgttggtcaggctggtcttttacttctgacctcaagtgatccacctgcctcggcctcccaaagtgctgagattacaagtatgagccaccgcacccagtggaaacataactttttatttatcttaaataaatacctaggagtgggattcttcggtcatatggtaagtgtatatttaactttataagaatctgccaacctgttctccaaagtggctgcaccactttgctatcctgtctggagtgttcgagtattccagttgatccatattcttgccaggatttgatcccaaacattcttaatttgtggacatttaaaactgtgggctcactttcaggtaaagagatagcatctccccatcttggcccactgatgtacaaagatacgggtaattttttatttatttttattttttttaatttttagacagagtctcgctctgtcacccaggctggagtgcagtggcgcaatctcagctcactgcaagctctgcctcccgggttcacgccattctcctgcctcagcctcccaagaggctgggactacaggtgtccaccaccatgcccagctaatttttttgtatttttagtagagacggggtttcaccatgttagccagggtggtctcgatctcctgacttcgtgatccacccatctcagcctcccaaagtgctgggattacaggcatgagccactgtgcccggccagatataggtaatttaacgtataaatcaagcaactggaatttatgaaacattttgtctgtaccccaagcatgctacgcactgggggcatgcaaaaaaaagcatgaaactggatccattcattcagtgaatctttattgcacattttcccatgctgtattctgagaataacaactgtttgggtcatgaactatgttaaggaatactcttttctggaaattagcaatactccttagcataccaatgactctgagaggtactgcagtaaataaactaatttgtttttctctttagcatagtttggaaaacactaatttacagttttgtcaaagagagaaaacacacaaacacacacacacacacacacacaaactgttaaatggaaataataacacttagctcataggattcaatgaaataaatgtgtaaaagtaccttttacaaaacctggtatccagtgagaaaagaaacattaaaacgtgtaatgcaggagaaaaggccaataataattgcacaaatttgttgagcacttattcatgccaggtactttactgtgcttttgagatatattaccttagttaattcttacagtaaccctaggaaacgtacgtgctactattgttcccaagtcatttacagtcagatctagaattcaagcccaggtttgggtgactcctaaccaaactcttaatctctgtgtacttaaatctcccaagactaggaatgctctaggtgttcagaggaaggaaagagagaatgcatgaatccttatttgtccacccttaataagaacaaggattggtagtgagtgtcactcaaactgagatctatagcatatttagcaccattttcccttgggatcttgatgtagccttgggttcccagttttgtattagtactccaggagtagtgaaattaccactggaagtatttctgcctgcttggctgcctttaagtagagttctggcagttctctgtcaggtcaatggtcactgccttcctctggaactgggtcactatagaacactcagtaaaacctgaatgatctctaccatgtatacagcttgagttttgagctgttttcctagggatgttgatggaaattcaactgtaattctatatttggggatgccatggtgtaaagatgtaattgttttttccatttggatgaacagttgtcacagaagcatatgttaaatattccattctttcctcatggatttgtaatgttattattcttatataacaattttccttatatttgtgagtctgtttctggactccctagtccattctattctgtttatctattcatttcttccaaagccaattcacattgtttcaatcacaatggctgttataggtcatcacatacctggtagagtaattcccccatcttctcttccttttttaaaaaaacaatgatattagctatttctgaactttatctttccatatgatttttttttttttatggagtctcactctgttgcccaggctggagtgcagtggcgcaatctcggctcactgcaagctccgcctcccaggttcaagttattctcctgcctcagcctcccgagtaggctgagggattacaggtgtccgctaccacgcccggctaattttttgtatttttagcagagacggggtttcactgtgttggccaggttggtctcgaacgtctgacctcgtgatccacccaccttggcctcccaaagtgctgggattataggcgtgagccaccgcgcctggctccatatgaattttaaagtgagtcttttaaaaaaattagctgaacactttttccagaaatattttgtggtctggtaacatacaaaaacaaaaacaaaaaactctgtttgacatgagatggggtttctgaatgtgacctttaggcctatctttgagcacctgaaatctttcatttcctgaaacctcaccactaaatttttaaagcgccactgaacatagaaagtcagagctttaagccagtgaatgacaaatggtgggagtttccagtccatggagagaataggagcagagaagaagatgggaggacagatacaggtgagagatgttaacacagcctatttttgagaatttcctcctagtaccatccgttaccctgttccaacaatgaaaaactacattatctagattatcctctaaaaattttgttcacaggaaggcataatttttgccttaattatgactccagctttagaaactggagaaattttggtctcccacattggtaaagaatctctttgagacggcaaacaactagaaacctggatattgtccttggaagacaaactagtctcccaatgtaaaaatcgaagagattttacatttttacgatgtaaaaatctcttagatcacagtccatccctatcaggggaacattattgcacaaacaagatgagcaccagttaaaaggtaatttcctgaaatagtctcatgtggaacaaattgaaaatccacagtccttcaacaaagttttttttttattattatttgatgttaaaaaaaaaaaaaaaaccgtttcactcttcacttccctagcagatgttgcaaatttcagaaacagacaggcacctttgggttgaaatgaggaattgatccacttaaaaatgtaaaattcagttcaaaatgtttagaagatagtgagtggggcctggagagtacacctctgactttcaggatttcctctctgtgttattcagttgccataaatctggcaaaagcaacactgtcctgaatgtggtgaatgacatttttatagccttattttaaaaaaaatggtctgtgtgttggggatgtaagaatataggatgttactattgataagacctggaaaattattatgtgtttcaggaagtaaatacaataatacagtaaagggatacaataaaggacagcaatgttatactgtgtcacatttccctctgccctttttcagaacacataattttctttttttctcctttctccagtctgactctactgcctagatgttagactttgctgagtattgaatttttattttctagaagaaaaaaagttatcaaatacttattctttctacagatatttattaatcagtgcctattatgtgccaggcactttgctgatcactaaggatataggagtgaaaagacagtcataggctttcatggagtgtaatgtttaaagggagtgacagataattaagtaaatggggaaaaaagcctgatgagtgtcatgacagagggatttagaggacaatattaggggacacttaaattaatcttggggtcgaggaggcctcccaggggaagtggagtttaaaccttgaagaatgaatgggaattagccaggtgcagaaatgaggaaaacgtggtaaaatgcttataagagagaaagaagagtctttggggcagagagaacagcacatgcaatggtgctgtggcacatggcagcatatgtgttttgagggagcaaatatatgaggaaaaatcttatttttaaaactttcaaggtccagactgaagtacctaatacttaccatttatactcaatctgtgggatagcatcccttaaatttagtcaaataataaatagaaaaagatgcagacaactagacattattgggaccttgtttacttatgagtcccttcacacaaagaaaaatgggccaggtgctgtggttcatgcccatggttccagcactttgggaggccaaggcaggcagatcacttgagctcaggagtttgagaccagcctgggcaacatggcaaaaccccatctctacaaaaaatacgaaaatgagccgggcacagtaacacatacctgtagtcccagctacttgggaggctgaggcaggaggatcacctgagcccaggaggttgaggctacagtaagccatgatcatgccactgcactccagcctgagtggcagaatgagacactgtctcaaaaagtaaaataaaacaataaaataaaataacctgaaaaagaatgtactacgctcccctcagctttgtgtctctgcctctcgctcccagccctcctccgtgactgaggatagcatctcctctaatgttccttcctggctccattctccccagatctgagttagatgtctttcctctgtggtcccactgcacctagtccttacctctgtcagagcacttttcacattgtgtttattttccagatcattcccatgctcaactctgagttccttaaggtcagaaacagtataaaggagagaatacgagggaggtttggagtcaaagagtcctaagttgaaatcacagcctggccacatactgtgtggtcttgagaacttacttaactactctgagtcttggcttcctcatctgtaaaactgggattataatagcatatacttctcagcattgtatgtgaagtacttgtcatagtgcctagctttaatagcactctataaaaatttgctgaatgggtgaatgaatgaatgaatgaatgaataaatgaatgcatgagtgacaaaatgtaaggtttgttcaaaggattgcttgttgagagctatcttgagactgtagccaattcagtaatcaaagtcccatcagctcaatcctgggcattgtcaccttagctagaaactccagaggcaccagtatcctgtacttcctgtaggtaggaaaacaagcttcctacaatgttgtccattcattggtttatttattcatcgattcatgaagcacttattaagtacttactatgtgccagggactgttataggtgttagcaatatagtgaagatttgattagagtatttatttatttatttatttatttatttatttgccaggatgctaaacaaatgcattgtataagataccttttttttttttttttaaccccatagcaatgctgggaccatcttagtccttctcatgttgtatctactgtgccgtatctactcgtgttgcatctacatcatccctcctttccatctactacatataaatataaatggattcttttatatcctgttgaattttagtcatatgtgctgagcaaacagatgccaaaaggaatacttttgatcaccttgaaaaggaaaccctgtagagagggttacataaagaatagggggagatttacagccctctcccttgcttgtatgctactgacaatgtgaatcacctctgaaggaagggagggttgggtttatctatcacatatgcatcatctcaccacggtagaagccgatgctcttaccagtgttgctaagaggatgagagacttaaaatgatggccaaagatccaattcaaacccaactattatctctcttgggtggtccctatgatctcaatgtacagaggatattgatattttagggttgtttcatgaactcaccttatattcaaaatgagagcccacttatattttcattcagcaaactttagccgcagggctgcaggtatactgctggccaaagtgtgattcctcttctttgaacactcttagtctaatgggagaggaggagactgataaatgaacagtttgtaacagtgcagtccagatggtggttaaaaacagttaattacttgtttgcagtctaactggggctagttactcaacctcttagaggctcagtttcctcatctataaaataggcataagaacagcattaccttagaaaaactcttgttgaagaatcagtgagatcgtctatgtacaatgcttcttaaggtgtctggaacattataagccctcaataaatgttagctggggtttatttgttgtttgcttctataatggttataatcagaggctataacagaatctttttaaaaaataatttatacttttggctgggcgcggtggcttatacctgtaatcccagcactttgggaggctgaggtgggcggatcatgaggtcaaaagattgagacgatcctggccaacatggtgaaacctcaactctactaaaaatacaaagaaaaaaaaaattagttgggtatggtggcaaatgcctataatcccagctacgtgggaagctgaggcaggagaatcgcttgaacccgggaggtggaggttgcagtgagccgagattgtgccattgcactccagcctgggcgacagagcgagactccatctcaaataataataacaataatttacacttttattttagattcagtgggtacacattcaggtttgttaccagagtatatgatgctgaggtttggggtatgaattatctcgtcactcgagtagtgagcatggtatccaataggtagtgtttcagtgcttgtccacctcccccctcccccagtagtccccagtacctgtcgttcccatctttatgtccatgtgtacccaatgcttagctcctactcataagtgagaacatacactacttggttttctgttcctgcattaattcacttaggatgatgacctccagctgcatacatgttgctgcaatggatatgatttttttcttttttatggctgtggggtattccatggtgtgtatgtgccacattttctttatccaatccacagttgacagacacctaggttgatttcatgtctttactattgtgaatagtgctgtgataaacatgcgagtgcacgtgtctttttggtggaacggttgcttttcttttgggtatatacacagtaatgggatttctgggttgaacggtagtttgttttaagttctttgagaaatctccaaactgctttccgtagtggctgaacttatttacattcccaccagcagtccataagcatataacagagttttgaacagagcactgtggaaacactgagaggatgtggccagtttgacacaggcaaggtggcatcagagctgcatgtggagggctgagtaagaggtgagcagaaggagaaggagtggcagggcagtctaggcctcctgcacaaaatatccacagttgccagggcgtgaaagtaccagaaccgttccgagaagttctgtaaggtgaatgggtgacagccaaaaatgatccttaggcacagggctggggagacataactgccacagataatggtttgaaatttactctactcagtaggaaaccagaagagatagccagaggaagtcttccaattattccttttagttctacctatgaccagcctactcaaaaaacagatgtggcttttagcaacatgagtgcatgtctgcacgcttagaaagtgtgaaatatagtggaggaaaacaaagaaattctgtgataataaaagctaacatttgtttagaactttacagatttccaacagtcttcatatgcaagatctgttttaagccttattgtatccccgtgatttgacattactaagttctctagtttgtatagagggaaattgaggcatagagaggtcaaactacttttacaagattgcacaattaggaagttatgaagttggggctgtaagcccatgttctttctccaaactcaggcattttgcaaaaataatcttttctactatcgcaactctttcatttcaacctacagtatctttccctgagagaaaatttttaatcatctattaaaaaatagatcttcccctcactggtttgcttctctactgctgaaatctcctttaccagcatttccctagtctttgcctcagctattttgtgtctttgatatctggactttccatttttatgatcatcttatatcttaactttctccagacctagacaactgagaaggtttgcagtttaattaatctgtcactttactgcaggagacttatccatttttaagatgattctgtccttattcagcaaaactgccctcttgttcactacctcttgatagaagcagctcatcctaataacctcacatttctccagcttccctaactttctccttgcattttcttaccttctgccttgctcagaatttctcagccatattctgtttgctctaagcctggaaatgttcgagatgtgaactacttgtataggaaaagccattaggtggaaaggccttgtgatcaatggccaccctcatgtttccagggcctcttaggagaactcatggagtctgcctgcatttcccccatagcctcctagatcccacgcccacagatgggacatcccatgtagcactgtgggcctgctgcactccacaacatgaacccacattccacatcagtcgtctcactagctgggtggtccaggctccattctggggagccttgccagctgctcctgcctggctaccgggcagtctgtaaagctttgacatgtgtgggaactgtgctgaaaagcgaggcggtaaggctgggctcggcaagtgggtgcattgggaattaatataagaaaaaggaggtcctccagaggcctcaagactacccagcaacaaaatatgcaaacagtgactccatcatatggcaacaatgccgtctgcagcttctccccttgtacctctgcccatcgcgactgcaaatcaggaagggacgcagtgtggttgaacctccctgattgatgagggtccaagttttctgtcagtagcatagtgggctgagtggcctgccagggatcgtccattccagcctgcccactgcagaggggcttcatcctcttctaacttctcattcctgaactcttttcctcactgaatcttgctcagctctacccagccccagtcttggggatcccctgcatgccttaccttcttcagatacagtatctttagcagtcatttttttataatgtgacaattgcctggttctatttaaacacaaagataccatcatcactggttttgaggttaagcgtcatgtctactggcctagtccatctgcccatctgttccaaacatcctcattgtcataatactgccttacctgtaaaaaacactttataatgggccaagtgcttcctcaaacatcctttcatctgatccttgtgagtgagatcccagtcagcctcattatgggccacattagacacatataattagcttcattttccataggctcagagaggttaactgatctgtcaaggtcacacagaaagtaagtggcagagccagcactcaaacccatgttttttgcctcttagcctagtgctatttcctctacagatattcgggggacagatagacagggacagtgagggctaactaaatccaaccactgtcacatatgcttatgggccccagtgacccttttcaaatcagctccccagtgtccttctctacccttcccaccaagcgaaagactaatccttctaaaagccctctgctctctgtttgctaccttaatccccaagatcccatctgttatgtctctggatgcagatacacatggcccatttaactgcatgattcagggcataatgagaaaggcaggaaactgggacaaaatttcctgattataggacaggcactggggtctcaggaaagattcaggacgggagctagcgatggagatcattgtggcagacagaatacagcaccagataacccttgggaatactgttatgagcaaaatgaaattcaacgtagtttcttcagggtgccctgacctgtgaatggatcacatggttggaggagcaggagcagtgatagagatccagccagccctagggtgccagccctaggcaaggcagctcctcccatcctagatggcctggcctacagagaccccagcttagtcatggacacatggcaggaatccttcaacctgaaccaggttcaaggtaggaactctgtttcaagaacagaggcaaagccttactttcagaaccacagtcttggatctgggttgcacctggagcccagcttcaaggcaaagaggaatgctgggactgggaagaggcaggacatggcatccctcagttcttggcattaccctcacaacctctgttaatcaggatgggtgaagttatgtagcagtaacaaataatgtcaaaatctcaatggctaaaacacagaattttctttcttacactgtacgtgcacgatgggggaaaggggttctgcccatcatagtcactcttggactataggtgttggagcagccaccaaccaggacattgccagccgctgtaccagagagaaaagcgagtcctcaagtggctagcattaacaaataaattcttagccagagagagacacacattacttcagctcacaactcactggcttgagctaaccagaagtcccagccacctacaaggaggccaggatgtgcagtcctaccttaggcccagtagacagagagccgcaggcattcagtgagtagcccacaaggaggctttcatctgctggggtcatgatggattcgtatcctccccctctagttgggaaactaaagcaccagttacagaaacctgaaatatatcgattttccattcatttaacaaatatttattaagcactgctgtgagtaaggccatgctggtggttgtagatacaatggtgaccagatacagtccttccttcaaagagctcccagtctaatggagaagagaacaaacctatacagtgtgacaagagcttcaacagggagaaacccaggaatctatggaagcacataggagaggtgactgatttaggctcaagggtgaaaagatcaacttgaggaaggcttccacatttacatataactctactcataaatatagatatacataaacacaccacaaaagaaaaaagaaaaaaagggaagaaatccataattcctagcactatttatcccctatttccttctatccatatagcatagttgtccctactcttttgagactaaacttcaaagaggagagtttctggttttatccaccaaaggctaggtctggagttctcgtgacttaaaggtaattcagtttgaaagggagtaatggccattctgtctctctcattctgaccaaaattttcttccttacactctgccactaagacttaaaattcctgttttattcatttatatgattaatgtgtaaaatatactgtaaaactgtaaacattgtctgaaagcagacatacaataactccctaccaccttagctcacagtagtgtatccatgaagcttcagtcacctagctctcatcagttcacacgtggcctgcggatccactgcatcagaatcacatggagctcgttagagattcagaaactcagtgccccagtcaccccctcccttaacacctaccgaataaggctttgccttttaacaagatcccaaagtgattcatatgcacattaaagtttgcaaagtcctgacctagctgagaacaagagaaattggccataagttagatacattttgataccaaaaaggagacctttataaatctgagtcatgtggtgctaataggaaggcaagtgtgggttagacttcagaagctggcagaagaagcagactatagagtcctgggcagaagagagttgcttttcaaaaatgagaatctgatggagaggggaaaaagcagcaaaagggagttttgaaggcacttttgcctggggatactcttggcaatatttgatggtctttattggagtttagaagtgaagtaagggtccagaaaaaccctcccaattactcttccttttccccctactaaatctgtgtgtgcaaggttgttccctctgcatgcactccccttcactgactggcacctccaacattgaccatgtagagaatgtgaatctattaactagaaagtgcttcgcagcctctttaaacagcacttaacgactgaatagcgtaaactccagagctaggagactcagagggacaaccaaagtttgaactttgagtcataagtatggagaaaaacgtataaactagcaactggatttttgaacaaaagttttacttaaaatggactttgatgtataatcatattcttccaatattaaggtcttctaagttttaccatttccccagctagactgtttccagtagcttttcaatccactattcactgccaggtgtctggttctacatgtgtattattattattattattattattattattattattataattattattatcagcccttggctgctgaaatggctaaaatggggaatttaaattatttttacaggactcagaaagttaggttaccttagctaaaataaaatctgatatgccaggagttatatctcaagtgagtgagtgactaattttttccataacaattttccatattatggctctaactgtattttattcaaaaacttgtctgtgatttttggagcacattcagcatgcattcctacccagaggaccccatgttgaagctaatagcttcctgttgcaaggtattaaagaccaaaccctacagagattatattcaaaatgattgttatgatcaggatgatagccaaagactatcactggcactattataacttcactagccacacttattagcaatattacttgctatataactaactatatataatcagaacttatatactaaattgtatatattataaagcagaaaaaataaggggaagaatttacattaaggcatttgccattttttatttaaactattctcataggcataaaacctaaaactcaccttaagaaacaaacaaaataaacaaaaaacctccacattttcttctgctacctctctatttttctgctttacagccatactccttgaaaaaaattatccccaatcctaactccctacttctcttctcattttgtctcaaactcatttcaatcacgtttttgtctctagatttccagtgaaactgctcttgtcaaaactattagtgatatctacattgccaattccagtggtcaattcttaactctcagccaggcgccgtggctcacaccagtaatcccagcactttgggaggtggaggcaggcatatcacttgaggtcaggagttcaagaccaggctggccaacatggtgaaaccccatctctactaaaaattagccagtcatggtggcaggtccctgtagtctcagccacttgggaggctgaggcaagagagttgcttgaacctgggaggcagaggttgcagtgagccaagatggtgccactgcactccagcctgggcgacggagcttgacttatcaggaacatcgaatccattaaatcacttcctttccttgacatactttcttctcttagctttcaggacacaactcattcatggtttgcactctcctttgctagtttcttcttcatataccagacttccaaacgatggggtgtccagaggacagttactgtactccttttcatcatctatactcactccctaggtgatagcatccaaattcatgactttcagtatcttttctatgctgacaactcctaaatttctatttctagtctatatttctctcctgaactccagactcatatatcaagttgccttcctgacatctccacttggatgtgtaataagcatctcaaacttgacatatcccaggttaaattccctatttccaactcctccaactccctccccacagaaagcaaaactgtttcacagtctttcccatctcagaaaatgataactctatacttccctatactcaggccaaaatctcatagttgcttattagtggctctaccgtcagagactatgtggaatccagccacttcccactgctaccactctggcccaagcccctgccatctcacctctgaattattcctgtagccttccttactcatcttctttctccgtacaaactattcaccacatagctgacagagtgatctttaaaacatatatcatgtcattcctctgctcagtatcctctaatggctttccttattattcaagtaaaagctaaagttctgacagttgcctacgaagccccacaggaccatgtctcccctgcttctccacccctgcaccccaccgccaatcttgcctcttgcacagcagcacagtggcctgcttgctaggcttcaggcggatgaaacatgctcccacctcaagaactcaggacttgaaatccctccactgtgcacaaggctctcccctcacttcttccaggtccaatgtcatcttatcctagaagtcttctctgctcaccctacccactcctacctgtaccagcaacacaccccgcctccagccctgttttctttttctttatagtatttatcatcatatattatttgttaaaatgtctattatctgtcttcctacactaaaatgttggtttcatgagggccagagctctgatttatttaccactataaccccagttattattgtaggcacagtaggaatgcaaatgtatttgttttatggaaggaaggaagggagggagggagggagggaagggagaaaagaggtggggagggagggagagagggagggaggggtaatctctcagtgtgctttggtttttaagacttcagttacctgcactttttcagaaatcaaggtatgcataaccaaagcacatctgcttttccaaactggatttagattcgccatttactaactaacaaatgttgtgcaatttagctaacttgtctaagcctcattttcctcatctatgaaatgggaggaatagtaagatctacctacctcaaaagaatgttgtaaagattaaacaaggtaatcaaattgtttagtaatatgccttccacatatcatgccctcaatacatgttgagtattattattattactgattattcctcacatagttaattgcctttaaaattactacacttcagtattattctcagaaattttacattttatatagtttccatatatcaaaagaaagggttactagcaacatttggctgattctttatctcccttttttgagccatttaaacaaatcttttctatagagtttctggatctgttcctcctaaattcaaaaaagtctcagattagaacacaatccgaaagcactctaaattgaaagtttagtctttaggatactaacaatagttattatatggacccttttttaatgtccctaaagtccataattccacacaaactacgatgagaagggcaatctgcatatttgtgtttatatgaacataggagcccttcttcttcttcccaaaagcttttgtaaaatgtcatcatagttagcttttatccccacaaaaagtgttcctcctagaatctgaatatctctgctagacagtatggtatgtgctcccttcaaacttaggagaggtggggactctaaaacatcaacagaagtaaggtgtgagaggcatggtggagggacaggggtctggcaagggtgttgaatctgatgcaagtggtaatctggtaatctgatcaccaccagagagcttcctgtggctgctaggagcaggatgggcagaatgactctttgatctccagctttcatcttctagtctttctctcccctccccttcacttttttgctctctgctccctcctaatgtgcactgcccacccaccctccccccatgtacacgtaggcagtgtctgttctcatgatcagtcagaaagcagttccagattcatggtgtaaattggaggacagttcactgaaccaaacagtctatctacatgagatacagagacccaatcggatttcttgatataagtggatcatttatttaaataaataagtttaaataaagtttaaataaagattaagttttgaacaaaaggactttagaagcgacctgatgatgccccaaatacgtcttttatgtacattccctagggccagccatgcatgtattatctctaatacatacctctcctgaaatttcattctttcctttatactgtactgacctgagaagttaaataataataataatagtcaccacattaactgagccttgtcagtatgaagcacctcatatgcattctctcctttaatccctacattcatgattcaatatcattaatgagaacattagataccttaagactggactaacttgttcagaatttaaacccaggtctgtctaagtacaaagttcatattcttagtatctaatgccataaagcctgcagacaattcacttatttttcaggtcactttggtcttccccatggcataaaggatcttctacacattttggtacacatgggtcatcactaatatgtcttcatgaattgccccccccccctttttttttttttttgccttcttagcactttcattttatggttagctcttccacatctattgaattggcccaatagaaaacatgtcagaagcttcattcttttatatttcacagtaaaccataatggtcaaccagctggagtacagtgtttacaaaatactttttacacatattatctcaattaaaactcactgctaccctgggaattgggcaccttactacttttatagatgaggaaactggggtttggaaaaatgaagctacttattcaacgtcatattactcctatatcaaatgcagatcctatataactgaactgtactgttatgtagtagcttaaattgcttcatgtttccatatgaagtgccaatagtatagatttaccaccactttagatcaagggctctggctgccttagttttgtattatttcttttcggatattatggcagggctctggagtcaggctgcctgagatagacttttggctcaatcactgactaactagatgaagtatttagcttctccaaatgtcagttctctcatctataaaatggagatactaatagggtggctagtacatagatggttattatagttatgaaatgtgatcgtgtataaagtgcccagtgtagtgactgatatggagaaagtgtccaacacatgatagctattatagttattgatgaattaatgactcaaacatgcattggaatttctttgagatttgcataccccatgatttggaaattgcttcaatgttccatgccatctacacatagttttaagtcctttaacttgtaattgatttaagtctttgttctaagactttgacataagcccccaaatgttacaagtggagcttcaaattagagaaagaggataagcagaccagttcaagtcaaatattgttttaaaagtatgtttgtgtgaggtgaagttgacgtaccctaactgcagagataacacagaaccagttagagttttttactacaagttgaattgagtcaaaataatcaattggttggtttgtaagaatgtagtttgagaccacctgaaaacctgaaagctttctctctacaattcatcactgttttccttctcagttcagagttcaccgatgttagttttaaatgttgattccaggaggctgtggttaagttcattttctgaatgtggtttcctctcaggctgctttgatattaatgtgagtcaacaaccactgtgtcatccctgtcgcaaggatccctgtggagagcctagttaccaataataaggtagtctttttgttcgtagagtggcattgtcatttcccattcctcagtgaatatactcagtttaaagaaactgcagctgtatactaaaatgctgagtatactgggagaattgcatattttatacttttgagacaagaaagattcccttgtccccctcgcagggtgtgagatggggaagtggctcgcttcatcagtgccccgctgatcaaacctctaagggagcatacatacaggcaggctgtggggctgcgaccccacggccatgtctaggggtgaatgtttacggctcctgaagccccagtgggcatgtgttacagcgtgctctcttagtttgctgtctataggtggcttgtgttaaccagctcaattagatccccttccttatcacaaggacagagggctttctgtatcctgggttcctgccttggtgtacaggaagaatcagatcacacgtgggcttgaagaaagaatgcaaagttttatttagtggaagtagctctcagcagatggaggaaccagaaggaagatgctctttccctggaggtgggctgctcggtggccctggctctcctccaacagccccacctcgtcccgccagtgtcctgctgacggcctgcaggcgccagtgcttgtgcgtgtgctcctctgccagtgtgctcctctcgacgtctggctgcctttgtgtctactgctagggtctggggtttttataggcccaggatggggttgtggcaggcccaggtggtcttgggaaatgcaacatttgggcaggaagtgcctgtcctcacctaggtcgttggagtggagcccttgccagggacctgcctttctctacccagtactttgcttcccccattccatgtcatttaaagggaccacactcttcccttcctagcagtcctgtatcactttgtggttggattttatactttagcttttatattgtagatggactagttataatctactacatgagctactggagacctcacattacttaattctgattactttgaagagagaagtgaatagatacaaagaatgcttagggttatctcattttgttgttcttaaatgtgacatttgttattggaaaaacaatatgtttgttgatacataacctacttcccttgatcattttaaaaatttcaattaacccttgcccctcacctctcagaaatctgtatctcataactctctcttttcacctgagctcctagcagtttacaggcaacatggtcatcagtgaaatgtacatgttgaaagagagaaaataaaaaccctccaagttagtctgttaaggtgaatacatatgctattgcatgaccaactaagatagataatgcccagacaggtcataaaaaagacacaggaaaagggaacattgaataaaatggtggcagcattagttgactttataattctgttgccttgtgaaacagaattatttgaaagaggtttctgaaaatgtttttgttgcttgtcaaagcatggtgctttgacaacacagaagctatttttatgtagaaacagtagtgaaggtatcttctgttcactgcacaactaaattatagcaacttatcattgtgttgcttaaggaaacaaacagatttcaaaggtttattctagaaaacagtgtttaatcaatttcttatactgtctttgaacataatctagtaagcagatgtggagttaacggcttattatgttcatactccctatatccattcagagtctgccaggctcagaataaaagtcaagacatgtgcacatagagactctgtagatgtttgtagcatttgaaattaaaatagtgagaaggctgcctgggcgtcccttcagacatggcacagtggagcacagagacaggaaatatgccagactgcctctgtaggaggctgctgtgaacacgtgcagcaaggaacagggaaccgcttaatgattaatcactgtcaacctttgttctcgttaaagacttgattgttggacaaggcttgtaatgagggactgttttggtgtctgttgctatgagattgtgttcactgatcctcagttgatgtaagccgctgttctctttttgcccaagtcgaatgaacttgaatgaaaatgctctcacagtgcctgctagtggtgctttcagaggaggttctgggcattctgtttaccaaatgctactgcagctcaaaaacggagaacaggtaactaagagtttggctcagctgaattttggcatatgagatttatgaaattttagcaaatgttttaaaagtttgattctaaaagacgtaaataaaagtagattttatggtagtaatggaataaaaacccttcaacacacccacacaccttttctttttaacaagcacagatattcaagaatcaaaattttaaattgttaccatttctcttgacttctataaataaaatattaaattgtgttttgcaaaccaaattcttaaaccaccaactcatgtgagaggtgggaatatgtcttggcattttcctaaaggctaagaaaaaaaattccatttattctgtcattgattacagcttgcagacttttatataaccatttttttgtttgcttgtttttagattcaaggggtacatgtgcagatttgctccatggttatattgcatgatgatgaggtttgggcttctattgatcccgtcacccaaatagtgaacatagtacccaatgggtactttgtctgccccagcctctctcccaccctcccccttttggagtccccagtgtctgttgttcccagctttatgtccatgtgtactcaatgtttagctctcacttataagtgagaacatatggtatttggtttttctttctgtgttcattcacttacaagaatggcctccagctgcatccatgttgctacaaaaggacgtgatttaattcttttttatggctatgtagtatttcatggtgtatatgtaccatattttcttactaattcaacattggtagataccttggttggttccatgtctttgcttttgtaaacagtgttgcaatgaacatataagtgcaggtggctttttggtagaatgacttattttcctttaaggtagatactcagtaatagaattgctgggtcaaatggtagttctatttttagttccttgagaaatctccaaactgctttccacagtggctgaactacaattcccaccagcagtgcataagcattcccttttctctgcaacctcatcaacatgtattatattttgactttttaataagagccattctgactgatgagaaatagtaagcataaccatttttgaatattttactgcaataaaatatcaatggaacattttaaaggaggaaaaaaacagtatttttaaactttaaagaatatttttctggattaaagtgaccttataaaactctgaatttcttctaaacataattgcatcatcatgaaattacttttaaaatatatacttatatgaaagtactaatatagaacaactaaaactgttagtgatattctcagattatgcttactatccccaggcaaaaatatttctctgtctctctttctctctctttctaacaaatgcaatctgctatagttttttgatgtgtctgcatgaagcaacttttcttgtgttttacatctgtatataactttttggttcaaaatactatgtgtctctattgttctctcttttttcattcgccactattcttaactcatctacattgtaatcagggaagttgagtagggactgtttgtacctcaagaaatctaaaatgtagcctctgtcagcatcctatgcccctacctggtctacaggtaactatgaatgttccacttgatcccagaagtgattctgtctaacccaaggacctgtctcttgttaagtgtcccctacatataaaagtaggaagggactggggaatggccaatctgcccctgtatcttctagtagatttgctctaaatcttcccacacaggaaaatcagttttttatataaatctctaaatagtaatccagttttcttagaaatagtcacagtgtataacttgtaaacactttaattttcaaagtcttgcttctatgtttaaatatgtatccatatataattaggatatagaatgtaaattttctctgaacacagtatctatctgttgaagttatgatggagtaatataattaagatagaaagcagaaggtttataatgataatgataactataattggttggtcttttaagacatattacagtttgcagtaagtagatcattcccgaagctccaaattgttcctgattcagttcatagaactgcaaccctctaaggaacatcttttcataacccacgccttataaatcctgttaggcctgattggttttttatccttgaccatagatacttatattaaggaatacatgacctttttgtaaaattggttcttgaacagatgtccttgggcaatatttctagtagctgacctaaaatcctagggctagggggaaaacgtatcaaaataaatcactctctacacaacattgtgaattattatttgcatttaaatagaaacagtacagccctccttcactgtaacaaatgtttacaggtaaataactgtgcttttcctggcttccctaagaagtgaagatatatgtcaatgcttacgttgttttcttctaccttctgaagagcagtgcagtagagtagtaagtacacagttggttctactaatgttagatttgactggaagttattcaccacataccaatagtctctccttgatttctttgtaaataacaaatatagttaaattactgaaataaactaaattattcagatctttagtgctttccctatatataaaaaagaaaccattccactttatcttatgaccaggacccagttaaattcaaagattagcaccttcctggtatagaaagcaatagtagggtgtttgaatgaatggcatattatctggggaaaagccatgaacccagctgtcagatcaaggtaaagaaaatacgtgagaaaatatttagatttaatgaagatgtaaaggaaaagttgcagcgctgaggtgcagaaggactgctatacatgcgaatggccatcgttagcattaagtgattaaaggaactgaattgttcttccttccatatgacctatatggctagtcaattgcacattaatattacatctaacaatattattttgcctccaaagaactcaaaatactttcatttagttaactctcaaaatatttattaacataacaccttccccaaatgaagtactattgcttacccaataccttgaaaaaagcaacttttaaaaatgatgctagaatttcagcggtgtcaatacagctgtgtcttcaggaagaaaactgaagtgaatacctggcaagggttagataaatatgatgaacttcaaccaaaaatctatcaaggaaatcatgtcctgggatgagataatcaagctgttcattttataccaaaacagctagttgactccgttagtttagttaaataatttttaggccaattatttggcaacatgtacatgaagcaaatagttgactgattttaaatttccatgatactcagtggtgtggcatttctcatgcttggcccaagttctgttaactttatggagaagagggctgtttttaaaacttgtttttgtttttcttctgaggatggctagataacaatattttcaaattctaaagaggatctaattggctcaaatttagtcacagttttgatttaaatatttagaaatgttcagatatgtactcagtgaactgttatttggatccagccagcagctgaaaagttgttccagtcccaaatgtatatcattttaaaaaagcaccacatgaatctggaaagtacaaaacaatgtaaacattggtaactgcacgatatatcagtctcccttcctgcattctctcctgatcagcagtgaggaacataagccacaaatgtttaccaaattgaaaaatcactggacagttatgttcaaatcaaggatctgttttcagttacaagtaactagaatccgatacaaccaacctacccaaattgctgaggaaaaaaaaggttaaaagttcacgtaaatctgtgtgtgttgaatttacattcaaggttttaatcacaaatgaaaaggtttatatattatattgaactgacattaataagtactcccaggtaaaacatgttgttatatgatatgtaatattgatattcgtcatttcactgaaaaattttttttttttttttatactttaagttttagggtacatgtgcacattgtgcaggttagttacatatgtatacatgtgccatgctggtgcgctgcacccactaactcgtcatctagcattaggtatatctcccagtgctacccctcccccctccccccaccccaccacagtccccagagtgtgatattccccttcctgtgaccatgtgatctcattgttcaattcccacctatgagtgagaatatgcggtgtttggttttttgttcttgcgatagtttactgagaatgttactttcttaataatatctaagtaattataaatcatgttataaatgaagtttatctgattttcaagtaattatttagttgtttacttaacaacaaatatatacttaatatctactttctatcaggcttatatatgctaataggagtgcataattgaataaaacagttcatattcttaaaataaccactatgtagtaaaagaaaacatacatgtaaataaacaattgatatattcgttagcagataatgcaagatatagtcatattttgtctcgcaggatccaagtgataccagttacctatgttggaaaggtgccaagatagacctgccttattctgaattttctattttgatgaattaatgtaaagagtcattctgtgaacccaaagatatactagaaatctttatagaagaaaaacgcctttaaaaatgattgatatcagctgggcatggtggctcacgcctgtaatcccagcactttgggagacagaggtgggtggatcacgaggtcgggagatcaagaccatcctggccaacatggtgaaacctcatctctactaaaatacaaaaaaaaaaaaaaaattaactggacatggtggtacgctcctgtattcccagctactctggaggctgaggcaggggaatcacttgaactcaagagggggaggttgcagtgggccgagatcatgccactgcactccagcctggtgacagagtgagactctgtctaaaaaaataataaaaaaaaagattgatatctagaaataatttaggcttactagtctacctagtctttgtaattccaaacaaaaagaaacaaaacattaaaatactcgtgtgtgtgtgtgtgtgtgtgtgtgtgtgtgtgtgtgtgtgtgtataagatattcctggccaggcgtggtggctcacgcctgtaatctcagcgctttgggaggccgaggcaggcggatcacctgaggtcaggactttgaaaccagcctgcccaacatggtgaaaccccatctctactaaacatacaaaaaattagccaggtatggtggcacgtgcctgtaatcccagctactcgggaggctgaggcaggagaatcacttgaacctgggaggcagagcttgcagtggaccgagatcatgccactgcactccagcctgggcaacaagagcgaaactccatcttaaaaaaaaaaaagaaaaaaaaaagatactccaatcttatttcccaatagaattaataaaaaatttaggtactgttttctatgttcatagtcacagagtagcatcagatctggcagtagttgtaccgcttatttgatcaatgtagacagacaaaataatcagaccaaaaaaaagttgactttcctcagtcttctccacagtagacttttcatttaaggttatcatttttctaaaacatcattttggtaccctgcagatcaaaatgtgtttatatagtttgcataaataagatttggtaaataacttgattttctgggatttgatccaagtgaaacctctaatcttttgaagttcatcccttagtgattcttagggagaactcagcttttttgaagtctcactgaagtatttagtggcttgctttgctaatccaagagagacttcatagctacatttaacagagaacagatggctccttttctaatgtcctttctgtccattataatagtacattcaaaaaagcaatcatgtcacattagactacacaaacacattggaagatattgaccacagtcactatatttgtgcacctagattcccatgtctaatagacaacctgtaataaccgagacattctctcatttctcatgagaaaaagtatgtcaaaatttgtaggttactttacagattaatacattttgtatattttagtacagaatggagagattcaaagcataaaaattatctgtggcaaaatattttgtattctttttatagtattagggaaaaatatgaatcttttgttagaattagttgagaaaagtcagaacttattaccaaagctgtatagttctaccttatgccttgaaaatccagtccagaattcagcctaatacatttattcaacatttccattcccaagcttcagtgtatttacttcaatgtcatcagaagacaaccaccttgatcccctactctccaccctcaactggatcaatctattatttgttcattatagaggcaaaatctttgcatctcttgttgatagtttgtatttttgactcaatgagaaaaaaaatcaaattatttcatcacagtggtatttattgttcctttgattaaataaaaatggaatttcaactattctagcactagagtggaattgagaaattatagtctaatttccatatcttaaagttggagaaagtaaggcctagagaagtcataagggaagactgaaaatttaaaagatttacagttcacataaacagatttctagaagaatcaattaaatgtcagtatacgtgataagaagtaaaaattgtcagagcagataatagttaaaataaatgctaatgtttcttggaaactgtcttgttcatttgtgctgttataacaaaataccacagaatgggtaatttataaagaacagaaatgtatttctcactgttacggaggctgtgaagtccaagatcaatgcactggcatttgtgtctggtgagggcctgttccactgattaggtgccttctcatcatggcattcttccatggtggtaggtagaagagcaaaaagggactgaactcactttctcaatcccttttataagggcacctaatccctgtcaggaggcagagccctcatgacttgatcacctcccataagggctcacctcttgtgccactaccctgaggattaagtttcaacaggaattttggaggagacgccattattaaaaccatagcaaacacctcataggggccagagactgtgtcacatattttatttacatgatcttattcaagccatacagcaattccatgaggaaggcactattattttttccataatagacaagaagtcaaaatatacaaaattgtataatttgcccaagaaaaacaactagtaaattatgaagcaaatatttacacacagacattctaactacaaaagctccattttttttcatcattacaatatattctcatgggatatcacatgagacatgtgagaattttcttggatttctcactttgctatcttgaagagtataacaagcagccaaaagtagtctatacaattgtcattaaggtgaaattccagagtcaaaattacatactgggttttttttattcccaaaggagagatcatatatgttttatagagtataagaagccatctttggaaatcaatttttttattccggatttgtttcatgtataatttggccatcattttgatttaagaactaaccctttaaaagtgattttctttctttggaactgtggtatcatttacccctctttagactccatcactactcatttactgaattgccttcatttttaatgagaatagaaaatgttgataacttgtcctacccaaaaccataatactttccaaatatttctagaggaatggaaaattcatggtataaaactagtttctaatgtatatccttttgcttttgtgaagagaaagtataggcttgatatacagcctaccaaagagaaaagaaaaggggattgacagtttattcaactcatataataaactcaacaaaagataaaattactcttaaacacaatttcctaatcttgttttagttggtagaggcagtggtggtaatgctcagctattactaagtttaagtgagaacatttctggataattattgtttgttgatttattactagtattactataaatactatgctaccatcactatctgatgatcagaaattgtatattatttaatctaatgccttgtgttatatgtatgatattcagaaaatttatatgatattcaattaatatcaaattgacttaagtatagatattaatatttgttttgaatctgttgtataccagatacttcacttactttatgctatttgttcttaatcatcattggaggtaaaatttattaaatattacccctatacaacttagaaaaaaccaaagttggaatttgaacccaggtctgcctgatcccagaacccacctttcactagtgctgtctactcactgaaatccctttttgaacagagggattttaaaatgtatatatatttgcttattatcttgtttactaagctcaatcgcctttaaagtacttttgattttaaaggcatacatgtggggaaaaaagacaagttctgtaacttgaatctccttatctttaaaatgtgaataataattaaaacagaattattatggggactcattaagataaaaaatgcaggccctcaacacatggcttggcatttatctttcaaaaaatgagaagtattaatactagtagaactcttattccatcagtgtgccttctccctgccttccaacacatgcacatcatcttcctcatcatccccatcatccttatcatcatccccatcatccttatcatcatccccatcatcctcctcatccccatcatcctcctcatccccataatcatcttcatcatccccatcatcctcatcatccccatcatcctcctcatcatccccatcatcatgttcatcatccccatcatcctcctcatccccatcatcatcttcatcatccccatcatcatcctcatcatcaccatcatcatcctcaccatcttcatcatcgccatcatccttcttatcatccccatcatcttccttatccccatcatctttctcatcatccccatcatcctcctcatcatccccatcatcatttcatcatccccatcatcctcctcatcatccccatcatcctcctcatcatccccatcatcatcttcatcatccccatcatcctcatcatcctcatcatcctcatcatcctcctcatcatcccgatcatctttcttatcatcccccatcgtcctccttatcatccccatcatgctccccaccatccccatcattattcttcatcatccccatcatcatcctcatcatccccatcatcatcatcatctccatcctcctcatccccatcatcctcatcatccctgtcatcatcttcatcatccccatcatcttcatcatccccatcatcatcttcatcagccccatcatcatcgtcattgtcatcatgatctccatcatcattcaccactaacttttctttcctaagacattctatttgccaaaggtccttctaaggtggcacacccataaaaacaacattggcttcaaaaatgttgctcaacctttgcctttctcccccactttggttttccagttgcctttggaaagagccaacattttcacaccatgtgcctcacagcaggaagttctgtcctcattttttccttcacattgcttcttcaatcattcatatatttttaattcagaaaacatctatggagagtctgctataccctgggaatttcacaatgaacatgtcccagccttcaaagcacttaaaatgggaaagaggtataagcaaatgagcaattgtgatatagagtgacaaaggctgcctaatgggccagtactgggtctcacaaaagcacaggagagggccacctaactcagttctaagtggtcagagaaggcttcctgaaaaaaaattacatctgagttgagcccagaaaaaaaggatgttcacctggtaggaaaaggcagagaaagagtgttccaggcagagaggatatgaccatttacaaaaatttggagaagagaaagagctctgtgggtttggagaactgcatgtagtttagtatcaccattgtatagggtgaggaaaggatgtgttgagagataatactggagaaagatgcagagcccagatcatggaaggccttttataccattcttgggagttaggacgtgatcccaaagttagtgaagagctatgtatgattttaagctgggagtacagtgtagaggctgtatccaagggaaaaatcattttattactttcataaataccaacgtttgcggtggggagtgagggggggttgagttctcaacctgagctctatggataatctgtggatgtttagagagtttgtaaactccctgaaattgtagacaaaattattagttgtatatgtgtttgggggatgggaggagatgcagaatccatagctatgtgaaatcctcaaaaggaactatgatccaaatcaatgtttgaaaccactgctctagaggcagaaagctaaaagccaacttatagagcagaaatttgaaatctgccacaaagaatccttctaaagttgcagaatttctcttttaagaaaaatttctcattccttcccctgagttaccaaactcttcccactccaccctgacccactgacgttttgttcctggccactctcccactgaaggctgctttctcactcatggaactggtctctgtgccaacccgtaatacgtgtccaccccagaggctgagaatagacacagcgtcctggtgacttaaaaattgggtaacatctgaaggataaactctgtagtgactatgaaattcattctaatcatttgaaataaacattataaacatatgattggggtttctctgcacggtgcaggagaaggtactgagcaagtaaagaaaatttcctattaaatagaaggggaaagcagctactattcacaattgtgaaggggaaagaagaatactaaaccaaatactttcttctgttttttcaagcttgaccttcatctccaccacccaacctctcacccccaataagttatatcagataagctacaattctttcaagcgaatagactttgttctgtttatttcttcttaatatattttcccagatttgggatctgtgttcctcatctctcagttaggtgtgtgaccttgtgcaagtcaattccttaaactttctgggcagcgtctttatctgtaaaatagagttggatgaaagatctgtaagttgttttttagttcctgctgtgtgtaattgttactgaagtggaaggctaatgtaaacagattttatgataaatatttcttattttcaacttgccagttatctcaaaggattgctgggtacttcatctaaggcatttttaaaatttaatgtgaaagaccaaagtatctcacattatttgtccaatacagccaagtacagcaagggtcaagaaactttttctgtaaagggccaggtagtaaatattataggctttgtgtgccgtaggtctctggcacaactattcaactctgttattatagtgggaaagcagccacaggcatatgaatgaatgtgtatggctgtgttccaataaaattttatttaccaaaaacggtggcaggctggattaggccgtcatgccatagtttgctgacccttgaaatagaaactgaaagatctggtaacctgaagataggagagtttcatcccttcagccttttctgtttacaagctgtttcctggctgatttcctgacaattgttttgttgtcattgttgttgtcgttgctgtgttaaacaacaactgctcaattattttggccacccacaaccacctcactattaatgccccaaataaataactttgagcaagtgggcctgccagcttattgggaatctgaaacagttcagacaacttgtttttcagtcacagagataaataaatggcttcatcggcagacagttccgaagatgaatagccgagaggaacagttgagcagttagttcattgagacagggaaagaaagacaaaaagagggaaagagagaagtgggtagggagaagaaagattgaatagcaaaccagtttgtgagatctactgtacagacttgcccagctgggtattttatcttgaatttgttttgcaaattgcggatgcctagctctagaagccaagaaaaagaaagggcagtcatcccacgccaaaatactctcatggatctcaagtaatttacattacttcatttttgtggggggaaaatcattatacagtccccttccaaaataagtgaagaggaacagagagctattttacccaaatgcctagaacaagacaaatattttgtagagcttttttttttttttttaattaagagaacaatacctgcctggtaactttgcctactttgtgaaagttactgtgtcagtgttcagcccacaaaactgctttaactataaaactgactgaatccaacgagtcttactatttctgtatatacttcagtgaaacaagggatattttgtaccccattctaccttttgctgaaatcaatcctgcctgacagagtccttacaattccattgaaatgaaagaaagaggtagtcccagtgattttattagttaacatcttttttaaagatctctcacatattgaccatgatttacagagacactttatcaaagtaacacctagtagccaggcctatcctctgcttttggatagattttggatagatttacaagattttcttcacacatactatttctttaaatatttatcccagaaaatttaaagaaaaggttagtggtgaatacactggtagaaggctgggacagtgaggtttgttcttaattttttaatttggacttttttacaaaaggacttcaaactgcctttgagagaaacacaattaacacagaggacaggtaatttgtcttctaaggaaaaagggtacccatttaaaagagttcatgtgttctcctaattgtctcccaggtttgtagacatagattgcaacctcagtgagctagtacttcccatggtcatccataggcaagatattaaaccaatgaagtaaaaaattggggaaagcatttttaaccagatttttttccataagttaaaacatgcatccagcttccttgtgagcttacttaacttgtgagcatgttttatttgcctcaagctaaaagattcggtcatcatatacctgatttaccaaatggtctcctaacatccttgagaccattctaggaaataaatgatccatcagtagcacagttggaaaacttaaaaatatagtcaagtggcaggattttccagcaggctgcatgaactttgttaccctcctaataagactgcccacaatccagggtgtgactatgactatctcctctccttggaggtaaaagcgttgcaaacaagaactgtgtccaaattatctccatttctctagcacctgatgaaatgcccaggacataggttattcttagtcagtacctactttttagaaaataagtgaatgaatgaaacccatcatgtccaaagcattttctttgctcagatgctgttaagaatagcagcttggagttctgaagagcattccaaataatacatcaagaatgtttctgtaattttagcagaggttgaatgatcatttgctagggatgtggtagaagaaagtgcactttggagatttggactagaatggacaggtaaggaggttgggtacgtagatggatggatggggtggatagatagatagacagacagacagacagacagacagacagacagactgacagacagacagacagatagatagaaaagtggataaatgggtagatataggctttgctatataaggaagctgttgctatataaagagtctagtatctgtatagagtttgagtccaaaattcttgagtatagcagtttgatcaagaatatctagcatcttcttaaatgacagatgaggatggaaacattttaaaaatatatatatatatgactgtattatgagatcttcactactgatttgagataattttaaaacattctcagagtaaaagagcagagataggatgactaaatactagcagtggttagggacagagcagtgaatttctaatgacaaggccaaagccttagaagaagaggatgctcaccagtgggccttagagtgggctcgggaccacttgtgtacagctcagaaatattgaaatgaagatctcaaatgctttttgattgggatggcattttgagaaaaagatgtgtatcccactaagcgattatgattctaaaactcataaaaatgttgtttgttttaggttcatgagaagtcccttcagtatctttttactgctttatccccaaggcccagaagaatgcaatgcttaataaatacttgttgaattaatgaataagaatgcagtgaacttaataattctaaagacaggttgattgattgaaccttataaaaagaatacaaacatgttttcattggtctggcagtcctgtgctgggttaaaacagggaccaagaagttttatccatacttaagcactggcatgctacactatctcagggactaatactataaaaagacttttaaaaatctcaaatgcgcatgcacacacacactcacaaacgtggaaaactatctaggagtacacaataaatatacgttattgtgcactcataattgatttaaaacccaggaggattggatgcgaaacctattttgtaggttagaaccaaactctgtaattttgtaggtaaaaacagaaaaagaacatgtaaaatgaaagatcatgcaagttcatgatttgaaccagtcattgactattccttgctgccaaatcaatctttaactacggtttgtctagaaaactgggttttctattatgtgaaagactacctagatggaaatagcctaattctttcacaatcacacacatgcatgcatgcacacatacacacatactctcatctatcagctgagaatgtgcgatttttaccacagccttcatatgcccttcaggagaaaatgtgtgttggggaaaaaacagatgatttctattaagttctacatgggttgaatttaaggcaaagagtgaggctgagtatgaaaatcgaagccaatgcatcaaagcagttttttctttcaaactattttatgtactaaagtttgcacaacatgttggcaatgacagcaagcttgtataaggaggtgttttgtgttttacagcaaacataagggcaaaaaaatgcaagagcagtgaaatattacttcaatcatgaattcaaagaatgtatatagtaggtacatggtaaaacccatgagttagaaactacaagatttaaaaatcttttacaaaattacaagaaaggatttatctcattctttcctccataccagggcacctcccttcacccaagcaccagtttcaaatttggaaaacccttcagaccctagggaaaagggtcctaaagtatcttttggtaccgtgaaggaaataaactacatttagcacagtctatctgtttgattagagagagaaagagacatagttacattttcctggcatgcagatcttttataaatcttagaaaaggttggttttccagaattctctggaagttattttggagctcatcaattctgccaacattgagcactctgtctacctcttttctttctcttcattttccccatttctaagtacattttggtctctagaaaataaaaaactgcctagcacagagtagacattcagtatactttgtcaaatgcattaatggattgatggattcatgggtgactaggcattaggtgatctgagattgattgattgattgattgattgatttttccttcaacttttaagttcccgggtacatgtgcaggatgtgcaggtttgttacataggtaaatgtatgccatgatctgggttttaatcttaagacactagtaggtatcataccacctaatggaaatgattatgcattgctttttgttgtcataactttgggtgagtggatatgtggagtgtgtggtatgtgtagcttatcttcccagataaactgtatgccagagatcttaaactcagatggcctacatggaccaggcaaatgatagaagtgaggaaaatgggtgggtataataaagtaaggaatagtagaggctgctgtggccacctggagagcaaaaagagcaatttgtgtttcaaacatgatgggggccaaacacaccacatctgtagtccaggtacacttacagtgtgagctccttcataagactcattggatataaaacatctaatatttaaaaatacagaaataacaaaataataatagttaaagtgtatcaaacatctctactaagtccctggcactgttctaaaattcatcttgttaaattttaggtaattaatgtattacctttatgttgcaaatgaggaaactaaggcacggtacttagtaaatgtacatgattgcactatgcataaataattggatgttaaaagaataaaaaccagaacagcaaagagcaaagctaacagagacctgagctaagcccctaactgagaagaaagaagcacaccccaaaagacagcccatcagagaatgataccccacccatcttctggcatcttcaagtaggaggatgaaggtaatttcccaaatccctggcagctcataatctgcaatataactgagacctctacatttctcagagacctgacacagaacagctttctgtagtctgcgagttctatctcctttgtttcacaatgaaaacaaacgtaaacagactattgttcctatgtgtagaaataactttaataattatgagcagctattgtttagtaagtgcttactacgtggtaggtattggattatctcccctaactcttgtagggaaactgtgacatccatactgttattatttcccttttacagataagaaaactgaggcttagagaggtgaattaacttctgccacatcacacaactaagtgtcagaactggggtatgaaccaaggtggacctatctccggagcttatggtcttgtccattgcatggcaatgcaaagaagatgaaaagaaaagtgttttgaatttttctacctatgcttgtcagctacttaaaaaaataaaccaaaacaaaaaaacacaaaatcttcttttgaaagtcttacataaaactccaaactaacaaagaaaagagcagactctttctattctggttcaagtggagagtagaaagcaaactaccatctccaatacattctctcccaccttgatgtcttcccccaccacttccagctgtctttacgcttccctgatcctgcctctttccccctgtcacaggctctgcttccctgtccttactcagggtgcaccaaaaggcccagcccccaatcctccatgtatttcctcctccttttgccctccaagacactcagctcaccgatcctcatttgccattctgtcaatgaccctcaagtacttgtctccaagtccacattcttagtggcttatagaacacaggcggtgaagtctccgaaattcatgatggatttaaagttgaaagaactgactggtcataggggtgtaaatatattagaggatggtttccttaagctgctcaaaggatgtacctcagagatggctgtaattattttttactaactagtgaagaggatctccccaccctgtcctcactcccctgtccttctctccaacacacttctttccaccttcctgacctgagggtgctcaaccctgggaagagtgctgcatgaactgatgggttggcccaggtttaaagtacaaaaatctttcttctcaatgcttcctgtctcacgtgacaggcagtaaagtgtactgattgagaactagagttgtggggtcagacagacctggcttcaaatcctcctcggccacttacagctatgtgatctctctgagctcaggtttctcatctgcaaagttgggttaataatacaagttcttgctcattgttttgttgggaggagtgaatgagataaatcacgtaaagcacggaccacagtgactggctgataataagcctcagtggatggtcgcccttagaattattttgtaaccctttgcttttgaggcagctggtgagctctgtagcctcagagattactaaagcaaggccaaggctttcggcttgtggcttacttacttacttgtttatttatttcagctcggcacatagttaaagaaagagaaagaaataaaaaagataatttccacaaacagtgtacctaccacctctactcatgtggtatcatgggagttgctttgtggttttttgtttgtttgtttttgttttgagacagagtcttgctctgtcacccaggctggagtgcagcggcacaatctcgggtcgctgcaacctctgcctcctaggttcaagtgattctcatgcctcagcctcctgagtaagtaattgggattacaggcatgtgccaccacacccaactaattttcatattttagtagagatggggtttaaccatgttggccaggctggtctcaaactcctgacctcaggtgaaccacctgcctcggcctcccaaagtgctaggtttacaggcatgagccaccgcacccaactccctgcttaatgtttttatgtcttgtaaccttacatagtttagttggtgaatgacagatggattttttttttttttttctgggcacagtgcttcatgcctgtaataccagcactgtgggaggccaaggatctaggatcacttgagcccttgactttgagaccagcctgggcaacatagtaagaccccgtctctaaaaaaaatttaaaaattagccaccctgtctctaaaaaaaatttaaaaattagccaggtggcgcacgcctgtggtcccaggcactttaggaggctgaagtgggaggactgcttgagcctgggaggttgaagctgcagtgagccatgattatgccactgcactccagcctgggtaatagagtgagactctgtctcttaaaaaaaaaaaagagagagttggatttcttttgttcccatgtattcagtgtttcccaaagcatattccctggaccaatgagtatcagaataacctaaggaggtaccctgatctatagcctcagaatccctgggacaaggccagggcatctgccttataagctgattcccagatcattctgatcaaagtataacaatttttgacttagtgtttatatcatgtaaactaaaatttgattttacattttcttatatttatacatgtaagcatttctccctcacttgggtgataaattctctaaggtgataaccatattttctagtcttcttgtaaccctactagtgtactagtgtagagctcaatcctaaatacatcattgggaattaatgagaatattcaactgggtttagcttactgtcttgcagagtcctgatctgtcaatgccaaaaaattggtagagacctcaaattagaaaggcagttcaccaatacccaatattatttgatatacagttgagtttttaatcaatattttctcattgtcagtgtgtcgggtattcttttactgagattcttgcgccgagatacctgaattgttgactgcggaacaaaatttacaaggccctgagaagtgaagtcctttccaagtttgagtttataaaacagaaacttagaggccttcctgcctttctgtcacagaaagctgggtaaggcaaaatgccttctgtccaaaatagtttcaacttttaaacacgtgaattaaaacatgactttcattgcaggatcagcaatgatacatgctaactttgggaaaaggaaggatttgttaggttatgatgtttattcctgagaaattgagaggtttgccatatgtttttatggtagttttctttgaggttccataaacaccttctggaatgtggaggttccacaatcagagtcctcatgggagcttttccagtgccctaatgtcattaacccagctgctttggttgctgtgttatgcaattatttcttctacatttaaaaagcgattctctgatctccaacccatttaaccatgtttgatctttaataagatgaaaaatgtttggaatctgagtgtatgatctttgtgctacatttttctttttttaattcacagtagcttttccttccccctttctcttctttaggatcaacactctgtggtaggccagaacacaggccccagtccaagtcctaacccctgctcaaatccaaacactggaagtggttacatgaactcccagcaatcactgttgaatcagcaattgatgggaaagaagcagactctacagaggcagatcatggagcagaaacagcaacttcttctccagcagcagatgctggctgacgcggtaaaactttctcttaatttctactgaacaaacctgttgacccaacagagggagtttattcttttccatttatatttactgtgcctacttacgtgacagcaacaaaggtgtgctgactgtaagagaggataattccatacatttagtgtactgcaggaagaaaaaaaaacccaaacttgatttaacaactgctggacacttggaatgcatggcacctctgctaaccagccctgcccagcccaggaatgtctagaacaaccaacatgggcatttgaatcaggcaaaagaaaccagtgttgttccccaggcttaaggggcagaaacagtaaactgaacttgaatcaactcaaatccaaactgattttagagataagagtttcaaaagcaattttaaaagccaacatggagcctcaaaaccaagatttggcttccaaaataaagcaactcacaatgggggattttttaaaagaaaatgtaaaatacatttcccatttgcactgtatatattaggttgatgcaaaagtgattgcgatttttgccactacttttaatggcaaaaaccgtaatcacttttgcaccaacctaatatttgactgtttaagaaagacaagattgtgtttcccacacactcttcatgcattaaccctccttcagtatttatctgctcagccctggtttcattgcctcccttcaaactatttggccaaatgaaataaaaagtaagcatctccaggtgaattagagctaaagtatacagaaaagataacaacaaaatcaaataattttatattcaaggagctttgtagtgagagtcagaaatgcagggtatcacaagtgctataattattcagtaaataataatttgcaatgaggggagagccataaacaaggcaaatcctctcttcaccctagagaagccttgagcccactgaggatatgtcagataaattggccaattgtaatgcatgtgattaaatgccatactctggtaactactagaaatgatttcagaaagaactttctatctaccgaatatctgaaagtggagtaagagatgagtaggagggttatttcagccagaacaaccagcatattcaaagacctagggacaataaaggatactacatattatgcctgccaaggtattgagtgtgcacgagaagggggaattgatgggtaaagatgggataagaagcaggaggatagggcttgagaggccagaatttacattaaaaagcaacagaagagattttaaggatttaacacaaggggaagtactagattcagatttgcattatagtaaaagtataaaatatactaaaaagtataaaaagtaagagaaaaaagtatactttttacagtaaaaagtataaaaagtaagagaaaatgtaatggaaagaaagattaaatccagcctgcaaagattgaggatagtctcccaaagaagtaaaatttgacattgattttgaaggactgtaggattctgatagagtaggtggggtccactattgtaggtggagggtggagcaccaaaaggtgcagcctgggtgtgaatttgttggtgagtttgagattgcattatgaaatatttaatgcctgataaaaagtaaacatagtataacaaccacacttttaaaggaattacaagtggaataagtttcgtattcagggcatgtgaaaagaaatagtgagaagtaaatttatttgacctggaataaggaatattgagaaataagattacagatgacgttgaatactgccataaggtttaagggagtcacagactggatcacaaagtgacacaactggtttcttctagaaatcatagttttgaaaactccagtcctcccccctgttcccttcccctcccatttttatccttataagctaaagaacttagaaacaaggacagcagagagaaaaatgtgtaatctaaggttgacttactgggtacactttcatcactaccatcaatactactaatttcatgaattataacacacagaggttgattttcagctcttgttaaaaggcaaggaagtggtagcatatacattccatgagggtcctggcctggcactgggctaactcccactgggccccagttgagtcaccactaggacaggtgcaaagggcagtggcataaactgtgagatgaatgagaatgaggctgctgtttttgtgatttttaaaaaccattcacatttctctttgtttggacaccattgagggtgtctgtgctttttagcatatccaggaagaagtggtctttgataccactgtacattagcatatgctttgtggtcatttgcagtcagttggcaaggccacataggcacctaaattgagacgttgtctcatgaaagtttgttatccttattctctattattctcctaccaatgaagcacaaagaagagacatgaatagtacttattacaacggacatcgtaattaccaacacgcattgtgtacctactgtatgccaggcaccaagctggattttcacagaattaaatagaaatatgagggaggtcctataattatccacatctcacatttttacagatggagaaactgaagcagaacagatatgtactataacagatgatttctataatgggttttcaagtccaacagattgggttatcattagatattagttcataaattaaatttcatattgcataaaagtattctcaagaatggcctatatgtttacacttgcacagaataggaatgtcagtcttttgcaaaatgtagccatctctattcagtattgcaggctagtctttgctgctcttcagcacaaaagaacaacatggcagttctgtgttatgtccatatgcaaggttattaatctaagtcatttgtgaacgagtagtttaagaaacctaaatttctggatatatatatataaatgatatatgtaatataaatattatatataataatgtaaatatatataatataaatatatatactataaatattatatatatataaatgaaaaccctttgaacaacagtttagcctctggtggagacaagcctgacaaacatggtaaaactccgtctctactaaaaaaatacaaaattagctgggcatgatggcgggcacctgtaatctcagctacttgggagactgaggcagaagaatcgcttgaacctgggaggcagaggttgcagtgagctgagatcgtgccattgcactccagcctggatgacaaagtgagattccatctcaaaagaaaaaaaaaagtcaataattagattgaagatatataaaaataaatccaggtttacaatatagtctatgatgggaagtcaagcaccttcttctctttatctctctctttctctctcactctcacacatacacacacacacacacacacacacacacacatcctgtcttcagtataaacggtagaaacacctaattacataagaaagaatgacagatgcttttggaaaagagtggatttcagaaagtccatgctggcataaaatcaaaactgtcatctcacacaacagtttacagcagagctggttgaacatcaccacatttgggttcatggaacatctcaagctgtttcttaaacatttagggtttgggcaaaaccaaagagcatttcaccaaccactttttcccttaatttgtaaacccatgtttaaaagaaatgtaatccatatgtttctgattcatttacacttagctcatcaaaattgtgttttatatgaattacttatgtgcaaaaaactgtgtctttcaagcctttttcttagcaacaagaatttaaatttggtttgttgttgttttaaggctttttcctctcctttatagtagacttattctactaagaaggtttggaatgtgatgggaaactgagaaacacatggtttaagtcagttctaagttaggcagtgcacatttgttttccagctaatttacccatgtatctattacaaagttttcttttctatttgttgacttttctataattatagtgttctccgtctacctatgctgattatttttattttgaaaattgagattgctttgggatgcatacaaaattgcagtgaagtcattctaaaaactccctgatccataccaaacaagataaaaagcagcccttaattcccaaagctgatatgatactcacagccaagctgttttgttctctgttgggtataaacaatcctacagaatgtcaacctcagacagggttactctgagaccatgataaaatgagacaaaataacacttcataattttgtctaaaaacagacacaaacaaggtcactgtgcaacctccaaaacaccaaacacccccctctgttgttaaatgagtgatagctacttctttattcagttagaattgactttactttgtgacagcttccaatctagaacaaagccccatttccttagactcttccgaaatcactcaaagtccaaatctcaggacagattctttctaacattctcctactgagacaccctgtgacccctcatgatgtgtgttctcccttgctgcaacaagtaataaagccaacagctgtgttcctagtggtctttgactgaggatattgacatattaaaagaatgtctctttttttttctcttagcttccaaagtcacctattctaaagatcaaaaggctgattccaaaaggaagaaatgaagggaggacagcaaacctgtgcttttagaatggggagctgagaaacagagtagcaaggggcctcgtattgtgtgtcaggaaagagcctgagttttggactcaggatttggtctcagttctaccactgtgtgaccttgagcaagttacttagcctaacaaggctttaatttccttattttttaggtggaaataatcatacctacctttaagaattgtttatgcgaaggtaaaaaagagataaaattcatatagtgcctatatcggtacctgttggttatctcctgacatctcctcctacctagggtcatcagatttaacaaataagaatacagagctgggcgcggttgttcatgcctgtaatcccagcactctgggaggctgagctgggtggatcatgaggtcaggagttcgagaccagcctggccaatatggtaaaagcccatctctattaaaaaaaaatacaaaaatttgctgggcgtgatggcgggcacctgtaatcccaggggctcaggaggaggagaatcacttgaaccagggaggcagaggttgcagtaagccgagatcacaccactgcactccactctgggtgacagagcaagactccatctcaaacaaacaaacaaacaaacaaaaacaaataagaatacagaatacctacatgttctgtattttatctgaaaaccctacctcctatgctttccccactgtgtgggaccagaattctacgtaggtacctgccaaagcatatcagatgtgctattctcattgaataaagaagtagctatcactcatttaacaagagaggggggtgtttggtgttttggaggttgcacagtgaccttgtttgtgtctgtttttagacaaaattagaaattagcatcttgaaaaatcacagaaatttagttctcattgaaattgaattgcaaaataaagaaaataggagtagttactagaaccaaaacacatgttgactgttatggaaaagtagaaattatacttccatacaggaagtttattgaaattgaaaagatttgtctctgaattaagactacaaaataaggtcatgatttgtaacccatgattgcaaaattgttcttatattttctgaaattttacaaaattttacatgtattttcacaagtgaaaagggaatgatgcaacataatatgctttcatatcatttctcaaggagaaaattgctccacaagatcagataaaccgacatttgtcaaggccacctccagattataaagaccaaagaagaaatgtgggcaatatgcaaccaactgctcagtattctggtaagtgttcttaaaaattaataaaaattatagctgtgaaaggaaaaaaaaacttcaattttcaataatccctgtaactcacatatgattataatatctttcttagaatttctaactcccatttgactttcatgccaagactacagttaaatattttttagtcctttcatcagtttttgcttagtcatgccctgtactcacatatttcaccactctctggactacctctgagaattcaaaagagctaaatatttttctgttaggttcaatcattctccttccaaagatataccttaacccaggtagtagaaggtaagcagacatttctccctcttagacaggcacatgtgtaactttcacaaatcctagtctttttgtatccaccattgagcccatctccaaggtttccccttcaaagacaaatggtcctgccaccaaggaatacttgaaaagcagatttagttttcacgaagtctctcaaaaacaccaaaggtgaactccatttaaatcacaaagcaaatcttcttaatagctctctcagtataaaataaatggtaagtacaaaagtcccccaaattctctctcctcccgctcatgaaactccaaaagaacctttcccaaacccagcctatattgctctgccttctcctattcagcaactattcaatacgcttctgcccaaaactgtctaaaatgctctgcactttttgatgtaagttaagtttacgctcttgggtttcctaagttctctctgccttacctgttaccttcatctgtccaggaagccataaagaagattctctaaagaaagaaaggctgtgaacacccctattttataaatacttcctggtactgttaagtgtacttttaaatatgttgtcctgacttatttaaaccccctcaaatacaacaggttgcctctttcaactaaaattgagaatggagctgggctcagtcgcacgtgcctgtagtcccagctattctggaggcagaggtgggaggattgcttgagcccaaaagttcgaggccagcctgggcaacatattgagacactgtctctaaagacaacaagtaacattaggaatgggatgtatgttttccactctctaagattacttcgcctcagagcaaaaacaggattctctagttgattgtctcaaggaggctgaaagataagatgcagtttccagccatgtgttggttaatgttgggggtatgttctgagaattgcgttgttaggtaatttcattgtgcaaacatcataaagtgtacttatacaaacctagatgatctagcccactacacacctaggctatatgatatagctgattgcttctaggctacaaacctatacagcatgttagtgtgatgactactgtaggcagttataacacaatggtaagtttgtgtgtatctaaacatagaaaaggtacagtaaaatataattaaaaagatacaaaatggtacatttgtatagggcccttaccgtgaatggagcttgcaggactggaagttgcactgggtgtcagtgagtgagtggcgtgtgaatgcaaaggcctaggacatcactgtacactactgtggaccttataaacactgtacacttaggctgcactaaacttatttttaaaaatttctttctttaataataaattaacttttacattaatttttttgctttgctttacaacttttaaattgtttaaacttttgacttttgtgataacacagcttaaaatacaatcacattgtacagctgtacaaaaatatttcttctctatatccttattctagaagctttttttctattttcttacaatttttaaattatttttaattgacatataattgttcatatatatggggtacagtaggatattttgatgtatgtaaacagtgtgtaatgaccagatcagtgttgttagcataaccatcacatcaaacatttatcatttctttgtgttgggaacgttcaaaatcctcttcttggtatttgaaaacatagtataaattatccttaactatagtcatcctagagtgctacaaaacaccaggacttattcctcctatctagctgtaattttgtatccattaaccatcttctgtctagctttttctccccacatcctccccacctctagaaaccgcaattctattctctacttctatgagagcaacttagcttacacatatggatgagaacgtatggttctgtgcctggcttatttcacttaaaattttttaaaaattttttgtttttattttttaaactaagacacaaacacacacaaacacacattagcctaggcctgcacagggtcaggatcatcaatatcactgtcatccaccacatcttgacccactggaaggtgttcaggaacaataacacacatggagctgtcacctcctatgataacaatgccttcttctggaatatctcctgaaagacctgcctgaggctgttttacagttaactttttgtataagtagaaggagtacactccaaaataattattgaaagcatagtaaaaacatttactatgctttttatatatgataaaggaagataaaaaatgttacatatgtgtagggcactcaccatgaatggagcttacaggactgaaagtcacactgggtgtcagtgagtggtgagcgaatgcatttaataattattttagagtgtcctctaaaatacagccataggaatttttcagctccactataatcttatgggaccactgtcatacatgcagtccttcattgaccaaacattgttatgcagtgcatactgtacttaaaacatggttttttaataccatggcctatgagcgagctttgaaaaagctgggcgccctttggaatactatacacaattcaaggtggatattgaggtttttcttttcctactcacataaaaggatcccaggcacagtagtctagggctggcttgctggatttcaagcatcttttatctttccactccatctctttcagcatgtggcttctatcctaagggctgcctggtagctaccacatcactagtctcatacctgtattccaggtaggaagaggaaagaaaagaaatctgattcccttagccagaacatattcacctggaccctcccgcccaccccatcgacaaggaagtttggggaatgtggtttttcagctgagcacattgctctgtttctaaagaaggctctgtttctaaaaccaaagctctgtttcgaaggaatatagagaggttggatattgggtaggcacctagcagtctcttccacagtgaatattggtgtttttctaagggagaaatccttagcatccaactgctgacactcaagtgggtcagaatcattattctagagcattgcgtttcccatgtcttctgatgatgaaataagcaacaaaacgcaatacaaactctttttaaaatcattttttattttaatcttggtacaataatgattacctttcccagattttgatattaaaaatggagtatgaaaagcacctggaacagtctctgtcacctgttaggagcttttaaacattaactgttactattttgtgatctttgtggaaattctctctattctggttgtttaaaaagattgttttccttataaaccttctcaggccatatcattaaaatacagggcgactacaggtgataatttttaaaacctctacatttttttccacagcattttcataatataaattcccttgatatgaaactttcagatacaaagatgatattgctgaatcttactggcattgtatgtcatctcagttattgttcaagtgtctcctacctggctgttatgtctcttcatcaaacactgcccactacacaatgcactacacagatacaaggagatacaagagactgttcttgccttcaaggggtatgtagtctagttgggggcatatttataaataaatagcaaagctactgtgttcatttggccctcagtttttcaggatgtataccacctacgtatccttaagcagcaggggatagcccacgtttacaattgcagacatgctctccccatccactgacattgtgatattcttatgtgtatttagctctgtatttctcagaatctctgactctctgggcctccctgatcatctttgcctccaaaaatatttcctcgtgatgactttaacctccagaagtcaagaagatttcaatatgttgattagtcactatctgttgtgtggagcctcttattacacagcctgtggcttaggcacttgttccatattgttgcagaactttctccttagttcagctaaaaccaggctctcgtcacatggcaaggaaagattaggttcgtggacacatggaaggatgaggaaaaatggaatttattcggcaaaaaggaaaaataactctcagcaaagtgagagagagtcctgctagcaggtttcccacctcacagattgaattccaggtcaccacacaggaacaggagaggccaggctcctcactgctgcaaatggcacgaacttcccaaggctccaccctgtcttcccagtgcacaggtgggcattattcagaaagagtcagtcggaagcggtcttcatccaggaccagcagtccagtttttcagccttcaggctgtgttaggtttgaaggcgtgggggagacccttgtctgcctcctgggtctctgtcaatatcctatcagttattgacaggcatcagtttaactggcaggcactttgagactccacagattgcccaatactaagtgttaaatgaaagattcgaagggcaaatactgctggagagaggaggctggaagataaaagaaagtttaatggaggagcttcggccttagcctgaaccttgaggaaaatatagggctcagtgaggaagggaaatcccataagcaaaggtggctcacagtgcattgagtaacaatttgatagtaactacacctcctggaactgaagaatttctttatgagataatttctagagcactgaattccagatgtttaaagagatggagatttaccctttgaacactggggagtcactggggtagcttcttgaatggggatgattcaaagaatgggacatgattttcaaggccatagtttgggaatattaatctaggagccgtgtgtagcattcatccacactttctcatttggacctggggtaaacagtaacatggatttcatgagagctgactaatcaagactgtagtctctggacttggaacatagtaaagctaattcaaaatggaagattgactattacctcccttcaatgacttcagaagaggaataaaataaaacctacaagatagaactattctattttagtcttctttttgtaatatgtaaacttctgaaccaaaaagtgacctcaggtgctccttcctcctaagagctgtcttgttccttttatataatttatttgatcattatttcgcctaaattgtcttacacctgaaagcagtttcagattgatgagttattgaaaagtgcagttacagaggagataacatgctgctacgaactaataaaattctcttctttttctcaggtggctcatccacaataagcttaaactctaaccaggctttggcaaacccagtttcaacacacaccattttaactcccaattccagcctcctgtctacttctcacgggacaagaatgccatcattatctacagcagttcagaatatggggatgtatggaaatctgccttgtaatcaacctaacacatacagtgtcacttcaggaatgaatcaattgacccaacagagaaacccaaagcaattgttagcaaatcaaaacaaccctatgatgccacggccacctaccttagggccaagtaataataacaatgtagccacttttggagctggatctgttggtaattcacaacaattgagaccaaatttaacccatagtatggcaagcatgccaccacagagaacatcaaacgtaatgatcacatccaacacaactgcaccaaactgggcctctcaagaaggaacaagcaaacagcaagaagccctgacgtctgcaggagtccgcttccccacaggtacacctgcagcctataccccaaatcagtcactgcaacaggcagtaggtagccagcaattttcccagagggcagtggctcctcctaaccagttaacaccagcagtgcaaatgagacccatgaaccaaatgagccaaacactaaatgggcaaaccatgggtcccctcaggggtctgaatctcagacccaatcagctaagcacacagattttgcctaatttgaatcagtcaggaacagggttgaatcagtcgaggacgggcatcaaccagccaccatccctgacgcccagcaattttccttcacccaaccaaagttccagggcttttcaaggaactgaccacagcagtgacttagcttttgacttcctcagccaacaaaatgataacatgggccctgccctaaacagtgatgctgatttcattgattctttattgaagacagagcctggtaatgatgactggatgaaagacatcaatcttgatgaaatcttggggaacaattcctaaagaagaaagggaagacaatttacaaactccaagcactaaaaggcagtatattacagaaactctgtagaggctgaactgttgatgttcaggtggactacatgaagataacatgcttaaaaatggaaagcagaaagtaactgcagtgatgaacattttggtccaaattcttgttttaaatcttacacctgaaagtaaaatattgggatcacttttccctgtctaaactccaggatacagtatccaatttatccaaacagaactgtggtgtcaatgtgtaattaattgtgtaaaatagccttcccaagtttctttttccctggaaaataaaaaaggtaatagaacttgtagtttatttaaaccccatgtcatgaggaggtactagttccaagcaacaaactccttaatttgctctaatagataggtatggtttaatctttccattgtgtcttttcatttaattttcctgaagcttgcaggatagattgaaatgttataggtttgtttggagtaaccaaacagtatgcaaattaagaaaaagccagagaacctagaaaacatccagtggattacagaatttcttccccatattcactcctcacttttacaattttcccacaatcctctacttcagtgggatgctgtgtctagtgattaaacaaaaatatagagctg

SEQ ID NO: 46 - DNA, 6153 bp, Homo sapiens
ccagccttcagccggagaaccgtttactcgctgctgtgcccatctatcagcaggctccgggctgaagattgcttctcttctctcctccaaggtaaactcaggagctatgaagtgtgggcatcaagctgccaccctctgccaggctgcctgtctgcctgtaaatctcatgttctgagagccaggaggccccttctcctgggaggcagcactcctgggtcccttttagtgctctgggctgggacttgtctaagaggatgggttggagatttttagggagatgggatgcaaaaccccaagtggcatgagacccagcttacaggtgcaatatcagcgatctgtggccttaacactgtcacctcttggagccttaattacttcctctgtaaaaggaaagttaagttgcctttgctgctcaaaggactggatgattttagaatcccctttattataggatccaatgtgacagtgagttcatctttaaggatagatgaagccatctggagtggttgttaaaaatgtgggcttggtggccgggcgtggtggttcacgcctgtaatcccagcactttgggaggccgagacccacggatcacgaggtcaggagatcgagaccatcctggctaacacagtgaaaccctgtctctactaaaaatacaaaaaaaattagccgggcttggtggtgggcgcctgtagtctcagctactcgggaggctgaggcaggcaggagaatggcatgaacctgggaggtggagcttgcagtgagatgagattgcgccactgcactccagcctgggcgacagagaaagactccatctcaaaaaaaaaaaaaaaaaaatgtgggcttgggtattagccaattgtgggtttaaaccctgactttgccatgacctggctaggcagccttgggaatattacttaacctctctgagcttcagtttccttatctataacatgtggttgataacaatggtacctacttcgtggtgttgttataggtacaagtggactgcgtgccataaagtgctaagtactcaatacatgagaggagtttcttgtttttctttttaacttaagaaaatagcattgatctgacaaagatcatattagaggtgagtctgagggcatatgcattttccagttttgtggtataaaggaaagagcataggttcatgaattctgactgtcttgaatgtgtacccatgttgcacaatttgctgtgtgacctttatcccttgtgatattgtaaaatatattttttcatcccccagttcctggcatacaactcctaaaatccttggaatcttcaaagtgataaatatcttttgagtgataactgtctaataagttgactgatggctggcatttcctctggggaggggagaggggctgaaggttaagctgattaccaatgggcagtgatttaatcagtcatgcctatgtaatgaagcctccataaaaacacaaaaggacagggtttgacaagcttccagatagccgaatacaaggaggtctccagtgggtggtgcttctggagaggaatggaaactccatgccctttctcccataccttgccctatgcatctcttcatccggagcatttgtaatatccataaggaaccagtaaatgtagctgggtatggtggctgatgcctgtaatctcagcactttgggaggctgaggcaggcagattgcgtgagttcaggagttcaagatcagcctgggcaacatggtgaaaccccatctcaaaaaaaaaaaaaaaaattagttgggcgtggtggtgcatacctgtagtcccagctatgctggaggctgaggtgggaggatcacttgagcctgggaggcgaaggtctcagtgagctgagatggggccactgcactccagcctgagcaatagagtgagaccctgtctcaaaacaacaacaagatcaattttttttttttaaagaaagaaaccagtatatgtaagtaaagtgtttccctgagttctgtgagctgctctagcaaattagtaaaactgcaggagggaattgtgggaaccccagtttatagtcagtcagaaacacaggtaaaacaacctagggctttcgattggcagtctgggggactgaaccctcaacatgtgggatcggccactatctacccatagtggtgtcagaattgaatttggggaccctcagctggtgttcaccagaggactgattgtttgcttgctggtggggagaaacccccacacttctgctgtcagaagcctctcgtacggtgagggaaactgagtttctttttccacacacccttctgtgctttctttctgaaaaaaaaattaagttgatgtgaggccaacgtttggtgccagtagatattcaatgcattgtaagaatgagtttgtcttaaaaatttttttaaagcaaattctatgcgtcaggcactgttcaaagtgccggggatacagcgtggaacagttattaaattaacaagtaccctctgaaatagactctattaataccccaattttagaaataaacaaactgaagcccagagaagcaaagtaccctagtatcctgcccaaggtcacttgggtacaaggccaggaacaaccacagtcatgatattgacatctgcggagcttaccacgtgccaaacaccgtgcgaatccgcacagaatccgcacacccaccggttggggcagggacatctctgccactgatgcggagaggaaacggattcccgaggctcctgagagggatcctgggttccattcaccacacctcgctgctttttactgattcagttggaactggaagggaaaacaacggagctgatgagctccaaaaatgctccggggaccatctccctctcgcccgttcgcaggtctagtgacggagcccgcgcgcggcgccaccatgcggcagaaggcggtatcgcttttcttgtgctacctgctgctcttcacttgcagtggggtggaggcaggtgagaatgcgggtaaggatgcaggtaaggggacaggtaagggtgcaggtaaggatgcaagtaagggtgcaggtaaggatgcgggtaaggatgcaggtaaagatgcgggtaaggatgcaggtaaggatgcgggtaaggatgcaggtaagggtgcaggtaaggatgcgggtaaggatgcaggtaaggatgcgggtaaggatgcaggtaaggatgcaggtaagggtgcgggtaaggatgcgggtaaggatgcaggtaaggatgtgggtaaggatgcaggtaagggtgcaggtaagggaacagataagggtgcaggtaaggggacaagtaaggaggcatataagggtgctgggggatgggaggagtgtgggataaaggagagagtttcagggtccggggtgtagagggtctggcgtgcttctgtagagaccctggcgtccattccaatggacagcgcagggttggtgtcgccagagtcccagattcaaatcccactactctgttcattcctccatcctaccgaaatttactcgatgctagttctgtgccaggctcggcgcctaggggaaagtcccttcccctctgtgaggctctctgagtaggagagtggtggcccccgcctccaggagtggtcctgagcatcagacacagagtaggggacccctgtgtcccaccccaacacccccactacgctttgtctgctctcctgcaggtaagaaaaagtgctcggagagctcggacagcggctccgggttctggaaggccctgaccttcatggccgtcggaggaggtgggtctggagggcgaggatctcgggcaggcggggcgggcctctgccgcggacgctccctcacctgctcctgttcctccaggactcgcagtcgccgggctgcccgcgctgggcttcaccggcgccggcatcgcggccaactcggtggctgcctcgctgatgagctggtctgcgatcctgaatgggggcggcgtgcccgccggggggctagtggccacgctgcagagcctcggtgagtgcggggcctgggcccctggtgggacgttctttactattattttcatcatacatctggggaaactgaggcactcaggaattaagtaatttactcaagtaattaagtagtttaccaggaattaagtgattctttatttatttattttgagacagagtctggctgtgtcacccaggcaggctgaagtgcagtggtgtgatcttggctcactgcaacctctgcctccctggctcaagcgattttcctgccacagcctcccaagtagctgggattacaggcacacgccaccacgcccggctaatttttgtatttttagtagagatggggtttcaccatgttggccaggctggcctcaaactcctgacctcagctgatccgcccgcctcggcgtcccatagtgctaggattacaggcgtgagtcaccgcgtccggccagaaattaagtaacttactcaagtctccctgctagtttagaccagagcctagattctgacccagtcagtacaatgcgagaagccccattctcagcctcaaaggctgggtgcctcactgatgctttggccaaatcacaagcctcagttccctcagcggtgcgtggggatgatcatcctcagtttaacattttttgaatctgctcaatctcagagaccacagtagcaaagaaacatagtagagtaactcaaatcaatctcacaccaaactggtcttgacttgcactttttgaacaccatggagggaacagataacagagctcacagtgactcttctatcgattgatcaatctattgatctatttattatagataaaggtcaaaacaaggtctcacactgccaggttggaatgcagtgcatgatcacagctcacagcagcctcgaactcccaggtttaagctatcttcctacctcagattcccaagtagctgggactataggcgcataccgccacacactggcttttttttttttttttttttttttttttgtagagacggggtctcattgtgttgcccaggatggtcttgaattcctgggctcaagcaatcctcccactttggcctcccaaagtgttgagactgcaagcatgagccactgtgctggcccagagtgactcataaaaaatggccttacttccctctctctcctctctccccacccacccccacctctctctcgcgctctgaggcctccaaaatcctggagaaaacctgcccctgacaaacttccctctctgcctttctgaacctcgcatcttctcttctctcaattctgaatggcaaaagcccaaagaaccagcccaaaagaagagagccctgctcagacggggccacacccctgcaatgggaggggaagagtgtgggcgagcccagggacacctctgggctatcagctagttgtcctctcacatggcacatagctgtgacaagatgaaatgatccctggcttgtgaaccccccacacccacacagggctccacgaaggtggctgttagcatgattaataacatggcgtttccatggcagacatcaggtgaaggagccattatttttgcctttttcatcactgaaacacatctctgatttgggatgtcaaggcaatgggactcactttgtagtagtgccatcccctctcagggcctctgtttctccatctagacataaggggttggactcaaccaatggtttccagacatttggattcccaggcctggcacttgggccccagtgactcatctgtgtttgctttacaggggctggtggcagcagcgtcgtcataggtaatattggtgccctgatgggctacgccacccacaagtatctcgatagtgaggaggatgaggagtagccagcagctcccagaacctcttcttccttcttggcctaactcttccagttaggatctagaactttgcctttttttttttttttttttttttgagatgggttctcactatattgtccaggctagagtgcagtggctattcacagatgcgaacatagtacactgcagcctccaactcctagcctcaagtgatcctcctgtctcaacctcccaagtaggattacaagcatgcgccgacgatgcccagaatccagaactttgtctatcactctccccaacaacctagatgtgaaaacagaataaacttcacccagaaaacactt

SEQ ID NO: 47 - DNA, 7803 bp, Homo sapiens
agagcactgctgcggccgccgccattttagcgttttgtcagaagcgtccgcgccgcgaggaggaggccctgctggtttctgtgcgggtgagactccgagcctttccactgcctttcttgtactgtgttaaatcttctctcactcccttgggcttcgggggtgtcctggtaggtccgcagtctccacacccgtcactgagagccgacctcggtcctcggcattgcgcggtaagccgggagcagcccttcccccaccgccccctgagaataccttgctttttttcgcccaccctgtcccgcgcccgacatggctgctcttggagcctcgagatttccactgggataaccccctttcccttatatctgacagttacattctcgtttcgggaatttctcgggccgtgagacatcgtctggttaatgaatctgaagctcttttccgcggccgcgcatttcagtgttcggcaggagctaggacggtgccccgagagaggcgttcaccactccagtatttcctttatctcccactcctcgctgtctgatccgagtcgcgcgttcattacttccaaaggaaactcaaatgtagctattacaaggcccattttcccggaaatgatggctgctttggttcctacgtgaggaaaagcctgttgataatttcaggcaggcagtcagcaagcctagtagacttttgttttctgttgtcctcctagtggatagaaaagcctagtacccccatttcttcatatgctgtctttcatgcccatttctgttggaaggtatcggttcttaccaaaccctttgtctactaaggacctccctattgcagacgtcttcttattcttacaggttcatggcggctactatagcaggccttagttcactcccacttccatttgattattgtgtggaggtgtgtgtgcaggcgtgtgagagagaaaactggaaatatacattagagtgaaagtcgttgtcttttgtgaacggatgtgggcctgaggtcttttgtcagatgtcttgtttttctctcccaggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggtgaaccaccctctttgggtagagggctgaacacaaggctgtgtgcagaaaatggttggataagtaaaaggagaggtttggtaaagataacagctgttggctggctggtgatgaagaaataagtgtgggtgatggacttcttatgatgtagaatgcatgggacttaggggctttaccttaggcaaatgtctcctggagaaaagccactcaccttttatttggagcccctacggcttttgtgcttatcagtgcagaaacccttttctttgaaggctttctgagttactgggccttttttattttttatttttttgtagtagagcacagttcagagttcctcactctgaatttattgccctcagcacaggatcagaattctgcattttacgtgaagaacctctcaaaaacatgtcaagcgacacttataggaccagaatccttgttaagctgtcctaccttacacaaactctttaaagggttacagctcttgttgcttttatattatacctgtaccaagggattgtattttgagtttaaggccactctagaattacaaggctgattttaggacttcctggggaggaggcactggggttttaggggcggtaatgactgtcttttcattggtttggggggctggactttataagattttggtgaatagagcacttagatttgtgttatcttggagtcttaaccaaatgaatcttttgtgcctggagggcagcatgggtgatatgtggattgtcacttcatttggaagcatctcaaatccccagcattttgaatgcctacatgttgctcaaaggaaatgcttgttagagcattttggattttgaattttcagatttgggatgctaaaatggtacgtagaacgcaaatattccaaaatctgaggtctgaagcaacagtggcagttcaggggtggtgatcatggtgagttgctatctgaactcttctttcacctcctttgggttcccagtgtcaaaaagagtggtgtccttttttagcttaattaagcaggactgaacaaaaataataaaaaataaaaaaagccttattcaaattatggagtatttccgtgactccttgctatatttcaaacctgtgttctgacagtgtagtttgccgattctttttctgggtactacctttgttaagagtcattgctgcctttggcgtccatttcccttaaattgggcttttttagagctgagagtctgatcattatttcccctagtaatgggtgccctgtgtcatgggcattgctgtgcgttagtaaagaaaagtgacacaggtctctcaggtctagtttgctttcttttttttaattggcaagttgagaattattttgtcaacaacttaattgagagcaaaggttgctcttgtggagggtttatggtgtgatacctaatttttggactgtttcccacacttcagcccagtcagaagaggtggtgtctgcttgtagcagttaggtttaaggagaggacagtgtggtcttgattcaggacaaattatccttatataaaactctgggtgtctgaaccctaggtcccctgacactaacctatgcttagttatttttaccttattttatgtaatattggcgtttctcatttcttaatactgttctggtagaattatagatgtatattgatgagcagtagttattagggtggtcttttttcctttccgtttctcagtgttgggtatcttctctattgcttgcccacttaaaatctcttttagatattttttaaaatttaacttctttttctggcgttagaaccaacagatccttagattaaggcgtttattaatgatctttatgtctggaatgtgcatagttgcttgcttagttgcacttgttttctctggttttgttaggtgccaaagtggccccctgggcaaatgccagagacaagctagcactttaaggcacttaagtgcataattgcatatctactctcttttaataacctgcaacctaaacttccagctgtgtagacctccttgatattttgttccttccacccccgtttccctattgtgttttctggtctcccagaatctaacattaattttgcaaggaaaattgtgtgtttaccactttctctaatgttagaggatccatttgttgactctcccttgcttttgaccatttactcctttgacaggtgtatgtttaggtgcatcataaccaattgcattgggaagtttttgcaggatttggatctcttctgaattttgcttaccagtaagctggtagatcatgttaggtagaaattgcttctgtagagacttactaaaacttagttttaacttttctagaaaagtttctgcttttattacattttcagaagtaatacttttcatttccagaatgcaaattttaattttcaggaaaaatattaggtgtatgttcttagttacgctctcagatatgtagttgcaggagaagtactttaattctgcttaaactgagcagtttggtccactgactagtataactagttattctccactttcctcaggcacgttttcttccatgttttttacagtattctaaaatttcaggcatttgagaacaatctgtcctgtttttgccctgtttgcctttgaccctagtagagggtcactaaaattaactgtcagattgtaaagaatcctcgttaaagcaatgatcagaaccagcagtttaaagggcccagttaagggagaagtctgtccttcaacttgttgtgcccctctgtctccccagttcatgagggtttttccagagatgtaccttgagatttgcttgccacattcagctgtggattgagtctagatcattctttaatagtggtaatcattggagtcttttattcggttcttttaaattttttgaggagggtggagaactggcctttacttatattcctttgcttaatgaaaatccatcttgctagtaaggattggaggtgtcagaaaagacttgggcactgtttcttactttgacttcttttgactttgagccgctgtttggagatgatttttacctgtttggagatgattggagcaagagtagtttatttcttaagcatttaaactgttgttatagctgaaatatttcttcatctaagtggtcttttcctgaaatcaggtcattatactgaatctatatgttgagtcttttttttttttcctttttatcttttcctaaagatgagtcctgcattagaattgtctagataaagccattgctatgaccagtgtctggggtaggggctggggctatgactaagagtgatagcaacccttcttgcgtctgtttcttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgagaggggtggggtgttccctcttctggttttgccatccctcctgcagcctaaagggctccaattaggctgccctgcttgcttgcttgcttttgcagggttaggggaaggttactaggatggctcacaggctagagagaagtcctaactgcttaactttaaaatacatagagttccttggccctcatggctatttttcagggcttctggtagtgggagtcaatttgattctatttgtgcctagaaaaataaagaatgatgtgctggtgaatcttgggtcacctatgtactatactataattgaaccttacctggggacccacacgttcaggctcaggtgttttgtttcttagagcctttgttaagtttcctacgtgtgcgacattcctaaggtcttcaagtttcctattctgttttgtgctgtgtgaaagttctgatatgacccctgatgataaagtccataactgtagttaactggtcatcactgctcaggtcccagttactaagaagactaccaaaatggcatcatcttaatcttgaagcgtatttctgacattcctgaaccgttcaacccttatgagttttatagaacttatttgatggtaagttggggtagagagaaatacaaaacttatcttttataaagttccacaaggaagtctgggcatagatgctaacactcaccttctctgcccagctcagatttattccctgaatagagtgcccactccattgctatatctttcagtctgtcctataacagcccagcctgtcacttacttagggttttttttttttttaagtaactattcccacagttctagttttgacatcatctactttctcagggtatatgttttaagaatgcaggcacacctgttaattttactcctttggtaatgttgaaatccagggttgggagctttgccataagcaaatcactcccttcttcatcttctcactagctgttttgggcatttaatactcttgagccagcagctctaccctgagtccgctggctttttccactgtcatacattttgagccccatgatccatttggctctccttgaatatattctcttctgatacttgccagctttgggctctaggtgtttgagattattgttgtacttaagggtaaatctcaatgcccttagttttgaatagctcccagtatgtcccacacattaccattgatccttaattatagtaactgtgtgagtgatagataactgtcatctttgcagttagggcagaaggtatgtggctttcccagggtcattgggtaggcagtcactgattgggctggaaaagagacttgatgtgtagcttatacatgcccttctgcaccttctttccaaagttagtttcttccctagttggaattggatgtcctcaggtcttaaaacttgtgcagttgatgctacttctatctagactttgaatgatttttaactcggaccttggcagtaactcctagatagaaaatactgttaattttttttttttaaacctcagggagctaattggaacctttccatttttcctatcctctgctgacagcttgtgatgtggaattaccttctctgaggaatgctaatgttaacatcatcaagagcaaggaatgtctctttgcctacttttatgaaacaagatttgctattaatttaagaccttagtctgaggttgtttagcctccccagttactctctggccttcaagctcttttcattgttagagattactgtgatactgggggagaagggtacaagtaaacttaaaaggagtgtcaagttatcagactttgtaaagatgttgaagttttaaatgggaaagcccttttgagctttgctgtaaagccgctgtattgtgctctctttcaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaacttag

SEQ ID NO: 48 - DNA, 6856 bp, Homo sapiens
cgcagtcgtcgcgccgccgcgccaagcatgcaggtgagtgagagggacccccacgcccccacccgcggggagcccggccctgcccttcccggctccgcgccctgcgcctcctgcccctcccgacgcggtccctcgcccgggacaaggcctccagcctcccagcgccccttccccgaagggctctccatccctccgcggtcctggctcgctcccgccctccctggcgcagccgtccccgtccccgcggctgcctccatcccgcctcggctcggcgggcggctccgcgcagtctcctgcttcgggtccccagtccgctctcggcactccctgcctcggggtcccttcgccgacctccttttcctcgtctccccccactctcgccgctctccagccctgtgcggggagtgcgggcctgcgggatgggtgggatgggggccacgctggggctggggcccggctcccgcaccccgaggctcctgccccacccccagctcgtctcctgcgcacaacaggtcggtgagaagctgggagaggggtgggggtggcgcgccagcccggggactgcgggcttcctggagggggcggctgaagctgtgcggggcccagggactgggttggcgctggctgggggtggggatgcacaggcggaggggcgatagtcctagagtcagctggccacagatgcgccctgggagcccttctccgcttcactggttcgctctacacgcctcgctccctccctctagctttcttcctttcccctctctctcccttcttcccaccatgcccccatccctatgtctttcggtatctccacatccctttacatttgggggagcaattccgaactcctccatctttgctgctcccgcctctgcttcccagcccgttcctcgtgtcatttttccttaagcatttatgttctctccttccccacttcctttctccccatcctgggctttccccccttttctcccatccccttactctccactcctctggctgtcctgcctggaccgctctctccttctcctcctgccccttcttcccctgcacctgtgaccccttcatcctctccgtttcccctccctgaccttttctctcatcctttcctcccttcggcatcctccacagttcgagtcttctgtacccactctcctcctctcttcccagttctctctttttcaggactgcctgctctctctcaccctgcactccaggccagcttcctcttcacatttctcctctctcactcttaaccagccttccatctcccagcccttcaccccttcccatctctcccactgcctgcttccccacgcccttcccgtgactttcccatcttgttcccttgttgttctctgggaagattcaatgggcagatttatttattttattttttgagtcggagtctcgctcttgttgcccagactggagtgcaatggtgtgatctcagctcactgcaacctccgcctcccaggttcaagggattcttctgcctcagccctctgaatagctgggattgcaggcgcccaccactacccccggctaatttttgtatttttagtagacacggggtttcactatgttggccaagctagtctcgaactcctgatctcaggtgatccacccgccttggcttcccaaagtgctaggattacaggcgtgagccactgcgtctggcccattgggcagatttagacccagaatccacaggaaacgggtatcctatcttcactccctctggggagcctgcccctcctggatccaccaccctcagctctgagaacacaccctttctctttcaaaaccaaccatcccgattttcccaggattctttacccaggagagccacatttgagggggtggtttcttcctgactccacctcccttcagagggcacctatgcacttggatgattaaacattaagagcaaaaattatattctgtagtttttctcccactcacctctctctttctgtctctttccttccatccctccagctcttcattcctttctcctgaagatgcagactcctggggctaatcataagacaaatgcctggcactgccagaggggtgggagggctgggagggctggaagggcccccctgcacgtacacacactcactggcttgctcagattgacttccccatccctccccctaccctcagactccctccctagcggtaggtgctcaaggaatcacaaggttcttggctctaaattaagatccaagaaaagcctggagctgtgggcagaggaagtgagaagaagggaaatcagagaagccagagtagaccctggggtggagaggtaacagggacctgagaagttgtagatggggctggagtctggtcaggcaaccacgctggagtttttcccccaaaaggatgctaacaaccagtgaatcctgggtgcagccgcatagctggcagctgggtggcctgggagggcagatgcgggtagaattggtggatgaattagctggggaagtacacagggcagggctggggtgtgacggccccctttttctcccagtaaaggctgaaaatctgggtcacagctgaggaagacctcagacatggagtccaggatgtggtaagtttggcccagcagagggagcctggagaccacattccctggggccatgactccttccttcctagacccatccagagccttcccatcctgagggccatcctcctttggaagatgggaaatgaggcgagtcttcccaaggcccacctgctttcacagggaaacctggaggtttctggtgtgaacctgtccctccctcacataggcccacagtaggcctgtgtctcagccacgctctctcccttcttgcaggcctgcgctgctgctgtcccacctcctccctctctggccactgctgttgctgcccctcccaccgcctgctcagggctcttcatcctcccctcgaaccccaccagccccagcccgccccccgtgtgccaggggaggcccctcggccccacgtcatgtgtgcgtgtgggagcgagcacctccaccaagccgatctcctcgggtcccaagatcacgtcggcaagtcctgcctggcactgcacccccagccaccccatcaggctttgaggaggggccgccctcatcccaatacccctgggctatcgtgtggggtcccaccgtgtctcgagaggatggaggggaccccaactctgccaatcccggatttctggactatggttttgcagcccctcatgggctcgcaaccccacaccccaactcagactccatgcgaggtgatggagatgggcttatccttggagaggcacctgccaccctgcggccattcctgttcgggggccgtggggaaggtgagtgggaaaggctgggagggatatgacggatggggaggctgggtgaagacaccaaggggcagaaatagaggccttgtctgttagctccttcaacaaatgtgtcaggcactatactggcacaggatgcagagataaagacaccctctcggagttcaggtccactggagcagacagacatgaaaggacttggagaggagtcatcgtaataaatgctttaatagaggcatgtgcagcatgatttacaaaaaaagagaagtgagagtctcctcctgcttggggatcaggacaccttcagagaactgacatttgagctggcccttgaaaagagagtgggagtattctgggcagagaatgccatgaatgaagggcactacccgggagatgtcttggctcagggagtgctgatggaggaacagggcctgtggtttgggagttgggccatggcagagactaggacatctccaccccttagtttccaggcatagtgataggttctcgctgatcatggggcctcatcctcatcacatatacacataagatttggtgaaatacatttgggaaagtggaggaaaagagctgaaaactcaggggaatgctggtgataataaagagtgaggctccagaggggcagacagagccggcagtgtggatccacacagcaatgccactccagccgacagagcccacagcccagcccccagcccctcttggctcctaccacctcggggctccctaaaactttcttcccaccccaatcaggtgtggacccccagctctatgtcacaattaccatctccatcatcattgttctcgtggccactggcatcatcttcaagttctggtaagctgggaggaggaaggtgctggtggatggggacggaatgtttggcagtcgaggctctaaccacgaggggcagtggcagcaattttgctggggggtgggtgggaaatgctggatgaaggcaagaccttgggaaaagataattaaggatttggctgggggaagacggtgagaaatcagggcagattctgtctcccagggaaatacaaggataagggagggcaggggaattattcctgtgcattcctggtgagcctcccctgcccctacttcctccaagacagagaaagctgacccagtctgcagagcccttcttagggttgcctggggggagcaagaaaacctggagctttctttgcacacatttaataatggatcactcagtccttcacactttactgagagaatcattagactcaggtgtccaagtcatcagcttgctttgaactagaactaaacctgccagttgtctgctgaagacagaaatgactcttctgggcatgtaggggagaggacattgtggtggtggggaggggatattaattttgtcgatctggatcaggtttggagggtaaggaggtttagattaccaagctcccctagagggcaggggaagtggctttatgggcacagagtcccaggggatttagtagagagaactgttaaaggccagtttctctgctataagatgttgggagtgactgggtgaggctgggggtgaccactggtgcaggcccaggatgggggctacttgagtgtgcaagagaacctcttttcctctggtaccccagctgggaccgcagccagaagcgacgcagaccctcagggcagcaaggtgccctgaggcaggaggagagccagcagccactgacagacctgtccccggctggagtcactgtgctgggggccttcggggactcacctacccccacccctgaccatgaggagccccgagggggaccccggcctgggatgccccaccccaagggggctccagccttccagttgaaccggtgagggcaggggcaatgggatgggagggcaaagagggaaggcaacttaggtcttcagagctggggtgggggtgccctctggatgggtagtgaggaggcaggcgtggcctcccacagcccctggccctcccaagggggctggaccagctcctctctgggaggcacccttccttctcccagtctctcaggatctgtgtcctattctctgctgcccataactccaactctgccctctttggttttttctcatgccaccttgtctaagacaactctgccctcttaaccttgattccccctctttgtcttgaacttccccttctattctggcctaccccttggttcctgactgtgccctttccctcttcctctcaggattcccctggtgaatctgtgatgcccccaatgttggggtgcagccaagcaggaggccaaggggccggcacagcccccatcccactgagggtggggcagctgtggggagctggggccacaggggctcctggctcctgccccttgcacaccacccggaacactccccagccccacgggcaatcctatctgctcgccctcctgcaggtgggggcctcacatatctgtgacttcgggtccctgtccccacccttgtgcactcacatgaaagccttgcacactcacctccaccttcacaggccatttgcacacgctcctgcaccctctccccgtccataccgctccgctcagctgactctcatgttctctcgtctcacatttgcactctctccttcccacattctgtgctcagctcactcagtggtcagcgtttcctgcacactttacctctcatgtgcgtttcccggcctgatgttgtggtggtgtgcggcgtgctcactctctccctcatgaacacccacccacctcgtttccgcagcccctgcgtgctgctccagaggtgggtgggaggtgagctgggggctccttgggccctcatcggtcatggtctcgtcccattccacaccatttgtttctctgtctccccatcctactccaaggatgccggcatcaccctgagggctcccccttgggaatggggtagtgaggccccagacttcacccccagcccactgctaaaatctgttttctgacagatgggttttggggagtcgcctgctgcactacatgagaaagggactcccatttgcccttccctttctcctacagtcccttttgtcttgtctgtcctggctgtctgtgtgtgtgccattctctggacttcagagccccctgagccagtcctcccttcccagcctccctttgggcctccctaactccacctaggctgccagggaccggagtcagctggttcaaggccatcgggagctctgcctccaagtctacccttcccttcccggactccctcctgtcccctcctttcctccctccttccttccactctccttccttttgcttccctgccctttccccctcctcaggttcttccctccttctcactggtttttccaccttcctccttcccttcttccctggctcctaggctgtgatatatatttttgtattatctctttcttcttcttgtggtgatcatcttgaattactgtgggatgtaagtttcaaaattttcaaataaagcctttgcaagata

SEQ ID NO: 49 - DNA, 6856 bp, Homo sapiens; identical to SEQ ID NO: 48

SEQ ID NO: 50 - DNA, 530 bp, Homo sapiens
  misc_feature (441)..(441): n is a, c, g, or t
acataagttatagagagcctcaggggaaccccgagccgtctcccaccactctcccaactccagaatgagatccgcggcggcccggcgagggggttctggggaggcgcaccccaggctggctaccctgagcccaggcccaaggctgcccctctaggccccagcacccagcccccttcctctctccgctccccgcccctccttcctcgcatcagacaaaggtggatgaagttcttttcaagtttcaaaggcagttgctgggcagctttgcagaaacaataactcttttattgggaacaaatgttgacatttgacgggcgcgggaggcagcgcccgcgccggccgccgggcaagcgccccggtgctctcggcagcccccggcccccggggcccacctgagattaaagcgcgaattccgataaatcagctctaaggaaaccctgngccgcggagagcagaagggctgtcgcggatccaccacgcgggcgccgggccgcggagccgggagcgcgcccaggcctgcacccgcagca

SEQ ID NO: 51 - DNA, 67919 bp, Homo sapiens
acttccgctcggcgacaggaagtgaggtcagaccggttgctttcccgggagttcggcgtttgctggggctgcagcagctgaagtgtagtgttttcttgggactggcggtctgcacttctctcccgggttccatctccccccgcccggtggtgaggccctcgaggagggctcggacgggtgtagcgatccgcgctagaggaagacgaggcccgggaacgcatgtcccccagggcaggttagggggctggaggggtcaaatcccggggtacttgtggagactctttagcgtggcttcttctctctgctgagaccccgagagctttcccagttctcctcccaggaccaccggggttcctgaagatcgggacttttctgcgcccctccaccaacagcccatctcctgtctatgaagaaagacccttcgtagaaacaacttccccgctgctgacgcgttttcccgtcccgtccccgaagtagtctactatgacctcgttgtgagcctctgaacgattttgacactttcccgaggcctagggtaaatgtttatgtgtgctcaaggtcgtgtgtgtatatgtgtggcatttatttcctgcaaaacctgagttagcagaaccctggggtacgtttagctagtgtatactttggtctgcttttctttaacatctgtggcaaggtttcttgttgcagaccagcgaagtttgcaccttcttttagctgggtgagagggcacactggaattaggcaggaagtgtccaggagttaactgaatttttagatcttagtttgaccttttcagttttcagtttttctttttttttttttattttttgagacggacggagtctcgctctgtcacccaggctggagtgcggtggcgggatctccactcactgcaacctctgcgtcctgggttcaagcaattctgcgtcagcctcacgagtagctgggattacaggcacccactaccacgcccggctaatttttgtatttttagtagagacgggattttaaccatgttggccagccccgtcttgagctcctgacctcgtgatcctcccgcctcggcctcccgaagtgctgggattacaggcgtgagccaccgcgcccggccagttttaagcttttaatgtgtctctttcttatttccaagaaactacagattcttggacaagaactatgtcatatggtaactttgtaattctcatagccccaagcacagcacggaacacatagtaaaggctcattaatattttaaatttaaatatgagaaaataacacaaactaacatttttggcttaaagttgaagaggcctatctaaatatagttcagctcctggaaatggcgatgcgcaatagcagggtatttttaggtaaaataacaaggtcttcttggagaaaataacatggtctttttagataaatgtgtgtgaaatttagaggctgccccagaaggctaggtacagtgctgttagtggaagagaagtatgctgcatctgtctttttggaagagaccaaataatggaataatggtgtttcacagcttctttgtttcttgtcttttttcttcatttgtttttattttaaacaggtattatatcctaaccttactaaagaccacagaggtgcttgccattatgggaaatcagcttgctggcattgctccctcccagatcctttctgtagagagttatttttcagatattcatgactttgaatatgataaaagcctggggagtactcggttttttaaagttgctcgagccaagcaccgagaaggcctggtcgttgtgaaggtttttgcaattcaggatcccacattgcctttaaccagctataaacaagagctggaggaactgaaaatcaggcttaattctgcacagaattgtctacctttccagaaagcatcagaaaaagcatctgagaaagcagctatgctctttaggcagtatgtgcgagacaatctctatgatcgcatcagtacccgtccattcttgaataacattgagaagcgctggattgctttccagatcctgacagctgtggaccaagcacacaaatctggagttcgtcatggggacatcaagactgagaatgtgatggtcaccagttggaattgggttcttctaactgattttgccagttttaagcccacttatcttccagaagacaacccggcagatttcaattatttctttgacacatcacggaggagaacttgctatattgctcctgaacgttttgttgatggtgggatgtttgccactgagttagaatatatgagagatccttcaactccgcttgtagacttaaatagcaatcagagaacaagaggagagttgaagagagcaatggacatcttttcagcaggtatttgagtgggtcacatttgctaagggagcatgtgtttttcttttaactgttaaacagaaatgtggctttttttagtcaccagatattgaaaagttaatgtcttggtttgtcctcagacgctatttcagttagaggcagcattcctgcattggatatgtttaaatgcctaggaaatgcaaacagcagtttatttacacaaacatataaacatatttgcttgcctacttttattgtatgtgtcaggcactgtcctaagtgctagggatattggtggataatatattttcataatgcttccattttaaagtgaccgtggatattgcaaaaggacatttcaatgcggtgttgattgctgtggtggtgataagcatagggtgctgctataggaacacatagatatttaaattagtcctcatggtggtgttgagtcaagaggtgggatcaagaaaggcctctttaatagaaagatgatatttacattgaaacctgaaagttgattgggagttaactttcgtagagtagtttgtttcaggcagaggatgttgcctatacagaagcttaaagaccagaatatgatgcactgatgtgttttctggaacacagtgtgaattaagcaaggcccaaactcagccagatcagaaagggtctggcctgactggagcatggagagtgaattttgcaggggagctacacagaagacaggaaaacaagttaggagaaaactgccacagtccaggtaagatgattgtgaccggcttaagattgtggcagagttggaaggagtggagagaagtggtaatgcttaagagataattagtagatagaattgttaggattctgtcattggaaggtgaagtcacaggaacttctctcgcccaccaaactgagtggatggtgatgctggtccctgagacagggagacacaggaggagcaacaggttaggttgggaagatgatgaggtctgtttaagatatggtaagtttgagatttctgccaagtatgcaggagaagatgtacaacatgtatttggttatatttttatttatttttaatttattattattttttagaggtaggatctcacattgttgcctaggttggtgcccagtggtgcaattgtagctcacttcagcctccaactccaatgatcctcttgcctcagctttctttgtgtagccgggactgcaggcgtgcaccaccacacccagttgactttttttttttttaacatttttggtagagactattttactgtgttgcccagaatgttcctgaacgcctgagctcaagctgtcatcccacctcaagtttccaaagtattgggattacaggcatgaactaccacacctaacccagcagttggttataaatttttgggcatagaaatctgggatagagatggagatttgggagttatcaggaaataggtagtaattgtagccagggaaaggttgtacagaagtgattctgaagcttttttggatacccttaaaaaatttaatgaaatcagtggactccttccccagaaaaatgtaccatgcattcattcctatatattatttcacatacacagaccacatgaagctgagctatggattccagattatttaagaatttgtgggatagagaggaagaagtgtgttgagagtggtactctgatagacttcaaaagaaatctggcatcggtgccatttttggtaaattttgtgatggtttggcttaatttttttcttgcttgtaggtttattacaaaaaacataaattgagccaaattttagattatttaggaaaattaattgatgaatgaatgtatttcatctaccagaatgaataatgttattcaggattgcacctatgttggtctattcagctcactaatctgtgtcccaagataatactgagagatgttttgataagatagggttagcctcaaggttgtaaatacagtataacaaggttagaaatgtaatccatcaaagttccagttttgttgatcagtgtattaaaattttcttgaaccatttttacattttaaactcactaattgttatgtaatcctttagcttaggaattgcgtcactttcaaacttcaggggatcattcataggtttaaaatttcagtggttgataagcttatttttatcctttttttgtgcattatagttttgtaaacttcaacaaaattcacactcagcatttatttttccagaccaaagagccttacattgttttggctgaaggtaggcccttccgttcctttgaaaaagaggtgggtggcatctgtccacttcccagtgctcttaagatttgaatgtttgggttttgagtgctactttcccctcttgatggatatccatggttccaggctgctggtttgggagaagtgttcagcgagtcctgacgtccttgataggctcttggaaactgctactttaagtgaaacagtgtaaagcaggtccatcaaataatgtcgttttcattataatgaaatggtgagaaaataaatggttttgttgtacgttgttgtacttaaagttgcagtttccaagaacccatcgataccgttgaggacttaccatatatattctgcctctggtccagtacataggcatagccttgtgtgctgcagatctttcattcattttgacatgcatttgagcatattatgtgcaagccattgttacgtaggtgccaggaatacagttgactaagcttttgccattatggagctttcattctagtggggagagagatagaataaacaagtaaataagaaagttaattttggttagtgatgtgttatagccaagcagaatgatattgaaaaggctggtagggcactactttaagataaaatggtcagggaaggcctctctgatgaaggtaacatttgagctgagatttgaatgatacagactcagtgatgatagtgacgatttaaacaagttgttccacagggaaataccacccaataacatctttcagaataaaatcgtaaaagttttgagaaaataaatatgaattcactgctgcattagtttgttagggatgccataacaaaataccatagagatggtggctgaaacaagatttattttctctcagttctgggggctggaagtccaagatcaagctaacagggttggtttcttctgagacctctttccttggcttgcagatagccatcttctggctgtgtcctcatgggtttttctctgtgaatgagcatacatggtgtcctttcttataagcacgccagtcatattggattaagggcacacccttattacctctttaaccctaattaactccttaaaggctctgcctacaaatacacttagattctaaggtatggagattaaacatatgaacttgcaggaggggaggcagggggcacttgacacacaattcagtcaataaaacctccatttagttataaatagtcatatgtcactgtgtttttttctgactttatttggaaatactgtaatttcaaacttgaaagccttaaaaacttacagacttttaaacttgcaaaaataaaaatagaacaaaggaacacccatatacactttacccagattcacctattgttaacattttgccctggttgctgtatcattggtatcgttttcttcttcctcacgccccattttttccctaaccttatgaaataagttacatatattatggccctttaccctgaaacatttcagtgtgtattttttactttttatttatttttattttttgagacagagtcttgctctgtcacccaggctggagtgcagtggcgcgatcttggctcattgcaacttccacctcctgggtatcatgctgctgcctcctgagtagctgggattgcaggcatgtgccaccatgcctggctaatttttttgtatttttagtagagacagggtttctccatgttggccaggctggtcttaaacttctggcctcaagtgatccgcgcccccttggcctccctgagtgctgggattacaggtatgagccactgtgcccggccttcagtgttttctaagatgaggtatagtctgttacaaaacacaatatagttaatggctgcagtaattttaacattgatacagtaattacactttttattctaattttgtatttgacccaataatgtctcttatagcattttgcctgtttcaggacaggaccttgtttagggttcaggtattacatttagttgtcatatctctttagcctcctttaatatttctacagcctttttttcttttgttattatcacattgccattttttgaagaatgcctccccccacttaatttttcaaaatcatttttatacattttagtttgaaattattgtagaatcaaaggaagttgcaagaatagtgatgtatccttcacccagcttcccccaatgatgaccttttatgactgttgtaccatatcagaatcaggagttgccataggtgcattactgttaactagagtatagcccttactcagttttcaccagcttttacatgcattctctatgtcacccactcctttgttttttgataggatgtttctcattttgagtttgtctaatgtttcctcatgataagatttatgttataacttagtaggaatactgcatagatggtgatggattttcacagggtcacatctgtaaacaaatgatggttgtttgtgatgttaattttaatcatctggtcaaagtcttcccaaattgtctcccctctatagttttttattttttttcaatcccttgcaactaataacctgtgggaagagttttaagatgtgcaaatatgcttggtgtggtggctcaaacttgtaatcccagcactttgggaggctgaggtgggcagattcttgagcctgggagttcaagaccagcctggacaatatggtgaaaccctgtctctacaaaaaatgtaaaaaattagttgggcgtggtggtgtacacctgtagtcccagctacccgggaagctgagatgggaggatcacctgagcccaggaggtccaggctacagtgaactgtgatcacaccactgcactccaggctgggtgacagagtgagaccttgtatcaaaaaacaaacaaaaggccagcgcggtcgctcacgcctgtaatcccagcactttgggaggccaagatgggtggatcacgaggtcaggagatcgagaccatcttggctaacacggtgaaaccccgtctctactaaaaatacaaaaaattagctgggcgcggtggcaggcgcctgtagtcccagctactcgggaggctgaggcaggagaatggcgtgaaccagggaggcggagcttgcagtgagctgagatagcgccactgcagtccggcctgggtgaaagagtgagactccgtctcaaaaaaacaaaacaaaacaaaaaaacaaacaaaaaaaggtgtgctaatatcctgcccattaccacggtttatcgcttgacatttggcatccattgatgattcttgcctgattgaatttttgttatgatggttgcaaaaatgatttttccactcaaatacgtcctccacattcaacagtaggacctcagcattctgctgtactcaaggatcctctgttttgccccatttatttatttatttattattggtatagactaattcttaatttttttcagttgtatatatttattaccttgttaattatattggtgcaccagttgtctcagatttggccagtgggagaaggagccttctcaggctgattcctgtgtccttgtgacagtcctcatctttttttttttttttaagcatttctttactttttgatataagataccgtacttaccctgccttagtgctcaaaccagccattaaggaagcctaattcttttagtgtgtagtgaattatattagaagcctctatctagtgctcgttgccattagattgtctttgacactttgctcttacagctgacaaagccaggcaatatatgtagtgtgtgtgtgttgtactctgcttttgttgggtggagtgttctgtcgatatctgttagatccagttggtgtttttccctactgtttttttcgcctcagcaccaacttctagattatattttatgtgcttatgttcctcaacttacaacggagttacatcccagtaaactgattagaagttgaaaatatcataaatagaaaatgcatttaatacacctaacttattgaacttcatagcttaccctaccttaaacttgctcagaaacttacttacattagctggttaattttaattgtatttttcgggtcctctgtttccttgttgcttatggtgtttttaatagctgtttttcgaagtccttcattctaaaatgtgacactatacagagagaaattaacaaatttattgagtgtttattatgtgttaggaacttagttgctggagatttttcaatgaatagagaaaaatagaaaaatcccttcctcatgtaaattgcgttctagtgggcatgtagacaagaagaaacatagagactgtccccactttgcaatggttcagcttatgattttttgattttaccatggtgcaaaagtgatacacattcagttgaaatgtatttggagcacccatacaatcattctgtttttcactttcagttcagtattcaataaattacgtgagatgaatcactttattgtgaaataggctttgagttagatgtgtttgcccaaatgtaggctaatggaagtgttctgatcatgtttaaggtaagctaagctggaaaattcagcaggttagatgtattaaatccatttctttttctttctcttttctttttttgagacagagtctggctctgttgcccaggctggagtgtagtggcccgatctctgcttactgcaaactctgcctcccaggttcaagcgattttcctgtctcagcctcccaagtagctggaattacaaacgtgcaccaccacacccggctattttttgtattttcagtagagatagggtttcactgtgttggccaggctggtctcgaactcctgacctcaagtgatctacctgccttggcctcccaaagtggtgggattacaggcatgagccaccgttcaatatttttaacttttcgttgatttattgggatctaaccccattgtaaatagagcagcatctgtacataaaatataacctggaagttgttgctatgggggaaaaacagtaaggaaagggaaaagggaatgtgtccggtgaggggtgtggcggtagttgtggtagtggggcctgcagttttaaaccggcaatcaagaaaggcattactgctgagtgacatttgagcacctgaagatctgaaggaggtggaggtataagccacatggatccttgggggaatagcattctaggtagagggagtagcaaatgcacaggctgtgaggtgaggttatttaaggatctctttagacttgttaaatgcctgtcatgtaatgatttcagttaaactgtgttgtccttttggaaatgtggatacttacaaaatttctggtttgaagattatataagtgcaaaacgagagttatctctcttttcctctccctaatcttacagctacactttttagcatttcacatattatgtttgttcactgctttattttctgtcttccttcctagaatgaaagcttcatgagggcaaggattttatctgctttatgtactgcttgtgcctagggcataaactttctgtttaatgatgaataaatgatttgtcggatatgactttgtagtagtaattccttatgaatctaatgtctgtaagtccatacttgaaaaaaaaagtttcttgttttatcactctatgtaaattgtatatattacatatatacattcattttattttattttattttatttttttgagatggagtctcactctgtcatccaggctggagtgcaatggcacgatcttggctcattgcagcctctgcctctctctacctcatctcctgggtttaagtgattcttgtgcctcagcctcccaagtagctgggaccacaggtgtgtgccaccatgcccagctaatttttgtatttttgatagagacgggctttcatcatgttgaccaggctggtctcgaactcctgacatcagatgatctgctggccttggcctcccaaagtgctgggattacaggtgtgagccaccacatctggcctatacattcattttaaattacagaacgggggaattatttaagtttttttaagagggagaaaaattgtatggctcttctttgactttatactttagaaaccagtgttcgggtaatagacattttccctgtcagcttgattgtagttgtatgttgcattaaaatttttaatttcatttactttggggttttgcattttgggttttatgaactgtctgagttctcaatctatattgcatgatattttttatctcttttctaacagaattatacctgctatttttcaggttgtgtgatagctgagctttttacagaaggtgtaccattatttgatctctctcaacttttggcttatagaaatggacattttttccctgaacaagtgctaaataaaattgaagatcacagtatcagagaattggtaactatgctacaaatattcgccataaagtttttaataggatctagttcccacttttgctttaatcagatttctggaatgttgtaaatttggaatcaagcagtaaaacaccatagactaatataaacagccttttgttattactttgttagggaagaatgtactgtttttttccccttcaggcacagagctcatttgacttaaaaaaaatctatttattatctattttcccactataatcttcagtgtgctttttacagatttggaaggaggtaaggtagtttctaggggttggagaggttgtcctggctagagcttgctagtaagaaatgaagaagacagacatttgaaatggaggggacaggaaatgtcaacttgaatgtaatacagcaatacagggccattgcatatagaagcaaatagctttgtattaatatatgaagctgagggcagttctggaaaggcagctacagaagcacaaattagtatagcagaatgggcgtgaggagtcgtgtgggggatcacgtaagccacatagctacattattgtttgagggcatcttttctaagtcagttatagggtaactgatattgtggtgatgactctgagtcatggaaaagattgtggtgtgtttagaatattctttaattatgtagggagatatgtaatacattttaatttctcttaagtatgtcaaatattaaaaaataaggtgcttcagaggaagccagttgaggccatatttattgaacagtgcactggatgaggagttggtgtagtgttctgtctttgggtatggcacatacttgttacgttgctttggttatataacttcatgtctttgggcatacattttctgaactgcgaaagaagtgaatttgtttaatttttagggcctagtccaaactaaaagcaattctaactagttaacattttcttttagtacatttgagtcccccatgttcactactaagctcttatttaaactgtaaacagaaagttcagataactcaatacattttgtgatattgtatttcaataatgactgataccctatgagtgtcccagaaagattaaactatgttctgtgcattgaaaaatatttatttccctatgatactagaaaaccataggataaattcaaattaggtgtatcatttctagtgtttgcagaatttaacatctctttgacactatttgaaaactttaagccactgattcccctactgattagatcctagagctatacttaaaccacagattcctttgcacttgtggcaataaggttctgaaccataactcaacccgggatatgtaaatggattttaggggttctgtgattccttccagaattgtatgtgttttttaatgcaaaaattgtgtgtatacatttttctctggaagagatccattgctttcctcagattcttagtggtatctcctacttagaaaagtttgtaagaatctttgagttgtggacagcaatatattagtccctattttaataaatggggaatactgagccatggtataacctcctctttatgtgtcagggccatctgtaatatatttgtatataattttttactgctttctaggatgatggagtcacaaatcacttagcagtcaggttctgaaagatcctttaaatcgtatgtaaattgcctttgtagctttcatctggtttacttttctattctcaaatctattttaattccttttcttcccttggtataggtaactcagatgattcaccgtgagccagataaacgtttagaggcagaagattacttaaaacagcagcgtggcaatgcctttcctgaaatattttacacttttcttcagccctacatggcccagtttgccaaggaaacgtttctttctgcagatgagcgtattctggttatacggaaggatttgggcaacattattcacaatctctgtggacatgatctgccagaaaaagccgaaggagagcctaaggaaaatgggctggttatcttggtatctgttataacatcctgcctacagacccttaaatactgtgattccaaactagctgctttggaactgattcttcatttggctccaagattaagtgttgaaatccttttggatcgtattactccatatcttttgcatttcagcaatgactctgttcctagggtgagggctgaagccttgaggacgttgaccaaagttcttgctctcgtcaaagaggttcctcgtaatgatatcaatatttatccggaatacattctgccaggcatagcccacttagcccaagatgatgctactatcgttagactagcctatgctggtaagagtttattgtccaaatattagccacttagatattttttaagttaatgactataatactgcttgtttttctgatttgtttgagaattgcaagtatgaactttgctctttgaactatttgtgtacattttgataatatttctagttactctgttcctgggaatcaacgtttgtgtgttctctcacttttgaaatgatcagaattatcaagtgatggaattttgtggttttcttaggaatactacattcgacttggaataagactaatgtttacaagtatgtgcttctgatctagtgtctttaggcctttatgaagtttctctgacaaatatggttatttgactgtcagttttagcatacaacaatctattgctgctgaaaaagattaattttgctagataatttgatgttgaaagaacctagcatactaacttactgaagtttaaggttgttttcccagttactgtactgtttaggatatacatcttctttatgatgaggtgggtgtgttatacacacctacctgttttgcctgtctcactcaaaatcaggtgatacagattcttgtttctagctccccaaattaattctgaaagcttatttctgcatgagaaatatcactgaatatatataatatcactgaatatatataatttatttctataatataatctgatagaaatcagggattctgttttgaagtctttgtaaatagtacgtgtgtggtaatgatattgtctttttttttttttaaagaaatgtagttcattcattttatgatttgcttgtcattattttaatgaaacatgtgaaaagtggtctttggactctggtcttatctctaggcacacccacaaagtgattggtgattgttacgtgtttttatgtttcctcatacatatatttttatttatgtttatctctgcctatttatttatttatggtttctataaccatacaggtatgaacttcaggcccagaaatccaggatttctcttaagacacatcaaagtttatcatttataacaaagcatagttgtaactcacttggcaaatataaattaaataattgaaccagataaaatcaaatcaaatgaaagtttatcagttttaaaaacaagctctgtcttctttaccagaattttatgatcctactttttggtgcagtgtatcttaatctgttctcaattgtgttaaacgggtcatgttctgatgaggtgccatattaacatattgacactcagttactaatagctatcacataaaaataatagctactgtttattgaaaaatctgctctaggttgttgtaagggttagctgcaacaaccttgagcgttagatgttatattaccttcatatgacaggtgaggaaactggggttaggagagactaaataacatgacccaaatgtatccggtctaattctcagttctcagagctcctgctctacaccttggttttgaagcaatcctgcttttctttggtcttctgggtctttatggtgagagtccgtgataacccagggtcagtgccagcaccttgcattgttatttcttcaaggcccagtatgtgatcacccaggctggaatgcagtggggagatcatggctcactgcagctttgacttcccaggctcaagccatcctccaaacgtagccttccaagcactataggtgtgtgccaccacgcctggctaatttgcggtcttttaaaatagagccagtgtatttgaatgtgtatggttaaatataattaaaatacatgtgtcagtaattataaaagtttaaaatcaacatttgtttctttacagtattttttaaatatcatagatgctggtacagatttgtgtaaagtgaacttccaagtgtgctgtggtttatggacttaaaaggggaaataagcatagatctactcagactttagaggtgcccaggaaagtaagagacttttcctaataaagatttgctcattaaagtggggatattcatctagaattttgacatattatcaggatatggcccagagtttttccatttttagggcgagcaggcgttatagggtatttacatcttgcttacttagaggtaaatttttattctattcagagcattgttgaacctagcaggggtggggagtgggacccaggatgaagggaataattgtgtttgattgactcaaagatctcaactgccataaggtacattttgatttcagagatgttggaaagcaaggaaaaagtaaggttattttaagtttaaggtagttaaactttacgttcagtgctattcactgctaagaaggaaaagagtacagtctttgaccggttgtgatcatatgttaagaaacacatatgttaagtgggaggcaaggtaggagaagaaagtgtaagtgaagagcagatacaattgatagtaaatgtgacagcagaaattagaagtagttattttgtagtggtgaggaatatcagacagtctttgtaggtcatcagaaagagaaaggagaagatatagacaactgtagaaatgtgcaaacagtctgccactttggttcactaagaacttgagtatcacttgtaaagcagtctaacaatggtttctctttgaggcagttgtgacttttcatttatatgtgaagaaacagtctcagattgcttaaatggtcaagttagtaagtggcaaggttgagatttgaacccaggtctttctgatgccaaagcttagctttatctgttattttaatgtggatgtttctttgttagtctaataaatatctctcacttgtcaaggatactgtttaaaaggtaagtccctgcagagaattaggcttttttttttttttggtcctcagtagatgaggtattagattatttttatattattatttttttaagctgtgtttcaaaaataagactagtggtttggagacagttacagattatgagctgggttactaaaatctgattaagttaaatgctaaattgaaaagttctgtttttcccataggcttatgattatttatgtataaagacagggaggaaaagttaataagctttacagagagttaagattgtaattataaattttcttcctttttattttatagaaaacatagctctgctggcagaaacagctctgagattcctggaattagtacagttaaaaaatcttaatatggaaaatgaccccaataatgaagaaatagatgaggttacacatccaaatggaaattatgacacaggttgtataattttctcttccagatttcctgttatttagaatgaattgctgatgctaacttgtaaaactatcatttgtagttttcatgtaaggtgaaggaataccagatctatatattagataggaagagtccctggtgtctaattattctctctatcctcatatactgttatcttgctcaaaaataatcagcttgtcaccatggatactaaagtcaattgtttgtcagccagaattgatttgtgtgaacagtaaagctggctgaattatataattctcataaaagaaaaaattagaaacatcatagctaaagaagctaaaccttttctccttacgtgagtatattctgagtatcctcaatcataaattgtttttatttcatactatttgttatttacaaaaaaccataaaggaacagatgtgatgatggtaaacttattgatgtcaaagtccttgtcttaggtttctttgtgttatacaactctttacagatttttacttaatgtttgttgagtaaaagatttagaagtaaagtaatagatgtaattttctccaagatgcttctagttgtgaaaaactagagaaatctagttttttagaattttatgctgcaaacaactacaattgttacttgttagaatggcaccatttttagacaacatgtattatctagagttgaatacagtggaataattttgaagttataggaggatgtatcaggaagtcctagcctttttttatggaattacttggaaaataatactgtcctataaccatgtaattggacctgttgagataataaagttaaatggtaaaatttttggggagggaatctaaagtttttcttaatgtgagcatatagttttgcatgtcagaccagttacctttttccttgacagtagtagctggaccaagagtggcccctgtcttctgtttattcacagataattgttaaagattagctctgcatcaggcaattaggagcctgccctaagcactagagcatggtggtgaatacgatagaaacgatccttgctcttgagcttacattttagtaaaaagaagacaggcagctaagtaaataaataagtgagaaaaagtgaggatgaggaagagaagaggtaagaccagagaagacagtggccagatgaagtaaagccttgacagaacttgcagtgtgttttctggctttctaaaataaactgacctttaaaaacattttctaaaaggattgctcagtaccatcatattatatcctaatcctattccattattttcaagtccttgattaactgggatcttactggggcaatgtgatttcctttctggtgcttctctataattttctccttgagctaataaatgaaactatttgattagtgagatagtaactatgtttgtggcatctgcttgttaggatattcttcactttatatttcagtttcccatccttcagagctttgaataatgcaaaaaattggtgattaaagtcttcggtggattctgtaatcagtctctctgatgagtaagaaagaagactgggactatctgtatggggaaaaattgatcttttcttaactatttcttttctttctttctttctttcttttttttttttttttagagctccaagccttacatgaaatggtccagcagaaagttgttactttgctaagtgaccctgaaaatattgtaaaacaaaccttgatggaaaatggaataacacggctgtgtgtattctttggacgtcagaaagccaacgatgttttgttgtcccacatgattactttcctaaatgataagaatgattggcatctacgtggagcattttttgatagtatagttggtatgttttttgcttttaaattcctttaagatttttaatcatcctctcaaatacttccatgcaatctgaaggatagatgatactaccaaatttcattaataatgaaatgaattcctagtatttctgtcttcatgctgcttttggatgatgtaagtattttggcttggttaaaataaagggttggtatatcaacctgtgttacatccgtatgaaggaataccgtgtggtcattaactatatttagacagaataatgacctggaaagtaccatgaagtatgttaaagtgacataagtaggttgtaaatcctcttaaagaatgattgctgtagtgtaaaggtaacaataacagaaatcatatatgtttataaacatgttaataaaagtgaacatgcatcacttttagaatcagaaaataagttaaaatataatcatggttgaaaatcaatgtagttggaaagaattaagttaaaggctttgtgtaactgaaaatttgtgaaaatttaagcagcattttttttttgctgttctttcattttacaattcttgatttttagatatatctaaagtcagacatcttgtgttttatatgcatgacttatattacatttgtattcagaattagaagtaaatgaagtggacagtattttgcatgggttaagtcatgtttgatacaggatttaatatttttctcttttgaataataactgatccccttttccctgaatgtactgatcttttcagtttaagatttggccaattatgaaatatatgctaaattcatattattatgattatccactaccccctattatatcatttcccacatagttgtaacagtttatctgttaacccgaaaagtttaaagactattctgcacaatagaaagcttggctgtgtccagactttcttgtgaggcagcagaagctgtaagactttaagggccgggcgccgtggctcacgcctgtaatcccagcactttgggaggccgaggcgggcggatcacgaggttaggagatcgagaccatcctggctaacacggtgaaaccccgtctctactaaaaatacaaaaaatcagccgggcgcggtggcgggtgcctgtactcggaggcggcgggaggggggctgaggcaggagaatggcgtgaacccaggaggcggagcttgcagtgagctgagattgcgccactgcagtcaggcctgggtgaaagagcgagactccgtctcaaaaaaaaaaaaaagactttaagttttggttcccaataatctaggaaaggtttgctgtttgatttttgtttgctaaaaaaataaaatgcaagaaacctatgtggcaacaggattgatatttctgcaaatgctatcatatgttttggaggaaagggtactttctactttgaaaaactttcaaattcccggttatttttggaaattactgtacctgtttttttcttttcagacatcttttgttttttatttttgcattaatttatagatgcatcttagccttccatctaggacttcatctaactcagttcctgaatacagtattctttgattcttacatctttttgtcttgcttgctctcttcttcttccaaataatgttatatttatttcttttctcgggaaaagtcggttcttaaaacttcccctatctattggtcaattcatgtgttctttgaaacacatattagtttgtcttaatttaaaaataaattttttatttataaaaaataaatatgcttatattacttttggaaataaaacttagaaaaatttggaaaatacggaaaccagaagaaaataaatgaccattaatcctacaacccatgtacaatgtctgttaaagctttgatgttttttcccatagctattcctcttctctttccatcccatttatccctttctgtcatatgctgatcgttaagagcaggcattgtggagctatactgttgggttcaggtgttcactttgtcactagttgtggttcttggaaaatcatttaatttttttgtggcttagtttacctatctgtaaaatggaaataagaatagtgcctgtcttactggttgttgggggatagaatgaattaatatatgtaatagtgcctggcgtaagtgctatgtatatattatattacttccaaattttattatttcttaaactttttctaataacatactttaagcattttctcatatcattaaaaatttatttgaaatcataatttgataggtctaaactattcctttatatagttttgcaaaaatttaacccttttggatatttaaattattttcatttttttctgtcatatatagataatctatatatttggtataaatatgcaacgtatgtatgtaagtagttgtttctgattattttcttaggatagaagtaaaaaaattttaattactgtgttaaagaatgtgaatttatttttaaaactcatgacacatttataagctattcaaaaagatgatatcattttgcatccccatctccgttaagtgctgcacacccatccagtgtgaaataggctttacttagtccttgcctgttggaagggtaaaatgataacttgttttgatatatatttcttagcttaactatcaagttgaaaaactttttcatgttgattatgcattcatatttctaattctatgaattttaaaattcattattttggcttatttttttctgatacttatgcttttcttgttcttttcgagcctttatatacatattaagaacattaattttttaaatcaattttaagctcacgtttcttagttctttaacttgatttttgaatcttttctgtagacagtttttctgaagtcagtttactcgatctttttgctttgtgatttttttttttctacttttgtatgtaaagtctcttcccattccagaattagattaataatctgttgtgtgcttgtctttttttctttttcatgctttagtttttacacttaactgtttaattgatctttatttttggtctgtgatgtgggatgaaaactaaattttctttttcttctcagatatgtaactgattttccagcataatttattaagcattttttttgttttttttcttactggtttgtttcttactgttttatcatctgttgcatgcttctgtctgttaaggtcagttttctggctatctagtctgttccattgatttttctcttcttgtactcatattcatagccatattcaatttacattattatatatttttaatcacctttatcatctgatagggtaagtttcagatgtcattcattttcaaaatagttttagctattttagctcattgtacatttcagtttgtaaagttcctaaatataattcactggaattttagatagaatttttccttttattaaagaaaacaattataacataattttttaatcataaaggaaataggcttttagaaattatttaaaatttaatcaaaatgtataatgtatgaaaaacaatagttgaaatttccagaggcaactactcagctttctgcttttattttagtgttttcaggtgattattaccatatctctaaataatattttcatattactatttttagaataaccaactttggactttatctcttgaatttttttctgtgccagatgaagatttaattcactcataacatgccttgatccttcttctcttttcagtttttgagatgttgactactattttctgtgctttagtttttggtttgttgttttaataactttaagtaattaaatctattttgtgtgctccacctctgatttgcagtacaagattagtgccccttttctttctctttacctgtgtctctcttttttattgtttggttagttgagaattgagaattctcaacaatttttttgtcatagttaataatacattctgttctataacacaatgaagtcttttatgtatagactgattatgaagcttcaaaacaaaatacatgattatgaatgtgtaaattttattgactgtggagccaagtaatatactgtaattatatttgcttcatcacaatcccaattcagtgactctccccctcaccatttgagtatgtttatagcaaggccagtggattctactttactccctcttctagttactaaatacactatttattttaatttcatatttggactgtgattttcttgagcaatttcaggaattttagatttctttgttttccttttagaaagaaaagtaataaattgtcaccatatccgtaatagctagcttctttcttattaattttatttgttgcttagaatctattccattttcttcttgatgacattcttgaaatttattagcttttaattctaatctgggctgactgatttctaggtctttgctagcttttttttgcccttgaattcttaggttgaaactttcctagaaagggttgcatgggaggcaaacttttaatagtccttacatgtcttgaaatgactttttttttatttaattgacagtttgactgaaaatagaattcttttcataacttttaatgccttgcttgcctatgtcttgtcttctaacctccattgttgctgaagattatataattacagtctgattcttcttcctttttaggagacctatattttcatttctgtaagttcttaggatcttagcttttctgtggtgtccgagaatttcctgatgatttgccttgctgtgggtctttttaactttatcatgctgggtaggaagtgcaatgttctttcctaggtaattgattaatatgtttggcttttgcttaattttattgctttacttaatgatatatgtacttttaggtattgaataatcacataatattgcttttcatttccaggtgttgctgcctatgttggctggcaaagctcctcaattctcaagcctctgctgcaacaaggtcttagtgatgctgaggaatttgtcattgtgaaagctctttatgcccttacttgtatgtgccagttaggactgctacaaaaaccccatgtttacgaatttgccagtgatattggtaagtttctgtttctcaaaattagaatgagattggaagaactttataaaatttctaggtaatataaagaattgcaactttattgttcctgctattgattgtgtggggttcctactattgattgtgtgggtgtgcatgtgtgtatgtgtatgtgtgcatgcttatatgtatgtgagagacagacaagctgactcattgggtcctccagcctggttgggaagtactgctttgttttcatctgttggtaagtctgtgttacccttgtcaaaaagcaagactttggtttttgttttggctttcttttttttatttttaatttttttttttttttttttttttttttttttttttgcgacagtctctcactctgtcacccaggctggagtacagtgtgtgatcttggctcactgcaacctccacctctgtgttcaagccattctcctgcctcagcctcctgagtagctggggttacaggcacctgccaccatgcccggctaatttttttttttttttgtatttttagtagagacggggttttaccatgttggccaggctggtcttgaactcctgacctcatgatctgcctgctccagcctcccgaagtgctgggattacaggcacgagccaccgctcctggccgagactttgttgttaaaaaaaccatgatgtgggtaaagccttgactggtctgaagatgaaaattatttttgggcacttgactagcagtcaagttgaaaattggatgtgaagggtctgtcactgcattgattaccagttaagaattcgtagacttgaataatatgtttattctattataatttcacataatacattgcttctgtggcctaattagttatttcaaaataatttttggaaattatttttgaaatttaatatagcttgtaattagcattttatttatctacaaaacagatgcccatcaattttaaagcaaaaatcatcatgaaaatagttttttacccctgcactcaaagtttgtggagatttttctggaccttgctatttctagtctttgatcccaggatgaatatatggagtgctcatatatctttagtgtcaaaataaattatgtttatatacagaataaacccagtgtggtactacttcttcaatggataactcccttagaactacaactgaatttgatatgaaaactatggggagaaaaaaacacgttaccaagaaaaatcaagtaaacagtcatttcttggcatttaaaactgtttaaaagtaaaaaacaattttagtaacttagaaacacctacttatttaaaacaaatgatagactatatacatctctctcattctgtttttaaactatgtgtattctgttgtagtgatttttttttccccagctttattgaggtataatcaacaaataaagatagtatattatgttcaacatgatattttgatatatatatatactttgtgaagtaattatggcaatcaagttaattgacatatccatagttctttttctttagtggtaagaacatttaagagttacaccctagtgattttccagtatacattattattaattataatcaccatgctgtacttgcacatactgtacaagaacttattcatcttgtctaactgaatttttgtatcctttgactaacacctgcccattccaccctcccttctaccccagcccctggtaaccaccattctactctctacttctaagagttcaacttttttagataatatgtattagttcgatcataacagtatctgtctttctgtttctggcttattttacatagcataatgttctccaggttcatctgtgttgttgcaaataacaggatatttttattttttagtgctgagtagtattttagttgttatatacaccattttttttattcattcagtggacacttaaattgatttcctatgtcgactcttgtgaataatgctgcagtgaacatgggattgcagatatcccttcaacatactaatttcatttcctttggatgtataccccaaagagggattgcaagatcacaggtagttccatttttaattttttttttttttttttgagacggagtctcgctctttcacccaggctggactgcagtggcgccgtcttggctcactgcaagctccgcctcccaggttcacgccattctcctgcctcagcctcccaagtagctgggactacaggcgcccgctaccatgcccggctaattttttttgtatttttagtagagacggggtttcaccgtgttagccaggatggtctcgatctcctgacctcgtgatccgcccgcctcagcctcccaaagtgctgggattacaggcgtgagccaccgcgcccggcctaattttttttttttaagacacagggttttgctctgtcacccaggctggagtgcagtggcatgatcacagcttactgcagcctggatctccctggctcaagctatcttctggcctcatcctctcgagtagctgggaccacaagcatgtgccaccacgcctggctagtatttatttatttagagacggagtttcactcttgttgctctgtgctggctgcctggactttggggaatgttgacatgggttatgtgaaactacccttcctgccctcttcattggggcttttctcaattttgctatacccaggtgctgtaatctctcacctggattcctttgtaatggtgttttcatgcattgatagttgttaaaacagatttttttctacaagaggatgaatactgaaatgtcctattcagccatattgttttcactgcctagtgactcttaaagagaatggtggtggtggttttgatggtgattatgatttctttgttactccttttaaaaactatacttttcccacttagctattattaatattttcccccacatttgtcttctgataagttgaatgtgttagacaaagaaaagattgattgggaggccaaggcaggcggatcacctgaggtcaggagctcaagaccagcctgatcaacatggagaaactccgtctctactaaaaatacaaaattagccaggcttggcagcgcatgtctgtaatcctagctactcgggaggctggggtgggagagttgcttgaatccaggaggcggaggttgcgatgagtcgagatcgtgccattgcactccagcctgggcaataagagcgaaactccgtctcaaaaaaaaaaggaagaaaagattgaatatgctatttcataggcagttctttagattcaggcttcttcttgttttgagtatttgaggtgctttgtatcaggcagctacttaatgatataataatgctgtagaacagtcaaccacagaatctcagtaaatccttcagtaaatttttcgtcatgcacctgtgggttgtataggtggccctgcttcaggttctgcatctccaggttgtctgtgatgactgtgattcatctgtctcattctggggccctcattgtaggggcagtagctacccacatcatgttctcatggtgatggcagaagcacgagagggcaaacccagctatatagcacatttcagattcctgtttgtcgtaatattcattggccaaagcaagtgatataaaccaaaagaaagggggcagagaagtatcctttgtatactacaggtgtatacaaagtgaatgagtgtggttgtgtgatacagggaagttaagaattggggtaaataattcagtataatacagttcccaactcctgtcaaaccgttatgggtttagctactttctggaggtttaccaatgtttttccagtcctcattttccctcttatcacagggaaaatacccagtgtcccttgttggatggatcagaggctgcagggtatttatgaaataaacaaaatcttcttcatttataattagaagaattagaaatgcgagaccttgggagatagatattttgaacgcatcttttctccttcccctgttaatataagtattattagcctatgattgtattcctatttctctattaatgtgtatttcttatatacactaaataaatattagaagataaagaaatatcctctgaatgctggtgtgtttgcatgctcagagctaatacaatttttcttgcctttaaaagtttggattttattctaaatcaggttagtctaatgtcgattagttgaaatcattgattttatgtttaatacataaaatcgttaaaaggtatgaaaagacattcatttaattttctggtttaatgttatattttaaactttttaagaataggtatcatgttttcagcctttttgtttccattcatcattgccttgtgaaagtaactgtgagttatatattagatttgatcaaactcctgcattaaaaagaatatcagataggctagattgttcccttaatctttatgctgtagcttggagaagtaaattctccccaatttctctgccccttgggtggtagaggggatatgtccttgaacttctgtgggggtacaagttggggaataatagttagctatatgctgttgggacttgttatgtctctaacagtttttaatccagtgttataaatgagtaggtgcccacacaattttacttctgactaaaaaaatataaattttaagtcctcagctatgaggtaactgtttttattcttttgtggtactgctgtgatatttataataagagaatattataataacagtgtgtccacttgattgagtttatgcttcagggtaattgagtatgtgaaggctcctgatagtaacactgtggcaaaatccttttgtcagttacgttataaggtaaaaatttgtttatcccgatagtttgaaataacttatttgatccctaccttttcttttcctctttagcccccttcctgtgtcatcccaatttatggatacgttatggtgccgtgggatttatcacagtggtagctcgtcaaataagtacagctgatgtctactgtaaactgatgccttatcttgacccatatattacccaaccaataatacaggtatacatgttccaagttggagtcagtctttcctccaaactgtgcctctttaaaaaaaatgtttagagagtcctatttttcttaacattttttaagtatttaaattgggctatagcatgtttatattcctttcaagctaattaatgttaatgaaccaagcacctttgaaggtcagaaaagtgcaaaagattattatgttttacatcatgttatatctaatgtagcgtacagtagttcatatattttcttttgtgtaatattataaagcaactgttaaaagtgaaatatagtctagcaaaaatgtatattgatggccctctgctttttattttaaaaagtataactgattgcatccagttataataaattagaaaaagtctttttcaaatttaagtttttcaccgctaactggttgttttgatgtcttttcttttttattctaacaaccccacaacctctgctccacctttagcagtacttggtgataaactttaggtctttggtttgtacagggcaaatattattcacctagattttcagtgtttatacccttcatcttgctagacagcaaattatcaagataggcattaaatggattgaaatggcgaaggacgattctagctgttaaaacatctgaaagttcctatttttaccagaactccatttggaattcacacacctctctggctttctcccacttttgtatttcaatgtgccttccctttggagaaaatggccttggataaactctggaaactaggaagctttggttataccttcttttcttcatagattcattcatttctagaggttatcattctatttcatagagtttgtaggattttttttttatttttaccccaagagcaacttatatatacatgaaagatggatagcactatcagaaaaaaatgcctttttagaaaagtttatgcttccttggaaattaaatctagagatatctactccttttgaatagttactctatttaaaagtttgctcattgaactttttcttttgtcattgtttcgtattttgaaaggccaggatcagaagttgagaggctaattattcatttgcttcatgaatcttatttttctacaatttggattagacaaaagatatctttttatgctggtttccactggctgacttcaccaaggagttaaatatatctaaaggaagtcctcttggttcttttgctagagtcacagaaaaaaaaaaagaaaaaaaagaagataatcttcttggttacttttagcagtactcatccattttatttgcattgacaaggaatgtattccttttggataattaaaggaaagattttataaacactatggagatagcaatgttttttagaagtggttgaatctaccacgaaaatgtgataactgaaggaagacctgtggctgttgagcatcttttctggatcagtacctgctggttgtcagacctgtgaactgcacatactttttagatctaggacgttgtctgacatattgggatctagaaaaggctctttttgttttctaaaatttcctgggttggatgattagtcttccaatgacagacacacgtgtggtctagcgctacaatgaaaagtaagagataccttagctctttaaattttactagtattcttttttcttctacacacttacagatgttgatatcttattttcttagaaaatgaatatgttaacttttctcaagttgtatttattgaatttgaaaataactgtacatgttatatttttggctgatcctttttatttttccaatatagattgaaagaaaacttgttctgctcagtgttttaaaggaaccagtaagtcgttctatatttgattatgctttgaggtctaaagatattactagcttgttcagacatcttcacatgcgtcagaagaaacgaaatggttctcttcccgactgccctccgccagaggatcctgccatagcacagcttctgaagaagttgctctcacaggttgtatcacccttccaaagtcttacatttaaatgcgaatttcataaaaatattgaagtgtccatttagttttttaaaatgtttttgattgattagattacatcataaaaatgagtaagtaaatctggcaaacatcttaggcatttgcttttgattcctaaacaaagataataataagatgatgataaggtatcaggttaagctaaataaggaatcatgggagacctcttaagtttcttttgtaattactggctaaataaatgagggaaagacagtagaaacaaccttagatttaattagtagtcttgattcagttctatgttttaccaaaaatgtaatgaaatttagctggaagaaacattgcaaaacacagatgcaatatagaaaaatcctggttcatttcgatccaaatttgtaattaatacttgtaaacagctgaaataacttgtatttagaatgcatcttaggtttaatagaccagcagtttactggtatatcttaaaagcctatgaatttgaatcaattaacaaaatcttactacacttggcattggtaatgcctctttagaaatatgaattgtattcatgacaaaaaggccaaaagcaattgcaacaaaggccagaattgacaaatggatctaattaaagaggtctgcacagcaaaagaaaccatcatcagagtgaacaggcagcctacagaatgggagaaaatttttgaaatctacccatctgacaaagatctaatatccagaatttacaaggaacttaaacatatttacaagaaaaaaaaatcccatcaaaaagtgggcaaaggatatgaatagacacttttcaaaaaaagacatttccatagccaacaaacatatgaaaaaaagcttaacatcactcatgatcagagaaatgcaaatcaaaaccacaatgagacaccatctcatgccagtcagaatggcagttattaaaaagtcaggaaacaggccgggtgccgtggttcaggcctataaacccagcactttgggaggccgaggtgggtgggtcacccgaggtcaggaattccagaccagactggccaacatggtgaaaccccatctctactaaaaatacaaaaattagccggacatagtgttgtgtgcctgtaatcccagctactcgggaggctgaggcaggagaatcgcttgaacctgggaggcagaggttgcagtgagcaaagatcgcaccgctgcactccagcctgggtgacagtgagactctgtctccaaaaaaaaaaaaaaaaaaaaagtcgggaaaaaatagatcctggggaggctgtggagaaataggaatacttttacactgtcagtgggagtgtaaattagttcaactgttgtggaagacagtatggtgattcctcaagggtctagaaccagaaataccatttgacccagcaatcccgttactggacatatacccaaaggaatataaatcattctactataaagacacatgcacatatatgtttattgtagcactatttacaatagcaaagacatggaaccaacccaaatgcccatcaatgatagactggatgagaaaatgtggtacatatacaccatggaacactatgcagccataaaaaggaatgagagcatgtcctttgcagggacatggatgaaactggaagccatcatcctcagcaaacacaggaacagaaaaccaaacactgcatgttctcattcataagtgggagccgaacagtgagaacacatgaacatagggggaaacgacacaaaccagtgcctgttgaggggtggggggtgaggggagggaacttagaggatgggtcagtaggtgaagcaaaccaccatagcacacgtatatccatgtaacaaacctgcacattctgcacatgtatcctgttttgctttttaaagaaaaaactaattaaaaaataaatacatgaagtctaggccaggcatgttggctcatgcctgtaatcccaccttgggaagccaagaaaaaaagaaatgttaaatctaaatgtacatcttgttttatgaggggtatgtggaacttagggaagccaagataggaataaaaatggttaaaaataaagaatacagtcgctgaatatatgctctatgagccataatgcaaattttaaaaatttaatttgatgtgacttgaattcctggagagctttttctttgggttttcttttaaccttggcttgtacgttagatatgttttgtattttagaaagcaatttgtggaaaattggattctgaatcacatttttctgttgtttctcctgagtaagtaatccttatcaaagagatttcaatgtgcagtaaaaatcatctcaatctaagtgtttcttcagccttggccgttgtgactatttctgtctcccctacctatcctgtatattaatttaaaaaccttcatcccaggcccggcgcggtggctcatgcctgtaatctcagcactttgggaggctgaggcgggcagatcacaaggtcaggagtttgagaccagcctagctgacatggtgaaacgctgtctctactaaaaatccaaaaaattggctgggcatggtggtgggcacctgtggtcccagttacttgggaggctgaggcagggaaatcgcttgaacctgggaggcagaggtcgcattgagctgagatcgcgccattgcactccaacctgggtgacagagcaagactctatctcaagaaaaaacaaaacaaaccttaatcttgacattttcttttccttatcagtcattagttacctcatggggccaccctagcccctcatctcttctttttaccttgctaaggtataggttttgacactgccatgggtaaaaggaaggagtgggaaggaacagtttccatagcctttctacttcctgcttcctacggttcttgtaatcccttctaccactactgctccttcaatgccagcccccgttactgggtgccatgataaaaatcactaaaactccctgacccgtattcctctgaaatgttagtgcttcgtatattcattggtctgtcagtgatcccctcatttgtctgagtggaaaaagaggaacaaataatcccccattttatgttatttctggtgccagtggctttaggagactcctaaaggttaggggacaatcctctgttcaagagataagcactgctagtagaagggagagcaggccagaaactctgaggttcttaccagaaataacagcagaacaacaccagcttccggttttttgaaagccagcaatgactttaccagagcagtttgtgatttccatatttttgactatccttaaaacaaatttgagcaacaggtgttattcctattttatagataagggaatggagacacaaggaaggtagttaacttgcttatgttcatatagtgcagtaagtttcagagttggcatttgaatctaaacctatctgattccaaagcctacactcctacactgtgctgtgtggcctctaaagtaaaataaacagaggacagagagctaagacccagaagctggcttgggttttatacagacttagggagaagcccatgtgcagtttatctgctccagccccttacaagccttttctctaccttcacttctttttggtccctgtgctacctgagtttcttaggattactagtagagacttggatccaggggaggctttggagataggaattgagtccttgtttctttttttttttctttttttaattgagatggagtttgttgttgcccaggctagaatgcaatggtgtgatctcggctcaccacaacctccgcctcccggtttcaagcgattcttctgtctcagccccctgagtagctggtattaccggcatgcaccaccaggcctggctacttttgtatttttagtagagacggggtttctccatgttggtcaggctggtcatgaactcccaacctcaggtgatccgcccgccttggcctcccaaagtgctgagattacaagcgtgagccacctcgcccggcgagtccttgtttctaatgtcagggctacagagcgaaggaccatatttttagcttctgcaagcaggcaatatgaacacttctacataattttttttttttagcttagagttcttcagtgctcttctatacgggactgtacttgagacacatcatgggtaaagtaggcctttctagaccagcgtagcattgtttctatgggaaaatatgttagtagttccagttaatagacttaacatacacttttggaacgttacccatatgggagttggaatctgtactccagattttcagtagaacttaaatcaggagatgactcatggaagggctgttttcattagatccatctacaatagctccctgttttatttgtatccatttaatcaggtgctaataaataatacaaaatgatttcactcctttaaaaaatgagttacatttttaatgattttttatttttgcactttttgacagattagtataaatacaggtttaaaattcaaaagctataagaagatatataatgcaatgttaagattttatctaatccctgccctccggccagggagtttctttctctgtggattgtgaattttatgttgggtgttgaattgctttgcagtgttggacttgttctgctgtgcagttacttggaatcagtttcatccttttaagctttgcttttaagctttgttaagataggtttaggataggtccagaccaacccttaattggtcactttagtcccactactaagaactcagaacatgatgctttgtgtatattaagaggtcttgcactgttcccaaccttgtgttgttctttctatggcctcaggtggtttccttatgcatacatagtttcatattcagccaaagacttgaggagacccttctgtagccctctgaagctctcattctgtgcagatcctccttcatttctctgctccacagagttagcctttgtaactttcttgaactctgatgtgtctcttgaaatcagctctgttttactctatgttccttctgccatagcctggcaactctctctagacagtattgctgggacagtcataggactcagttttaaatattttaggcattgtagccctgtctgcctgttttcccatgcctgaaaagtgtgtgtctgtgtgtgtgtgcgtgcgtgtgtgtgtgtgtgttttgtacagtttgaagttgtttaaagtggaagggtaaaactagtctggtccctgttatttcatcatggtcagaagctgaagtttgtgggtatgtttatggacttaacactagtactgcactttcttagttaccataacttaggcttgatctttggtagaaaaaaacatctcccagcttgtttttttttttttctttccttttcaagatattcttggctatccttggttcttaacatttttttttctttttcaagagtttcttggctatccttgattcttacacattttccattttccaagtgatttttttcaagtcagcttgtcactttatgcaataaaaatttactgatgtattgattgagattgcattgaacctatagaagtcagcttgtcacttttgattattttgagtgctattacaattggcatattaaaacattattttgtttgtagctggtatatggaacaatttttatatttccttttatctggcaacctcataaaatttattaattataataatttgctaaacattttcttttgaacttgtacattcacagttgtatcatgtgtgaacagtgactattttattcatttttttccaatctgaatacctttgttttccttgccttatttaaatgactaggatatttagtatagtattaaagggagttggtgtgagtgggcatccttgtttctcatatcagagggaaaactctcgacattataccattcaatgtgatttttgctattaattttttttgtacaatcttttgaacagattaaggaaatcctctttctggagctaagatgattattggaagaatgttaaattttatcaaatgtcttttatcgagattattatatggtttttctgttctgttaatgtgttgaaatatgttgattgatttttcatattttaaacttgctttattccctggatatttgaaataaacacagctttgtcatattgtatctatatataaatgtagttttagaaaataaatacaatataaatatataaaatgtttttatatatactggatttggtttgctcactttagtggatattttttcatttgcgtttatgaacaaccttatcctatagttttcctttcttgtaatgttcttgtcaatttgttttttcatggtgcagtgctaacattttttgttttttattgagatacaattcactaccataaaattcactcttaaagtgtacaacttgctggtttttaatacatttgcagagttgtgcaaacatcaccactgttaaattccagaacattttcgtcaccctgaaaagaaaccctgtatccattagcagttattttctttcccttagcccctggcaatcactaatctgctttctgtctctatggatttgcttaatctggacatttcatattgatggaatcatgcaatatgtggccttctgtgtctggcttctttcactgatcttaatgtttttaaggtccccctatgttgtagcatgtatcagtatttcattactatttatagcccttactgtggccctcccttttgtggactaaaacatagactaacaaaaagagagctcttactttagctataaggtagctattgtctatttaaagcgaattttaggaggagacatgaaaataaaccaagtattgcaagttaacactgggatttagtcaagaatatgtctattattattgtactttaatgcaattttatttcatgttttttagctttgtgccctcctagggttggttttatcatagtctgcctgagaattgtgaatatgactctaaactctagtgggattctagattgaggcctcaggagaactgatattttattaaatgaatgttttttattcctttacatgatgaaaatgtactagaggattctgtggatggttgggaagaaagacactcagagctgccacatttaccagaatatttaagttgccaaggaattaattatttagattgattacttagtatttgtccgtttcaagtgcactattttaggtggattaacatgtaaatttcactataatctgataagatgggtgccagtaattatctttatagctaaatagaggtgcacagatacagtaagtagtaattagggctggaatttgaacctaggcagtctgacttcagccattatcctagattgctactgggtttgttgctcacatttgcagttgaggcagcattccaatcaatcccttagttgcatggtatattttatatatcgtagaatgcctttacatactcattcaatataaatttctcaacacaaccaggagcaaagttgaagtaggtacactttcttttgcttaatattgtacattcagagttttgttcacataataaatatttattcaacagttgtattttaaatactactagatatcacacattgtgttctttggaaattccaaagatgagttatgtgtgaatactgtcctttaggaagaaagttaagatataaatcatgatacaaattacaaagtgccctaatagagtgttctgggagatcttagtcgtgacatgtcattctgtattgttaactttatttttcacttggacttggttgtttcacccttctgtctcttttcagttttaaattgggtgatttgtcccttcagttgttagtcattctgaggcttgtttttattatttgtgaaaataaactagaacatatggttttatttggttttagggaatgacagaggaagaggaagacaaacttctggcactgaaagacttcatgatgaaatctaataaagcaaaggccaatatagtggaccagagccatcttcatgatagtagtcagaaaggtgtaattgacttggcagctttaggcataactgggagacaagttgatcttgttaaaaccaaacaagaaccagatgacaaacggggttagtatgcttgtttgtgtgtgtgtagcttgttgttgttagttatttcataagactgttttttagctaattaataataaaataaaaagccccatttcacagataaagaacttacaaatacagtgactccattacttagcagggagattttggggaagaaaaatagggaagcgaactaacagttaaggaagtaacttgccagaatcacagctctgtatgtgacaaaccaaggtctgattccaaagctctacttttacagtaaaatcacgttgtcaccatggaggtgtatgattgaagatgaaattctgttttttaaccctttaaccagcaacccaagaacaatagtttgtgtaaaatggtatcaagttttctagttcattagtagtaggtaatgcccagtgaattaaaaagaaaggtcttgctattaacaatgaaatacaagagtagagaccagacaagacttaaccatttgtagtcttgagatctgaaactgtgagctcttgtgacattgacattgattatatgaagttttttaagatcctgtgcataccctttttgcacatatattcactgccagttacatgcctttaaaatttcctctattctagcattagattttgaaggcagctaatgaattacatttaaaataaacttctaattgccaaatttgagaaaaagtatttgtaacttaagttttaatggtttatatccataatatataaaacatacaaattaataagaaagcaagccaaaaaaagaaagattgaaggatatgaacagacaactgatagaatagaatgcatatatatgaaaaggtaaatagtttaataaatgcaaattaaaacatgctattttcttactattcactagatatagtggttacttgaaattgagctggctttgggaaactaggaagtaattaggtcttattattaacatcattggaagcacatatgttccatctgccctagaaatgaagtgagagttaatgaattgatacatgaatatgaataaattagaaatcttaaggaacaaatagaatatgaagtgtattgctatccctgcctcctctactgtcccctccaaaggcaataaaagcacataatggttttaaaggctaccttcagactaactattctgaatatattttcatagccagaaaacatgtaaaacaagactcaaatgtaaatgaagaatggaaaagcatgtttgggtcactggacccaccaaacatgccacaggccctacctaaagggagtgatcaggaggtgattcagactgggaaacctcctcgttccgagtcctctgctggcatttgtgtccctttgtcaacttcttcacaggtactgtgtcacccagtcagtagtcctcctaatgtctttgaacgctcttctgctattttggttgtttaaaggctgtgtactgtagtggaaaaatcaatatggtgacttgtcttttagggaggtcatatttctttctaagacaggtttatctttaattttatggtgaggaggaaatctagttattgaaagtactaaaaagatctcattttagagtacttggcaatacagtgatctgagattgtgggttgaagacattattatgaactgtgattataattaggctgcagtgaaccttttaaatcttttttattcctcctccagtataacatagccatatctataaaatagcaaaaatacttctgggaagaagtcccaaatttcctacgtgtgataaatgtcatgatgctttttatgtacagatcattcctgacttaacaatggttagacttaggattttgtgagtttatatggtgtgaaagtgatattcattcattagaaactgtacttccggtacccatatagccatcccatttttcatgttcactacagatttcagtaagttacatgagatattcaacactttattataaaataggctttgtgttagataatttgcccaactgttggctaatgtaaggttctgagcatgtttaaggtaggctaggctaagctgtgatgttcagtagttgggtgtattaaatgcatttttgacttaatgatattttcaacttatgatctgctttttgggatgtaatgccattgtaagtcgaggagcatctgtatttgaaataagtttgtaatttaaggcagctctttcctagtcagtcatatcttaaataaaaaacattaattgaaccagattaattgaattgaaattccatttcttcttttcacttaatgataatttttgtttaatgttattttcatgctgatcagtttttttatatataaaatgtaggatttatataaaaaatggaaatgtagcatttgtggttatacttcattttaactgggttttcactaaaaaatgtaattgtaattatatcgattttaaaattggtacattaatgaggacaaaaagctgttataatttatagataaaaacatgcatacacttctgtcttcaaatatactttgcttacgacgtaaatagttagaattctatttgttttgtaggttccagaagtgacaactgtccaaaataaaaaaccagtaataccggttttaagtagtacaatcttaccatccacctatcagattcgaattacaacttgtaaaactgaacttcagcaactcatccagcaaaagcgggagcagtgcaatgctgagagaatagctaagcagatgatggaaaatgctgaatgggagagtaaaccaccaccacctggtaaaagttccgttgataagtagttgtagtctagtctaggtgcttaaggctagaatctaatagaggaaatgaatacttaactaccagacaaaagaggtaagaacaaaaatgttatttgggaaacccagaagaagaagcagtaagtaagaaatcttgtcattatttgtggagttggatctttttacaactggcaaagtcatgtttaggccaatcatgtaataatttagcctatctgtgcttcattttccccatttatagtactaggttttgcctgtttaatgccttgccactttttcacttgaatgtctggcttctttgaccaaattcctgcttttaatttctggaaggtttaacatactttcattaatattatttaagaaaaagttagaaaatttagaaaatgatgagtactttttttaaaaagaaaacaggctggttgtggtggctcatgcctgtaatcccagcactttgggaggctgaggtggacggatcacttgaggtcaggagttcgagaccagcttggttaacatggtgacaccccatctctatgaaaaatataaaaattagccaggtgtggtggcacacgcctgtgatcccagctactccggaggctaaggcaagagaattgcttgaacctgggaggtagaggttgcagtgagctgagattatatcactgcattccagcctgggcgacagagcaagactctgtctcaaaaaaataaataaataataaagtaaataaataaaaagaaaacaacatcacctctaaccctacgccttaacgatgatcaacattaaaattttgaggaaacagttccatattctgttaagacttaaaagcaatttagagatacttcaaatgaaaatctgactcaactatcttaacagacttgcctagtgtaatgtagcagagttagtctttgatactagatttgtaggtttaaaaatattttttgagtttctgtctacattttaatgataaaaattgaaattgagaagatgcatagtgtgcttatatatagatatttacaaatcatgtgaattcctatgggctactgatgtggacttggggaaaatgctggtaaaggtcaatgatttaaagatttagaaagtataattaagtggcaagtggcatcattagttgcataaattttcttatcaaaataaatattttggaattgtttaatgttcaaacggtttttgtgatataccagcacaactttaaaaacagtgaaaagttgatcataaactgctgtattttatgatagaatctgtctttgtaagtggtgtattatacttagagtaacgtattttatttaataaatcacagaaaagatgtcaaattttgtagttcagggatttcagaggtagcaggtacccctgtgccttcattttcaggtaactgctgtgccttctcagatcctggagaagggccccaggggctgcctttctgaagctatttaagcaacacttaattgccaaattgatgtctcagtaaataatatctgtcatggtccagtagaccactctttattggcaactattggtactttcaaatattttagttcttatgattgttttcaagctggttgttggttattataacaggggatgatggggacattgtatttgtaaactacagtttatgatacactcctttgcttttccttaggatggcgtcctaaagggctgttagttgcccatcttcatgagcataaatctgctgtgaatcgaattagagtctctgatgaacactcactttttgcaacatgttcaaatgatggcacagtgaaaatctggaacagtcaaaagatggaggggaagaccaccactaccaggtaccatatgctcaggaatgaatcagttcattaattcaaatcaacaaatgtttattgagtgtttactctataataaccactgttttgggtaccaggcatacagcaacaataaatggacaaaaatccttcttctgtggagtttaccttctagtggaaagtgagagacaatgaaagtataagtaaaacagctaatgtgttagatggttaaaaaaaattgtggtaaaaaatacagcaggaaaggaagctaggaaatgcagtagaggtggggtagggtagaattttaaataaattaaccagagaatgcctcacagggaaaatgacatttgaggaaggacttgaaaaaagtgagagaaagccatatggatatcttgtggaaaaacattccaggcagaggaaacaggcatttcaaaggccctgaggaagaaacatgtttggcatggttgaggaacagcagaaaggtctttgtggctggagcaaagtgagcgaggtggaggagtaagaggggccagttagatatggctttgtaggctgttgtaaaggactttgaccttgactctgagtgaggtggggagcctttgaagagttccgagtagaggagagatgtcatctgagttagttgtcaacagaattactctggctgttatgttgagaatagactgaagaggagcagggcagaagcagttagaagactattaaataatcaggcaagagctggtcgcttggtagcagtatgaggtggtgggaaatgatcagatcctggatataacaagatttgctgaatgaatggattagatggaatatgatcatgaaaaaagtaaaaaaattatagaatggctaactgtgtaaggaaaacaaatagtgtaccattgccacactcctgcggacaagaaggatataatttatgacttcaaatccctaagactttaaatatgcatgatgtgattttaataaatgtgattatgataaatattttagatttgtacaactttataagtatgtccctatctgatttgcagtttgtcctccctctctttctttctttctctgtattggttctaccatattcttatttgttctttgcctagtttggtctgaaaagaaagctgctagaaatcagaattgaatctcatctgtgtaaacagatgtggagaatctctggtgcttttcttgttataagttcattgaccataattagccacaaaatcatcaaacaacaaaatatctttgataactaaaataatttaaaaatttacttaagattttgtgccgattagctctatatttttacaccattcttaattattgtatttttcctcattctctgtttgtgttgtattggtcagaacataatttaaaaagaagtaaagactcctaggtccgtggagcaatttttttttggtcaacattttactataaaatattcaaatatgcaagcaaagttgaaagtgtttcacagtgaacatccatgtacttgccacctagatttgtaatgattttactatatttgctctgttttataactattcatttttctgcctcccatcaatctattgtttaaaatttttatttttattttatttcttagagacagggtctctttttgcccaggctggagtgcagtggcctgatcatagctcactgtaaccttgcactcctgggtttcaagcaatcctcccgcctcagcctctcaggtaactaggactacaggcgcatgccaccacacccagctaattaaaaaaatttttttttttacttgagaaatggggtctcgccacattgcccaggctggtcttgaactcctgacttcaagtgatcctaccctctcaagtctcccaaaatgctgggatacaagtgtgagctactacctggccccatttttttttaatgatttcaaaataagatacagacatcagtatgtgccctctaaaaagttcagcatgcgcatcattaacaggatttcaatatttatagctcttttttcttcttgatataaaatttgtatgctatgaagtacacagatcttaaatgaaccattccatgagttctgacaaataataccactgtatcctgaatccctctcaagatgcaaaatttgaccatcataccaggaggttcccttctattcctttcttttaaatccctgctctttccttcccctgctactaccattcttttgattttttcctaaccattcttagcctttttttttttttgagacagtctcgctctgttgcccaggatggagtacagtggcacgatcctggctcactgcaaccaccgcctcctgggttcaagtgattctcctgcctcagcctccaaagtagctgggactacaggcgtgtgccaccacatctggctaatttttgtctttttagcagagaggggttttgccattgttggccaggttggtcttgaactcctgacctcaagtgatccgcccgcctcagcctcccaaagtgctgagtttacgggtgtgagccaccgcacccagcccattcttagcattttaattagcattttaagtacctcttcagataattgttttccaagtggttctttgttattatcagttggattcattgtcccctttattaggatggtaaattgcaaaaaccctgcttgttagttctcaagtgatttttattacagtcataccttctgtatcccagtgtcatgctttagacagtggtattttggtatcacatttcagataatatcccccaaattttggtaatttagctgactttatagaatttgggaagtctgtatggttaggagactggatctcctctgaatgcagttactcttttgctttgctgtaacacctgctctcgtttgtggccagccatgggccttggcttgggaaagagggtaagaaaatgcagtgtgtcgcccttatcacatgcctttattgactggtgaggggagaaggaagcaattcttattgccagagccaagtgggaaacagctggtggcagggaaagaacagcaaagctaatgtgttttcttaggaaatgttactagtacattctgactaagaggagtttcccccatgagtgatgttggcagaccattcagttcccagtcctgattttcttactgaattatgactggtgatttggactacctagatcttggctctgccattttcttttttcttatttgagttaaactttcagtttgtctctttgggactagttcttgaaaaattgctgtttttctaaacttttgcacagctttttcaacttatttgtttatagtattctaaattatattttctatgttttcttcttgtgctaccttatttctggctcattcagcttctcaattttaggggagatggatgcatttggtattcgttgaaattggggtggtagtaaaatatctaaatggagttctatcacagtgaaaacttaaaacaatatgagcagtacaaaagaaagttgtcaatgttagggttacatgttttggagtcactggtagtgttgaaagtcagcgtttttgagtggctatgaagtaaagggaatatgaagggcaacaaaagcctgatgtctgaatcttaggaagttaaatttttggaacaggaagagaggggcaagaaagggaaagagaagaaaccatttaagttaatattataaactacaatgaaagagaaaacttatgaaaagaatatgtaggcctctctcagtgagacaaaaaccctactagcatgaaaacctcataatgccattgatgcactctcatatagtgccctctggtggaatgcaattgatacctctttcctggaggtttttttacaatatatgtatcacaagcctttatgatgtacatatcctaaggaagtaactaagaatcaactcagatttagtttcaagactgttcagattgactttctttataatagcaaaaaattaggagcaaactaaaagttcagcagcagttatcaatgaaaaacattgataattgtgttttttaaaattaggtttaagaaaagcatatggggtttctattttggaatggcagagtaaggacctccaaaaatctgttcctccataaagcaatgagaatactggcaaagactgtcaaagtcaattttctgagaactttggaaatcagctaacacctttcagcaatctaaagtggattcaagaaaaacacctgactctcagtaagaatagtgagccatgtcgtccttaacttactgtaatcttatccccctttaccagctctgtggtagtctggaaaaacagcctcacaactatggtagttatgaaaactagccccttagtagacagtggaggggtcataatggcattggagctccccaaaagcacatctccagagaattgtcactatttgacctctgtgccagctggctgaaaagttctgttttcagggcccatctttatttgacttggcccataccttgttctttgagaaaactcttactcacagggcacttgttgaaactaatcagcaccatttatttaacatagcagtcatcttgaggtggcatcagcaggctgacagaaagcttaaaaggaagaactgggtaatgagatgtccatatgggcctttgaaaagttttgatctattcttgggtccttataagaccacatgtatgtgtagagttgtgcacatacccaggaagaaactgaaaagaccaaattctcatgtctggctggctttgagactctgtgcaagcaagaactgaaggctaaagcagagatgtaaaatgcttgatggagtgttgaaggtgtgccacaacacaaacaaaaccctcacttaattgttcaaggcattgaaagaaatacctgccagttattaggtgatcacttacctaactgaacagagacttcagtggccacatatgacaaggaatacagactttatagaattagtggaggaaagtcattaaacaaatagcaacactttggaatcttatttccaaaattgacacgttatattaattttgaatgcacagttttgaacaaaagattacaagttaggcaaagaaacaagtaaggatggcttatacctaggaaaaaaccttactagacatagattttaaatcagctattaaaaatatgtgcaaagaactaaaaccatgtctaaatatttaaaggaaagtatgagaacagtgtctaaccaaatagacaatatcaataaagagatagaaatcataaaatagaaattctggaactgaaaagtataataacagaaaatttgctggagaacttcaatagcagatttccactgataagagcaaaaaatcagagaatttgaagatggttggtattatccagtcagaggtacaaagaagaaaagaataaagaaaaatgaatagagccttagagacctgtggtgcactatcaagcattctcacacatgcataataaaagttccagtaggagaggagagagaaaaggggacagaaagaatatttgaagaaataatggctgagaacttttcatgtttgatggaaaacattaatctgcacacccaagaattcaatgaattctaaataggacaaaatcaagggagccatacctggacacatcataaactgttggaagacaaagacagaattttgaaagcagagagagaaaagtgactcatcacatacaagggatgttctataaaattaacagttgatttttaagtcagaaatgatagaggccagaagtcagtgtgttgaaaggaaaagactgtcaaccaataattctgtggcagtaaaattgtccttcagaaaccaaggagaaattaagaatttcaagataaataaaaagagggaatttattgccagcagattttccctaaaagaaatactaaagggagtcctttatgctgaaatgaaagaatatgatacagtaacttcaatccatataaagagatgaagagcaccagtaaagataacataagtaaatataaaagtacaaattatttttgtttgtaactctttttacctgctatctgattttgaaagatgactgcatgaagagataattagaagactgtgtcaatgggcttatgacatgtagatatgtaatttgtatgacaatagttatacatatgagggaggagggaagagacatattagagcaaagtttttatgtattactgaaattaagttggtattaatttgattattttaaggtgttcattgtattctcagagcaatcacaacttataaatgtaatcacaaggcagagttggtagaaggggtgaaaaaacatgatccaactgtatgctatgtatgatagacacactttagatttaaagacataaatagactgaaagtaaaagaattgaaaagataaaccatgcaaatagtacctaagaaagagctaggccatgcgcagtggctcatgcctgtaatcccaagcactttgggaggctgaggcggtggatcacctgagatcaggagttcgagactagcctggccaacatggcaaaaccatgactctactaaaaatacaaaaaaattttgccaggcgtggtggcacacgcctgtagtcccagctactcgggaggctgaggtgggagaactgcttgaacccgggaggtgggggttgcactgagctgagatttgccactgcactgcagcttgggtgacagagcaagactccgtctcaaaaaaaaaaaaaaaaaaaaaaaaagctggagtggccaatgtcagatagaacataaactttaaggcaaaaattactcctagagacaaccaaggagattttataatggtaaaaggatcagttcatcaggaagacataacaattacaaacatacttaacagcagagccccaaaaacacactaagcaaaaaccgatagaattgaagggaaaaatagataattcagttataatagtgggagcctttaatagcttattttcaagatggatagaacaactaagcataagatcagcaaagaaatagaaaatgtgagcaacactacaaaccaaccagatttaacaggtatcagtagaatactccactcaggaacagcagaatttaaatcttccttaagtgtacatgtaatcttttctatatttaaccatatattaggtcacaaaacaaacctcaataagtttaaaaggattgaaagcatatgaagtatgtttgttaaccaaattggaatgaaactaggtatcagtaacagaagggaagttaggaaattctgaaatacatggagattaaacaacatatggctaaatacccagcgtttcaaagggaaattagaaaatactttgagatgaataaaaatgggaacagcatactaaaacttggataatgcatctagaggagtactaaaagggaaatttatcactgtaaacatttatattaaaaaagaagaaagatcccaaattagtaatttaaccctaaccttaagaaactagaagaagagcaaacttaaagcaagtagaaaggaatgataaagactgaagaggaaataaatgaaatagagaatagaaaaaaaaaaatcagcaaaagtagaaattggttgtttgtaaagataaacaaaattggcacacctttactatagtgatcaataaaaagggaggactcaagttactaaaaacaggaattgaagggggcacattactactgacttgacagaaataaaaaaagagtactatgaaaggaataccatgaacaattgtatgccagcaaattagataacctaggtgaaatggatgaattcctagaaagacacaagctgctgaaaatgactaaagaagaaatataaaatctgaatagatctataataataaagaaattagtaatcaaaaaacctcccacaaagccctggctgagatagctttatggtgtattctaccaaaggtttaaagaattacaatagttctccattatgtgtggaagagacaatccaagacccctagtggatgtcccaaacctcggatagtaccaaaccttatgtatactgtggtttttgttatgtgtacatatctatgataaagtttagtttataaattaggcacagtaagagatcaacaacactaatagaacagttacaataatatattttaataaaagttatgtgaatagagtctctatctctcaaaatgtcttactgttctgtactcacccttcttgtgattatcaatctcataactgggacagctactaagtgactgactgatcaactagcaggtaatgtcttcagctggataaaggaatgattaaagtcctgggcaggagggaacaggacagtgtgagattttatcacactactcagaatggtgcacagttcaaaacttatgaattgtttattctggaatttccatttaatattttctgactgcggttgaccacaggtaactgaaactagggaaagtgaaactgtggataagaagagactaatgtaacatccattcttcaaaaagtcttccaaaaaataaatgagggaacacttcttaactcatcctttgaggcagatgtcaatctgataccacagccagataaacagttcacaagaaagctgtagaccaatacccataattaatataggtgtaaaaatctaccacaaaataatagtaaactaaatccaacatgtaaaaaataatatcatgaccaagtacaatttttcttaggaatataaggttggttcaacacatgaaaatcaattaatgaatgtaccatattaatagaataaagggtaaagaccaaatggtcatctcaacaaactctcagaaagtatttgacaaagtccagtatcattttatgattataaccaactcaacaaaccagttagtaatagaaaatgaataaaggccatctacaacaaaaaaccctacagctaacattgtacttaatgttaaaagattgaaagctttccccctaagatgaagagttagacaagaatgtccacttttgccacttatttgaatactgtactggaggttctagccaggacatttgggtaagaagaagaaattgaaggcatacaaattggaaaggagaaagtaaaactttctgttagtagccagcatgatcatgtatatggagaattagcaataattaaacaataattgttttaaaaacttactagaactaataagttcaacaaagttgcagaatacaagatgaatatataaaaatcacttgcatttctttatggtagcaatgaatagtccaaacatgaatttaagaaaccatccatttacagtagtatcaaaatgaacaaaatacttgggaataaattttacacaagaaagtataagatttgtatactgaaaaatactaaagatcattgaaagaaattaaagaagactcaaatgaatagaaagaaaccccatgttcatgcagtggaatacttaatatcattaagatggcagatctctcgatgtacagatgcgatgccatctctatggaatttctagctgccttttttttttccctgaaatcgatgatctgatcctaaaatccataaagaattacaagagactcagaataaccaaaacaatattgaaagaaaagaaccaaattgaaggactcacacttctgtatttcaaaacttgctacaaagctacagtaaattaagacagtgtagtacgggtataaggatagacatatagatcatgtctatgtctatgtctgtgtcatatattcatggtatagaactgacatgcagaagtacatttatggtcattttttttttgacagaggtgtcaggatatttcagttgggaaaagaatggcctttagaacaagcagtgctgggattataggatttccgcatggaaaaagatgaatttcagtagacttattcaaaatggatcatagactaaatgtaagaactaaaaccataaaacttagaagaaaacataggcatgtaaatcttcatgaccatggattaggcaaggatttctgagaaattacgtgaaaaacacaagtaacaaaggaaaaaatagacaaatgggacttcatcaatgttataaacctttgtgcttcgaaggactctatcaagaaagtgaaaagacaatccacagaatgggagaaataacatatatcatatatctgataaagatctattatttaaaatgtataaagaacacttacaactcaacaataaaaagacaaatgacccaattaaaaagcaaatgatgtgaatagatgtttctccaaataggaccaataagcgcatgaaaagatgcttcttagtcactagagaaatgtaaatcaaaaccacagtgagatactccttcacacccactacaatggctatagtaaaaaaggcagtgaccagtgttaggatgtagataaattgaaagctttatacattgctggtgagaatgtaaaaacagtgcagtaactttggaaaacagtttggtagcctttcaaaacggtagacatagagttaccatatgaccctatgattccattcctagctatatacccaagacagttgaaaacatatgttcacacaaaaatctgtacacaaatgttcatagcagcattattcataatagccaaaaaatggaaattatgataaaatgtggtatatctatacagttgaaaaccagccataaaacggaatgaagtactgctacatgctataatgtgagtaaaccttgaaaacagtatgctaagtgaaagtagccagatccaaaggccacatattgtatgatttcatttatattaagtattcagatagataaatccatagagacacaaagtagattagtaattgccaggtgctgggggaagggagcattgggaagagacagctaatggatacagggtttcttttgggtatgctgaaaatgttctggaattagataatggtgatagttgtaaaatgtggtgactttgtaaacccctttaaaagggtaaatttggtgatatgtgaattatatgtcaatattaaaagagatggggagagaaagcctaagtgtgtgtgagagaccaagcatattggcactcccatctctgccattgcttgtcactggctgtctttactcatttacagtactgattgggcccctgtggggcccctgtgggcattgtgtttgagacatttgtccacacaaagacttatacacaaatatttatagcagcgttattcataatagccaaaaggtggaaatgactcacatgtttatcagcagatgaatggataagcaaaatgtgatgtagccatacagtggaataatattaagcctaaaaatgaatgaggtattacataccacaccataaactttgacattatgttatgtgaaagaagcttgatataaaagaccacacaatgtatgactgtatttatatgaaatgtccagaacagggaaattcatagaaaataaagttgattagttgttgccagaggctagggagagggggaaataaggaatgaatgctaatgggtatgaggacagcttattttttgatttcttataattaataaaaatggcctggaattactggtgatctttgcagaattctgttaatatactaaaaatcattgaattatgcactttaaaatctatggtatttgaaaatcatttcagcaaagctgttattaagaaaaacaactaggccaggtgtggtggctcacacctgtaatcccagcactttgggaggctgaggcaggcggatcactaggttgggagatcgagaccattctggctaacatggtgaaaccctgcctctattaaaaatacaaaaaaattagctgggtgtggtggtgggcgcctgtagtcccaactactcaggaggctgagtcaggagaatggcctgaacccaggaggcagagcttgtggtgagcccagatcgcaccactgcactccagcctgggtgacagagtgagactctgtctcagaaaaaaaaaaaaaaaaaaaaaaactagagagagatactgataaaatatatgaaatattacagatttttttaaaaaaaacaagtgtgaatgtattgtaatatgtatagaaaaccttttgaaggatatgtaacaaaatgttaagtgtttctgggtggtattataaatgtttttacatttctgtatttagtacacttaatatgcattaacttttataataaagtgaaataaattacacaagatagatgaatgtgttcggtgttcaggggcttttgaccttttagaggtatggccccttagaagcgtaaagttgcagtctgtgtggagagtaatggaggagggagttggtgataatggaggtcccctgtgtagatgatatattcaagaagtttggcagtgaattcaaagagagtagaaaacacagcttgagaggtcagcatatgtgtgggagagactgaatattataattttgcatttatgaatgttttatggtttacatattacctgattttccctatggtccggttagggaaataggtcagtacttgttttgtagatgagtaaactgaggcatacaactggttaagtagcttgaccaacatcatataagtagttggtagtagaagtccgtgattccaaagccaatgcttttccttctgtgccaagctgtgtgatagaataactgaagggtataagagtgagggtttaagatattccaggagttgaagaagataggatcaggaccacaagtatgggagttctcattagaaaagagttcaaaaccagcctgggcaacatggcgaaaccccatctctacaaaaaattagccaggcatggtgatgcacgcctgtagtcacagctgccagggtagctgaggtgggaggatcacttgagcccaggaggtcgaggctgcagtaagctgtgatcgcaccactggccactacactccagcctggcaacagagtgagaccctgtctcagaaaaaaaaaaaaaaaaaaagaggagaaggaggggtagtctatgatagagagaagtgtgtgcagatggccatttgaaaatatcggaagaaaaggcaatttttgtaacagttcttttgagaggaaattcttgtttttgtcctgagatcagggagattaaatggaccccaaagtaataattttgcttgctaatggccatgtggatatttaacattagcagtgacattggttcataaatgaattttatttttctttcattcagatctattcttacatacagccgaattggaggacgagtcaagacgctcacattctgccaaggctcccactatttagccatagcatctgataatggtgctgtccagcttcttggaattgaggcttctaagctgcccaagtctcctaaaatccatcctctacaaagcaggtatcttatcttttgtctttcttaaacattgtatttagtgcactacagtaccttaagtctcctttctaccctgcaatgtagttgggatcaactaagggcctcttacattgcacttctttttttaagcccataaaataaataaataaataaataaaattttaaaaatgtgcttccagctcaaaactgtcaaatgtggttagtctcagaagatggtatctatgtatcttatcttctgcaaacttgtcaagaggtcaaaggggcagctttgaacttgcagctcatcccagtctagaatttgtctgaataacctaaaattaccagttatatcttctgtctcagctactaaaaacacaactctgcctgattttgagaatgtgagtgttcttcattaaggaaaactcaaatgtcagcattctgttgcttggcattaaaatctctgaagttgatggggacatggagaagagcatttagacagatgatttgcttatcattttaaaacaaaatagcggtggttttatttaagaatgtttattttttataaattgtggttgcttgcagattaaatgcatacaaggtaagatatttaaagacaaagcagaacaatttttgaccaatatgtgttacacactgaagatttcaaagacaagatatgttatgctttaagaatctacagtctagtggaagaaatagacaagtgaacagacaatttcagtgcaatgtggtaatttttacatggataacaggagccagcttgaaagggaagacaacaggcaagaccaggtgtgagttagccaggtgaagcaaggtggttaagaagggccaggtggaggtggtggaccccacagaagaaagcaaaatgaggagttgtttagtggatgataagccatggccattaggtagcttaaggcagaaagggatatttgttgggtcacctgggcttttgttttgttttgttttgctttttgcatttaaaaagattttccacacattcattgaacagatttaagcagcttttgtccaggacatattctttatggcctttaataacaaataccagcctatttttaagaaagtctgtttccgcagatgatgtctgtatagtaacatatctattgagtttcatgtaaattatttaataacttggcatagtgcactgtgtgatgactgagcccacaggccctacacgcagacagacatgcacattcagtgcacggttgtctctcagccaatggcacttttcactgtaaatgttactgtcttaaagcaaacactagataactacctaactacctaggtaaggagacaggcaggatgtttagcttttactctgcctcacagtgtgtgcttcaaagaaactttgccataaggtcataagtttttgattgttttggttatatcaactgttctcatagatagctcttactaattagaatttgtggaaggaaccattttacattttagttggcagttggattttttcatcactcctcaatgggaaaatatggtcaaaattagaatatttgtaagtacaagtgtttatccaagggttagcagactacagcttgcagtatggtccataaaataagaatgatgtttgcatttttaaagggttgcaaaataaaaataatattcaacaggaatgtatgtgattcacaaagcctaaaatatttacaatctgactccttatagatgatgtttgctgacctctgatctaaaagataaaactaaaactgcctgtatgaatgcatgatatgtgtgaataaaggagactggccaatgttttatgatgttctttttagttttaaaaatgcctcagcttcaaaaaaaaactagtacacttatatagtagaataataatctgcattataaaggaatgagttattgactcatgcaacaacattgatgaatcttaaatgcattttgctaattaacccacttaactgtataccacaaaaagtgaatttaaatgtatgtaaaatttaaaaagttaaccaggatgtaaggggaaagatggaatgcagtctgtgacaaattaatctgttttacaagtgaatcacataatcacattgaagggcatggcgaataaaggagtaactttggaaaacagtttttgaatttgacactgggaggctaatgacaaaaggaactcaactcaaacgttgtattctagttggttgtttttcacagggttaacaatttcattttagcagtttcaggtttaacaattctgaaactttacccttcgtttatatattcaggttgaacaaataagtaaatgtattgtagttatgagagccaggtttgtcactgttagagaaaggtattacagatgaatgaactctggtgctagataggagttggagattatcagtatggactcatgatatttgtgtatgcataggcataaatatatacatgtatacaaacacacgaacagatgcagaaatatagatgtgtccacatgcctgaagtagtatacataatatatcttttagctctggccattgagaggaactagaagcaggcacactgccgtagcaatgaacacatagggcttagatttttgtttctaaataccattcttcaataaaaggaactagtacttctagaactggttgattccaggtgtgtgggaaaaataaaacaagcctggagcatcttgtggtgtcaaaaaattaggaagtatttaaaaaagtacattgaaagggcacaagagctaacatgaaagagcttccagtgggcaaagttggaacaacttgggcaacaaaataaataattgtagtattagattgtaactcaaagaataaaataaatatctgtgaatccatagtggtataaataagtgaataaataagtttatggggaagaagtgacaacttacagaagaatcccagtcaactaatgtagaaggactgagggaaacaaaaagtcaccattagcttaccacaggcatgctccctcaaatggatgttaaaattagtgggccaaagttaaagcagaaactgaatttttgcattgtctcaaagtatttttgccaaatattgagtaattataaagggaaaaaatgtttacaatggagaatcctagcagacaccagcttaattcacatgattcaagttaacatcataagtgattcaggttaaacatttctaatctgaaaatccaaaatgctccaaaaactgtaagttttcgaatgctaatatgatgtcacaagtgaaaaattccacacctgactttatgggacagtttgcagttaaaactttgtctcatgcacaaaagtattttgtacaaaattaccatcaggctaggtgtataaggtatatatgaaacaaatgaatttcatgtttagacttgtgtcccattcccaagatacctcattatgtatatgcaaatgtttcatgctaaaaaaaaaaaaaaacccaaatctgaaacagttgtggttgtgagcattttggctaagtgataattaacctgtacatgctaacatccggtcctccctcacatgatgcactgagaagggcacatcacttctgtggtatctttcccaataaggcataatttcaggataataatgagaaaacatcaaacaaacccaaattgaggaacattctctaaaataaccagtagtcttcaaaaatatcaaggtcatgaaagactgaggaactgtcacagattggaagaaatttaatattgccctgtattatcctggattggatcctggaatagtaaaaggacactattgggaaaactgataaaatcagaacacgttctgtactctaattactagtattatagcaaggttaatttcttagttttgataaatgttctatggttatataagttgtttacctaaggggaagcttgagtgaaggatatacagcaactctactatttttgcaattcttctctacatctggaatttttttaatgtgtcggctttcgttttcttgatagagtcacatagctctggtttcttgactatggataggatataaagtcatcttaaagggagactagtgctatgttttcagtgactggaaacgtctgtgctttgtgtatttctctagaattctagatcagaaggaggacggttgtgttgtggatatgcatcacttcaactctggagcacagtctgttcttgcctatgccactgtgaatggctctctggttggctgggaccttaggtcttcaagcaatgcgtggactttaaagcatgatttaaagtcgggcctcatcacttcctttgctgtggacatccaccaatgctggctctgcattggtaagctaactttcaagtcattggctgggttttgaatgccactaatgcctgcaattgctgtcttgtgaaatcagttttttcctctttgttcattggtaatttttcccgtcttttttttttttcatagtcatgttaaaataacttgcaattttatttttttttcattaaaaaacaggtttgaaagggtggaatcagtatcctaaggcataaaacagtttcctcattgtccttgttcttaaatgagcctccttactttataatcattaagtgatcagatttgctggcattctcttactctggcagtgaagcagcagacttaaggaaaatagcatccaagtttgggcaggcatggtttaaattccaatagctttaggcaggttatttaactcctctgaggttcagctatcttcatcttcaaatggggctaatcctttcaagggcagctttgaggatttaatgaagtaaaaggatctgtcacagtgcctgttgttgagagaagagctaagcaatggtttcttactttattgtttgccttgtctccaaaggctaaagatgaaccaagtgatccagcttgcttaagcaggattttaaaaaatgtattgttgcatgatattccattttatagataacaatttgtgtatccctctatccctcagttgatggatagctgagttgtttctagtgtttggcttttcagagtcaacctgctgtaaatatttgcaaataagtctttgtaaggacatatatttccattaatctcaggcatatatatacccaagaatgggattgctgcttttgtaaaatttcttttttgacaaacaattgtatatatttattgggtacagtgtgtgatgttttgatacatgtattaattgtgggatgattaaatcaaactaacaaatctatcaccttacctacttatttgctatgaaaacatttaaaatttactcttggcaactttgaaatatacactgtattataatcaccattctctgcagtagatcactaaagctaattcctcctaactgaaactttgtactctttgatcaacatttccccttttcccatctgcccctttcttaagtttcgcgtttttccctcatggtgttttgaacctgccgcttgagaaactaccaccttattcttttttggttggcatgcttattcagagagttatcttctgtgcttgaatttaggttttctagattccctaactcatatttgttacactgttaagtgtgtgccctttgctttattactttttatgtagtttatatggaatgcattttttttgccttttgtgtgaataaactgcacagggatagaaagatgtaacatacctgtctatagaatgtttaagagggaagggcaaatggaaacaattgaaatctgatgatagctacaaagctgctgctactttgggattggtaaagtgatcattgaataccagtaaaacatctttgggtatttaaggcaatctgaacattttgacttaccaaattcattttgtatcttctcaatagcttctgtttttgtgggtgccttcggcaattaataacaatgtcagcaactaataaattattcattttcaatttacattattagtagtagcattatgataagcactttatatctcagttatttatcaaccaaaggggtattgtttgaaaatggtgagacagcttcatgagaacaaaacttttttttaagtaacgaaggcatttttcaaataaattcataaaaagctaatactatttttcatttgtataaatgcagcttgatgcactttgatcattagatggtaatctttttttccttttttctttaaggtacaagcagtggtaccatggcttgttgggacatgaggttccagttgccaatttcaagtcactgtcatccttccagggctcgaatcagacgcctctcaatgcaccctctgtatcagtcctgggtgattgcaggtaagatggagggctggctttcatgtgttgggagattttcttggaaagtacataataacctgttgccaaaactcatgtttttagttttattttacatatgaactgaatgcttgattgtcttctgattatggaggttgccactattgatacctcactgtcatctatgttcaaaaatgatctcatcagtcaccatcattactccattcttaactgtccaccaccatctcctatcccttttttcttcttcctgtgtcccctatttttgttacagctgccaccatcttcctagagagctaagttagaaaccttgactcatccttctttgttgcaatttcttgttgctctgcttcctttgtgttgcttgaaagcttcccttcccttccttcattgggcacccaaattttcttttatggctcctgggcatgatacttgggcaagtcttgaaactgattttcctcatctttaatacgtagttaaaaatacttaccttgtagagttatagggaactgagataaaacatgcaaaatacatactctagcacacaactaatgcttgataaataatagctcttattattcttaggttttcccctcagccctcttgcctctaggctctttgtggtcccttcttgtacacatagtccatcgcatacactgctgctatcaaagtcaccgtgttgccaagttctaaggctattactgtgagcccttttcttatttgacttatcatttgatcagttgatttctgttattttcaaatactttccttacctggtttcaaggacatttctcttggttctcctacttcttgatctgctcgttccttctcatcttcctggcttttaaattgtggcctgcctcaggacccagtctttggtctcaaccacttctcctacactggctctgtgtttgatctcatgcagtctcatgctttaactactaaatttattcagactcatacctatttaaaatctctcttaagatgtctaatagccattgtaaactcaacatgtctaactaaaatgaatgcttgatttcctctctactaaatgtctccaccactgcctcctaccctgctcttcctatggtattctttcagtaaatggcagctaggtgctcagaagcctggaattatcctcgactgctctttttctcatcccacttccagtccattagccagtcctgtaagttctattttaaagtatagccagaatttgatcactcttcactacctccatcactatctccctagtccaaaccactataatctctttcccctattaatgtaatatcttcttcacagcctgcttctgtctgtacctcttaagaccatttttttcttctgctcagtaccttccattggcttcttggtccaaaagactttatgggaccggccttcttgccacctctctgacccttatcacctacaattctaacaggaaacagtagcacactcaaggtaggataatttaagaatttattttcaaataaaattgtttacaaaggtttgggtgtagggggtattaaaaaagatagcacagtaatatgggctggtaacagcagagtagcagtagaaggcatgaggggaggagggcatggttactgaatttgggaaggagtagagaaggccaccttgaaaggagcagtgactgtgagatgagggatacaaccagcctgatatgaatgacttgactttcttccctccctccctttgatctcctgctgcggtttcccataggcaagtattagtttcctattacatcacaacttatttttttaataattctagaggccagaagtctgaaatgggttttgtggaccaaaatcaaggtagcagcagacttgtattccctctggaggcactaggggaacatctatttccttgccttttcctgcttctagaaccaaattccttggctccttctttcatcttcagagccagcaacatagcatcttgtttcattgttatactgctttctgttcttgctgccaaatctgcctccctcgcctaaggagatttgtgattacatgtagggccccctgagtaatccagaataatctgtctcaaggtccttaatttcatcacatctgcaaagtcactttgccacataaggtaccattcacaggttccaggggataggacttggatacctttggggccattatttagcctaccacaggctggcggacccagccagagggagtacagaagcttgttgatgtggttcattcaggtcagatttagagcagcaaatggaaaatgaccagcattactgccctttctcctacttatctcccattctcagtctgttcctgccacactgacttgttttttcaactaagcacactcctgcttcagaagggcctttgcatttttgtctgttgtccccactaaaatggaagttccatgaaactgggaatttttctgctttgtttgccatctcttcttcagtgcctagcgcagtgactagcccatagtaaaaatatttactatatttactggctcagtaaatattattaagtgaatattatattgtctctccccctgaaagaaagaaagaaatttttctttctttctctcaggactgcaatttgttttgttgtaatcttctccaactctttttgtctgagtcaagattctggcctttgtttcctttagctgttcagggcaacaacgaagtgtccatgtgggacatggagactggtgacagaagatttactctctgggccagcagtgcaccaccactttctgaattacaggtttgacttcagtttttactgtaaaggatgatattattccccacatcctaagtactttcaggcatttaatcaaacctagtatctgttgggcttttgggttatgtttaaatttgggtttttaataacatcaagtatcatgtggccattgctacatgagtgtttccttgctagtgttctgcattattgggtaaataagttgctagcccataaagcttgtgatgtctctttggaaccccaataagatctagcataattaggaaaaggccagattgaagtagatagggcatacataactggtctctcatttcttcagttaaccaggtgcttgtaaagctactgacagttaacttgcctctagaaatagcactatcatttatggaatacacggatgtcttttatttgactccacatctatttcttttaagccttctcctcatagcgtccatggtatctactgtagtcctgcagatggaaatcctatcctactaacagctggctcagatatgaaaataaggtacactatctcaatactttaataaaatggatacttttacaagctgttattatagatactgatggcactgtaatgtttaaaatcatcttataaggacagctgttaatactttatttgtaaccaatggtatgctgttctatgaaaacctcttttcctaatgcaaaagaaaaaatgcattgatgaagataagccaatgattattagttcctcccattgtcctgaagagattgtcatcatttatttcctctttcctaggttttgggacttggcttacccagaaaggtcctatgttgttgcaggaagtactagttccccatctgtgtcctactacaggaaaataattgaaggcactgaagttgtccaggtactgtagtcttttcattcctttcaccttttgtaagcacaaacatggcttttgtaaacagaattgattaaaataaatggcttgaccaagcgaggagtactttgaatttaggaaatttattttttcttgaattttctgtatttaaaaaaattaacttttattaaggtaaaataagcataaagaaagtgcatataagtaatagctcaaatgaccagtatgtactttataacatcgtaaggaagcacttttattatcctcttacaaatgaaaaaggcacagtgaagttaagtaacttgttcaaggtcacacagctagtaaacagaaagctgggatttaaacctggctttgggactgtaaagtttgtattcttgactcaggcaaaaacttcaagtgagaatatacctttagcacctgggccaaagtaggtgctctgtaaatgaaagtgtgcttccttcatgacaaatattaatgagctttagaagtggtagaatatctgctatgtattttttatattttggtcatttatacctctttttttttttttttttttttgagatggagtcttgctggagtgcagtggcacgatctctgctcactgcatcctctgcctcccaggttaagcgattctcctgcctcagcctcctgaggagctgggactacaggtgcacgccaccacaccctgctaatttttgtatttttagtagagacggggtttcaccatgttggccaggatggtcttgatctcctgaccttgtgatccacccgccttggcctcccaaagtgctgggattataggcgtgacccaccgcgcctggcctatacatcttttaattatattctatcccttttttcttttgatgttggcaaaagttaatatgcacagaatattgacctaagataagttttccatagttataagtggctactcatgaaatccaatgactaggaccctagaatgtcattttggctcctctactccttttgctcaatgtattcgtgaaagcatgactacaaaaggtgttaacttaaatacaacaacagtatctcagaagcaggactactgacgagaggaaaaatgtggtacagacttttaacctctggcttgctcccttttaatcaccaaacaggaaattcagaataagcagaaagtaggaccaagtgatgacacccctcgaaggggcccagagtccctgcccgtgggacatcatgacatcatcactgatgtcgccacattccagaccacacagggcttcatcgtaactgcttctagagatgggattgtgaaggtgtggaaataaaacctactgatttgtataaattttaatagttataaatataatactataactcgagaaaaggcatttctagagaacagattcatttgcttaattttcaaaattatgtctccatattactgtttcatgactgactgactaaatgacacccaaaatggttaagatgtacttgactagtttacttatgcatctctttgcaagaatcagccagccaacaatgtctgggatttttattgtatatgttatagaggtgagaaatgtaaaatatgaaaatgaatatgtttattttgtattgaaaaagatggttgaaaagatggttgtaagctattatagtataaacacatttttgctattaaaaatgctattcaaagcagttaaactgta

SEQ ID NO: 52 - DNA, 71470 bp, Homo sapiens
agtcggaagttgcctgagcagatcccagccggctggctcgagtggccttcgtcgtcccttggcgccctgggagagtcgctgacgggtggactgacggaccgcctgaggacggccggccagggcggtgaaagcgccagccctatggcgcgggtcgcgtgaggcggaaggccgaggacggccggcggcggcgcccgccccggcgatgcgggccccgcccgtcgcctcaggtaaccgggcagccggccccgccgcggccggaccctcccctctccttccctctcttccccacctggcggtcaagggacggctgaggcttgtttctcggctctgggtgctccaggggcccggcctttggaagctcatctgcaaatttttgggagacccacgggggcggggaaagcttggccctggagtgggcggctgctgtcgagtctgtgtaaacccggtctaatccttgggagctaccccggccaggcgaagctctctcctggcaacctgggggagggggcgggtctggagcggagctagacaactcccgcaaagaatttggtccagcagaaaggttaggcaagttgctgccgcccagtggggacgatgctgcccattgcacagtgacactttgatgagggagagttgatgatgggagtaaacagctaacccccattaagcgcttcttatccgccaggcatcatgccaggccattacgttctccacgtctaacttcacagcaaccctgtgaggtaggattgttgtccccattttactgacgaggcaactgagtccctgggtggttgggtgacttaattacccaaggtcacatagctagtaatttgaaccggagcatccgacccaagtgcttaacaattagggcagtggctctccaactttgctacactgtagaatcacctgggggaaattgtaaaggtttctgatgcccatgtggcatcccagaccaaaacaatcagaatgtctggagttgaaagccagacttcaatattttttttttaaagatgcccaagtgattccagcttgcagcaaagtttgggaaccgcatgtaatttgataattctgcatctcaaaaagcatctctctttctccagcttaagtgtgcaggagaattgtctgggagcttgttaaacttgcaggttccacccgcagagatctttaggttgactgaccactacaccttgtgaaagactgttagggatggaattctctgcagggattctgagtcatctggaacatttaaaatgtatgcatcttatgcaaactgctcgtttgcaattttcctaaatatacagtacttataggtgtagcgtctgtaacctctgggtcgtttttacatatgctggaagtctgcctagaccatcctctgaacgttctggccatcccacccaaacgcacacacttctgctctctcctatatgcatatacacacccttttcttttctttctttcttttttttagacagagtcttgctctgttgcccaggctggaatgcagtggcatgatcttggctcactgcaacttccgcctcctgagctcaagcagtcctcccacctcagcctctcaagtagctgggactaccacgcttggctaatttttgaattttttttgtagagatggggtttctccatgttgcccaggctggtctcaaactcctgggctgaagcagtccacccactatggtctgccatagtggtgggattacagatgcgagccactgtgccaggcctacatacccttttcttcctgtctctggctgcattagctttaagcattcccttcaagatacctctgtccctgacccctacccaccttgagtccttccaatttgctctttaggaacatcgtagtgaaacttatcagttatttttctgagttgtagttctatccctacttctagattatgagaagctttagggcagggactatgttttcttcatctctgtattccttccagtgctttgacatacagactcacaaagcttttactcagtggaatgtttgggtccttttatgtcatagatagatcatgttgcgaacagattcttctctatttccatttttgtaaaagatgtttggtagttcccagcttatagagttttgttctttttgcttaggagtgagtattctagttatgttcagcaatttgtccagcagttgaacacacacattgagttcttaccaattgcaaggcactctgtaactaaccatgtgcaatcaacattgtttgatttttaatgtctgattctatcacaatcggacgcaatcatgtctgtagggaaagtctttttattactgttagacctttgcatgtgttccctacttcattgtccaaaaaagtgtttagttgtcatccactaaatgccactgccttgttggtatttggtaaatacaagcagatgggattgccattggtaatgtttggtcctgttcaccaggagagaggacgttaagtacttaatgaagagtaaaatcatgttgtcacaggaattgacaaatttagcacatatttattgcagaatgcctgaactgccattgccccatttgccatatttacaagtttaaaggaaggcagaccaataattcagattggatttgttcttggttggtcttaaaaccatgtaaggatttgcaaaagttagtgaatatgtgtgtgaaggtcattatgaggaggtttttggacaataaagatttttttttgtatagcaattaaacatgacaaagtatgtagactgaattaaaaacacatttcataaaattttttttttcttttttttttttttgagatgcagtctcgctctgtcccccaggctggagtgtagtggcgcaatctcagctcactacaacctccgcctcctgggttcaaacgattctcctgcctcagcctcctgagtagctgggactacaggcacccaccaccacacctggctaatttttttgtatttttagttgagagggggtttcgccatgttggccaggttcatgtcgaactgctgaccttaagtgatctgcctgcctagtcctcccaaagtgctgggattacaggcattagccaccgtccccagcccataaaatattctttataaggattgttatagaaaaattttcttggttccgttttgtattatttggtcagtttttaggcttagcactaatagaaactgatgggacaacttatgttaaattcagatactcaagaaacttgtccttgtgtgtctgatcagatagggacacagtatccagttcttgctttagcacatggaagaaactcaatctttaaggctgaaggtttaagtctgtagttgtgccccaaagtaaaggtgaaaaattccacatgctcagagaacaaaagtgactctaatcatgatagcttgggacctagaaatggattctgtttaatacgaggtactcatcagtgttagcaggtgtgtttcctgacatgtgcaaagactttttgggcagaatagttgattttctttggtgcgagatgatttaagttttaaaattaaggtgcatggagtttcattctaactttttatagatgcggaaagtaacttggtcaaggctacatggttagcttctagcacctccaggactagaaagcaggcctccttcctctggacggtgtcccctttcgcccccgaccccttccccatgagaaaggttgtcttgtgtattgttgtgttgtgtttgcctgtctgtgtgtgcatgggatagggaaggggagagagtgatctgctatgtttgagaaactcaattagatatctagaggcccctcgacttatgatgggattacttcccaataaacctatcaaagttgagaagatcgtaagccaaaaatgcatttaatatacctactgaacagaatagcttagcctcatctaccttaaacatgctcagaacatttacattagcgtacagttgagcaaaattgtctagcacaaagcctattttataataaagtgttgaatatttcatgtaattgattgaatattgtactgaaagtgaaaaacaatggttatgtggataatcagagtacggtttttactgaacgcatatcactttcacaccctggtacagttgaaaataataagttgaggatagtgagtacttggtgtgtgaaatgcacttagctatataaactgggaatacaaagataaataagacacggcccctgtcctcaaggagtctaatcaaagttataataaaataatagtgtagtatctgaagcagctctgtcaaatagaattttctgcaatcatggaactaaatcttacttgctctaatatggtagccactggccacatgtgacttgtaagcatttaaaatgactagtgtaaccaaggaagtgatgtttgactcaaatagtttaaacttaaaactattaaaattaaaagtttttaaaatttaaatagttacatgaaatagctgctgtattggacagaggtctgttttatgcctcagagaaggtctcaggcataaaagatgagaactgtggtggtgctggtagggggcagacagggtattcaaacgttctttgggtagcttaccaaaaactaccattttccatgttttgggagagatgcaggcagaacctgtctttgtttcctgtaattcaggtgtttgataggatctctaatagcatctggtacataggtgaataccttccttttttgccagctttattgatgtttgccttatggggtcaatgggactgcaacagcaatatgaatcatgaggttatatggatgaatttggtgcaccttaaaaaaagcacagtttatttatttgctcagtgttttagcaccctgtatcctatttttcccaagagaaataggcatgtcttataatgtgtaccttccattggtacatttcaaagtatgtcaacttaggttgctttatttgatccttctcccaggtcactctagataggcactgcaggtattctccctgttttacagatgaggaaactatgacaaagaaatgccaggtcaccgagtgcggtggctgacttgtaaacctaacactttgggaggccgaggtgggaggattgcttgagcccaggagtttgaggccagcctgggcagcataatgagactttgtctctataaaaatttttctaaaaattagcggcgcatggtgacacacacctgtggtctgttacttgggaggctgagtgggaggattacttaagcctgggaggcagaggctgctgtgagccgagatcgtgccactgcactgtagcctgggcgacagagtgagaccttgtctcaaaaagagaaatgccagttgacttatccaaagtcatatggtgaggtatggagtcaggacaaagggaagtagcattgcactttgaggcaagaggtggagtttcttgtcccagatccgctgttacttgatgtgatcctgagcaagtcatagctttactttgtttccttacctagtggttagtgacgtctgtcttacctaaccttctagggttgttattggaataaaatgaagtaacatgtaaaagctctttgaaaatgataaattatgcaaaggtacaatgtgctcaagcaagacctcaagtagtttttctttttttttgagacggagtctcgctctgtcacccaggctagagtgcagtggcgtgatctcagctcactgcaaccttcgcctcccaggttcaagctattctcctgcctctgcctcctgagtagctgggattacaggcagccgccaccacacccggctaatttttttatttttattattatttattttattttattttttatttttgagacagagtttcgctcttgttgttcaggctggagtgcagtgacgccacctcggctcaccgcagcctccacctcctgggttcaagtgattctcctccctcagcctcctgagtagctgggattacagacatgcgccaccacgcccagctaattttgtatttttagtagagacggggtttctacatgttggtcaggctggtctcgaactcccgacctcaggtgatctgcctacctcggcctcccaaagtcctgggattacaggcatgagccactgcacccggccaatttttgtatttttagtagagatgaggctttgccatattggccaggttggtctcaaactcctgacctcaagtgatccacccgcctcggcctcccaaagtgctggggttacaggtgtgagccaccacatccagcctcaagtagtttgttttgttgtattatgctgctgtcgtaactcatcagttaccatattgaatactactgtaccatggtgtcatctttgatttctcttgtcttcctcactatgaaactttctcttgggcagccattgtgttttgtttatattaggatttgtcctaaatcctaggacaaatttgacatgtagctggtgtttaatgtttgtttaatgaaataactgatgtctggatgtactttacaaagttttaaagaattgttttttgtaatgagacttgaagctccttgggaacagggatgttgtttattttctgtgcttgttgcatagaaggcatgtaataaatattgtttgaatcaattgatgtaattaatgtcaggctatggtcttagagtgtccaccattgtattgattattttggtaatttgtcatttagaccaaacttgcatgttattttgcggtggtgcttacaagccataagctgttacccagcacacacaacctccagagagaatacctagaaaatgagtacatatagagttgggaaggaaattaagggatctgcaggggagcactgttgacttcttccccttcttcccattatatttacttctggagcattgaaggtagaggtttctctgctagcagctcaggttgatagcagacagccacctggggaggggactcaggatccctaatatagcagttgaagtccttaatcatctaacttgacagttatatcattatatctcactacagtgcctgaaacctccctgttacccccctgaccgccctcaaccttagcctatatggtagccacattggagtttgctcttctactatcccttcagtgtatcttggacacttccatcaaattgctttaatggaaatttagttcccgatgtgtcatgcctgtggtaaggttaaactttcttcttttttttttttgtttgagacagggtcttcttctgttgctcaggctggagtgcagtggtgcgattttggctcactgcatcctccacctcctgggttcaaacgattatcatgcctcaggttcccgaatagctgggattacaggtgtgtgccaccatgcccggctaagataaggttaaacttttgctcattttctgcctccagttttactgaattaattacaaatattcaatcctaacattcagagtccttcaaaattggtcactgcttacctttgaaaccttaccaccttctacatatagctttctttcctttggctctgggttttcggtttctagtgctttttttttttttgctacctgaagcaagtttcctttcttttatgtattttcttttctttctttctttttttttttttttttttgagatggagtctcgctctgtcacccaggctgtagtgcagtggcgtgatcttggctcattgcaacctccgcctcctgggttcaagcgattcctctgcttcagcctcctgagtagctgggattacaggcgcacgccaccatgccctgctagtttttgtatttttagtagagatggggtttcaccatgttggtcagcctggtcttgaactcctgacctcaggtgatttcacctgcgtcggcctcccaaagtgctgggattacaggcatgagccaccacacttggctcttctatgtattttgttctctcttttatctgtgactcccccacccccgccccccccttttttttttttgagacggagtctcgctctgtcacccaggctggagtgcagtggcgcaatcttggctcactgcaagctccgcctcccaggttcacaccgttctcctgcctcagcctcctgagtagctgggactacaggcgtgtgccaccacgcccggctaatttttttttgtatttttagtagagacggggtttcaccgtgttaggatggtcttgatctcctgacctcgtgatctgcccatcttggcctcccaaagtgctgggattacaggcgtgacccactgtacccggcctcatctgcccctttttaccctcagtcttatcacctcaattttcttacctccatcaaaattatacccttccttcaatgcacaattcgtatgctctgtatctgtagtctttcctgatcttaccctgttgttttccagctcagcctatctttcaatcaaaagtaatctttttcctttgaacttccgtggtgtcttgcctatagtttttaaaaatatcacattcaacattttaatgttctaacttatgttatagttatttatggtaggtattagtctgttttcatgctgctgataaagacatacccaagactgagcagtttacaaaagaaagaggtttaatggagaaatcctagttccacgtggctggggaagcctcacaatcatggcagaaggcaaggaagagcaagacacatcttatgtggatgacggcaggccaagagagaacttgtgcaggcaaactccggtttttaaaaagccatcagatctcgtgagattcattcgctgtcatgagaacagcgcagtgaagacttgcccccataattcagtcacctcccacagggttcctcccatgacatatgggaattgtgggagttacaattcaagatgagatttgagtggggacacagagccaaaccatatcaatgtatacatcttaatctccttaattaagccataaactcattgaaaacaggaaccaagtcctattaatctttcttcttcatggttttaacactgcattggacaaaatagatggttaatagctgtttattgaataagtctacttggtggtccccgccagtgtctctgaatgttcatatgtatagtcaggatgctgacatatacttaccaattctatgacataaagatgtagtaataaaaacatattacattaagttgtaccaacatttctaccactaagttaaaactacagttgactctcgtacatcataagggttaggagcactgaccctgtgcaatcaaaaattttcaagtaacttttgactctgccaaaactagtaatagtcttctgttgaccaggagcctggccaataacataaacagtcaaataatacatattttgtatatatattatatgctatattcttaaagtaagagaaaagaaaatgttattaagaattagaaggaagagaaaatgtatttactattcattaagtggtagtggatcataaaggtcttcatcctcatcatctgcatgttgagtaggctgaggagtaaggggaggcattagttttgctgtctcagggatggcagaaatggaagaaaatccatatgtaagtggaccttagcagttgaaacccatgttgttcaagggtcaactgtacttgcatttctctaccatccttctaatctttagtcacagctgtatgtttatctttttttttttttttttttgagacagagtcttgctgtgttgcccaggctggagtgcagtggcgccatctcggctcactgaaacctcaccctcccaggttcaagagattctactgcctcagcctcccaagtagctgggattacaggcacacaccactaagcccagctaatttttgtattttttagtaaagacagggtttcaccatgttggtcaggccggtctcgaactcctgacctcaggtgatccacccaccttggcttcccaaagtcctgggattacaggcgtgagccaccgcgtctggtgtatgtgtttatctggttgtaattatgatatatatgtttttctttctctaatagttatttattgattgcttacatggacaagggcatgtttcaaacggattacatatgtgattctttaatcaccaccacaagaaacacaatgtgtaggctcctaatctactatttgcttttttttagacagagtcccgctctgtagcccaggctggagtgagtgaagtggcacaatcatggctcactgtagccccaacaccaggatccaagtgatcctcccacttcagccttcagagtagctgggactacaggtgtgtgccaccacgcctggctaacttttttgtgttttttgtagagttgggttttctccatgttgcctaggctagtctcaaagtcttggactcaagcaatgtgcccgcctccgcctcccatggtgctgggattataggcgtgagccaccatacctggccttattctattattatccccattttacagatgaggatgttccaacacaaaagtagagtaacttttgcaacgttacccagcttgcaggtagagctgggatttgaatctatgaagcctagttccagagcactggctcttaaccactctcatctatgtttttatgcttctctgtaatctcagtgtttaatggctacataatagtatatagaattaatatgtcctaattatgaaattttcccattattgatggaagttaaattacacccacttccccatcttatatgtaatactacagtgagcatcttgtacatttttaaaaattgagctgttttataaggataaacaagtcaaattaccgggtcaaggcaccctttgtcttctgctttgtactggcaaaacgttcatgctatccttgggtgaatgtttaggaaatgacatatcagcctgaggtgccttacaagtgtgccaacttactaacgggatggagctacaaacaaccccatggcaagtagactaagacatggcaagtgtgatcaagacatgtgagggttctgccatggtgctatcctgagaggttgattcttgcctaggagggcctaggtggtgcagcagtactggctcctgaaagtaacgttctccaggatctccaaggtttgttgctttggatagcctaagccgcaacagcaagaggaggttcttatttgtgtgtttaagagtaggctgggcaggcgcagtggctcatgcctgtaatcccagcactttgggaggccgaggtgggtggatcacaaggtcaggagttcgagaccagcctggccaatatggtgaatactaaaaatacaaaaattagccaggtgtggtggtgggcgcctgtagtcccagctactcaggagtctgaggcaggagaattgcttgaacccaggaggcgaggtcacagtgagccaagatggcgctattgcactccagcctgggtgacagagtgagactccatctcaaaaaaaagaaaagaaaagagtagactggccactgacaatactgggcctaatggaactccctctaccaaatctgtcactgcactttgccttcatcccttttttccctaacagcaaccacgatgaaataaagtgaagttgtaggacctccatagttgggttataagcccagccccagcaacaaaggtgggttggggtgacttctggggcaccaacagcttatacaaagtatacacttcactatcctctttccacaaggattttgctataattcagttaccaaaactagtatatgcctttatctgtgatcagaggcataaattggaccatagataagttcttttttagctgacattgtgtttttttgtttttgtttttgttttattttgttttgagtttagttgataacatttaaagagtaggagactgtagaaatgtccagattttctgtgtctcttcaaaaattggattatctggcaagtctaggtctgcattccttctaggtgacagctagaactgtgtaatagctgtaaacagagcttgtatactagctcttgttgcccaggctggagtgcaatggcgcgatctcggctcacagcaacctctgtcttccaggttcaggtgatcctcctgcctcagcctcctgagtagctgggattacaggcatgcaccaccatgcctggctaattttgtatttttagtagagttggggtttttccatgttggtcaggctagtctccaactcccaacctcaggtgatccacccgccttggactcccaaagtgctgggattacaggtgtgagccaccaccacacctgcctggtgatgtgatttttctagagttgtgaacagttcttggttctaaagataatgaagcttagtcttcctcaatttatatgattaattgcattattggaaaattcagtctattaaaatagcacaatatattttgtatttatatgtaaatgaagttaatttttaggctcagacaatggttttctagcagatgttcaaaagtcatgtgagatgtggcataattgttcattgtgcaggactgtctcatgcagtacaggatgtctagatttcctgactctgcctgtaataccagcagcttgccctactcattgtgctaaccaaaagtacacttatttccacagtgcctctaggtgacaggtttttctattaaaaatcattgccctaatctctcagttgggtccttacctcctcatcagagttgagttttttgtttttttgttttttctttttttgagatggagtcttgctcttgtcacccaggctggagtgcagtggtgcgatctcagcttactgcaacctctgccgcctgggttcaagcctctcctgcctcagcctcctgagtagttgggaattacaggtgcccgccaccacacccggctaatttttgtacttttagtagagacggggttttgccctgttggccatgctggtctcaaactcctgacctcaggtgatctgcccgcctcggcctcccaaagtactgggattacaggtgtgagccagagttgagttttatcgcttgttttgttagtttaataggtacaaaatgatactttagttgcctttgtgttttttccatgtttgtttctaatgtttatgttctcttcattgttttacttaatatatccgtaattataatgcatttctttgttttaatgttttttgtctgcattttgttaaagtttagcatcttttttctgttacatatattttgatgttttagttcagctttttcattgtatcctttctatatcttttttttttttttttttttgagatggagttttgcttttgtcgcccaggctggggtgcaatggcaccatctctgctcactgcagcctccacctcccggtttcacgtgattttcctgcctcagcctcccaggtagctggagttacaggtgtgtgacaccatgcccagctaatttttgtatttttagtagagacagggtttcaccatgatgttgtccaggctggtctcgaactcctgacctcaggtgatccacccacctcagtctcccaaagtgctgggattacaggtatgagtcaccacgcctggcctatatctttctattttacatgtttcttgaaagcattttttggtttcatttaatcatttaaacattaatacatttagagaatgaaaatttcttacatttaaaaacttaaaaaaagtttgtcagaaggatttaatagctattaaacctattttgattggtctttcataaggtatactcctctcttcagaattgggagggtagtggccatttcttaaaaatgcagattctcaggccccagctcagacctgcagaattgagctttttctgaatggggtctaggagtctgcattttcagctagaccctttcctcccctgatgattcttaagtgtacagtagagtttgagagctagtttgtccttttttttcttcttaaaatctgttttcttccaataatatgctgtgatggatcctgaatattaaatattcatttagtatttggaaaccatccaacttttatttttactagtaattagcttcaaacaagtgaacatttttaaatttttatttgaatataacatacaaaattttggacacactttagtggaatagagggaataccttctgatatcttcctttttcccactggtaaaccttgacactctcaaacacatggtcaatgtccactgtgtgctagggactcagaggttcaggaggcaaggtccccacccaaaaaaggctgacacttttgtggtgaatgtatccgtacaccactaatgaatgagctaatggcagctttatatgaacatccggtaataggcactcagctgagaggagttggtctaaggagtcaagaaaggttttaccaaagagaggacatttgagttgggctttgaaggctgagtacttcataagatggatcaaggcagggaatggcagttcagtcagtgggagcagcatgaccagtgacttagggtaagaaaggatttgctgggcttgagcaatcatcagtagttctttgtggccattgcttgggatgtttgtgggaaagtggcagtagaagatgaggctggcaaggtagtgtatgcaattcccattagaattgtagcaaggctttattgttgatttttttttatttggataaaataataaatcgtatactgaagaataaatgtctagagaagacaataaagttttggaaaaaacattctataaagccactgaacttaaatcattatgggttggcatgggaatagacaagtagttgagtagaacagaagtttcatagattctagaagaaatgaaaatttaatatatgacagaattagtatttcagtttagtgcgaaaaggatgtatttttaagaggtgatgctgacacaactgaccatacatttagaagaaagtaaaatcagacctttcctacaccacttacagaagtaaattccagatgaatatacaagttaagtgaaaaattatgcaattatcttgcaggaaaatctaggagactacatattcacattagggttatgttttcaaatttttggactaagacctatcataacaaatgtattttccgctgggcacggtggctcacacctgtaatcccagcactttgggaggctgaggcgggtggatcacctgaggtcgggagttcgagaccagcctgaccaatgtagagaaaccctgcctctactaaaaatacaaaattagtcgggcatggtggtgcatgcctgtaatcccagctactcaggacgctgaggcaggagaattgcttgaatcgcggaggttgctgtgagccaagatcacaccattgtactccagcctgggcaacaagagcaaaacttcgtctcaaaaaagaaaaaaaatgtattttccattgtgacccagaacatatgcatatattacaaaggaaacaagtttcacagaaacattgcttgcctttattatgtgtgatgcctttatcatacatcctataccatctaattaaaacaagtattatccataacatttatttcatgacccatagtttgaaaaacattgatagtttcatgacccacagtttgaaaaacattgatagaggcaagatgtttgcagcattctttatcatgccaatagtctatacatctgttttatttatttctgttaatttccaatagtataatttgacatgcatttctgttttgtcttttcaggtgccatttggattgtactttagtggcacgatgtactctgagtggaggtcactgcatttggtgattcagaatgatcaaggccataccagtgtgctgcacagctatccagagagcgttggacgagaggtggcaaatgctgtagtccgtcctcttgggcaggtgttaggtaccccttcagtggctggtagtgagaatttgttaaaaactgacaaagaagtaagtgtttctaaatttcattctcttatatgaaaatgtacatttgttcttgaagaatttgtttaatgttaacttttttgttcttttttctttgaaaagagctgtagtagaataacgtcaactttttaatggatttctccccaacgtagtatgacttctcaattttgatcttgtttgagttgagggctgggactcggagtttgtggaggttataaggagtgagttgtactgttttgctgctgggactttttactagttatggtcaattctccacttgagctgaaggccaagacaaagacttgaatgtcaaacacttcccccaaagatctaggcttagtcttctgatttccatttagagtgtgtttggaaggcctcatccctacctctggatggcccctgactgaagactcatgtcaagttttcaggctatgtgtatgctgtgcttaagctctcccctgtccccatccctacctactccttcctggcttccaggtttaagagtgctgcagagaagccaagcccttctggcctaagcctaggtgattggaattggggttgtgtttgctgtttctttttttttgacagagttttgctttgtcactcatgctggtgtgcagtggcaccacggctcactgcagcctcagtctctctgggctcaaatgattcttccaccccagtgagtccccagtagctggaactacagacacatgccaccacgccaggctaatttaaaaaatttttttatagagatgatgttcttactatgttgcccaggttgggtgtttactgtttctaaagataggggctcttggaatggcttgccctgaagctggccctttgttcttgggttcagcggcccaggctgaagttaaaaagttgccattgggaagtcatgaaggggccctgagaatggagtgatagaggagcttgctagtataaattctggctaagatgcaggattaaaactttgtcccttgtgttgaagaagctcatgcaaccttcagacttcatgtttagcaaaacctgtaccctatttctcagaccctttttttctgtttgctttttggtttcctgtgaaggagagattagacttagatataagactaaaacttgtagctctaagggtaggatcctccttcagccatgggtctctgaagagtaaaggtcttcagtctgaggaacatttttctctcttcagaggaccctagatttatccccgaggactagcacaggccctagtgtttctcttcctggtgcgtttgtgatcccttgttgccttctcctgggaagagatggtacgtgagtagatagaggtgctctgatgcagcccttttttttctcctttctcaccattgaaaagagatgagaattcctgtttcctctggaattatacttttttttttttttttgagacggagtctcgctctgtcgcccaggctggagtgcagtggcatgacctcggctcactgcaacttctgcctcccgggttcaagcgattcttctgcctcagcctcctgagtagctgggactacaggcacatgccaccatacctggctaatttttgtattttaaaaatgtatttttatttatttattaattattatttttgagacggagtctcgctctgttgcccaggctggagtgcagtggcatgatcttggctcactgcaagctccacttcccgggttcacaccattctcctgcctcagcctctcgagtagctgggactacaggcacccaccaccatgcctggctaattttttgtatttttagtagggacagagtttcaccgtgttagccaggatggtctcaatctcctgacctcgtgatctgcccgcctcggcctcccaaagtgctggtattacaggcgtgagccaccgcgcccggcctatttatttattttttgagacagagtctcgctcttgttggccaggctggagtgcaatgtcgcaatcttagctcaccgcaacctctgcctcccaggttcaagcgattctactgcctcagccacccgagtagctgggattacaggcatgcaccaccatgcctggctaattttgtattttttttagtagagacaagggtttctctgtgttggccaggctggtctcgaactcctgacctcaggtgatccacccaccttggcctcccaaagtgctgggattacaggtgtgagccactgcacccggccaatttttgtatttttggcagagatggggttttgccatgttggccaggctggtctcgaactcctgatctcagatgatccacagtccttggcctcccaaagtgctgggattacggttgtgggccactacgcctggcctagaattataaaattaaacaactgtgtgaagatgccaccaaagatatcttcttggtttttcatctgataattagggacctgcaatgtcttttagaatctcttctcttatgtggctaaatcttgctacaccctgctccaaatttgtcacagcttcactgtgctgttataggcttctttaacacttactgcagttaaaccatgtatttcctacccttaacctttgtagttgcttttgagcttaacaaatttaatacatatatttatcttgttagatttaactttggttttaagctgttgaagcctttttgaatcctgaatttctgtccaacaagttggccatcctttttagctttgtggtatctacagatgatcagcatacactgtttttctttttttttttcccctaagttagaatcttggcagagcctttggcatgccactgagcacctttttccaaaatgatcttggcatgttaatctactgttactctgtcatgtgatgtcttgaccagttgtaaatctagccattctaccatcctctgggccatatgtctccatcttgtccacaaggagatcctgggtctgtctagatttcttgctaacacccagatacccgtttgccggagaactctgttaatggtatggagagaatagcttaaaatttctagttggaagaccagggttcaagttttcagctccaccttttataaaccagtgacttatgccaaattgcttaatcttgctaagcttctgttttcttatgtgtacagtaaggatagtttaccctgtctacacagagttattgtgatggctagatgatatttatgaaagtgctttgtaaactgcaaggactacactgttgtcagccctctaaatagtaaccctattaataaaggaatgaagctcatttggcatggcttgatcttattgagcaggctgggtcttggtgatcatgcttctcttttgtgagtgttcactgattgcttagtaatttgtctcaaagttttgtctggaattcacttaaactttccagtttacaatgtctggaatacagtttcctcccttttttgcaaattggggtttctcatagatggagacatatagctcagatgatggtagaatggctggatttataattggtcaagataccacatgacagaatagtattagactaatgtgccaaagtcattttggaaaaagttgcccagtggcaccttctagttggaagaccagaattcaagttttcagctccactttttataaaccagtgacttgggccagattatttaatctctacaattacgactgccggcagcctagtggttcagccgtctcttaggcaagttctctcagtccttaggatgtgattcagctaggtcaggaggctgggactcattcagtgcagctaaatgccttgttaagatcttacccagcttcaatcctttttcagatgtgtttgttcttcattttaagtattattattatttttttttttggcagagaacagttgtaaagtaagagtaaacagttgatctttcttcctgttgtttgtgcatttgcataatctggagatggaatgtgactgactttatatgattttctaaatgctacacatacttaaacattaagtggagaaaaaactctaaaatgttctattttgcatatctaatctctatggaaatttgaaatgacctgtatttactttttagttcacagagcaaataataataatatctaaagggtaaaaaccagcataggcttgatattcaaaaataagtaatttattttcttcttaaagcttttgcttgggaaattgtatgtttgatatgtgaaaaatgcattatctaaaataaatctgatatttacgttgagacgaatatactgtcaatttagaggtttttggcaataaaagagattgacattttaaatcagtctactgagataggaacgtgtaataattctatatggatattttcttttgtctaggtaaaatggaccatggaagtaatttgctatggactgacccttccattggatggagagactgtaaaatattgcgttgatgtatatacagactggattatggctttagtgttgccaaaagattctattccattgccagttattaaagagcctaatcaatatgttcaaactatactaaaacacctacagaatctttttgtaccaaggtaagctatacctgtctatctggcccattatcagggtcatagtaaaatattcataaacgttactatagtataggagctgatttcattgttagtcctctgaacagtgacttcatgtgttcagttaaagattgtattaatgtgaatgttaggagagatgggcttatgtaatgtttactaggagtttttaacaggtatgtgttctttaaaggtttttagctttgcttctaaaatctcatacctgttagatattaaaatactgtaacatctttcccttctactcaaaaaaatatacttttgcctatcacaattcttgtttccatttaggctaaacacaactaagggagatgcatctaccttaataggcatctttcctatgagagagtgaagacacttgaaatgattatgggcaaattgttagtaagccaaaagattcctcttgatagtttgtttctgatttttttttccatcttaggcaagggccttaaatatcataatatagggataccttcaaggagcagtagaacatgtttccttttggtaaagttctggttagagcttttggtctgtcatacggtgagggactttgaaaaccagctctgtaagtttttaactttctaaatatagaagggagattactttggaaaatctgaattaaaaaagagaagtctccagaactctggtctgtaggctcaggtgtaaacagcataccatgcatgaaatgcctggtgtagtctggcccctaactagactagctgttctgaattctgcgtgagtgctgctctgtagtcagactcgtaagtcagacattcctctaagacctcctaaagatctttcccatcatgatgtctttttgtcttcttcctcttccttctctccatcaccacatctcattcttgttggttctttaattctgccttgtgaggagaagtcctacctaaccactcaggcccacagcgatcacaccttctctgaacctatatgatactttctgcatcactcttgtatctctcactgttttattgcttatcttttaaaatgtgtgtctcctttccccatctaaccaactcaaaggcaggaactctgttgtctctattttaggcttccacagtatctggtgcaatactggtattttaatacttagtacttatcttaggtgtcaattaaatgcgtgttgtttgtatttattgatttcacatggaattaaaaacaggaaatgggccgggtgcagtggctcacgcctgtaatcccagcatgtttggaggctgaggcgggtggatcacctgaggtcaggagttccagaccagcctggccaacatggcgaaaccctgtctctactaaaaatacaaaacttagccgggtgtggcggcatgtgcttataatcccagctacatgggaggccgaggcaggagaatcgcttgaatctgggaggcggaggttgcagtgagccgagattgcaccactgcactcagcctgggtgacagagcgagactctgtctcaaacaaaacaaaacaaaacaaaaaaaacaggaaacggttgggagtacttagaatattgtttataagcaggttcttctaaaatggtgtaatagttttaatactttcttgttatcttatttaggagcctactaggctttttcttcgtgcctgggatagtctcatgagtagtattgtcactgtgtctctttcctctttgtaagcctactacctttcagtgctcagttaatttgtattgatgaaaaaaaattaatggcatttgagttaattaggcttgtgcctttacttttctcttttgagaaacatgactaccttataaatggttttgctatttggtaattaccttgttttctcaaaagtatgtgtgcataagtgttagtaaattctgagagggtactcaactgagaattagagttctcttcctggctaatgttttaggaaaattagctgaatattttcaatggtaagtattggtgttatgatctcatctcccattatttgaagttttagttgtttatttgattctgatagttcacaaaactgtcatctaagtttacttaattagttgtttttataaaaactgacattcaaaatggagggaactgcctttgccattttgctagagattatgtcagaatgaatgtaacatttctcttttgcccatcagtttgatttttttttttaagattgagtgaagagtaaatcatcttttaaagttggttaaggttttaattgctcacatatactatactgtactttagaaaaacatattattgttctgaagcagggttagcaaagagtcagatagcattttaggctttgcaggtcatatagtgttataattagtcagttctgctggtgtggcatgaaagcagccatagacaatatataaatgaatgatcattactgtgttccaatacaacttcatttacaatatagatagtaggccagatttgtaaactctatttacaataaaagatggcaggccaggtttgacccattggccagcattcaccaccactgttctaaagcagtttttctgaaaatcacaagttacattttaaaaagtaacttgatatttttgaaagggaaatctctggtgtttagctcttctgtttttttttaatgtaaaggttaccttgtttcttttagctttagaactttggaccctgcctctgaatttaggccttctgaatgaggaggaaggagcctcagtacctgaggaacaggtatttcctttcctgtcattgggcaaatacctggaaatggtaggtagacctaagttaccatgtaggaggcatgcactcttggaagggtgtcagtcccagggccattagtggtatttttatttcttattctgggcttcctcttatattacttgattaggtttggggctatgctatagttttttattcttcttcaagtaagccagagcaatagacacaagcttgagccttagggctttacatggactagatccacctttactagatccacctttagctgaatgtggaacatctccccgctcctggaggtgcttggctcttcctaggcaattttctcatcattttgctttaggtctgacttctttagggaaaacttagtggtgtcatttgcttgcaactctagggtaagtgtcgttttctgcatcatagcccagaatctgagaatctctcttctaaggttgggttgacagttctaagggaactcacttcattttctggaatttcttgaggaaactccccagtctgattcaggtatgtttctatcagttctttgtgacaaatgacaatatgtagaaacttggcctcaagacttttttcagtaatattagatacttctcttgggtttcccataagagatctggaggccagcttaccacttgctaatacaatgggtttcctactattctcaaaattctcagtggtctactttggaaagtgagggtaagggctgggacctggacctctatcttcatcttcagtcctagccaaaatactttgatctgttttatagatcattcttctttataagatttcccttggaaaaaatggtcctgcggtgagttttaaaactgttgttccggggtatcctgggaaacttggagcctccatctttggctaagtgtctttttctaaaattagagcagcagtagcaggtatttatttctgaagcaatgcctgcatacctcattaattttggggacctattaggctattccttctggcttgtaggcccttctctaacagaccttagcttcagagggactatgagcactgtaaaatcacatgcagaattcttgcaaatatgtgtttaaaaaaattaaaaaagaataccaaggccattctgcttcaatgtgagcagcaagggtggcggtgggtatttacttgttcattcaacaaaaacctattgagtgtctgctattatgtgttaggcacatgttagacatagaaaatccagaagtgaagtttatgttctagtattcccgccttcctcccagaagctttcgagttctcataggagtggtaggtttagattccagagtgcttaactttacgacgagtaagaagtagctttaaactgaagacggtatgcctagccctctctgctgataatattagggagcttcattggaccactgcttgctacatccataagtcacctgtcctgaagctgttgctgtctctcctccaggcttgtcagtgatatctgtctgtcttcttcagacaggaacagggttccagtcagattcgactatgcttacaggtcctgagagccattcagaaactggcccgtgagtcatctctcatggcccgagaaacttgggaagtcttactgttgtttcttctgcagattaacgacatacttctggccccaccaactgttcaaggtttgtttatttttttttttctaatttatttctgagctccaaatacagttcatctttaaactcagtgagcggtagactcattggggatttaaattttggcatgatggtttacaaacaaaggttaacagttcttagaatggaaactctcaggcacaatataactttagccctgatgaagttattttaccttcagtcatgattttgctaatgtagggagggactcagtgaattatgcatgtttgatagtgatgggagcagtagcttgtttaataggataggccaggcgtagtggctataattccagcactttgggaggccaaggcaggtgtatcacctgaggtcaggagttcaagaccagcctggccaacatggcgaaaccccatctcttctaaaagtagaaaaattagccaggcgtggtggcacacacctataattccagctactcaggaggctgaggcaggagaattgcttgaacctgggaggtggaggttgtagtgagccaagatcgtgccactgctctccagcctgggcgacaagagcaagactctgtctcaaaaaaaaaaaaaaaagaaaagaaacaattaaccaattaaattagagcctatagataatatattacaaagtagttatcaaagtagagtctgaaaacttggtagtgacaagatattttactcagcaaatgaaacctccaaagtcttttaactgttctatttggaagtgtgccagtttgctattcattagctagccattaaatgcctccagttttataagactttacagtgtatttcagaatccctgctttgtatatagcacagtgtatataaactataagttgatcatctagttccaagttctcttgttgcttattcattggtgtactctgttgactaacacatgtgagtgtgcttgtgttctcacacagatgcagtattcagggaaatatctaaaaggaagcatggaatttcagtgtgggaagggatgcaatgatagtaatactctgtctggtattgacaatagctggacagtcattgattcatcacctctctgctacttactccccatgccaggggtctcaacagcatgaggcagacaattcatccccctcctgggctctttgttgttgaaactttggttttgctcatttgaaacacacattcttacaacttttcctgtgagtcccaactttgccttctggagctatgcggtgtaaagaccactgctgtttttccacctggttccagggcttagaacaggggaacagccccattttcatggttaaggctctgtccttcccaacaccagtccttttgctccattatttgtctctctgtctctctcccttgaagggtggctttcaaatacttggagcattgtatggcaaagtttggaggtaaaaagacatgggtgtttgttgtgattccttcacttactggctgcatgaagtcggagaagttacttaaactttctgaatctaagttttctcatcttcaaaatgggtataattagcagttggtattaggtattacagatacctaccctgcagaattaatgtgaggattatatgaggtcatttgtatgaactatttggcatagaaactgactcatagtagtcagtcatcataggcagtcatccttttccttctcccctgtgtccctctgtcccccttgctggaggattaaggccttcaataagaactgaacagggcaacttgaaatctttcaaagtaaaaattttttgatgtgtctgtgattttgggtacaggaactcctaagaattgcttctcatttttactattaaatgattatttgaaagtcaaaacttaatattgcacttattttaattttttgaccagttctcccaaatcagtgtcttaaagattctgctttaaaaataagtttgccaaagatgtgttttctttttgttggtaaggtggcattgctgagaatctagcagagaagttgattggtgttctctttgaggtgtggttactagcttgtactcggtgcttcccaacacctccttattggaaaacagccaaggagatggtggctaactggaggcatcacccagcagtggtggagcagtggagcaaggtcatttgtgcactcacttccaggtaggttattgtcattgccctgccttccttcacctgtctgaccttaggcagctttctggcattcatggaatacattataacaaaggctgggtctgttattactgtactttagatacagaattgagccactttttaaatatagatataacagtttggctagtgcctgtttaaaacatttcagaataatcaagtattcttgagaaacagataaattttataccctacttcccccacaaaaaaattccactcttattttgatcattaaaatatgcatgatcattaaaatatgcctaatcattattttaaagaaacaaaccatagaaagatataatagaaaagttctcctgaaatcctaccatgtatatttatatataattttacaggaatgggaccatattatacatgctactttataaccaaagtaggcagtttttttataataataattttacctttttgccatttatatttaataccatcgctgttttataagtacactcttaggttcatttttttcagacttattttttcatttcaatcgtgattttaatatgcaagcataccttgttttattgcacttgactgtattgagcttcacggataccatgtttttttttttttccaaattgaagggttgtggcaaccctgcatcaagcgagtctgtcgggtgccatttttccaacagcatatgctcactttgtgcctctgtcatatgttggtaattcttgcgtatttcaaacttttactgttatggtgacctgtgatcagtgatctttaatattaccattgtaattgttttagagtgccacgtactacacctatataaaatggtgaacttaactgatcaatgttgtttgtgttctgacagctccactgaccagctgttttccgtctctttcccactcttgagacacaatgatactgaaattaggccaattagtaactctataatggcctcaaagtggtcgagtgaaaggaatagttggatgtctctcactttaaatcaaaagctagaaatgattaagtttaattaggaaggtgtgttgaaagccaaaacaggctgaaagctaggcctcttgcaccaaatggttagccaaggtgtgaatgcaaaggtaaagttcttgaaggaaattaaacatgctacaccactgaacacaggaatgataagaaagcaaaacaggcttatttatgatatggagaaagtttgagtgggctagataggagatcaaaccagtcacaacattttcttaagccaaagcgtgatccagagcaaggcctaactgtcttcagttctatgaaggctgcgagaggtgaggaagctgtagaagaaagcttaggaagaggccgaggttggttcatgaggtttaaggaaagaagccatgtctataacgtgaaagtgcaagctgaagcagcaagtgtgatggagaagctgcagcaagtgatccagatgatctagctaagatcattgacgaaggtggcctcactaaacaacagattttcagtgtgcattaaacagtcttgtattggaagaagacaccatctaggacttctatagctagagaggagaagtcagtgcctggcaagctgaagccagtgctcatttaccatttggaatatcctagggcccttaagaataatgttaaatttgcgcttgccttggcagcctatatactaagaatgatgttaaatttattctggctgtgtgcagtggctcacacctgtaatcccagcactttgggagtacgaggtgggcagattagttgagctcaggagtttgagaccactctgggcaacttggcaaaagcccatctctacaaaaaatagccaggtgtggtggcttgcgcctgtagaacacacctcccaggttcaagtgattcttgtgccttagcctcccgaataactgggattacagaggtgtgccaacatgtcctgctagtttttgtatttttagtagaggtgggggtttcaccatgttggccagtctggtctccaactcctagtctcaaaacaatccacccatctcagcctcccaaagtgcttggattacaggcatgagccactgtgcccagcgtgactttcaaatcttaagaaatacagctgaccattgaacaacatgtatttgaactgtgtgggtccacttacatgtagatttttctcaattaaaaatagtggaaaattttttttgaaatttgagacaatttgaaaaaatgtgcaaatgaaccgtgtatcctagaaatattgaaaaaattaagaaaaaattaggtatgtcgtaggcataaaatatatgtacatgctagtcttgtatcatttactaccataaaatacacacaaatgtattatactaaattaaaatttattaaaacttatgcatacaaatgcttatagactatatacatgataccatttgcagtaatgtaaacaataggtaaagaaatgtaaacaaacataaaagctgcagtattaaatcataattgcataaaattaactctggtacatactgtactactgtaataattttgtagccacttcctgttgctattgcaatgagctcaggtgttgtgaatattcactgaaaactccatgtgacactaatcatctctgcttgagcagttaatctcttcagtaaatagtgtatctcagtaaaaagtgatgtctcagttttcatttatttttcgtcatatttaatttacaatactgtaaacctggaataagtaataccatgagacccataggaagtgccaccagtggtgctggaagtgctcccaagaagcagagaaaactcatgacattacaagaaaaagttgaattgcttgatacgttctgttgtttgaggtctgcagctgtggtcacctgccagttcaggcagacaattgactttgtaaacagatgacataaacttatggtatcaataaacacagtacagtgctgtaaatgtaaatgtgttttctcttttatatgatttttttttgtttgagacagtctcactttttcacctagtctggagtgcagtggtgcgatctcagctcactgcaacctctgcctcattgcagcctctgcctcccatgctcaagtgattctcgtgcctcagcctccccagtagctgggattacaggcgtgagccaccatgcccagctaattttttagtatttttagtagagtcagggattctccatgttggccaagctggtctctaactccaggcctcatgtgagccgccccacctctgccttccaaagtgctgggattacaggcatgagccactgcgcctggcccttttttatgattttttttaaagagggggtcttgctgtgttgcccaggctagagtataatggctattcacacctcctgggcgcaagctgtttagattggtgcaaaagtaattgcggcttttgccatattttaattacttttgtaccaacacaatatcttctgcttcaagcctacaagtgtctgggactatgggtgtgctgctgcatctgattttccttatgattttcttaataacattttatttagctttctttattgtaagaataccatatataatacacatacaaaatatgtattagttatttgttattggtaaggcttctgattagaagtaggctattagtagttaagttttgagggagtcaaacattatacatagatttttcaactgtatgaggggccagcacctctagtccctattgttcaggggtcaactgtacattctgtaaggttatagctaccatatcaacattaacaggagtttggaagaagttgattccaaccctaatgaatgactctgaggggttcaaagcttcagtggaagaagtcactgcagatgaggtggagaagtagcaagagaactacaaattagaagtatagcccaaagagatgactaattgctgcaatgtcatgataaaactaatggtgaggagtcttatggatgagcaaagagtttcctgaggtggaatctactcctggtatagatgccatgaacattgttgaaatgacagcaaagtatttagaatattacataagcttaattggtaaagtaatggcagagtttgagaggattgactccgattttgaaagaagttctactatgggtaaaatgctatgaaatggcattgcatgccacagataaattttttgtgaaaagaagagtcagtccatgtggcacacctcattgttgtcttatttttaaaaactgccacagccaccccaaccttcagcagtcaccttcctgatcagtctgcagccatcaatgaggcaataccctccaccagtgaaaagatgactctagatgacgcaaacaaatggaaaaacattccatgttcatggattagaagaatcaaaatcattaaaatggccatactgcccatagcaatctacagattcaacactattcctgtcaaactaccagtgccattttttcacataactaggaaaaaacctattctaaaattcatattgcaaccaaaaaagagctctaatagccaaagcaaatcctaagcaaaaagaacaaagctggaggcttcacattacccaccttgaaactatactagagggctacagtcaccaaaacagcatggtactggtacaaaaacagatatataaactaatggaacagaatagagaacccagaagtaaagctgcataactacagccatctgatttttgacagagtcaataaaaacaagcaatggggaaaggactctctattcaataaatagtgcagggataactggctaaccatatgcagaagaatgaaactagactcctacctttcaccatatacaaaaattaactcaagatggattaaagatttaaatgtaatacctcaagctataagaatactagaagaaaacctaggaaacactattatggacatttgccttgggaaggaatttatgactcagtcctcaaaagtaattgcaacaaaaacaatcgacaagtggtacctaattaaactaaagagtttgcacagtaaaagaaactatcaacagagtaaatggaaaacctacagaatgggagaaaatattcacaaattatacatctgacagagatctaatatccagaatctataaggaacttaaagcaattgaacaagcaaaaaacaaccccgttaaaaaacaggcaaaagacatgaacagacacttatcaaaagaagacatataagtggccaagaaacatatgaaaaaatgctccacattactaatcatcaaacaaatgcaaatcaaaaccacaatgagataccatctcacaccaggcagaatgggtattattaaaaagtcaaaaaaacagtagatgctggcaagactgcagggaaaagggaatgcttatactctgctggtgggaatgtaaattagttccagctactgtggaaagcagttgggagatttctcaaagaacttaaaatacgactaccattcaacccagctatcccattgctgggtatatatccaaaagaaaacaaattgttctaccgaaaagacacatgcacttttatatattgcagcacgattcacaatagcaaagacatggaatcagcctagatgcccgtcggtggtagactgggtaaagaaaatgtggcacatatgcaccatggaatactatgcagccatgaaaaagaattaattgtgtcctttgtagcaacatggatgcagcttgaagccattatcctaagtgaattaacacaggaacagaaaaccaagtatcacatgttcttacttataagtgggtgctaaacattggacataaaactcatggacataaagatgacaacattagaaactgaggactgctggtgggggaagaggagcagtgttgaaaagtccagatgatgggatcatttgtaccccaagcctcagcatcatgcagtatacccagataacctgcacatgtacctcctgaatctaaaattaaagttggaaaattttaaaaagggaaaggattatgacttggtgaaggcacagataaattattagcatctttcagcagtaaaatattaatatttttaaattaaggatgtgcattgatttttaaacatataatcctattgcatacttaatcgactacagtatagtccaaacataacttttatatgcattgagaaaccaaaaaaacgtgcatgccttgctttttgcaatgtttgttttattagggtagtgtgaaactgaacctgcaagatctcgaagttatacccgtataactctagatatagataagggttctttaaaaaatataatacccttatcacacccaaaaaagttgacaattctttaataccggttagctagtcagtgttcaaatttccaggtacaattgaccctctgtgggttctgtatccatggacacagccagtcagagatcaaaaatatttggcaaaaaatttcacaaaattccaaagagtaaaaattgaatttgccttctactgcctgagtactgcatcgaatctgtgcaaatgaagggatgtgtatgcattgtattaggtattataagtaatcttgagacgatttaaagtatataggaagatgtgtgtaggttatatgcaaatactaaattattttatgtaagggggcttgagcatccgtggattttggcatctgaggggtgttctgcgtcaatcccctataattctgaaggacaactgtataggttcctgcttttttctttcctttttttttttgacagggtttcttactctgtcacccaggctggaatgcagtggtgcaatcacagcttactgcagccttaatctcttaggctcaagtgatcctcctgcctcagccacctgagtagctggaactgcaggcgtgcaccaccatgcttggctaatttttatatttttggtcaagatggggttcctccatgttgtccaggctggccttgaactcctgggctcgagcagtcctcctgccttggcctcccaaagttctggtattacaggcctgagtgaccacgcctggcctaggtttctgctttatttttctttgcaatttttttgttgaagaaactgggttgtcttacagagtgtttcacattttggatttgtccacattgttaattactatattcctctgccccgctgtatttcctataaactggtagttagatctagagacttgatctcattcaggtttgatagggggcaaagagagggggtgacaggaacaaaaactttataggtagtgttatgtatcagaaggtagacttctctttttctgagttaatgtttagatctttattattatttaaactaaaaaatgaagctttggaatattttgttaattctagtatatcacagagaacatgaatattatgaatctagccatgagcggtggctcacacctgtaatcccagcactttgggaggctgaggcaggatgattgctttaaaaaaattatgaatctgtttttaagtaatgcttttatcttgattataatcacagtacatgcttataatagaaaatttggaaaatgtagggacagatacctatcattcagagccaacccatgttaacattttaatgtattttttccatttagttccctttttaaaaatgccagtttgaaattattctatataatattatctacttttttcatttgatgtctgattcttgtcactttagttacacaaactttttctcattaaatagctgttgagatcatatttttaatggttttgtagttttccattatataattggaattataattcatttaataatttccttgttattgttgttgttatttttgtttttttgaggcagggtcttgctttgttgcccaggctggagtacagtggtatgatcaggactcatagcagcctcaacctccccaggctcaaacaatcctctcacctcagcctcccatggcagctgggagctacaggttcatgccaccacgcccagctaatttttgtattttttgtaaagatgaggttttgcatatcgcccaggcaggcaggactcaagctcctggactcaagtgatccactagacttggcctcccagagtgctgggattggagtgcaggcgtgagccactatgccagcgttgtttttttgtttttgtttttcttttttttttgagatatggtcttgctctgttgcccagggtggagtgcagtggcgcagtcatggctcattgtagcctcgaactcctgacctcaagcaatcctcccatcttcccctgctgttttgatatttatgttgttcccattgttttattttaaaaatattggtgatatgaatgctttatacatagtctttatatgtgagaatattatctctaggtagagaataattgagttaaagggctttgaatagttttaatacatttagaatattaagtaattaagttgttgagttatttttatggtatgtcataaattctaaacttcatgtaaaactattataacttagttatatggcagaaatttgcagtgagatgaatcttttaaaaaatttacatattgtatgattatataattatataagtataattacatatataaatagctataatttataagtaatatgcaatgtgtatatgtcaaacatattacatataaacatataaatgtcacagaaagacatttaaaaactaagatcactgacagctgaaaaacacaaactataactacaaaatgggaagaaatgataaaaaatgattaacatacctaacctataaaaaggtcataaagaataattcagaatcactgatacacaagtagaaaaattaggctagtcaaaccagaaagagaagagatgcaaggaaaaactttaagaatcagtttacaacagaataaatgtcccacagagcacatggatgggcctggaagagggacaagtaaaaagtgatgaagctgaactgaagagaattactatataaaagatagggacagcaggaagtaacagtattttaatactaattattttaaattatttaagtatcttaaataatttaaaacactctttttttggtatacttgtttattttacccaaaaactcatgtatcttgtaaagaagatgctgataacaacacgtgtattacatataaaatatatacaacagcatatactcttcttcccagcttctttccattagaaatcatcttgaaagtctccaatttgttttcaatgtaaaacttctttttaatgaacgcataatagttgtacatatttgtggagtacataatgatgttttgatatatatataaaaaatgtgtagtgattgatcagagtaattagcatatccatcatcccaaacataaaaaaactagaaatcctctttcagtttgtctgttttataaatgagggtttccatatgtcttgttcacgtatgtgaggtacacatgtttcatccattttctctgtcttctttctatgcttgagtgtatttttcaatctgttaagaaatggactcagtggtgtgcatttattttctagattgctacgctttacatatggtccttcatttcctgcatttaaagttcccgatgaagatgccagtctgatccctccagaaatggataatgagtgtgttgcacagacatggtttcgctttttacacatgttaaggtattgttattttattatttcatgtgccatttacctagtaagtatcttagggcaggaatcatgctgtaagtctcttgtttgaattcagaaggtggacactaagccccattcatcaaatggaatccagctggacaacaagcacatttctgtcctgtgcctcctgctctccccgtcccagcagggttaggctgtcctcagccgctcttggtttacacgctctaggaacgcgttccctgtggtagatgccgcacttgttctcttgcctgttactgcagccaggctgatgatctttctcttgggattttgtcacattctgtggggactggaggttgccttgctcctctctgtgcccagcactgactggtcagtctgcctctcagagccctcctccaatagcctgtttaaagtttcaatgggagatacaccctaaaatttcacagaggggtatactgctacttcctgctgtccctgtcttttatatagtaattctcttcagttcagcttcatcactttttacttgtccctcttccagccccatctgtgtgctctgtagaacatttattctgttgtaaactgattcttaaattttttccttgcatatcttctctttctggtttaactagcctaatttttctattttgtgtatcagtgattctgaattactctttatgacctttttataagttaggtatgttaatctttttttatcatttcttcccattttgtagttacagtttgtgtttttcagctgtcagtgatcttagtttttaaatgtctttctgtgatcattttctatttcctttgtgttctttgatcagatagtcacctatgatttcttccaatgttgtttcctttgtaatagtaagttcttttatatacctcaggatctgtctttatatgtatataaacacacacacgcacatacacacacacacacacacacacacacacacacacagacacacgcatgcatgtaatttgcagagatggggtcttcctacgttgcccaggcggtctcaaactcctggacttaagcaatccacccacttcagcctcccaaagtgctagggttacaagcatcgagccaccgcacccagcctggaatttgtctttagttcacatattactgcattaaattcatttgtttttatatcagattcacactcttattttaactttataatatttactgatatttagtaggtctaatgtctttttctctttttccttctcttagaatatttatctcttcttgcctgtttaacatttcagatcaattttagaaccaatttttcaagttacaaaacataagcaaacagaaggaaaaacctcaacgaaaccttctggggtttggattgtgtattatttagggtaaggaatatgtgctgctttagcaaatgaacttgaaaatcttttatagggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggggtgaacccgggaggcggagcttgcagtgagccgagattgcgccactgcactccagcctgggcgacagagcgagactccgtctcaaaaaaaaaaaaaaaaagaaaatcttttataaagtctggagtcaggactggctctgctcacatagtcgttcagagacccagctggcagaggctctttcatcttcaacagatgactccattagggcctcagtgttataagcaggattctcgtatctggctagcagatggggaacagagagcaaggaaaattttgtgggagggttttatgtgtcaggccttgaagtaatataaatcactgttactcatattccattagccacaactcagacacacaccacacttaattgcaagagaacagagaagaaaagagaaagtggtgaacagctagccagactctgccgaagatgagaattgtattaagcttgtatttatatttaggaaacgctgatatctgatattgagtctgcctttcttttttttttttttaatttttttagtatttattgatcattcttgggtgtttctcggagagggggatttggcagggtcataggacaatagtggagggaaggtcagcagataaacatgtgaacaaaggtctctggttttcctaggcagagggccctgccgccttccgcagtgtttgtgtccctgggtacttgagattagggagtggtgatgactcttaacgggtatgctgccttcaagcatctgtttaacaaagcacatcttgcaccgccattaatccatttaaccctgagttgacacagcacatgttttagagagcacggggttgggggtaaggttataaattaacagcatcccaaggcagaagaatttttcttagtacagaacaaaatggagtctcctatgtctacttctttctacacagacacagtaacatctgatctctctttcttttccccacatttcccgcttttctattcgacaaaaccgccatcatcatcatggcccgttctcaatgagctgttgggtacacctcctagacggggtggcggccgggcagaggggctgctcacttcccagacggggcggccgggcagaggcgccccccacctcccagacagggcggcggccgggcgggggctgccccccacctcccggacggggcagctggcgagtctgcctttctaagagcatgtctttttctttttttagaattttgcgtatcttcttgaaatgttttacagttttcttcacaaagatttttaatattttctttaccattatttctaggtatttgttgctgatgttttgaaaagctaactcttttctgctattctgtcttctagatggttattactgctgtaaagaacattttttactgcatgttattttgcatattatatatagcatttaaaagagctctgaatatttcactgattcttctgagatatgggcacatatctgcaaataagaagtgtctcttttctaataattcatacttgttttggtgactaattaaaagtacttcggatgcagtaagacttggacctgacttaaattctgctagttttttctttgtgaacttgagcaatttattctctctgtgcctcagtttctttttaatctacataatgggaataatgatagtaccatctcgttataagtattgaagaagaaaaagcatgtaaaacggcatgatgcctagtgcatggtaggtgcttgaaagttgctattattacagttatttctgtatattattttactgcatccatcagaagtagaacactgttgaattaaagtgatactgttttggcaccttttttggtctgattttcatcggaatgcctctgatatatggaattttgagtaggatgttggttgttgatattagatgttcttttttatgctcctggtttcctaagcagttaaaaattttatttatttttatttatttattttttgagatggagtctcgctctgtcacccaggctggagtgcagtggcgcaatctctgctcactgcaagttccgcctcctgggttcacgccattcttctgcctcagcctcctgagtagctgggactacaggcgcccaccaccatgcctgactaattttttgtattttttagtagagacggggtttcaccatgttagccaggatggtcttgatctcttgacctcatgatccgcctgcctcggcctctcaaagtgctaggattacaggcttgagccaccacgcccggccagcaattaaaaatttttaaaaatataggccaggcacggtggctcacgcctataataatagcacttttggaggccaacgcgggtagatcacccaagcttaggagttcgagaccagcctgggcaacatggtgaaaccctgtctctactaaaaatacaaaaaatgggctgggcgtggtggctcacgcctgtaatcccaacactttgggaggccaaggtgggcggatcccttgaagtcaggagttcgagaccagcctggccaacatggtgaaaccctgtctctactaaaaatacaaaaattagctgggtgtggtggcacatgcctgtaatcccagctacttgggaggctgaggcaggagaatcgcttgaaccgggaagcagaggttgcactccagcccgggcgacagagcggcggcggtggggggtgggggggaagcaaaaaacaaattagctgagtatagtggtgcacctgtaatcctagctactcaggaggctgaagcacagggattgcttgaacccgggaggcagagttgcagtgagccaagatcataccactgtactctagcctgggcaacagagcaagactgtctcaaaaaaaaaaaaaaaattaaattaaaatataaataaactatagtaccgaattgtttcgaataatatttttggatccatttaagcaattaagtggtttttcttctttcatctgttgatgtgaaatattaattaatttcccaatgttgaaccatctatcattcctgaaagaaaagttttgcttggttatggaatgcttttcttttaatgtttttctgaattgtctgtagttctatcttttcatgaattggataggaaaactttctgtccttttttatggtctgttgtgtcaaagttttgtgttccttaagagtttgaaataaatgaacagtaaaactctagtcgagtcttttttagaggtagtacttagatagtctttcttcttgagctgactgtggtactttagtcagagttattttggatggcaaaaagaggagccaacttaagcaaatgcaggtgagaaaaagagattatgtgaagatagagcagtcttactaggctccatgaagcagcgaacaaccctttctcatgttggggagggatgaaggcaacctcgggacaagccactctgtcatttgtttctctttgcttttttgattctcttgtgcatgcacattgttctttctccagcaggcttgctcctgggtccctttttcctcctgcctttgagagggggacatgcagtctcttgataactgcccagtggtgtaaatagctgtgatactgtttgacttcagtgtttgtcctttcagttcacgggggctttccctttgcttagtttctccaaagggaaaattggatcaaattatcttcgttaattaggtctctggcaggcatctggatacctcctttaggacagttttacctcctttcttaaatgagctgcgactgggtagaaggcaggtcatgaggattttttatgattgtgattatttgtgattgttggcagatttcctaggatgaaggttgaatatgatggggagataggcatcaacattttgtcttgtgtgttagtgatttatctttttccaggaaaaccaaaaaatatttttcatttttgtttccatactgttgtcaaatgcttgtctttggacttgtgtatgcccacctgccctttaggccccatctggagattgtttcagtaaatttaggtctaatctggattttttaacaggttccccaaatgtgtcaggtacacggggcattgggaactgcaggaatgcagttgcttttagtttttcatatcctttgttacccattcttatttcaagttttacttactttcttgagtctgttctctaaatatttgggagccaataaaatcattcctggtttacctctggagaagctggtatgaatctttctctctccagtttttgatttacagtagacatgaatttagccaagctctgtgggacttaggtgtagttccatttcagctttactccttgttcttctaatttctgaatagttgaactacagcccccagcaggcactgctgctggagacgaatctcccttcctctgtcttacttggtggactagtccagttctatggaaacagtgtgctaccactggaagcccatttttcttacatgcacacacgttctcctttccgcaattacagttacttgaaattaagtcttttggtgggtggaaaaagaggttttgaaaggcagagcatgtatagatcactgattcctatttctcagcctagttcttttgccttgtagctagtggaaattctgtttaccggctttagattatcagtattactttgaattggagaggctttttaatggaatgctaagcagaccatttgagtgaaaaatcataatctgttttttaatggaaatatttcaaactgtttgtacataaaatgtaattcaaacacaaatacaccgttttgaaatttatggctttagtacatacacatgaacacaacataaaactattaacactaatcctgattttcaaatatagttgtttttttttaattgaaaatgttaatattaaagtaaaattttctccttggagcttttgttgacatatttatagctttaccattccattgctttttctttttttctttttttctttttttcctgagatggcatgttgctctgttgctcaggctggaatgcattggcatgatcatagctcactgcagcctcggccttgaactccttggctcaagtgatctgcctcagccttccaagtagttgggaccataggcacgtgccaccatgtccatctattgcttaattcttaacatattagaaaaagcatctatgtatactctcaaaattaaaattttttctagtcttactttgattctcatgcttggagtaggcaatgttcatgtaaccacactgcagatcttctgtaaagaagtgttgagatttgaatcgctggcccattaaatacaaatcagtctcttttctgaatcagagaaataggcacagtcctattcttaaattagattacgtgtattttattgctatagaaatttctaaatttgtgattaattctttcctctcttttaatagtaatcctgtggatttgagtaacccagctattataagctctactcccaaatttcaggaacagttcttgaatgtgagcggaatgccgcaagaattgaatcagtatccctgccttaaacatctgcctcaaatattttttcgtgccatgcgtggaatcagctgtctggtggatgcattcttaggtgaattttgtgtatgttgctagatgtatgaagagcttcatttagataactctagaggctaaccctaggagttattagaaaacatccgaaggaaaagatgaacagatttgatgacaaataacaagcgaggaaaaattatttgcaacaaataaaatagccagagggttatcgtttctatgtaaatatttagattggtgcaaaagtaattgcggtttttgccattaaaagtaatgcggccaaaactgcagttacttttgcacccacctaatacatcaaacaaagtgctaagaacaagaattaggcctagtagataaatggacaaaggataagagtaaatgattgcaaaagaaaagagtgttcatgcatactagctatccaggaaaatacagatgaaaatgcatttgggaccattctcatgtatatcattaaaaagcaaattatacctttagtgagccattcttttaagctgtttttcacattttagatatatgaaaagtcaattttttaacctgttgaaaggcagtgatttataatattttctaaaatatttatgtatacttattaatgtacagttaatatgttagctctgattaagtttggctgccacgtaacaaccaaaaatcctattgtaaacaagatagcttattttcacatatgttaaatctagggctaggcagtgtaatggttccatcaccagcagggatccaaggcccttccatctggtggctctccattctttgcacagtgcctcatgggccatgatggttgagtgagttccaaacatcctgtccaggaattaggaaggaaggagagtctgcatataattggtcctttaagaagatctcttagaagacctacccaacagtcaccaacttctttatggtcaaaatatggccacatctaggtgcaaagggagtttgaaaattgagtcattttttttctgggtagccatgtccatctaaagtttgtgttctgttactcaggaagaaatagtgagtagatactgagaggcaactagcaatctctgctatagtctatgtgtcccaagccttcactaggttactgggagaaattttctgatcatatattttgacctatgaagaataatttcatttgtcttttttttttttttaaggtatttctagaccccgatcagacagtgctcccccaacacccgtgaatagattaagtatgcctcaaagtgctgctgtcagtaccacccccccacataaccggaggcaccgggctgttactgtgaataaggccaccatgaagacaagcacagtaagagtttacatcaccattgttatgctatataaggttggctttttaatctgccattctttttataaagtcttgctattttctcagacttttcattggtatgggtgtattcttgtgttcgtctaataggttagtactgctcatgcctctaaagttcagcaccagacgtcctccacctctcctctgtcaagtccaaatcagactagttcagaaccccggccactgcctgcccctcggagaccaaaggttaacagcatcttgaatctctttggatcatggttatttgatgcagcatttgttcactgtaaacttcataatgggataaacagagacagcagcatgactggtaaatattactcaagaaatatgttatcattattttccttttcctttttctttttctttttagtctttcctacctgcaagattaatatgtatcttaaaaagctctctgtttctgaccaagcaatgtcttgtgcttaaccccttccagctgaagtaacagaacttaagaagttttcctccctgttctttttatgtatgttctatgaggtttggccttttgtctggttttattagacatacttaaggttagtcacattttgttgaatcagatttctttcagtaggtgacctggaagttcccttcatgtcagccaggataataaaatttatataaagaattaaaaattcgaactggaaatttacaagaagtgttttcgattttgacagccattcactcattagtatatgtaaacatcagaaaatttttgcttcacactacactctgacctctcaaattttagtctagagaactttatttcaagggcacactttcaaaaatattatttgctttttaacttaataaaattgattggtggagaattaataactcaaccctgatatcttcatttagattttattataaaaaggaaactgtctaagagctggtggttttttttgtcatcttaactattatatttgaaagtaatggcatagggtgcaggatggatgggtggggtagggcacaatgttttgaatatttataatatgtcttagagagctgaaaaatgacaatggctggcatttattgagctgctgttactattggccaggtactgtgatatatgcattaatgagtgtattgattgtttggtaagaaaccactcttctactggggttggaaatagatcaagacaaaaagatgtctaattagtttatgtatctctagggagactgtcagttccaaggataaaactaatacaatgaccagaagggtctctgctttctctcagaaatgaattcttagctgttactataattcttagctattattattatcatctcagaactaggatctatgtctgtgaacattatactcgtaattattttgaatattcttacaaatctttaatttagaaaagttgtgaatataaagatttttgggaatataatttgagaatgccatggttgagtttagggatgtctttgcttgctttattttgttcaaattcagacactttatattcttccattttcatattataattttatccacaatttgaaagtagtgcttctgggataggtaaatgtgcttacttacaataagtgaaaactttaaaaaaatgactattgggttattcttgtctttatgttcatgtaccttgtattttgagttttctgtaccatgtttatatttattaatttgcattttctagaatgaatcagtcctatttttcttttttctttttgttaagatgtaattcttacaatgtaacttttgggtatagagctgttgacactgaaatctgtgaatctagaatggctcaacctgttgcttggttggtgggcttgcttaaagggaacttatagatctttttgctctccagggagtttgtaacagctttgctcaccctcttgcaccagaagataaaaaccagacttcaaatcatacgtgaacaacatcttactttaaaatttttccttgctggggagaggatagaagctccttttctcctcattgtgttcagagatgataaaggctgttacattacccaggagatatgaggtgtccaaatagttaaaggggttagaatgctaggtgccaatcttgaggtctcaagtctggtgggaggcatgggtatattaactgttttttaagtactggctgccatcaaggaattctgccatgcagttcacctctaacttaaagtgtttgcttctttgaactggttagcttttgatttacatgacagtacactgtgctttgtaaaagtaacattgagctgggaagggttaatgaactaaaattttaatgcacgttatgggcacttcaaaacctcagttctttgtagttgtgtaattttcttcgttcattgttttgcatgatacaaaaatcataattttggacctgaatgcacaatttcctatgtttttgaactagcttgtggtatcgtaaagcttttaatttaacttttaaaaagctaaaaagcttcttaatttattgtaaaatttcaccatctttaaagtattttataattactactgtcctttgatttgtttccatttatttctattatcttgcagcatcttttatccaaattcttctttcttataaatcttgtaagtaggaaccagaagcttctccttaattgcagtcatgtttttatttttttcataattccattaaaaatttgattgtcattgtctcttgtagtttttgcacttgggaagaaaaatacttttctgtgttttgaatggggaagattgttggcaagagcaaattaatctgcctgaatcagtcccattatttctgtatactagtctggtcatgtcatgaattccaggactttgcactaactgtgttttggcttttttttttttttttttttttaaagctttaagcttatttttatacagatttagtgtttgatttgtatgcattctgcatgtagtgtttttcaaatgtattattgctggatagcttatttaggactaaaaatggctcatgggaagttgcataaagatttatgcttgactctgtattctattaaatctattataaaataatttaagcatttcatgtagagtaataaaagatttcagagtgattttcaatacactgtgaaatcttttgttaaaaataaaagcaactttcaaagggcttctgtttcagtgataacaaatgaccatgataatcttttttatcaatccaattttctgatttatcagcctcaagttagctgctgtctgtggttgttaaaattcattctcattttgcttggttgagcgattctttggtgtgtgttttggagttgggtgggtggtgggaatgctctctttttctccctgcccacttctcatccttactttgccctctccctaaagtatacagactggcatagggttgcccatttaattaggatgtccatctggggtaatgtgtaaattgcagtagctatttttcttaacgtttaagcatcattctgtagggggaagaaaaaacagaaaagaaataatagaaaagccaaattctgtattatatatctgtatgtggatacagatatatacaaatgtactctgctgatcaaaaattcagttgaaaaatgcttcttgtaccatctgttaaactgacaatgccactgtaaattaattgtaacctattttcaaagaagatttcagagagccctttttaaaaatattaagacatagttgctaaacaaaagcacttattggattcaagtagctatttaatgacaccaatatttgatctttgtgtccagggtcccatgagcctacgtggcatattgcaaatataataaaaccctccttttctctccccagccattacaacacaagctagcatggagtttcgacggaaagggtcacaaatgtccacagacaccatggtttccaatcctatgtttgatgcaagtgaatttcctgataactatgaagcaggaagagctgaggcttgtgggacactgtgtaggattttttgtagcaagaagactggagaagagattctgccagcttatttatccaggtcttggaatttttgtttgttttttcatttatatagttttgatagtgaagccattgttggttggccgactgaaccgatgagtgatgttggtctgaaatacctacagatgtctgtaagtgatcgacatttgcctgaaatctttcattttacctgtctcatcagatttggtaaagacccttaagaccctttttgttttagaagtgctatttatgtcatcttatttgaatctttttaatatggagagatttcgaaggaccacaattatttgttaacaaatttttagcacagtattcccatgtaggcagtccagaaataagtcagctgtaaatcctgcctccaaggagcttattttctgggcaaagccccaaacaaagccgtgtacacatgtaacaatgatccagcaggaattaggatattgatgggagaggcacagataatgtgctgtgggcattcaggggaagaagcagcgcacatttatttactgtaggggattcaggaaagagttttgggggattaaatgattatgctggacttataaaggatgagtagcatttagcctatgttagaaagttggttagggtcatcttctccaaatctatggcttcagccatctttgttaatgcctctgccatccattcagttgctcaggccagaaacgaagagtcattttagaatcctcttcttctgtatctttagttgatcaaccgatcaaccaactcttgccttcctgctacttaactctctttctgatctctcttttcactctatccccaccattatactttagactttgtcacttttctcctaaattaactcataatggcctcccgttcttcttgacactgttttgccttccttaactgatcattcacacaagtgcagaagtgaggttaatatcaacagagtatttagatatctgcatacttgctaggttctcaggagatagaattaaactgaccctatcagagggaaccaagtacagaattttatagatatgaaaaagaatggtatatacaggcaaataggcagggttatcataactatcggcgcttggtttaagcaacagaaaccctctcaatctgacttaagtaaaaggagaagaagttgtgagaagctagtgatatttattaaattctaaggtcaggaaatgcagtatggcctcatgaagagcagatactcaaggaccaaaacaactttattcctctctctttctctgtcttcctggtctgccagaactgcttcattcttctcttctctgcagatcattttctcttattgtagtgtgcttctgagttcccagttttcattagccgggcatgatggcatttgcctgtagtcccagctactcgggaagctgaggcagaagaatcgcttcaacccaggaggcggaggttgcagtgagccgagattgtgccactgcactccagcctgggcgacagagtgagactccgtctcaaaaaaaaaaaaaagttcccagttttcatggccttggtctaggtgaccatcaggaccaattagtatctctgaattttaattatagactcctgggaaggaggatctaattaatctgcctgtctctggtctagtcagctacagttgtgaaggtgggtcacataagggtgttggagctcacccacttgttgtgggggcatgtttctcaggaactctgggctggggagatatcctaaatggtactttggtagtaggggagaaggctatcaccatgaactttctgactgagccataagactgaatgggtggtagtaggacaaaccaaaacaacagattcatgagagggcaagttattagtttagttttgaatcgattgaatttgaagtgcctatgggatatttatcaacaaatatttattaagtcctactttgtgccagatattgtgcacagaagtaccataataatcactagacatccagatatccagtaagcttttgggtaatagatctggagttcagttgagaggtgtgggttagaatgatttgattatatttagtgacttaagaagtgtttaaaatcaggttagtaaaagagagagctttgagaactaaggttgtcagactgaggaacaccatctttagggggcaggtagagtaagaggacctgtaaaagaaaatggtcatagaaatcagggaagagcaaggagagaagggagtagttagagggctgaatgctttcaaaaggcagaatgagttaagacttagtcatgtctcttggatttggcaatcgagagcccattggttatttgctagtatggttttagttgagttctagggagagagatagattgaaatgggttgagcagtaaccagtaggtgatgaagttgtttctgaagagttttgcagagaagagaaactcacctcacaatagaagagtataacagtgcagctgctgttgaataacgggagattgaatgcttagtaagttgattagaggttgggggtggagttaaaaactaagctatattcaggtatattcctaaaaggaatcttattcaggtgaccttcatgatgaatacagatgatcgaatgcaggtttctttctttcattgtccccccaaaaataatggggaagggacaaaaatgtaaacacacctttttccctaggaattactaaatgttgcaacatttttctcttacggaatttaactcagcagttcccccagtttattgaaaagtactgcagcctgttgttttgttttgttctggttgccttatttgcaggcccctagaactttgagttgcaaggcttaaggtttgagaaggtgcaacagacatgaatttttttttttcttcattaagaaagatgatttgggtcttagtgtatatgattcagaattgttctaattccagtaatatcctttaaagggtaaaattccagtaattccagtaataacttttaaagggtaaaattctaataaattccagtaattccaataatgtcctttctttaaagggtaaaaatagtgatgagtggaaatagactttcagttaactatgtagcaaataataattatgaaaacttttgatcagcagtttgtttaaaatttttttcttgctttcctagattttacatgcttttaattcaaggtttgcagataaatgattatgtgtgccatcctgtcttggccagcgttattctaaactctcctcctttgttctgctgtgacttgaaagggattgatgttgtggttccttactttatttcagctcttgaaaccattttgcctgacaggtaagctatcattctctgctattatatcaactgtctgatttggcctggtctgttggtgcttcctccccagtttcctaatgtatcctgtccagttgtcttcatagtccaagagaactcaggcgacattaaatgagtgtagtgtgtccaaacccacctcatccctgaaatccttcagttctcatttgtctgtgggcttgttgaatcgtttttggcctggtctagaagggtaagaacaactccaacacagaggtcttacctttgtagagtaggccttacgttttaggtaaagaaatcaatcaatcaacttctagtttaattcagtaacagtttaacttagaaatatacaatatacaaatacacaatgcttggatttggaaaaattggcattatatgtatttggcagtagctaaaaatgtgctttagttcaaaaatactaatagctttttattttttggcagagaactctcaaaattcaaaagctatgtaaatccaacagaattgcgaagatcctccattaatatcctgctttctttgttgcccctccctcatcattttggcacagtcaaatctgaggtaatgttttgttaaagtttttttatatcctatattctgttttttgtactaatttaagtcaaatcgaatgttaaaaatgaaacaggagctttttttatttttcaattcaagttatttcatcaagttatttcaagtgaattaacaaagttgacttgtgattttttttttttgttctgtcagtttttctaccagttttcaagcagttataggctaaggacatctattaacatattgttagtgacagattcagcacagtggctaatattagactgaaagcctttctcattatactgatccgttcctccatctagctgttcccacatgggcatcataagctgcaacagctgatgttaaatattatttgttttttccataggtggtcctggaaggaaagtttagtaacgatgacagctcttcttatgataaaccaataacttttctgtccctgaagttgagacttgtgaatatattaataggtgccttgcaaactgaaacggaccccaacaacacccaaatgatattaggtttgtattcacacgttattttgtaagtgaaaccaaagtactgttgactacaggcctgctgaggaggcggcagtcggtaatgggagcctaaacctaatgtagctctacttactctgaatcagaggcacaagttagttttttaatgtaaaaaaatttaaagcagtgagatgagggaagtaaagtgttacagttgtcttggttggtcatttatttgtgcttttgcttttctttctcttctcccttctctcctttctccactctttgcctctccttcccatccctctcttctttcctcctttcttcctgctctccttcctcctgcctctttctcttcctcccgcctcgtcctcttcctcctgcctcttcctcttcttcttgcctcttcctcttactcctgcccattacttacaggtctcatcagtctgcactttcgtcctagtcctttttttctcaaacacatcagctaatgatttcttcagaaccttactttatatccctcctgctggggtgttctttccctagatttttgtttagcttttcttcatcatcttcttaagagagagcttccctaacaatacttgctaaagattatcttatttcatcatttttttcacaacacaaaacctgaaattatcttgtttgcttaaatgcttaaactccccgctttttacatgtttttcaaaatatatcataaggtatttggtgattgacaaatctagtgttagcactaagggacagtcttatctccctgaaaatcttcagagagaccctgatgaacagaggagctcttcttttcttcctctaatctgatgttcaaattgggtaaacagcaatgtattacatttgaaagcaaagggttttcagttgttgcttctgtgtctcagtgccactaaagtgcaatcctgggtattgagatcaccacccttgacagtggaagctcttaggaaagtagggctttcctcagccacctaacaggagtccccactgaaccatgtgaatgcaaataccatcccagcccacaaacctgggtggcagttagaactccccgcttatggagcaattgatctctgaggatgacttgaccttggcagtggttagaggctttctttcttctcttcattagcaagactagaattcagcttcttcctagcatcttagatttttatctgttcaaaagtgggatcagacattccctttaagcccttatgcccccagaggaggtggggtgtatgtccttccaacaggaacacaatccttgaaatggtttctaaaaggcctctaaaactgagggacagatcctgaagagatgggtcacaacggccaagaaccatatttatccagagacacctaattagtaggtgactggagttgtctgtagctgggcaaaaagttttttagggtttcgtaagtctcaaaagccattaattgtggacatgattttctagactcacaaatggagttttttgctctttacattctcagttatgatgtatagctatattcttgttcaggctgggcttttagagaccttctgaagttaatgtggtcagtctgaccaaggtttggaaccagagtctaccagtggcattgataatatctcagatacattctgaacacagagggtggtttatgtggagggggatgttttgatatgtgagaacctccaagttacaatgttttaggttatttaaataacataattttgcttgaaattatataatttctacgattgaagcagtatttggttttgttacacccttgctctgaggcactccctatgtactttccaaggaagagtcagttgttactcttgccataaagtggcaaagctctttccatcttctctttatccatagtgggcaagagtacctcccacggggatgagaagcagtgtgttaggctcaccatctcatttctgtcctagcctttccaggacaatggtttccttgataataaataaatgaagcttacttcagggtatgcagatgtcaacaagccccagactgtgtggctttaatcattcttaaaaagcagtgtggtcagaaagctattgctgtgactttattttgtaatttttgttttatttatttgtttctttttccctgtagaaaaaacagacagtaatgtttgttttatttttaagactagaacctagttttgaaagtattccataatattttccttagtttatattacccttgaaattgagatgcttacatctggtcttttacaccagttaaaaaatatctgataatgagcatgtttttatataaagcaagtttgaccttcacattcattttatttttatttatttatttatttatttatttatttatttatttatttaaatacaagttcttgctctgttgcccaggctggagcgcagtggtgcaatcatgggtcactgcagcccaagctcctggactcaagtgattcttctgccgcaacctctgaagtagctgggaccacaggcgtgtgccaccacacctggctaattttttgttgttgttagaatagggtcttgctctgttgcccaggctggtctcggacttctgggcttctccagtcctccctccttagcctcccaaaatgctgggattacaggtgtgagccactgtgcctggcccacatttattttagggaattttttttttttgagatggagtctcgctgtgtcacccaggctagagggcagtggcatgatcttggcttattgcaacctctgcctcctgggttcaagcaattcttccacctcaccctcctgagtacctgggattactggcacccgccaccacgcccagctaatttttgtattttttagtagacacaggattttaccatgttggccaagctggtcttgaactcctgatagcaaatgatctacctgccttacccttccaaagtgctgggattataggcatgaaccaatgcacctggccagaattaaggaatttttaaagagtctcttctgaccaatcagtggatttattagtagagttgacccttgaacaacatgggtgttagtgatgccaattccctgagtagttgagatccacatataactttttgattccctaaaaacttaactactgatagcctactgttgaccagaaaccttacccataccagttgattaacacatattttgtattttatgcatattattaatatatactgcatttttacaataaagtatgctggagaaaagaatattttattaagaaatacatgttgtaatcccagcattttgggaagctgaggtgggtgactcacgagaccaccctggccagcatggtgaaaccctgtatctactaaaaatacaaaaattagcagggtgtgatggcacatgcctgtagtctcagctacttgggaggctgagataggagaatgtttgaacacgggaggcggaggttgcagtgagccaagatcatgccattgcactgcagcctgggcaataagagcgaaactccgtctcaaaaaaaaaaaataaaataaaaataaaaataaagcttgggcgtggtggctcatgcctgtaatcccagaactttgggaggccgaggtgggtggatcacgaggtgaggagttcaagaccagcctggccaagatggtgaaaccccgtctctactcaaaatacaaaaaagaaaaaaaaaattagccaggcgtggtggcaggcgcctgtaattccagctactcggaggccgaggcagagaattgcttgaacccgggaggtggaggttgcagtgagccaagatcacgctactggactccagcctgggtgacggagtgaggctccatctcaaaaaaaagaaaatcataaggaagagaaaatacatttacagtactgtatttattgataccataaattgtctgtttataagataaatcgtctcaactgttgggcagttgtagctgtagaccccaatctacagtacatatcaagcaactcagctttttcttgtaatgtcatgacttttctctgcttcttgggagcacttccagcatcactagtggcacttcctatgggtcccatggcgttagtcaaggttcatggtgttgcagtaaacatgatgaaaacatgtgagaaccatggtatgcaatttactgcagtgttcagtctgttagagagatgaactactcacatggagatggttagcatcacattgtattttaagcagcatactcattaacacttgagctcaccccagtaacaacaggaggaggctacaaaatgattacagtagtgcagtatgtactacagctaattttatacagttatttaatactacatctttgtttacatttctctggactgcaaatggcatcatgtatggtctgtaagtgtttgtgtacgtaagttttttgataaattttagctttttattttttatttatttttagagacagggtcttgctttgttgcccactctggtctcaaactcctaggacttcaagcaatcctgctgactcggcctcccaaagtgctagaattacaggcatgagctagtatgcccggccaattttaactttttatacttttttaaatatttcttttctttctctttttttttttttgagatgaagtctcgctctgttgtccaggctggagagcagtggtgcaatttcggctcactgcaacctccacctcccaggttcaagcaattcccctgcctcagcctcctgagtagctgagattacaggcgcacaccaccatacccggctaatttttgtatttttagtagagatggggtttcaccatgttgaccaggctagtctcgaactcttgacctcccgccccacttcggccacccaaagtgctgggattataggcatgaaccactgtgcctggccatttttttttttttttaatatttctaggctatgcagtttgggagttttttcaaattgtcacagatctccaaaaaactttctaacatgtttattgaaaaaaacctgcatatgtacagttcaagctcttgtttaagagccaactataatttcatgggtatttcaggaatgctcaaccaaaattatattcttatctgtactattaatcatataaaatgtcttacgcattttagtgttcttgtgtattttatataaaatactgttttattgttgttgtaggggcaatgttaaatattgttcaagattcagcacttttggaagccattggttgccagatggagatggtaagaagcatacatgcaatctgtcagagaatatcacttttgaatttcatgtaaattatattccagaatgtccatctttgtgaattttaaaggcctttggtttgtaaatcctgctcattggctcagaagttttctttttaaaaataatgtatattttgaggtttgcttttcagtgcctcttcagctgtacatcaggttcccgagatattctgtatgagagaaactacagctaaatccagtctttattcctgaacagtgtctgcttaaaactgttacttgttttgctgtggtggcaaacttggttgaataacctaggaaaagccctagccagcaagcaactagtttaactttttcttacccatcaattctttctaacccctctagacctaagtttgcaggtccctcaaagcaccaatgcttccaaatcaaaaatgcttctcagagacttccagtgctctctgctttgtcttcaagatatatcatccctatacttggagtataggcaagacaatggaggggttaatagggtatactggggtaagttgggtagatgtagtaagctgagtagatgtaagatgggtgatcaaattattattacggaaattacattcgtgtctcagtagatggtgaataataatttactgatctgaatataatgaactgtgtttatatggggaaaaatgagggaagtctaacagataggtttattagcccctatacatacgggagttaaaactaaccctagtattgtttgtgttttctgatataactgtatttgaaagttgccgtttgtttattcatgcctttttgttttttgttttgttttgttttgctttggttttgagacagagtctcgctctgactcccaggcttgagtgcagtggcgcaatctctgctcgctgcaaactccgcctcccaggttcctgccattcttctgcctcagcctcccgagtagctgggactacaggcgcctgccactgcgcccggctaatttttttgtattttttaatagagatggggtttcactgtgttagccaggatggtctcgatctcctgacctcgtgatccgcctgcctcggcctcccaaagtgccgggattacaggtgtgagccagcgcgcctggccttattcatgctttttaagcttatatttctgttctgaggttttgcttgggaggcactagggtattctttttaaggacctggaatctagtgaagtctagtaaagatgaaaaagctgggccagccctttgtaaatagtggcaaagaagaccccagtatgggcacttgtagtagtacaaatccttcataccctccagtagatttgtgtgtgtaaaaataccacagtggttttaatcccttgtcaatttctgttactatcagtttgtactattcagttggcacattctgctttatcaacatggtttttaatgattgacctttatttatgcttgtaaactgtgatgtaatcctcacttgattcattttcatttgactagggtggtggagaaaataacctgaagagtcatagtcgcaccaatagtggtattagttcagcaagtggtggaagcacggagcccacgactcccgatagtgagagacctgctcaagctctcttaagagattatggttagtcgtgtttcttttgaaattcaaagtttaatagaatgactttaatgcttacatttataaaacaaaaacattaaaaatgttaatgttcatgttttttatatacttaagtataatagagaggatgtcagtcttaagaagctaagaaaaaacaaatctttttgatttagctgtatagcttttgggtagtatattagatttggggtagtatattaggttttataattgatagtaatgggtgatcagtaaacatttctgaattctctaccatgtgtggtggtagagaaccaaataagatgtggactctgcctcagagctcacagtgtagtggcagagatgtccaataagccagttattgcagtgtggcaaggagggtaatgggggatggattagatagcagcccagaggagagcatgtcttcatgttaaaacctgtgtaccccctactgtagctcactagattctttagccctgaaacatttttattttctgccctgccaagtaaaacatttgccagccaagcatcctatacaaggttgtcccctaccttgggcagttgttttatggattctgtgagtttgtgggtacctttatgtttttctacacaagtactaacagtgtattaaatctgtgagcacttatccagctagattggagtgatatctagattcttagatgtgagtttaatcctttaatcatctggagagttcatgagccatgttcatgaggttcatgaggcatgtcatgagccatgttcatgagttcatgaattcatgaggcatgtttctatggtttaagtttgcaacaagtatccttgaacatgtcagatatacataaagccattatgtggatatttgacacatttaaatattatattcgtgaagaagttatttaaattatcttattcactgtgtatgtagatttaggtattctataggttgaaaattatttttcatgctttctgaaacacatttaagctaaataaatttttcagtactggctgggcgcagtggctcactcctgtaatcccagcactttgggaggccaaggtgggcggatcacctgaggtcaggagttcgagaccagcctggccaacgtggtgaaaccccatctctactaaaaatacaaaaattagctgggggtgggggtgggtgcctgtaatcccagttactctggaggccaaggtaggagactctcttgaacctgggaggcagaggttgcagtgagccaagattgcgccactgtactccagcctgggcaacagagcgagactccatctcaaaaaaaaaaaaaaaaaacagaaaacaaaaacaaaaaaagaaatttttcattactgcatgtgttctaatataaatgttttaagtgattattgtttgtttcagcattttgagctggtgttagtgagctctgcttgtaatgtcgtaaaatattttttactaagaaatcctgatttgtgttagtgtcgcatgagtgtctctctttaatgatcattcctttttctgttgtcactgccctctttctgataggatcgacaggtataatgtccctaaagcttcctttataaattcagtttaatttgtctttatttaatttttcctaatttcctattagctaactagtgattgcttttacatatagattggagcccaaataaaaatatggtggcttggttatttaatttttttagaagtattaaagtaatcctggagaattaaatgttaaagtatgtttgaaaaggcattgcatgtgagttttgatggcttaaaccctgtaagtaatttcaacagatgcttgcttcagagtaattcctagcatctgaggaggccgtaaaattagaactttcctctgtaaagtttcaaggaaataattgatagccttttcatcactctttttgaaaatgtagctatgagttgataatttagaaactttaaattacgttgttatgaaaatgacactgaaactgccaaatcccacggttgtgtcaaagtgcgtgaaccaggaactagaagctgctctggtctagcacatgtgcctgtgcaccgtgtagtcaggcttggcactcaacccagtggggtggggagcgtagcactgtgtgggtgcccgtcgttctcactgtggctgctgtggtctgtgcctagtggatgctgtgcttctcgttactaatgcttagttgttttccctccctgtgggatgtggcattggggttatatcctagctcttaatacagattcagctgctgggctcctgattcgcagcattcatctcgtcacccaaagactcaactcccagtggcgccaagacatgagcatatcactggcagctctagagctcctctctggccttgcaaaggtgaggaagacagtccttttattttaacccaacagccttgggccttggctgttttttctgtatctcttaaccccttgtgtgggtattttagtgttgatcatgctcaaacatagtttatattatatccaaagtgtacaaaatttagcctccaagtgatattctatgcaatgaactttactttttaaaaataggttcaaagagtatgaatgagatttttaccgttaaattataggaaacatttcaatacttgccatttatttatttgcatataatactagaatgcatattgattttgtaaaaaatgattatcctaatgtatgccatttgggattacctgtggctctgccatcctccattatcagagataagtgaaaactggctacacctttttttttttttttttgagacggagtcttgctctgtcgcccagtctgtagcgtagtcgtgcaaacttgttgcactgcagcctccgcttccaagcaatccccctgcctcagcctccaactagctgggattacaggcatacgccatcacagccagctaatttttgtgtttttagtagagatggggtttcaccatgttggccaggctgatctcgaacttctgacctcaggtgatccacccgccttggcctcccaaagtgctaggattccaggtgtgagctactgcacctggccttggctacactttttagatttctttcccagccgttacttcagttttttggaaacttagaacttggtggtcatttgtgcttctctaagtgtattcttttgagatgaaatttgtgtaatataaaattagccatttaaaagcaaacaattcagtgactgttggtacattcacaatgttgagcaacttctacttctagttccaaaatgtttttatcatccctaaaggaaaccccatacccatgaagcagttttgcttcagtctccgcaccccctcctctgacaaccaccatttcatctcaatgggtctacctatactggacatttcatataaatggaatcatacaatgtgtgaccttttgtgtctggtttctttcactaaatgtaatgtttttgagtttcatttatgttgtagaatgtgtcagaactgtattcccttttatgattggataatatttcattgtgtgtatataccccagtttacccatttatcacttgatggacatttgggttgttttaatctctaggctgttgtcagtagtgctgctgtgaacatgtatgtacatgtatttgtttgaataccagttttcagttcttcgggtgtacactaggagcagaattactgggtcatatggtaaccctatgtttaactttttgaggaactgccaaactgtttttcacagtgactgaatcattttacattcccagtgtatgagagtttcactttctttgcattttctctaacatctaggtgttttcttgacagtaagatgagcaggattatcttacatataatatataattgaggaaatacgtaaaatattttgtgaacaaagagccgataaccaggtgctactgtctgggatgatatggttcaaatccttatttttcagttatgggaatagttgtcagaggctgtgacttacctaagctgtaagaaacaaaataagcaataaaacctaaggtgttcttaccaccacttagagcttacctcaaagatcctccaggatggacatcataactttgcgagaagcagttactggtacagaaaataaaaaacagccatttgtgagacatacaggaccacactgtctttgagagcaaggtactgtttcctgtgacctttagtacactcagtagtaagcaataattagtcctaaatggagcactgctctggacctgcctaacaattcataaagggctaacactacctgatttgatgatttactgtaaggctacagtaacacaacagcctggtattggcataggggtggacaaattgatcggtggaagaaaatagtatatccatacttaagtggtcatctgatttttgacaaaggtgcaaaggtaattcaaaggagaaagggtggtcttttcaaccagaggtactataaaacaattggatagtcatacacacaaaaaaaagccaaaaaattttgattcataccttgcactatgaacaaaaattaactcaaactggctgggcatggtgactcatgcctataatcccagcactttgggaggctgaggcaggaagagaccagtctgggcaacatagtgagactttgtctctattacataaaaatatatatataaaacctaaacaataaaacttctagaagaaaacaagagaaaatctttgtgaccttgggatagatttcttaggtgttacgctagaagaacaaactgatatgttggacttcaaaatttaaaactgctgttctttagtaaacactgttaaaagaatgagatgacagatcacaggctgggaggaaatgtttataaagcatatatttgatgaaagatttgtattcagattacataaagaactctcaggactcaataatagcctttccttttggtggtgcacagcagcaatatggtggtgaaaatttctaagaagaggaagtttgatagcatcttcagaaataaactgagcgaattcttcactcagaagcttgcagaaggtgactactctggagctgaggtccaagttatgccaaccaggatagaaatcactaccttagcctccaggatgcagagtgttcttggtgaaaagaaccaccggatctatgaattggctgagatagttcagaagaggtttggcttccttgagggcagggaaagctttatgctgaaaaggtggcctaaaataattctctatgccattgcccagacagagtctgtgctgtaaactactattagggtttgctgtgaggagagccttctgtagtgtgctgtggttcattatggagagtggggcaagagctacgaggtcatggtgtcagcgaaactctaaggacagagaactgaattcatgaacttttgtgtgtgatctgatgatccacagcagagaccttgttaactactgcattgatactgccatccaccatgtgctgctaagacagggtgtgctgggcatcaaagtgaagctcatgcgtcctgggcccaagtggtaagattggccttaagaatcccctgcctgaccacgtgagcactgtagaccctaaagatgagatactattcgccatgcccatctcaggacagatggttaggaagccatgctctacccagccccaactgtgtaatagggtctccttggcagctggatctggagtctggatgttgccttgtaaagacctttaataaaatcttttaagacaacaaaacacaacaacaaaagcccttaataatacaacaaacaacccaattaaaaattgggcaaaagatttgaatagatgttttatcagagatgatatacagatgacaaataagcacatgaaaaaaatactcaatatcattaattattagggaaattcaattaaaaccatgatgagataccactgcaaatctattagaatggctgaaatataaaagactggtcataccaaatgttggtgaggatgtggaggaactattgacgagaatgttaaatggagccaccattttggaaaacagcttggctgttccttaaaaaggtaagcatacacctacatatgacccaataattccactcctaggagataagagaacatttatcgatataaataccttgtacatgaatgtttatagcagctgtatttataatatccagaagctggaaacaacccaatgtccattaataagtaactagataaattgtggtatatccatgcagtggactactattcagcaatagaaatgaatgaacaattgatacacccaaaagtgtagctaagtctgaaaataactatgctgagtgaaagaaaccagaccaaaaaaagtacatattgtatgatctttatatgactttatttatttaaactctagaaaatgcaagctaatctatcgtgacagcagatcagcagttgcttagggagaggggcaaagaggagtgggaggaaggattacaaaggtgcatgaagagatttggaggtgatagatacatccgctgtcgattgtggtgatagttcacaggtgcatacttatgtcagaattgaccagttgtatacttgaaatattgggcaatttatgacaattatgcctctgagcagctgcacagaactttctgcagagcctagtgcatcactgtgaggttgggttaggggtttaaaaatgtgcccatgttctttcagtctctgggaatgatgaacaggtatacccaatgggtttgggttttagggcatgaaaaactatgctaatgaaatactgtttgagcacttgaaaaatgccactattttttgtggagtattacaatacatctgaaataatctgttcctgtatataaataatataaaaaagcaaggcttcctgtagtgtatgacattgtcaaataggtcaagcttcagtgcaaatgctttgaaattggtacagtaattcctggctgattgtttttgttctccaaatgaatatgctcaggtaaaagtgatggttgactcaggagaccggaagcgagccatcagttctgtgtgcacctacattgtttatcagtgtagtcggccagctcctttacactccagggatctgcactccatgatagtggcagcttttcagtgtctctgtgtctggctgacagagcaccctgatatgcttgatgaaaaggtgagtttattttattttaaaccattaagtaaaaacaaaaatgtatgctagcaaaatgccttttgaaagagaatatctaaatttaaatacagtattgcacactttaaactgaaaatacttgttagattacagtggaacacttgtccttttgggtacaacttgaaaactgtcattttgcttatatttggttgcaaattaactcatagagaaattgtttagaaagatgagaccttggctaatttatctgagctatcaagattgttctttcttgaaaggatggtagcctggagatagctagtaggcactttggtcacccttcaccaaacaaagaagggcagatgattgccaggctgcaaacctagagcacagctcatctataaaggttgcttctatcgaaaaatgttactccatactcatttcttcattctcaagtggatgcagataactagtccatgttccctaccattgttctgtgtaatgtcttccttatagggaagcaggtgttataaggaattcacagtgcaaatcaaaggagagatcattggatatttatagaaacctttatgtagtttaaggaataatattgttgattaaatcttagtcattttcattatggcttctgaagttgtaataccagaaattacttaaaaatgtcaatgacaagatttcctttggatattataatatgtcttaaaccatccccctcctttgatagctaagtccagagatggtgtctgtctctctgtggttacactatcccaagcttaactgaattactatttaatctcttagatttgtgcttttgtgatttatagtcttcagtaatttcacaagaaagttgaattgaatttatttatctaacactctaaacaccaaaatttagttctttaatgagaaattggggggagggggtgtaaagtttattatattactatgaagttaatatatatccattaaagaaattaccaagaaactggagcccttccaccaaaacgcaaccactgttagcatttggatggatttccttgtcttctcatgagaaaggtgtgttctaaaaattgatctgcctttcctgcttttaggactgccttaaggaagtactggagattgtggaactgggtatctcaggaagtaagtccaagaacaatgagcaagaggtcaagtacaaaggagataaggagccaaaccctgcatctatgagggtaaaggatgctgctgaagccaccctaacatggtatggaagtgaccgcacagggattgtgcctaggaattagatggggttagcagtgatccatgttgtttcatttccttcctgattgttcagcattgcgtgatgcagcccctttagaatatactttttctccagaaataaaatgggaagaaaatctctattttttttttacgtgttttgtagaccaaaagaaactaggaacttggggttgagagtttgagtcctttttctataccgtttgatgttaattcaagtaatactgtgttagagctagacttactgtaccccctcactttgatagctaagtccagagatggtgtctgtctctctgtggttacactgttagatctgctttccagctcagtggtctgtattctctgctataccatttatattacatagtataggttcattcaaccaagatttatgaactctcttaacaactgagaataggatcttaaagataagtctgatttagtcaccactacgtctaccatcttgtctggtagggaagataaaatatgaacacaaatagctataatattaggtggaaaataagtgctgcaaaagaggtataaataaaatgctggggagttgaaaggagaaaatgaatacttccagataaggggaagtcagagtaacatttcttgaggaaaatgacactggacctgactctgggaggatgggtcaagtttgagctgcaagccagagtacagggtgggtaaaaaggcaccacgactgctgttttgagaattttggtgtagtaaagtggtaaagacagggagtttggtaccttgaaaaagagtagcagagaaagttgagagagtttttgtttggcttgtaagtgagcatactggaaagagggaaggaaggcagcttagccacatttgtggactgaatggaacagttagtggaaattaggtggaaccatagtacacgtggaaagatggggcttatgaaaggatatgtgcagatgaaggctcagaaaatgtaaaagcagaaaggaggagtggcaagttagtgtgggctggggcatcttggtcttagtaaagtagcaggcaaaaccgcttgaaaattcgtgtgtaagtcagcccttaccaagatcccagcatcttctgtgagttcagtggcctgttgcttgcttgggacatgcacagtgaagttggatttgtttctattcctgtgggcttaagtcattcagtgaatttttagaagaatgctttctgtcatttagtcctgctcactatgcaaatgctggactttcggtgacttgatggaggtttggctaatagctagaaaattaaaaaaaaatgtgaatacagctactgaagcatgtgcttatgctgatgatgaatactagaagtaatataagttcagaaagaagaccatgtgtgggccagggtacccttaaaagtgtcatagggctgggcgcagtggctgcactttgggaggccgaggcgggtggatcacagggtcaagagatcgagacctcctggccagcatggtgaaaccccacctctactaaaaatacaaaaattagctgagtgtgatggtgcacacatgtagtcccagctactcaggaggctgaggcaggagaatcgcttgaacccaggacacggaggttgcagtgagccgagatcacaccatcctggcaacagagtgagattccatctcagaaaaaaaaaagtgtcatagaactaaaacttgatgcatgtcttaaagagtaagaaggatatggagagaaaggaggggacatttctcactagaaactcttcattatacaaaaataagcttgctccatcctagcctggatggggtgttctttgagtgcatggctagcagtgaggattggatatgtgctcagggtgagtagagtcttgggatgcttcttctcaacctcaccagtaagctacatggctcatctgtttcgcttcagctgtcttgtctctgctagcagcttgacaaatggtatctccagttttcagtcttaactgtcatcatgaaacgtgtctctaaccagatttctctgttctctcacaattgctgctttatgttagtatcattgctgtttgccagttatgcaaacacagaactttggctgtttctctgatttatctttctgtcattccccatgtacatgagccagtgactgagttaaacagactttatttttgtaaagtatttcctccatcccctccaacctggatagcatcctagtccaggccctcctcacttcttgcccaattgccctattttcgatctcttagcccttcttgttcattttgtattctattgcaaaactcatcatccttaagcacaattttgatcctgctgcttgaatgattgaaaaccttgagtagatctgtttccttccttgttgtctaaactcctcaatctggtttttaagggcaccatctgatcttttccaccactgctttgcaacttgtctgttttgccgttgtcaggcctgacagagcactgtggctatgaactagccatgcttatacctgcttatgctcttcccctgggtttcaggacctcttttttcttcacttggctacatcctccgctgttcagtgcttatagcaaatctatctacctccatggggcctttggttattctgcttctgaagatgactcttttctgtacttccgtgctcattctgtctgaccctgctgcacggcatggagttttatactgtcatgattgtacctggttacatgtgatccgtgctagtgttgtctcgccagtctggggagcacatttacctctttgccaacacagtgctgaacacgtagtagaaaattatggagtgcagattagctggttaggttttttttcctctctgtgtacactaatacaaattcaggattagggctcttggaagtcatttcaacagtccctttgcctgtcacctttaagacatgtgtaccaagttatttagcctctaatttggagattttctaacccccaaggttgcccatttcattttaattgttaaaaacttgatactttacattgagctaaaatctctcccacttctatgcgttggttctaattcatacatttgatcgttaaatcctttttgtccaggcagtagcagtatccagaagcagtcttca

SEQ ID NO: 53 - DNA, 18677 bp, Homo sapiens
ccggggagtaggaaggagccggggctgtagccggagtggagcggctgccagccgaggagcaggcgcggccgcggcgccatattgcggccctcagcggccgcgaccgagtcatggctgagacctacggtgagggtggtggacgaagctggggtcctgggtctgggcccagggaggatgcggcctgtgggaatgggcggggctttgtagatcagggggcggggtctggtgtgatggaggcaggacctaagtggatgctgggaggggtttagtgggtctgaggctgagcttaatcgatttaggtggagcctgagggtctggtgcgtgggttaaatagatctggggcgggatttgagggagctggtcctgaggggttcagggaggccctgagggaagaggtgggccttaatggatctgggcggagcctgagtgaaggggcggggctgactgcatgaatggcaggagtcgggcttatgggctagagggaacactgaatggaagctcgggaccctggggctgatctggctggagagagctctggaatgggtttggggatgggctgtccttgagttaggggcaggacttagtggcaaagggtgggacttatgcatgagaatggagccgggttctgggcagagggagggaaggagaggtcgggaagtggaaaatcagtagggatgcaccataggaggtggtgattggaggcaggggaagtgcaggtttaggagtcagagggagccgcattcactcaacaaatatagaagagaagggagaagagtgcaaagaccctgaggtgagaaccagcttgtcattttcagggaatagactgaaggtcaggagctatagtggagtgaatgagtcagagggtggtaggaggtgaagaggaacaagggctatatcgtagtccttgtttaaatagctttcaagagactttagcgacaaaatagctaagatctgggactctggagcccttggcctaggtttgaatctcacttctgcccagctgtgtcactttgggcaagtcagttaacctttctggcctgttacctcatccggaaaatgggaataatttttagtctacctccctcatagagttttcctgaggatgatgtgagctgttgatgtgagtaaagacctttagaactgttcctggcccacaacaacacacaattgacccatgtaacaaacctgcacatgtgggctgggcgcggtggctcatgcctgtaatcccagcactttgggaggctgaggcaggcggatcacctgaggtcgggagtttgagaccagcctgaccaacatggagaaaccccgtctctactaaaaatacagaattagctgagtgtggtggcgcatgcctgtaatcccagctactcgggaggctgaggcaggagaattgcttgaacctgggaggtggaggttgcggtgagccgagatcgcgccattgcactccagcctgggcaacgaaaagtgaaactctgtctcaaaaaaacaaaaacaacgacaaaaaaacccctgcacatgtactccctgaatctaaaataaaagttgaaaaaaaatatatagaatgtgcctggcacatggcaagtactacataagagttatctgttactgttacctattggtttgtttctgcctatgtctgtttctctccctctaactgtgatggttagagagagagattggattggaatccatcttttttccctgtatctttctctccctgtgggtatccctgattttggctccatctggtcagacttcctcttcaaattcctggtgattggcagtgcaggaactggcaaatcatgtctccttcatcagttcattgagaataagtgtgagtttcccgcagtggtcctgggaaccctgagctgtgtttatgcgcatggtgtgggctggtgggcagccggtggggagggcagggctggccataggtacaagtccagtgctggctttttggtccttgctttgtcgtatgtcctttactaggttctccttgacctcaagtcactccagcaaggagaatgggtttgtagagactgagagggccttggaggatgggggatcctctgagctgtctcctctctccctgtactgccccttctgttcctcctactcccagtcaaacaggactccaaccacacaatcggcgtggagtttggatcccgggtggtcaacgtgggtgggaagactgtgaagctacagatttgggacacggctggccaggagcggtttcggtaggtgggctgggctcccaagggtgatggggagagagagtgagaaggaaagagagagatgtgtgtgtagagtcacttggagacactgagagggcagacaaggcagacagagagagatgagacaccgtagttagcaggtatatatatccaaggagagagggagtactggagagataaagagatggtggaagaaaaagaggtaggggccaggcgcaatggctcatgccggtaatccccgtgctttgggaggccatggtgggaagattgcctgagcccaggagtttgagaccagcctgggcaacatagtgagaccccatctcaaagaaagaaaaagagatagagaaaagtggcttgggggtggggaaagggatggagactgagagacaccgaaacagaaagagaaggggaaacttgagagactcacactcagaaaggaaaagagcaagagagacagagactaagagagttgaagagaatgataagggaggtaaggaggcctggcacggtggcttacacctataatcccagcactgtgggaggctgaggcaggtggatcacttgaagtcaggagttcaagaccagcctgccaatatggtgaaaccgtgtctctactaaaaaaaaaaaaaaaaaaaaaaaatcaaaaaatgtagccaggctgtggtggtggatgctagctacttgggaggctgaggcaggagaattgcttgaacctgggaggcagaagttgtagtgagtcaagatcgcaccactgcaccccagccggggtgacagagcgagactctgtctctgaataaataaataaataaataaatgaataaataaataaataaataaataaataaataagggaggtgaggagacacagagaaacagaggtcagaggcagagagggagacagggtgagtcagacaggtgtagttggacgttgaatgaatgaatgcacgaatttacgggaaggcaagggtgagcatgagagccacagagatggaacagaaagagagacagtgagaaatagggaactgaagacacacacgccaaggcaggagaaccgcttgagtccaggagtttgagaccagcctgggcaacattgtgaaatcccatctttccaaaagagagatggagaaatggacgtgttgtgggagagagagagagagaaatgcgtagggctcaacacactgtaggtcttcaggaaatgcctgcagagcagaaaagttgatagacacatagaaaccttaggagaggccgggcgtggtggctcatgcctgtaattccagcattttgggaggccgaggcgggcggatcacgaggtcaggagatcgagaccatcctggctaacatggtgaaaccccgtctctactaaaaatacaaaaaattagctgggtgtggtggcagacgctggaagtcccagctacttgggaggctgaggcaggagaatggcatgaacccagaaggcggagcttgcagtgagcccagatcgcgccactgcactccagcctgggcgacagagctaggctccgtttcaaaaaaaaaaaaaaaaaaaccttaggagagtcggagaaacagagagcagggagagaaatagagggaattcagtccacggaaaagtgtgatctatggcagcatctagtagctgctgagttaattcttgcgtatggattaactgcctgaggtgcacagagcccaaaggcagagagaggggctgaaggatagacaggtgtgtagcatgggctaggtttacggtgagtgcttagtaaatgctgtggaatgattgcatgagttccagaaggacccagactggtgagacagagaatgcagaattggctacactgggaaggagactccacctgacacagcaggagaaggataagcagatgttgtatagtgcttgggcagggccaggcaaaggggagatttgctcagaaaatgttgaatgaatgaatgcacaaatgcatgggaaggcaaaggtaagcatgagagagccacagagatgaaacaaacaaacaaaaaagacagaaatagggaattaaatagggccaggcacggtggctcacgcctgtaatcccagcactttgggaggcctaggcgggcagatcacttgaggtcaggagttcaataccacactggccaacatggcgaaaccccatctctactaaaaatacaaaaattagccgggcgtggtggtgcatgcctgtaatcccagctacttgggaggctgaggcaggagaatcacttgcatccggggggcaaaggttgcagtgagccaagatcacgccactgcacttcagcctgggcgacagagcaaaactccatctcaatcagtcaatcaatcaatcaatcaatcaataaaagacatgtagggccgggcacagtggctcacgcctgtaatcccaacactttgggaggccaaggtgggcggatcacttgagctcaggggttcgagatcagactggccaacatggccaaccccatctctactaaaaatacaaaaattagcctgatgtggtggcgtgcatctgtaatcctggctactcgagaggctgaggtgggagaatcacttgaacccgggaggtggaggttgcagtggttgcagtgagccgagatcatgccactgcaccccagcctgggagacaagagtgagattcctactcaaaaaaaaaaaaaaaaaaaaaaaaagaaaaaggaaaaagacacataggttaaggcaggagaatcacttgagcccaggagttggagaccagcctcggcaacctagcaaagccccatctttacaaaaaatattaagaaattagccaggtgtggtggtgcacacttgtagtcccagacactacataggctgaggtgggaggatctctccgttgggatactgagcctaggaggtcgaggatgcagtgagccaagatcgtaccactgcactccagcctgggctacagagcaagaccatcaaaaaaataaaaaataagacacacatgaaagagacacagagagaaaaacagacgaatggaaagatagggacacagggagagacaaaaatggagattcataaatagagacagctggccagctaagtgagatagaagctgagagaggcgaagagagagggacttcaaggatgcaagaagagagaggaattgcatggtgacccgaccaaggccaggttttgggggatgggccagcagtgaaggggggggcctccgaaccaccagtctgtctctgtagaggggggcattctcggggcagaccccagccttgggggtgactgggtccccctggccccacaggtcagtgacgcggagttattaccgaggggcggctggagccctgctggtgtacgacatcaccaggtgggtgcccggggtgggtggggtagggcatgggtggttcctctcctgcactgcctccctcccttctcccttctccacagccgggagacatacaactcactggctgcctggctgacggatgcccgcaccctggccagccccaacatcgtggtcatcctctgtggcaacaagaaggacctggaccctgagcgggaggtcactttcctggaggcctcccgctttgcccaggagaatggtgagggctgtgtcgtggaccaggtggtggtgggggtggacagtccacagggaccatgggtttactggctctcagtggctgtacccagcaggggaacgtggaggttcagaagtctgggttcaaatttgagtgttggctgggtgtagtggctcacacctgtaatcccagcagtttgggaggccaaggtgggaggactgcttgagcccaggagtttgagaccagcctggacaacacagtgagatcctatctctataaaaaatttaaaaaattagctgggtgtggtggctcatggctgtagtcccagctacagtggaggctgaggcaggaggatcacctgagcctgagagtttaagactgcagtgagctgtgatcacgccattgtactccagtctgggagacagagcaagacactgtctccaaaaacaacaacaacaacaaaacaacaacaaaactaagtgttgccatcagtgagctatgtgattacactggttctcagtttcttcatctggaaagtgggatcacagtgtttctgccccacagtgtgctgtgatgattaagggagattgtggaaagtccttagcacccgccacagagtgggtgctagattaatgttggccgctaaggtttcgcctaccgtcaggaggccgcacagggtattggttttttaaattaattattttatttattttttcctcctaccgcaccttcctgggtattggtttaatgtagagattgcaaccctagatggccctaggtgaaaggcacttttttttttttttttctgagacggagtcttgttctgttgcccaggctggagtatagtggcgcaatctcggctcactgcaacttctgcctcagcctcccgagtagctgggactacaggtgtgcgccacaacgcctggctaatttttatatttttagtagagacggggtttcaccatattggccaggctgatctcgaactcctgaccttgtgatccgactgcctcggcctcccaaagtactgggattacaggcgtgagacactgcgcccggtgaaaggcacatttttgaatacaggagatgggatggggtagatccttgagtaacaggtactggtgttaaggggagtgcagcatactgacaacccacaccaaaaggtttgcaagggccaaccacaatggctcacacctgtaatcccagcattttgggaggccaaggtaggagcatcacttgagatcaggagttttagaccagcctgtgtaacagagtgagaccctgcctctacaaaaaaaaaaaaaaaaaaaaagcctgggtgtggtggtatgtgcctgtggtctggggtactcaggaggttgaggcaggaggatcacttgtgcccagaagttcgaggctgcagtgatctgcaatcacaccactgcactccagcctgggggacagagagagactttgtctcaaagaaaaaaacaaaaaaggtttgcaagtataaactcatttgaaaacattgtgttggccaaaccacccacatctggtggcttgagatctgcctgtgttcccctgttttgcaacctccaggtttaaaggaggttttgccatcagagaggtgtgggtgtgaattcagctctgattttctgactgtggggccttgtcatgctgctgatgggtagactctggttggcctgttcctgtcctagatggtgctagagacacagtgttggagacagccctaggcccaaccttcatggagctcacagttcagtgggtgagggtggaaggacagacccacttccagacagtgacacctcaggaaggtcagggcttgatggtgaagcaccgggagacaggggtcagagccagcaggggagagccccagagggtcagggccagtactgggggggcaggcagagggatcggggtgggatggagaacacaggcagaggggtcagggctgggatagggcaggcagaggcagaggggtcagttgggatgaggggacacaggcagaggagttacatgggatggggggcaagggcagaggggttggggtgggatggggggcccaggtagaggggtcaaggccaagtttgggaggcacaggcagagcggttgcatgggatgggggagcatgggcagagggctcaggggtggaatggggcaggcctaggcagaagggtcaggggtggaatggggcaggtccaggcagaagggtcaggaaaggaatggggcaggcccaggcagaagggtcaggggtgggatggggacccaggcagagggttggggccaggatgaggaagcacaagcagtggggtcagggccaggatagggggccacaagaagctgtgggagccctaagtcggtacctgactcagcccaggaagtcagggaggacttcttggaggaggagctgtgtgagctgagctctgaaggaagagctgggtgggcatatcgggaagcggacattagtggcagggaaatggcatgcgcagaggcctgaggtgagggtaaggggggatggaacattggaggaacaggatgagagtcagcaggtgagagctcagtggagggtggggactaactggggccctgacctcagagtgtgtgcccctgcagagctgatgttcctggagaccagcgctctcacaggcgagaacgtggaggaggcgttcctcaagtgtgcccgcactatcctcaacaagattgactcaggtgaggccccgaccggcccgagtgggagcgaagggcaggcccgggggtctccaggcaaccaatgctgacctctccccttccccacaggcgagctagacccggagaggatgggctctggcattcagtacggggatgcgtccctccgccagcttcggcagcctcggagtgcccaggccgtggcccctcagccgtgtggctgctgagctctgtggagccaggtgggacactgggggctttagggaggcagggcggcctcttgggcatgggggagatggtgtggagatagacactgaacatgtgatgacaagagaaacagagtgagagaaagatgcaaaaacacacaagctaaaggaggcatctggctgggcgcagtggctcacgcctgtaatcttagcactttgggagtccgaggcgggcggaggcagttcattgggtgggggtggggagacagacccacttccagacagtgacagctcagaaaggtcagggccaggcctggctcggtggcttatgcctgtaatccctgtactttggaaggccgaggcgggcggatgacctgaggtcaggagttcgagaccagcctggccaacatggtgaagccccctctctactaaacatacaaaaattagctgggcgtggtggcaggtgcctgtaatcccagctactcgggaagttgaggcaggagaatcacttgaacctgggaggtggaggttgcagtgagctgagatcacaccattgcactccagcctgggtgacaagagcaagactttgtctcaaaaaaaaaaaagaaagaaaggtcaggaccagatggggaggcactgggggagaggggtcagagccagcaggggagaggcccaggggggtcagggccagggtcagggcacaggcagagggatcagggtgggatagggcaggcagaggcagaggggtcaggtgggatgaggggacacaggcagaggggttgcatttgatggggggtatacataaggtcaggagttctagaccagcctggccaacgtggtgaaacccctcctctactaaaaatacaaaaattagccaggcatggtggtacatgcctatagtcccagctacttgggagactgaggcaggagaatcacttgaacccaggaagctgagggtgcagtgagccaagattcagccactgcattccagcctgggcgacagagcaagactctgtctcaaaaaaaaaaaaaaaaaaaaaaaaaagagacatctgccaggccacagggaatccacctgcagccccaggccagcttcctgccctagaccttgaccctcccattcatagttctccagcgatttattgagcgcctgctgtgtgccaggccctgctcaaggcactggggatatggcagggagtacaacagactcccatcctcatggtgctgacattctctttgggggagacaggtgataaacaagagatgtaagtcgactgggcgcagtggctcacacctgtaatcccagcactttggcagggtgagatgggaagatcactttgagaccaggctgggcaacaaagcaaccttatctccacaaaaagttttttaaaattagcgaggcgtggtggtgtgcacctggagtcccagctacttgggaggctgaggtgggaggatggcttgagtccaggtgttcgaggctgcagtgagctgtgaccatgcgccactgcattccagcctgggtgacagagcgagactcttaaaaaaaaaaaaaaaaaaaaaagtaaagtatgtagtagtgagggaggtaagaactatggggaaaaataaaacaggcacagatgagtggatagggtggaggagtgtacttttttttttttctttgagatggggtattgctctgttacccaggatggagtgctgtggcgtgatctcggctcactgaaacctccgcctcctgggttcaagtgattctcctgcctcagcctcccgagtagctgagattacaggcgactaccaccatgcctggctaattttttttaatttttatagagacagggtttctttttttttttttttttttttttgagatggagtcttgctctgttgcccaggctagagtgcagtggcacgatcttggttcactgcaacttctgcctcctgagttcaagttgcctcagcctcctgagtagctggaactacaggcgcccgccaccacgcctggctaatttttatgtatttagtagagatggggttttaccatattggccaggctggtctcgatctcttgaccttgtgatctgcccgcctcggcctctcaaagtgccgggattacagtgtgagccaccgcacctggccgacacagggtttcatcatgttggccaggctggtatcaaactcctgacctcaagtgatccacccactcttggcctactaaaatgttgagattacaggcgtgagccactgcgcccggccaagaatgtacttttttttttttctgagatggagtttcactcttgttgcccaggctggagtgcaatggcgcgatctcagctcaccgcaacctctgcctcctaggttcaagcaattctcctgcctcagtctcctgagtagctgggattacaggcatgtgccaccacacccagctaattttgtatttttagtagagacggggtttctccgtgttggtcaggctggtctggaactcccgacctcaggtgatctgcccgcctcagcctcccaaagtgctgggattacaggcgggagccaccacgcccagcctttttttttttttttttttttgagacagagtctcactctgtcgccatgctagagtgcagtggcacgatctcggctcactgcaacctctgcctcctgggttcaagcaattctcctgcctcagtctcccgagtagctgggactataggtgcgtgccaccatgcccagctaatttttgtatttttagtagagacatttcaccatgttggccaggttggtctcgatctcttgacctcgtgatccgcccacctcagcctcccaaagtgctgggattacaggcgtcagccaccgcacctggccaagagtgtacatttaaacaagatgaggagggaagcctcgctgagaagatgacatttgagtgaaggaagggagatagggaggcctgtggggatctggggcaagagcactgctggagagcacagcaacgcttctagcgaggggtatgcctggtgtcggtgagggtgaccaaagcagccagtgtggtcatcatggaggacctgtgtgtgttttgtgggtacagcatgagatggggtcaggggttggaggaagcagatcagttagggcctgtgggccctggggaggcctctggcttataccctgtgtgggagccatgggaggcttctgaacagaggaaggacaggatcagattcaggggtgcagagagttcctctggctgcataaagggaaggggctgtgagggacagaggaggtcaccaggacaccagagaggaagctgctgcaaagtccagggaagatggtggaggacaggacaagggggcgggaagaggagtggctgagaagggaatagggttcatgtcctccctagactctctgtcttccagtcttggcctctctcttttttttttttttggttcctgtctttttattttgagacagagtctcgctctgtcacccaggctggagtgcagtggcgcgatcttggcttactgcaagctccgcctcctgggttcatgccattctcctgcctcagcctcctgagtagctgggactacaggcacccgtcaccatgcccggctaattttttgtattttttttagtagagatggggtttcacggtgttagccaggatggtctcgatctcctgacctcgtgatcctcctgcctcggcctcccaaagtgctgggattacaggcatgagcctttcctttttttttttttttttttttaattttagagagaatctcactctgctcactctgtcacccaggctagagtgcagtggcgccatcttggctcactgcgacctccgcctcccgggttcaagtgagtctcctgcctcagcctcccaagtagctgggattacaggcatgtactgccacaaccagctaatttttgtattttttttttttttttggagatggagtctcgctttgttgcccaggctggagtgcagtggtgcagtctcggctcactgcaacctccgcctcctgggttcaggtgattcttctgcctcagcctcccgagtagctgggactacaggtgcgtgccaccacgtctggctaattttctgtatttttagtagagatggggtttcaccatgttagccaggatggtctcgatctcctgacctcgtgatccacctgcctcggcctcccaaagtgctgggatgacaggcgtgagacattgcgcccggccaatttttgtatttttaatacagacagggttttgccatgctcgtgaggctggtcttgaactcctgacttcaggtgattcacccgccttggcctcccaaagtgctgggattacaggcctgagccactgtgccctgccaatcctgtctccttttgatgcagccactgggtctttctaacacacatatctgctcctgtcgctccctttttcaaaaccatccatgcatctcagggccccaggacacaaatgaactcctcagcctggtgtttgaccctctgcagggactggcccctgccagcccagccttaccggcctcagccacttgtcggtctccctacctctcaggccactccagccacactgaagttcttcccattcctctgggcccttgctcatgctgggcctctgcttggaacattcctaccctcttttccctggcaacctccttcctccaggcagcactacttgttcctccaggcttggtccaaacttttgtttttttttgagatagagtctctgtcactcaggctggagtgcagtggcgtgatttcggctcaccgcaacctccgcttccaggttcaagcaattctggtgccccagcctcctgagtagctgggactatgggcatgggccaccaacgcctggcaaagtttttatatttttagtagagacagggtttcaccacgttggccagctgctcacaaactcctggcctcaagtgatccacccacctcagcatccaaagtgctggaattataggcatgagccactgcacccggccccaaacttcttgacaggctttcaaaaccctgcaggatttggtcccatccctccttctctgggggatgtgtatgtcttgccagttctcccttctatacttcatgctaaatcccctcccagcccttggcagctccagggtgggacaggtggggaacaagtggttagaccttggatctacttggaaggcagagccaacgtgatttcctgatggaatggatgtgtaatctgaaagagagagaggaatcaaggatgatgtcttcagacagtgctctcttgtctttccaggactttgcacctgctgtgcctgagcctaagtttgctcatctgtaaaatgaggctaataatagcacctgcttctatagatgttgagaagaagaaatacattaattcacgaaagtgctcagaatggggcctgatggtcaagacttgatcgatgagggctgtttttaaagttttcttcttatccatctttgggctgagctcaaatgaatgggtgtgtcttcttcacctcagggcttagcagagactctgtcctagagagtttgccctcagtaggtgaaatgtaacaaggcaaggcaaggctttttcacactttgctgactgcaatctacaggaggaaatatattttatgtgttaatcaaggactgactgtagcagatcccacccacatataaaactcaaacacacattttcctaccaccagtattctttcgtttcttggcactaaaatgaaagtcacataacatacatttacgtgacttttcaaagtgtacaattcagtggcattcagtacattcacagggttgtgcaatcaccacttctgtgttgttccagaatgttttctttttttttcttttcttttttttggagacagagtctcgctctgttacccaggctggagtgcagtggtgcgatcttggctcattgcaagctccacttccagggttcaagcaattctcctgcctcaacctctggagtagctggaattacaggcatgcaccaccacacccggctaattttcgtatttttagtggaaacggcatttgaccgtggccaggctggcttgaactcctgacctcaggtgatccacccgcctcggtctcccaaagtgctgggattacaggtgtgagccactgcgcccggcctcagaacgttttcattactctcagaggtgccatgcttatactgctttgtaccttatacctttgtacccatatttattaagcagtcactctccatttcccccaacccctagcaaccaccaatttgttttctgtctcttttggccaatatgatattcttttccttttccttttttttttgagaagggtctcactttgtcacccaggctggagtgcagtggcaccatctcagctcactgcagccttgacctcctgggctcaagtgtttctcccacctcagccccccaagtaactgggactactggtgtgcaccaccacgcccagctaatttttatatttgtattttttgaagagatggggtttcaccatgttgctcaggctggtctcgaactcctgagctcaagtgatccacccacctcagcctcccaaagtgctggaattacaggtgggagccaccatgcctggcctcttttccttttttcttttcttttcttttttgtttttttttttttttttttttttagatatggtctcactgtgttagcggggttggtcttaagctcctggccttgccgggcgcagtggctcacgcctgtaatcccaccactttgggaggctgaggcgggcagatcacgaggtcaggagttcgagaccagggtgaccaacatggtaaaaccccacctctactaaaaatacaaaagttagccaggcgtggtggtgtgctcctgtaatcccagctactcagggggctgaggcagaggaatagcttgatccctggaatcagaggttttagtgagccgagatcgcaccactgcactccagcctgggcgacagagctagactccgtctcacaaaaacaaaaacaaacaaaccaaaaaaaccaaaacaaaacaaaaaaactcctggcctcaagcaatcctccacctcagcctcccaaagtgctaagattacaggcatgagccaccgagcccagccaaccaatataatatatctttttaaattattattattattttttgagatggagtttcgcttatgttgcccaagctggagtgcaatggtgtggtctcggctcactgaaatctccgcctctcaagttcaagcgattctcttgcctcagcctccctagtagctgggattacaggcgcccgccaccacgcccagctaatttctttgtatttttagtagagacagggtttcaacatgttggccaggctggtctcaaactcctgacctcaggtgatccgtctgtcagcctcccaaagtgttgggattataggcatgagccactgcgcccggcctatttacaaaatttttttttttaaataatgttttaattttgtagagatggtgtctatgttgcccaggctggtcttgaactcctgggcccaagtgatcctctcttgcccttgcctcccaaagtgctaggattataggtgtgagccactgtgcctgcccaaccaatagaatattcttattatatatgatgcactctggtatttgccgttctgtgctattctgtttgaatttaaaaattggtcaagacccaccaaactgatttccccaccaaggcagtgacacacattagaatgacctggagaattttaaaagatactgatgcccaggcctcaccctagagattctgaagtggtttcaggactttttcttaattaaaagataaatagagatgaggtctcactatgttgcccaggctggtctcaaactcctggcctcaaacgatttctcccaccttggcctcccaaagtgctgggattaaagacgtgtgccaggctgggcatggtggctcacgcctgtgatcccagcactttggggggctgaggcaggcggatcacaaggtcaggagatgaagaccatcctggcttgatctgtagatcaagtgaaaccccgtctctactaaaaatacaaaaaaaaaaaaaaaaaaaaaattagccaggcgtggtggcaagtgcctgtagttccagctactcaggaggctgaggcaggagaatggcgtgaacgcaggaggcggagcttgcagtgagcctagatcgcgccactgcacttcagcccaggcaatagagcgaggctccatctccaaaaaaaaaaaaaaaaaaaaaagatgtgagccagccagttgcaggatttctggaagctcccaggtaatgctatatacaaccaaagtgagaaccactaacctaacgttgtctccccagcttggggaacagtgaaatgagacttagagccagggtgatccaggaacatagagggacacagaaagatacaaaggcaggttcattttatttatttatttatttatttatttatttatttatttaaattttttgagatggagtgtccctctgttgcccgggctggagtgcagtggtgtgatcttggctcactgcaacctccgcctcctgggttcaagtgattctcctgcctcagcctcccaagtagctgggactacaggcacctaccaccacgcctggctaatttttgtatttttagtagagacggggtttcaccattggccagggcggtctgaactcctgaccttgtgatctgcctgtctcggcctcccaaagtgctgggattacaggcgtgagccaccgtgcctggccgatttatttatttatttatttatttattttgagatggagtttcgctcttgttgcccaggttggagtgcaatagtgcaatgtcagctcaccgtaacttctgcctcctgggtttacaagattctcctgcctcagcctactgagtagctgggattacaggcatgtgccaccacacctggctaattttgtatttttagtggagatgaggtttctccatgttggtcaggctggtctggaactcccgacttcaggtgatctgcccgcctcggcctcccaaagtgctgggattacaggcatgagccaccgcgcccggcctatttatttttttgagacagtctcactctgttgcctaggctggagtgcagtggcacaatcttggctcactgcaatctccacctctcaggctcaagcgatgttcccacctcagccccccaggtagctgggactactggtgcatgccactacacctggctaatgtttgtatgtttttgtagagacggggtttcgtggtgttgcctaagctggtctcaaactcctgggctcaagcattcctcctgccttggcttcccacagtgctgggattacaggcgtgagccactgcgtccatccagattcatgatatttagatgttgaaatgtggctttacagactcagacagctctctgaggcaaacaaagagggagatgcaggtaccctcagcacaagccccaaattacctgcaggggagaggcggaaaatcagacaatgtagaaaccgggagaagaaaggtatggacagaccgatgcagataggaggggaaggaaatacctggaaatgagatagagaccggctggacagaccccggggaccctgcaggtcaccacacccttctctttcagctcacctgttctccaggaccagccctgctggggcccaggcccaggctctgagaggccgtgtcctaacctgccctggccccggagaagctacgttgccacctgtcccccttccctggcctggtggggcctggctttggggcaagactgagccacgggggaagggggaatcccgtacctgctgctgcttcctctgtcttggctaacgtctgtccccctgaacccctaaccataccccaagagctcccaaagcctgagaccagggtcatttgtccccaactccccatctggccctgctgttgctagtacctgttatttattacctggaggcctgtccagcacccaccctacccccataaagcattgtttacacctg

SEQ ID NO: 54 - DNA, 52744 bp, Homo sapiens
aaaaggaaaacgaggcaccgagaagttaaggaacttgctcaaggtcacagagtttgaactcaggctacagatgctgcagcaactggagaaagtcctcatcgccccatatcacccaccaccgacccccagcaggacgtgacccccgccaggacggaggccggcagctggggggctggagcatgggacccagaacacggactcaggcttgcgcagcctcctggcttctaggcgggagcctagaaaggcgccagcccctttcgcgtgctgctgagactccaggggtggggttcactctcaggggcgcacaaaggcatgaaaaccttggcttcagcctctgagatgcggaactgaccgacctattgtcttgggacccaccagtgcgcttgggtgcaccagcccccttaacgttggtgccggctccctcccggctcctccccatcccagagggtcccctcgccccaggccctgagcctgcgtcctggggtcctgggccgcacgtgcctctggcagctcgaagaagctgtcggggcttgcaggagagcgtgcaaactgaaaccaaaacaggccgactcgaggaacatccgggtgggaccgcagactcaccggagcgcagcgcctgggccagggcctgggaccctgctccgccccgcgctcccctgcaccccttccccacgctgctcccctcttcctaagcggccccccctctcccgggcagcagaagaaggggtgggacccgggcgggctccgggagggggccctggaggaatggatggtggcggaagggcggagcaggggcggggcccgcggagactccacggggcgccccgggcgtgaggcacccactctgggagcacagagagctcaggtagcctgcctagatggcggcgcgcaccctgggccgcggcgtcgggaggctgctgggcagcctgcgagggctctcggggcagcccgcgcggccgccgtgcggggtgagcgcgccgcgcagggcggcctcgggaccctcgggcagcgctcccgcagttgcagcagcagcagcacagccaggctcgtatcccgcgctgagtgcacaggcagcccgggagccggccgccttctgggggcctctggcgcgggacactctcgtgtgggacaccccctaccacaccgtctgggactgcgacttcagcactggcaagatcggctggttcctgggaggccagttaaatgtctctggtgagtgggcttcgggagacccaggacgcccccaactcttgggtcccgaggggactcggagcctctcgccagcggcagccgtccccgggcagcgcggatcgcagccctgcaggggcccctcctccggtattccgtccgccccgcccgctctaagcagtggctccacgtcaccccgtccctcatcccatcgggccccagatccacgtgcccagctcgggccggcgcccgcggggacccggcggccgcttgggacgccccgctgctggccttgctcggcgcggctcctcgctcggcggactccagagttgcgttaccgggtgcatagcgccgctgagcaagagccggcggggagccgcgggctacacccgagcgccccggagtcgggactttcccgttcccataccggggtggagggaaaaacaaagcggtggcggttgtcactgcgggctgcggtgcccggggatcagcctggggacaagccctgcccacgtaaacaaacagagctgtggcgggcgacctggggaggaggaaactcggcgtggcagctggaaccagttatttcttcgctgcgggcctggggcctggggcctgtggacgggaaggaagtaacggcggcctccccgttctcgttctcggcctcagagaactgcaccccagcgacctggggcctgctttggacccgcggggtctgacgtcggccccaaacagttgactggtggtcagttgtttggaacttgctgagcagaggccctgctgctctgctaagatttggggctgggggtcgtacacagcaccctcgcccccacctaaggcgctgactgggcaccgagggggaggccctgaactgcaggcagggctggccacgcagggtgggtgccaagtgcgaggtgggctccggatgcagggtgggcctgggtgtggggcctgcggggaggggctggcagacacggtgttgatcagagggatgcagaccagaagggtggtcataaccagcttgctggatttgggagtgtttaagaaaggacctgcgggtctttatggcagggtcaccagggccccattttctccaactcctccctcagttgtccttgttgttctgcccccccagccctcagtctcctcattgtgaggatgggggcagtcatgctcagaggttaggctgagtgctgcaaggtgtgcagcagacccagcgcttactggtgacccataagcagtagcgattttagataacttcagaaatagtcatacaattatagatagtgtcttgcagttatttttcaaagaaattggaaggaactttggacctcccccactccccgaaattgtatattactttgctggtttaattaaaatgagtcacttactagataagtgttttctttaacattgagtcagcagcaagtgcccttgaactagtgggaaaaaaaccaaaccctttggtttgcagagttggggcaatgtgcccttgaaggagactagagcagcttgcccaaggacagaggtggaaagtgacctgctctggacttgtgaggccaaggtcatggggaacattcacagttggcctgtgcacacttgcagccccactcagataagacagtggggcggacctcctggggccaacagcaaggaccttctgaacctcgctcggtcaggatcagggtgtggtcagcaagcattcttctgtctccttttccttcacttatttcttctgataatatggcctttatggctacgttagccagaaattgagcttcagaaaactaacttgaaaaacagcttttcagcagctttctcccctgggatgtgcgtgccctcctgttcatgggtcagcaatatctctttcctttgccggtgtctgcaaaccatagagaagacagtatgaaaaagggccaggccaggccatgactcttctgggagcatctagaaagtcgtgggatggatgagaacactttggtctgatctgtcagctgtgtgtgataaagtcagatggcttgttccaaaggaatatcactcttgaagaaagcttcacctcaccccctcaagaataccagtggttctcaacgcatggtcttcagacctgcagcatcagcattacctgagaacttttgagaaatacaaattctggagcccatcctggacatctggaatcagaaaccctgggatgggacctgacacctgtgtttataacgagcccttcagatgctccagaggacactcgggcttgagaaccactggcctgtacgcctcaaaccagggcagatgaaggcacttctaaaacagaattgggattagtgtcctggccttggccctattaaacaaacagcaagcaaatgatgggctgtggatggcgcaacacagtttcgtggctccaggtgtctttagaatcatgactcgggttgatttcttgctttccctgtactgtactttgcatgtttcctcatctgtaaaacaagggccgtatgtaactgaattctgtcctagttactattgatgtacatcaaaccacccctaagtttagtgacacaagataacaacaattttatattcctcgcagagtctgtgagtcaggactttggacagggcccgatggggatgactcatgtcaaagggcaaaattaggacaaatttagtttaaagaccttacttcactttattcgtgattatagaattgggaaacaccccattccataaaacagaaggaatgtttgatgagctgaacagaggaggatggttttatagacagaaggggctgaaggatgcagacatggagaacaaaaagtggactggttatttcaaagctacttttgttgtaaaggtgaaagtggaaggagctcccttatcatgccagcttgtttggagatttagctatctttcactctccttgtttcttagaaggtcggataaacaacttagtttccatttggtgacaccgcactttagcaagagtgactccatttttgtgtgatctattgggcctcatgcagctcagtccagaccagtggcctcctatacattttatttaacacttgctcctgctcctcagtgtctgaggttggagtcatctgcctgtttctcactcccaagtctggagccttgtttgggacaacttgcaggctggcttcagccagaactgtggcccaaagcacctcctggggcttgtcacagcatggtggctgggcccaggcaatttcctgcaaccagaggtccaagagaccagcacagatgttatcaggcatcttccgacctggggaaggggacctgagtgtttgcacctgttttgttatccatgggagtatctatcagcacacccatcccagggctgttagaatgaaatgaggaaatgcttgtaaggcactcagcactttcttaacacattatacatccccagtcactgactatttgttatttattaatgaagcatgtggggaggctgtgaccttgtgcttggccttcggcagtgctgctgagagagctgagcttcatctgaactggaccacatgggcttgcatctgatcagcctgggataggtggggaataggcttcggagagcatgcaggtggctgaggttgctttcaaagctccacagtatcctgcccatcccacaactccaatagccagttgaggttatggtgtctgagactcactgggcagggtagacagagtgtctgtgcccttctgtgacttgcttctattgtgtaaaactgccttgcagaaggttctttggagagccaggttctaaaagggattctttcccacctgtgaaatttggctctgtcctttgtagggctctgcagctctttttgccctgtggcatatcaactcaagatgtcaggaagttgtaaatgcagaaccagagggtaatgacatgtgttgctttcaaaacacacagctaagctctatttttaaaacccccaattttaagtgatgtttttcagtgtgtgtactcttaagcaagagtgtaaaaatcctctttgtaaccaagcattgagcactgggaaatttcttggatgctttttggagattaattgcaggaacagaggcccttttgctgtagttcctctgtgtttgctgtagtttcctctctgtggcatgcctctaatcgttcagaaggcaggacactgacagcggcaagacgctgtgcgcctgtgcttcattttcctcctagtgattccagtgattaaagtaacttttctaaggtttttcagggaactctacatgaaaaaggaacccctaatcttaggaggaggatcctcccgaggaatccaagtcctccccagctgtcaggggcacgacttactttaaataacagatgctttgggaaaattgtccaaaacaatttttgtgactgacgtaatatctcaaagcctgccagggaagattgctattaaaagaaagtccattgtgggccaggcgccgtggctcatgcctggaatcccagtactttgggaggctgaggtgggcagatcgcttgagcccaggagtttgagaccagcctggcaacgtagtgagaaccccatctcaaaaaaaaaaaaaaaaaattagccgagcgtggtggtgcatacctgtagtcccagttacttggaaggctgaggtgggaggatcccttgagcccaggaggtggaggttgcagtgagctgagatcacgccagcgcactctagcctgggcaatggagtgagaccctgtctcaaaaaaaaaaaaaaaaaaaaagctcattgtgaatagtaactccgtattcaaattgaatttctgtatgctgggttccactttcagttagggtgtgtgagtgtgagggatgtatttaaataagcaacaagagtacttgaaaattcgtacgtgtgtgtcaggattgtaatggaaatcccaatactcttataatgcctttttaaaacaaaataccaaacccctgccccagccacgggcattggccgactgcgtccagctgtgttaggccctgggtggggccctgggcatctgtgagcgagatggagcgccctggctggccggccctcagctccgcatggcttgtcgcatcctcatggcaccaacatgaagtggttggtggtcccattgcacagatttggaaataaaggctccaattcatgtacagcaatgaataatccagaaaatgctcaataccacagagcccacattctaatgaggagatgaaccataagtcagtaaatgagtaagtccacactgaggtgggaggggaattgtgatgtaattcccaacgccagtctacatgataaaggaatcttagggacacagtccctgcccttggggaatggcattgtgccctgtaatggggaccaccagggagcatggggcagtgtgaaatggtgtgggcctctgagaggcgaaggacaggtcatccatcatgtgctgggaaacttgggaaaggccggaaataggaggtggagtttcagctacactttaaattgccatgggtccttgcccaactcttcttggaaatgctgagaaatggaattttcttgtctcactgcccatttctttgggcagatttttttttaaactttcttttcctcctccctctcttccccacttccttcctcctttccatccttcctcaccttcttacctccttcctccccctcctttctaccttttcatcctgaaattgaagcactagcaggaaccataactatgtgcgaagagccatgtgcacatgggtgttagggccactgtcccccaaaccccacatggagctttcttcaggtgcctgtgtggtctgagcaccagccatggtggccagaacaaagatgggggagggttgttctgtttgccttcttgggggacaccttgactccatctgacccacagccagaaacaacccaatggcacctagtccttccagtcccacccagaccaaggatcattatacccactccaaggattaggaaatgggcttggattaaatgatatgtgcattgtctgtggttagtgagtggctggacaggggctggactttagaccctgagtttttagtggtgactccaggctgccaaccagtggctcatgaggctggcaagtatgtgtaatcacccctgtcccaaaggaaaaagaaaaccattggaaatcttgcatctgcatagaaaggggatgtgcatgtaggtccatgtgcacacatcgtcagagtcgggtcccaggaccagcagcggctgcatcactaggatcttgttagaaatgcagatgcccagaacggggacggggcacactggctgcagctaacacgtcctctggggacttctgatgccactcaaggttgagaagcactgatttgggccaaaaaagagaatgtcttctacttaagggatgaagccacaaagacaagaagaggtctgctccctcccttgggcatgaggggaccacctggtgccagttacacctcaatatgaccctttggctcgaggacgcaagtggtctgttcctcagctctgtgctctggaccaggctacctgaacccagacctgagcaggacactcagccctcgccctagggagcgcagcaggcagtgagcatctggaagagttgggggatgcgcagggtctgggacagtgaggtgctcgggagagtgagcgccttgggctgagagctgcagtgtgggtgtgaggagggcacagtgccccaggcagggagaagccacagcaaaggcctgagggcaggggagctcaccagatgtggcccggtcagcagggagaggcaggtcattggggccttggtggccactttttgagcacctctgcatgtggcgaggcacctgggggacactgtgtttggggctctgttctgatctgctggacccaggccacctgtcagccctggaaagacagggacacagggcttatctcacgggccacccagccgcacctgggtgctgtccatcctggggctggcctgcccctctccaccttcctcacctctgccttcctgcttggtataaaatggtgcaggatgtcctgctgggctgggaggctgtgagggcctgtttgaagttgggcagtcactgtttctgagaagagtgtcctggtgccctggctgctgtgggagcaggtgaggcgatgagatgaatgccaaggcgaagtgtccagcgtggttcgagcccttcctgcttcatcttggctggggccttgggcaggtcaccaggccatgcagagggcgtttgctcatctacacctgggcaggccactcttccggggggctccagggtcaaatttggagtggagcaagtatgtcaggcagagcttttcagatatgagagtgggttcacatctcctggggcttcttatgaggctggttgggactcagcaggtctgggtggggctgaagatttgcatttgtgaccagctcccgggggggatggtgggtgcagacagtgtcgatcctcagctagacattcccaggcttgtcatagcatcatagagtcactggaggtgacaggcaggcagcggggtgtaggactctctgtgtagggatggtctcctgctgattgttcagaagccagaagtccatggctttcatgtgaaagctctcgatttttaaatattggactggactcacacacgcatgcctgcacaccctggtcagggtggttagcacaactgtatgctggactcagcctagggaccacgttggctaatatctgctgtacccgtgtattaattttctccctggcagttgtgttgtttttccatctccttcagggtttacatgttcctgtcgcctgcctgaattggcctcactattcttctcaactgttctgtcttccgtctgtaagaccaagcctgattcatccctcctccccaattcccccactaccggcaaagctcgcttccctcccacttgttgcatagagcagttcttcaccgcctggtgaagaactggactgttaccgggggactttggagggtggggcggtgggacagactgtggagccaatctgcctgcgttgaatccagctctgcctctgtgtgaccttggccaggcagcttaacttctcggggcctctgttctcccatccataatgggagatgctggtggtgcgggcgctgtctccgtggaggctcttgcagtaattattgtttcagccccaggctgctcttgacttcccagggtttgccttcccagggtaaattcagctccagtgccctgtttggacaagtgtcatgagcctgccgccaccggccttgtgtgtttggtcacttttgcatgtttcttacgtttgcatctgtctcctgcacccatggcaggggcttcgaatctgccctggcatttccctcagtgttcagtgtggggccttgatcaggattggcacccaggactggttgggttaaaccatctcagggttgtatgctccttctttttgctcctaagagactccccaacacccagcaaaacattgtggggttaatgctacacttggcatgaccacagtgaacagaggttagcacccccagctccccaacacacacagagatgttgtgtaaattcaggtctgccactgatccccttcttagtttgtcttcttgtttttattttcttctattttttgggcatgtcttctcttttatttttctgttaatagtagttcaaagaactttcctgtgtctcttactagtattagtaattttttcctggaatctgtctacatttgttacattttttgaggtgtaatttacaaacaggctacaggggtgaccctgagagaccaggtgggtgggtgctgctgcccccaaaaccattcatggggctcatgtccctgcatacctggggaccctccgataagccagtgagtgaggagagctggcttgagggttgccagaaggggctcagctttggaatctaatgagtagtgaccagcctgccagcggaggggccccgtgctgctaatcctcagtctcacggtgtgccacagagctgtttctgccggagggtcatgtgtgggagcttgggtaatggagagggagggagcagagccttctgcaaaaccaggacatttccccatcacgagccacttcttggaacaaggctggtttactgggtgctcgtggaacacgtgggggagttgggtcctcgtcccttcttgcacctttaaccttgggggcaggtcagcactgggcacatgggaactgcaggagccaagccctgaaacaggaacaacctgtttgcactgagtgttctttccaacagcttaggctgcagtgcccagccctggctgcacatcagaaccaaccatgggggctttgaggctttgaaggcccaggacccattggatggggtctctaggggtggcccaggagatgccaatatgcagccagggttgggtccactggtgtgaagcaaccacttcaaaatatttgcaggacatcaccttgtacctctgagatcatgtttgttcacccttctccttgcaagggggtagaaacatcatcactgatgaggacagggtctctgtcagtggaagaagagagagccacagcaaactagacccgctccaacccctcaacctggccgaattctcactcaaaaagcaccaagtgtaacatccgcaaaccctctttttgtacagtcaactgcttggaccagcatgttcggaagtcccccgagagcgttgctttgatctgggagcgcgatgagcctggaacggaagtgaggatcacctacaggtactgtgccctcgaatgttcaaggtgcgagggaggcgcccagcccagtcctgtgtgctgagtctggctgtcagggaggggccgtctgagtctcagggagtgcattttggctttgcaagtgctctcttatccaggaaaagtaaatgtgaacgcaagcagaatgaaacacagtaaaagccggtctagcctgcctggccacactctcagcgccttgtgaggatgggacaataaataaaatcatctttagtagagttgttttgtttttaagctgatctttttagtctctgattccttaagcagattctatgtgccaagcatgcttcagatgctgtgtgctttgggcggtctgcactggccttccccaagctgcttcctgtaggggctgctgtgttggtgcagcaccttggttctccatgcaaaccccgtttgcctgaagctcaccttacccttacagagatgcctcaggcccactgtgcccctaaactgtgagttcctaagtccccatcacacacaatcatcgagcgtgattactctcctgggggcagctccagggtcttcttgtccaattacttagcaagtcttcactgggtgccttcgtgtcagtatgggctgcagtatgttgcagtaacagacaatccccaagcacatggcagagtgtggctgggtggccactgtgagctaatagtcaggaaggcctcttggaggaggcaacattccagctgaggtcctgtgggccaagaggagcagccctgagaagacaggggcagacctggtgcagggatcccagaggtagagggaaggtgcatgtggctgggacacaggagcgaggggacgtggaggaggagcattccgacaggcaggtccacactgggcagcctgagagcagcggtcactgccctgccactcgggtgacctgggggcgaaggggcacttgtagtttcctgtttgtttcttgaactccaattttatcacagaccaaattcaccaaacctgctaaaaccgtgctcatgctgacttttggaggcagacgagtgatgctagtggatctgctgcggctcccagtgggccctgtcctgctcgttcctcccctcggcccccaggagccctcaggcccatcacagctccaccagcctcggccagggctcctttgctgacccgtctcccccaccagccagactcacagcctatacagcacgcatttcttatctctagtccctggttgcagatgccgtgtggcccataggccagcagcattcttctgccctggatcctcgggccccactggacaactgagcggccccccaggtggcccctgcacactggagtgtgcttggctctgaagacccaagctgctgcagctgcccctcgccacggtgggcccagctccatctgcctgcgaacaaagccccttctgagaaggaacttgaggctgctgcccctggagtagttcttcagtaaaagatgaaaaccctctgttgggggtcgggggctaaggagctaactggacacctggaggtccggcagggagggcccagccatggcactccccgaagggccagtttctctccatcagtctctcaggtgtgcctggaccctggggcaggcaggttgtgtgccacgccccctcggctggacgctgcccgtgggagcactgagtgtgtgctaagtagcggttcggtctgtgagcggggctggagccctgtggagacgtgtggttaaacataaaccatgtgagaattctcaggaccacagccagcctgtggaagctaaggacagcttcaggtccatgacactgaaatggccctggcaaagtacttattactctgtctctaaaaataaacaggggccggtcgcagtggctcatgccggtaatcccagcactttgggatggtgaggatcacttgaggacggtgggtggatcgcttgaggtcaggagtttgagaccaacctggccaacatggtgaaaccccgtctctactaaaaatacaaaaattagttgggtgtggtgatgtgcgcctgtagtcccagctacttgggaggctgaagcaggagaactgcttgaaactgggaggtggatgttgcagtgagccaagattgtgccactgcactccatcctgggtgacagagtcagactccatctcaaaaataaaaataaaaataaaaataaattgacttcttctaaaatggtttgcagactttagccaggcttagtaccaggtgaccatttctatttactgtttgagtgaaaagtgttacctgtaattgcagctagtatttgagggatgtgagttcctcattgtcctggtcaggctaggtttctgatgtgaggttttcttcttcctttctctgaggaaagcccctagacattggcactggttgtcctcctgacagacacatcactgccactgaacacagtgcttttctgcccatgggcctcgtgccacagcactcgaggtgcctaggatggttgcaggcctcctcagctggaagatcaatgtccagactagcagcctgggccctttaaagaaaccccgtggggctggtagaggttgggacgctggtgccgatgcaggaagcttgcagggtgtgaggaagtctgtgtgttacaatcccaggtgacctggcaagggaaacctcccgactctggtccccaccgtgaccttaggcacaggtgacgctgggtcagcacaggcagatgcagccctgggacgggtgcccatggcctttaccctgcaagtggaggatttgcaatccctgcttccccaggtcctctggggtgcagggtcagcagaaagaggcccgttctagttctagttcagtaccatcctgctgctggcctgtgaccttgtgcagctccctaatctccccgggtgtgactttcccatctgtacacccagggtaattatcacaatggagatgactgtaaagtaggcacagggagatgacagcccgaacgcactagcaagtaagaatagccgtgataatgatgtagctgctatttattgagtactcactggattctagagctgttttcagcattgtaactgggcagcgaggttggacctcgtgctggctggctgcagggcttggagaggaggaccccctcccctgccgcggttttgccccgcttcctccttcacaaatgcagtcctcaattcccactgggaggtgaagggctcagcctgggacgtgtgcacccatctcccagggcagtctgccacccgactccagggtcccagctccatttccagccttcctctgcccggagccagctgaggcagcccttctcccctggtgagccagcaggctgaaagcccagagcaggacagtgcctgccagaggctgtaggcctagtggccccaaggctgtggggccaggcagcactctgggacggcagtggctctttctggctgtttacctgcacttctccagcaggtgcccattttattttatttttaattattgatttttgaggcaggggctcaaaaatgtcacccaggctggagtgtagtggtactgtcacaactcactgtagccttgacctcccgggctcaagtgattctcctgcctcagcctcccaatagcttggtgtgtgccaccaagcctaagctttttattttttgtagagatggagtctcgctatgctgcccaggttggtctggaactcctgggttggagtgactgcccaccttggcctcccaagtactgggattgcaggtgtgagccaccgcgcctggccggtgcctgttttagaagactgtccttcacactgtagttcacatgggcaggttctagagaccctggggggtggccatgtggagaaatgcaagttcctctctttcggaaaagcggtggcccaggtagatgaatgaggctttgagatggctgctgcctagctggtgtgtttctccctgcctggagcctggagcctggggtctgggccaggaattcccaggctagggttggactccaggtgcaggaagcagcctgaggccctgtgcaggtccagatcttctcagccagcagggtatgcccccacacagaggagagagtggactgtgggtgccaggctgggggtgcctgcagagcctccaaatcagtgaacctcttctctgagggtctctgtaggggggtgtgaacttaaacttgaacttaaatgagagcatcttaagccagaggaccaagttttagctccggcttgtcctatggccttggacccatccctctgggctttggtgtcctcatctgtaaaaggagggattcaatggccccagtattccagccctggcaggcgtgcatgaagcacggaggagcagagctgggccccgagtctgtgaggaagcacaggcatcgtgtgccactctgggagctgttcccccgtggaaactcctgctggtgggggtgatttctgtggctgttccttcctggcctttttattgggtggggtcgtgcacagtgagaaacccctgaccagagaagcagaggggatgtcaggcctcccccaaccccacctacctcagagtcccaggaagctgagggaggttttctccctgggtgtgctgtgctgggctgggcatggggctttactgcgaatctgtgaggcctggcacctgatgcggaggcctgcagggctgtgcatgacagggcctggccgttcaccctaggcagagggagctgccacacactccagctgtggtggggtggggactgagcctggggccacctctctgagaggcttgtttctgttgtcagccctggatgtcttcgaacacagccatttagggaggtcacagaagtggctggtcccttggggggagcaggaagcaggaagtcctgtcacagacacttaggtggagaaggctttgtggagggttgagttttgagaggcagaggaaggggaagtgtggcgaaggcaggagtgggggactggtgaggacatggcacggggaggagccagggtctgggaagtggtggaggcgggaggctgtgccctgcctgccctgtccctggcagggggaggggccagggcccaggacctggtggaggcaggaggctgtgctctgcccagcctgaccctggctgtggacctagagcctgtcactccacctctcccacccttggttttctcatttgcaaaatgcagtcacacttctcctccactgggctgctgggcgtggagaggggcatgtgggatgaaaaccagaggggtgtctggaggatgagggtccgtttcagctgcaggtcagggccaggtgaaggaaggccagcaaagggtttcagatttgaagaagggcaggacatgggtggccccatggctgctggggccgagagtgggtgggtggtgatttcaggggtgacggtactcagcgggactttgcctgggaggacacgtacatcagctaaagtgtgccccctccccatgtccctagtgggtgacccttgccccttgctcttctgctcacctcccaagttaattaccctagtgagcacactcccttattaaaacatcagggcagctgggggaggatcctaactcacgggaggctgtgggggaacagcctcgttgacccgtgtgtgacacagcggctgtcgtggaaggcaaactcggtgtggtctgtggggctcccatggtggggtgaggcgtggagtcccggcctagctgccccacctgagaggagggtgcccgggcagcctctgagacttgggctgggacccttggtctggaatctgcacgctacagccagaatctgataggatcccatgttactcggggtgggctgtttttgaagcagcatccacctttcctccagccccaggctgcggctgctgccactggaatatttggggtcttcctacgcacgctgcctgtgctcccttgcgttctcctgggtgccgaggtcctggcacgtcgtagtttagagaggccccatcttcagactgcagcacagtgacccacactgagggagtttatgtccacagagacctctttgttggggacaggacctttctgagaattctctggggcgaccacaggcaattctaggccagcgggtgggttgtggaacctgactgggctgacacctgggctccacaacccactgttagggcaggaggatcccacctgtaccttcttggatcccaggccactcgaatggagtctggcgtccttcctcctcatgcaggtgaccaaaccctcaaagtcactccagtgtgcaaaggcctttggccaccacagctgttcaaaatctgctgtaactaacaggctctggtcttcaccctgatgtatttattccacccacggtggcccatctcatgtggattcccagtaggccagcccgttttcaacaagaacagtcttctatcttcacattagaaacccattagatttttggacttcacaactaaattgtgggacagttttccaggctaacattttgtatggtttctggcatgttttcccagtgtgaatggggccacttttgtggaagggctcccctcccaaaggggtattctgcctggtgcagattccagcatccctggggtagtgcctttgaacagggatgagctgcaaggccacgtgcggtggcctggggacaagggctgccatggagagtctgtgggcgtgctctcagcccgtggccttatgcccgggagtacggtgccatctgtggaagcccagccgtgagcttatgcagaccctccatgccatcttaaacccagggtcagagggagtgtggcctggaggtcacacggggtggactgaaaaagctgcatgcttttgcttctcaccttccttccaaattaacaggttttttttttttttttttgagacggagtctcgctctgtcacccaggctggagtacagtggcgcaatctcggctcactgaaagctccgcctcctgggttcacgccattctcctgcctcagcctcctgagtagctgggactacaggcacctgccaccacgcccggctaattttttgtatttttaatagagacggggtttcaccgtgttagccaggatggtctcaatctcctgacttcgtgatccacccgccttggcctcccaaagtgctgggattacaggcatgagccactgcgcccggacaaattaacaggtttttattagcaattacttatccttaaatgaataattattcaataaaaggaatgaaatcataaattattaacaattattgttttataaaggggaaaattagttcaagtgaactttaagggtggcctggggtggggcatctgggcagcttctggggtgtggctgcaaagatagaggaggaggctgcccctggggctgggtggtttgggtattggggctgcaggctcccaggctggggctagtgtcaaacgggctccgtggagcagttgtgtgtgcatatcttccttgtgcagtcagtcctatcaggagccgagaatcagcggtggaaatatttgcaccatgatcactggcaaatgttataagtcaaggcttcttttgcagagaaactggctgttatccagcacagcactggggagcaggagcctcctgttctttggaggagtttgatgcttctctaggctgctgccaagaggcaaggaaagtcgctgggcccgaggcaggtatgccaagtggctgtgctctctggatttccacctgtgtggctgtgtctgtgaacttcccctccagggcttactctcctccaggtgttaatctggaatgttgtgtggactcccaggaaagcctgataaatagaaggacccccaacctgcgtccaggctctggagcgttctgtgtgaagttggctgccctgtgttgtgctgtgtctgtggcagccgaatgggctctggtagagccattcagagagacggaacagagggcatgtggggtgtgcaaacttggagtgggacctgaaaaatctcctgtggttttttttttaaccacaggggaaagtgaatgtttacagaatgttaaaacctacacccctttccaaattccacaagggaaaggactcacttctgtggctttctcccaggaggtaaacaagtctgtccagccaggggcgaatgttctgccagggcaccagctgttctcggggctggcttccaggactccagtcccccagtgtgctcttgtcctgggctgccagcctgcaggagcttccagagttcttcaggcattgacacctggttcccgcagtcatgtgagctgggctttgtgtctggaagggaaagaacttcctttccagagacaagacttgggccaaaggccaagtgctgaggtcgaagggaaaaccaggcgttaacaggaatgaggacagagcttctctggagtctggcctggtactttagtcctacaaggctttcttagaagctgactgcatcctgggctctggttagaggagaaaagaaaaactaaggatgtgggatttgacctgcctgtgcctggggaggcatgccctgggcaggtggccctgaatgaggagccaaacactgaatgatgaaggaaaacgccattccacacccaccctcggccctgtcctccattctggggacaagaagaaaggctcaattgaacccccatgcgtgtggggactttgggcacttctcttgctaactttcccttttgaatgagaatcagcctcaggttcattcttagaataaatttatattaaaaaagtgaactaactcaagaaaaatgttacatgaataattatagcattggcagatggcaaatcttttgaagtttgggagcctttgcaataggagtggttctgatactgaggagctggctgacagcaaggcccctggagctgggcctgggtttgaatcctgccctgactccttcagctgaatagccttgagaaagtggcccaacttctctatgcctcaatttcctcatcaggaaagtgaagaagggaaggggagctcagaacctatgggctgttgtgagggttaagtgggttctccatgggaacctgctctgtgggagcagccctgggtacaggatacttgcttgatagctgttctgtccttgttccatgggatggggctgtgaactgagggtggggtgaggacaagtgggaggaggggcaggggagggaataccccctggatgcagaggaggtaggaggccatgggcctggagaggaggtttcctgtgctggcagtggcaggcaatcatggctggagaagcttgggtagccagcaggggggcagtgacaggacgacatggcagatggtggtaggctgtgcagagcatgtggggtggaactgccttccctctggccttttggaagcacaggcctcgggctgagtgcctggaacccccagactggcagcaaccccaactgtaggaggctctgcatccttctcagatctactcccgccctcagcacctgccttgggggcatggagcaggcaggctgtgcaggtgagggcttcctgcaaggcattcacacagctgaggtgcatgtgccctgagccggcgacacggagactgcagcttccataaggcaaaccagcattttgcacctgccctcctgagaaggaggtgcctgaggtgcccacctttcttaaaggtccatcagtgttcaataattctctttttcccatgtcttgtattttctgcagtcattatggccactgtttacaggtcaccttcaaaggtgcctgcaacttcatatttggtctccacgaccaccttggtagtgggtcctattattaggccatttcacagatgagacagttcaggccccagtggtgtggggggctgtgttgggaaccctgctctctgatcagtcattgtttggcctcccgtgagactcctgagtgataaacttgcaggttcagcgctttccacagagtctagcaaaacctcagggaagagactttcactttccataaggaatttagaacacacatagctttagtgatcttgttactggctgagctggcatcactactagcaactcagctcatgtctcctgggggccctcgctgtgcctgggcccgccttggcccaggggaccattcatgttcaagtgcggctgccactttatgttttcacggcagcttctctttgctaaatgtcatggtcatgacatcaaataatgacgtgagaaatttcatacttggtttatgagccctgctagctgacttcctggtcttctgttctctcagcagagtgagcaaatcttaccaccattgaatgacagtcagtggctacagtaatgtcagggccagaggaggctgccaggagggaaggagtctgttccccaggcctgggtccatgagatgcgagctggccatccatgctttgcgtggccttccacgctcctcctgcgtgagaaggggtcagcctcgccaggcttcccttccctaaggctgatcctttcttctcttactacgaatatgttcctgacacagcatgctgaagaaaatatcaaattctagagacagcataggaatgtcctttcaagttttggatctagaccatggagttggccttccccagcccccatcagcaccggtgcttggagagaagtgactgagcctgaggaaatgctttgtgtctgtcagaggccttcacatatcaagacaattacctgggtttacttcccttattggcagaagaaaatgaaacgtttctgtaggctggtttctcagagggggtccttcccatttgcttctcagagcagcagcacatcttcatgccagcgtgatgcaaggtgacagcagcctagcccctcaggggaaggaggacacagggtgtctgcagggtgggtgtcgctcttggtggaggtccttcccacttcatgctcacctgctgcgcccatttgctcaacaaatatttattgagtaccttatatgagctaggtggatgccaggaggaaggcaataagcaaaacccagatctctacccaagcagaccttgtacttgatggacaacaaagaagtctgttagctaatgtttatttcatgaatactgactgccagaataattgtaagcaataaacaatcatgcattctcaatttctttctttccctctttctttctttccttccttccttccttccttcctttctttcttctttctttctttttctttctttcttcttcttctttttttttttttgacagagtctagctctgtcacccaggctgcagtgcagtgatgggatctcagttcactgcaatctccacctcctgggttcaagcgattctcctgccttagcctcccaagtagctgggattcagacatgcagcaccacgcctggctaatttctgtatttttagtagacacagggttttgctatggttggccaggctggtcttaaactcctgacctcaagtgatctgcctgcctcagcctcccaaaatgctgggattacagctgtgagccactatgcccagccttaatttgtttatttcttaaacacgagagcacacacaggacttacttatcctgggccttcatcaggaaatgtctaggaggaaaagacactttcaatattaaccgtgacaaaactagctctgattgaaagacagatgaaaaaataaataccagtgtatttcttcctctcttttctctgaactctgtttccagctgtttcctgttttggactaattttaaattctgaggcggggggtggggggcaggggtgcagttgtaccgtctgagttcaggcagttatcgtgttggtcacaattacttgcagtcagattgtatctttagcattggataaaagttattcccaattgatgttaagagttggtaataagtcttcttccttccccaaggccagtcagcgttttcctagtgttaagcaccaggaacacaaggccacatttgtatttttgtgcacatcatttgcatacgtctgcaccaaaagcttgacccggcagagtacactgcagacaaacctaaatatcctgctcagtacctgaacaacaagtgttatatttcttcttggacttaaaagtaaaactctaactcattttagtgactcagaaagctgcatgtccccgtgctttggaaacccactagggtgctacataagaggatcctgcaggtagtgaggaagccactgtttcctgcaactgtagcccaaggcaccagtcactgagtggctgcattatctttctgatacagaaacagtaacatttcggtttgtggaagtctgagaaattatgaatatccaaaaacatgctttcaaatggttcctgagtacttggaatggcaggatcacttacttgaacaacatttatttttcaatgatttgaagacctaggtttgctgaccatattttccaataatatatgtctggaggatattactaatgaaaaatgagagtttaaacttaaaaatccaggcttcaaaaattggctgggtgtggtggttcatgcctgtaattccagcactttgggaggccaaggccagtggatcacttgaggtcaggagttcaggaccagcctggccaacatggtgaaacctgtctctactaaaatacaaaaattagctgggtgtggtggtgcacgcctgtagtcccagctactcaggaggctgaggcaggagaatcccttgaacctgggaggtggaggttgcagtgagcggagatggcacccctgcactccagtctgggtgacagagtgagactctatctcaaaaaaaaaaaaagtcacctggaaagatggggagaaattgagatagaattagattgggataaatggaaagcctgctttaaaaaaacacaaaacatttccatggccataataggagcaagccctagttaaagggcatctgttacatgtattaggagttgggagggtgcaggttagtgacctcatgttgaatttgagccacctgtcaggtattttaaaaatgcatatggtcggccgggtgcggtggctcacacctgtaatcccagcacttcgggaggccaaggcaggtggatcatgaggtcaggagattgagatcatcctggtgaacactgtgaaaccccgtctctactaaaaatacaaaaaaattagccaggcgtggtggcgggcacctgtagtcccagctactccggctgggctgaggcaggagaatggcatgaacccagggggcggagcttgcagtgggtggagatcgcgccactgcactccagcctcggcaacagagcgagactccatctcaaaaaaaacaaaaaacaaaaaacaaaaaatccatatggtcggcctggcgtggtgatagctcatgcctgtaatcccagcactttgggaggccgaggtgggtggatctcctgaggtcgggagttcaagaccagcctgaccaacatggagaaaccccgtctctactaaaaatacaaaattagctgggcatggtggtgcatgcctgtaatcccaactactcgggaggctgaggtgggagaattgtttgaacctgggaggtggaggttgcagtgagctgagatcgtgccattgcactccagcctgggcaacaagagcgaaactccacctcaaaaaaaaaaaggttaaatatagaattgaggtcaagggtctgggtacccacattcagctctgggcaggcaccatgagaatgtgggggtccatttggaagtctgggggtgtctactgagatcgagtgccgtcatggagggctcgaccagagaacctggggaggaaaagcttccaagaggatgaggggcaaggagtattcaggaatttgaagggctgtcattgagaaattagatttattctgggaagctttaaaggtctgaggtaggactaaggggtggagtttgaagagctgcaaatcttggtccaatttttggtagactgtttccctattaaagtgacagagatgtggccccatgaggtgagctctggcagtgtgatgattaagtagaggctggactgctgtaggccagaatgtggctgccagatttcagaacctcaaggaggctgcaccgcctgacgtccaaggatcctttccacttcaaggtttatgaccttggcagagaaaataggaagggagagagctctgagatttaccggatcaaatccttcatcaggagcccctcctctggactcagcagcaagagtgtgagactcaccagaccctgcttcagctcttgggcccatgttgaggcccctcagtcttccagggaaacctggtctctagaccctccctggaggctgtcgtttagctgtccagcttcaatgactgggtgacttctgcccctatagggaaaatccactcttctttctgccccagtcctcctcccaacagccaatctatccagaaagctctccctgctgcccttccctgccacccccagtggctgtaccaccaagttgagctgctcagtgccctgcacaccttcacatgtgccgtcatttcctcatcggagctgtgctcctggaggacactctccctgtcaattcctttctcaaatgcaaacaccccactcactcccaaggtgcctagaatgggatttttaacatctcaggaattcactgaagtgagttagctggtttttgtcattttagaaaacgatttcaaacaaagatttctgagaatttccatctgatgggaaagacgatagctactgaatgtttggcagagttccaagtcagtcttgctttttattaatacttgtgacagctgtacaaggtggagggtgcttgctgtttctcagatggtcacatggcagctcagaaagataagctcccatgtctaggcagctactacagaaagctaccccaggcctttctgtagggacagtccagtgtcctttcttggcttcagattgctgccctccgtctgcagaacagggactaaatttcatcgccatttaactggtgagcataattcaagccttcatctctggtagcagcgaggcttaagctctcagagctatgaaaacggaatctggctgaagatgttgagtgactctggaccacggctccctcttcagccggtcacaggccaccccagcctcctccccggagtagcaggagtgtttctgagccctagattctgtagagcttggtgctgggggttttccgggggagtgttccgtcttttatcataaaccttggcaaggggtgcgtgggtggggcgccactgaaaggcgcctttgtcctccttctgaaagcctgaagggaaaacgatgaaatcccacagaagaggccgctggagccaggctgggcaggcgtgctggctgcggggagaactgcgggctggccttgcgatctggttctcatgtggtcccctctgcagatggccttgggaagaaacaaaggcctccttgaggcccctgcctgtgatgcggacagctcattttcattctgctgtggtttcccgggtggcctcgttgagcttcactgttctcgggagccctttccttgactaccctttgaacagaggagagctatgcaaacacgctgcgagcggccttgagagcccgaggagggtctgctttctgggcccctgcagagggcaggggtcgcgggctggtggtctgccccgcccagagagaaagggccttggcttcccctcattcttcgttctgtgttagctctttttattgcaaataattaattaaagtcagtacagcaagagtgggaaagtggttaatgcaattgccaggtccagattcagagggatgaggcgccgaaaggaaagacaaccttgggatcgcttccacttcctccacttcgcaccgcatggccggcaagttggcggctctcgcctgctcccagttttcccggagttgagtatggttgactctgactggaccaggttgggtcacgtgtcggccctgagccaatcagcttgcccagagagatgatgcgccctgagtggtgggtgaacctggtgataggccccagagtggccagagaggaagggcatgcgcacaccatagacataggcaacgtggtggacgacatgggggctgggcgggggtgctgctcacccaccttgtgcccagtgctttcccttccccttgtccatggtcccctagcttggggagaaagcagggtgcttgctctacccgccagtgctgtctcggggctgcagggagttgtggctgccctgcttgcggtcttcactcccaactcactgtggctttgcagagctggagtccgccctatctgggcttgggggtctgctccctgagagcattatttggtgcccctcgactgtgttgattcagaaatctgggacctgttgtttctcgactaaatgtcttatgagatcagtctttcttttggaggcaaacattttcggaagttttggaaccatgatgatctatgcctcagacacttgtggtccctgagaagctgctgctggaaaaaggggtccccatccggatcccaggagagggttcttggatcatgccgggaaggaatccaaggcgagtggcagagcgcagtgaaaagagatagtttattgaaagcttctcagttacatagtagggcatcctcagcaagaggaggaatgcctctgttttgtttctttcttatataggggtcttatctatgtaaaagctaagctatgtctccctgcgggtaggctgacgaagtgacatttattactttgttgattgaaagaaagctatccttggcattttagtgcataagtacatcaaagcatgcctataatcatcttaaaagcatatattatgcaatattggggcatctggacattctgttgttgcaagagtttgtctttgcaggtattaagctacttcgtcagctgtaaacatcttatgactgtgggtcatgactggcaaggaatgtgccttgctagttttaagatggaattgattctaaaatggtgtcaccatggctcccctacgctcctgttcccctaaaaaaaccctgccgtaagcggacttaaggatagccttgtcaccctagcaatgtggcagtgaatctctgccaatagcaatctacaaatgttaaaaacttttctttttctggaaaagtactttccatgcattaagtattcaagtgcctgttttcctggcactgggctggatgtatatgacataaaatttgcagtattgctccacccccaaactgctctgcattttggccctcctccatctctgatggctttctcttccctgtgctgcagggaactactggagaccacgtgccgcctggccaacacgctgaagaggcatggagtccaccgtggggaccgtgttgccatctacatgcccgtgtccccattggctgtggcagcaatgctggcctgtgccaggatcggagctgtccacacagtcatctttgctggcttcagtgcagagtccttggctgggaggatcaatgatggtgaggaggtgggcatggggagggaggaaccctggagttccctgatccttgttcctgggggcctggccatcagtgtagagaccatcagagtgcagacattaatgtcacacagacaaatgacagatcgtactagggacaggcacatggccgaatgagaatttgttctgtgggctgagatctgagtgcattggatttagccaggtgaaaaagggacagttccagttggagggaacagcagaggcacaggccaagtggaggaggagcacagcatgagggcctagtgcaggtgggtgtagtgcggcaggagggaagtgtggaggtgggataaggctggagatgcacagggaaggttccacaggtcaacaactggaaggcttctatcctgaggagtgaaggtgtggaccatatttggggatctggagtcaggtgaagggggtctttctgtctgcatgtgggtcagtgtgttttggacattgtgcagaacaataacttccttgttttgctgttgtcaaaggactgagtgtctggatggtggccctatgtccatgcagtctgatctctgcaccctgctgtctcctagagggagtccctgagctggcttcgcaaggcaggtgccaggttctaggtgccattgagaattcttgtgcctcatagaaaatagaactaatgggtagagttctcagactcctgttgacctccctctgtataaaaggctgggaagcccttccgcttcctttcagagtttcttcccccacgttcaagggtgatgctgctacctctttctctttttcttcctctctctagaactctgtaataccaactgtgtaccaggcactgttctaagcactctacaaaggttatgtcctttaatttaccttactcttcataagtattttatgcaataatactattattattcccctcccctaaaattactgttgtaaccatcttaaagtgtacaattcagtcacattaagtacattcacagtgttatgcagtcatcatcagtatctagtacctgaagtttttcatcactcaaaatgtacactttacacccattaagcagacattctccattcatccatgttgtggcatgtatcggtatttcatatttttaataggtgaataatatgcattcattgatggccatttgggttgtttccattttttggctattgtgaatagagctgttatgaatgttcatgtataggaacacctgtttttaattttgggggtatatacctatgagtgggcttgctgactcatgtggtaattccatgtttaacttatcaaagaactgtaaaactgttttgctaaggagatgcaccattttacatttccactaatagtgtatgcaggctccagtttctctgcatcttgttgtttttcactttaaaaaattacagccgtcatagtaagaatgaagttgtatctcattgtggttttgatttgcatttccctaatgactaataatattgaacatcttttatgtacttgttggccatttgtatgttttcactggacaaagtctacttaagctgtttgcccatattttaattgcttgcttgtctttttgttgttgagtatgtaagttacttatatattctgaatattagacctctatcagatatatgatttgcaaatattctcccattctgtgggtggtcttttcactttctcagtagtaaactttggtgtataaaagttttaaattttaatggagtctaatttatctattttttattttgttgcttgtgtctttgctgtattatttgagaaaacattgccaaatctaatgctgtgaagattttttcctatgttttcttttttttttctttttgagatggattctcgctctgttgccaggctggagtgcaggggcatgatctcagctcactgcaacctccgcctcctgggttcaagtgattctcctacctcagcctcccgagtagctgggattacaggcacgtgccactgcatcgagctaatttttgtagttttagtagaaacaggatttcaccatgttgaccaggatggtctcgatctcttgacctcgtgatccgcccgcctcggcctccctgttcgtatgttttcttcaaagaatttaagttttacctttttacatttagatctttaattttgagttgatttttgtacagggtgtgaggtaagggtccagtttcattctttgtcctatggctatccagtggtcccagcgccatttgctaaagaggctgttcttttccctgttaaatggacttggtactcttgttgaaaataatttgaccatatatgtgagggattatttctgggctctctatcctattccatttatccatatgattacctatgtatctattattatctcagtatcaaactgttttgacactgtagctttgtaagttttaaaaccaggaagcgtgagtctcccaactttgttcttcttttttcaagattgttttggctcttcttgctttcttgtattttcataggaattttaggattagcttttccatttctgcaaaaaaagatgttgggattttgattgcattcaatctgtagaaaaattggaaggtattgccatattgacaatattaatccacaaacatgggatatctttccatttatttaagtattttaaaatttctttcaacaatattttgtggtattcagtgtacaagtcttgcatatcctaggctaaatttattcctaagtatcttattcttttatgaatttttataaatggaattgttttcctaatttcctttacagattgttcattgctaatatgtagagatacagcaatttttgcatagtgatcttgtatattgcaaatttaatgatttattagctctaataaatagtttttttgtggattcattaggatttatacatagtagatcatatcatctctgaatatagttttacttcttcttttccaatttggatgtcttttatttcttttttttttttttttttgcctgatcactctggcaacaactttgtttacaatgttgaattgcagtggtgaaaagtgggcatccttgttttgttcctgatcttagggggaaggcttcagtcttttaccattaatatgatgttagctgtgggttttcagatgctctttatccattaagttcccttctattcctagttttaagtgtttgatcatcaaagggtgttggattttgtcaaatgcttgctctgcgtcaattgagatgtgttttttccttcattgtagtagtgtgatgtattacagtgattaattgttgcatgttgaaccacccttcctttcctagggtaagtcctgattggtcatagtatattctgttaatatgctgctggatacagtttgctagcattttgtggaagagttttgtatcattgtttatatgagatatttgtctgtagttttcttttctatagtaatctttgtctggctttagtatcagggtaatgctggcctcataaaatgaatttgaaagtatctcctcttcaattttttggaagagtttgagaaggattggtgctaattctttaaatatttcatagaattcaccagtgaagtcatctggttctggtctttagaaagggaagaagatgggtaaactgagacacagagagtttaagtgacttacctaaggtcacatacctagtaagtgacagagccaggagttgaacacagacattctgctgccatagttgatgctttcagcattatgctaagctgccccttttctctcttgctggtgtggccatggtcacccagtgcttctgttgagattgtttgaaacaagcaatagcagttgactcttggtgacttcatcatgtggggatttagtagctggatgctggggcagctcccagaacctcagaattcctaaacaaccaagcatgggagggcaggggccatgactctgtcctgaagaggactctgccctgatatccttcagcctttttgtgcagctctgcaggtaccaggttcctggggacaagattctgttgagatgggtatctgtgtcctgttgggtcaatgaggggctgttttggttttctattgctgtgtcacaaactactccaaaacttagtgtttaataaaactgaaaacaataaattttagtattctatttcatgggtctgtgggacaggaatcagatggggacaggggaatggctgttttctgctccatgacatctgggacattagtcaggttgacttgaagggttggggactggtgggcctgtctttctctccacgtggcctcttcacatggctgacttgggcttcctcatagccttgcagccttagcagtcaggcttgtcacatggcagcacatggctccaagaggaaggaaatagcaactgccagtgtcctacagtccaggctggcacaggcctggcatcactcttgccttactagattggccgaaccagtccgtggccattctagattcaaggggaggagacctggatcctgcttctctataagagcaggtgaaagaatgtgcagccatcttcagttggccactgggaggtgggtgtatattgtgagtctgaccgctaggctctcacatgtctgggcagccaccttagtcagcaggtgcagttccagagttcagtcccctggcctggcttccagggttggaccatccctcttcatttgtcttccctcttgctttaggctgcttgaggagtggagagtgttgcaggggagggtagaggtcaggagaatggctttgagagagactgtgggggtagaataatgacccactcagatggccacactgtaatcccccagaagctgtgctatgtcacttgcatggtgaaagactttgcacatatgaataaggcaataggatatccaggtgggctccatctaatcccacatccttaatgcacagaacttgctccaactagaggcagaggaagtgaagcagaaggggaggtcagagagattcaaagcaactttacccgccgttgctggctttgaagataaacagggccacgaaccagggcaggtggtggctgtagtcgctgagaatgacccctggctgacagtcagcaaggaaaaggcgaccttaatccctcagtcgcgtggaactgagttctgccaaccactgaaatggcctggaggtggatactcccccagagccaccacataggagccagccctgtccttgactttggccttgtgagactctaacagagaaccccaccaagcctgtccagacgacagaactctgagctaaaaatgagtgttctgagccactaagtttgtggtcatttgttatggaagcagcagaaaatgaacgcagatgctggtacctgctcaaaaccagggagagaaaattgaatcctcccagagtggcatgtggttcctgccagcacccatgctgtggcccagccttggagggcgccagtgggccagacatgctcatggtgctcagaagctcctgggtacttcctagaggacctcctggagagcctactgggcagggaggccctggacaggtgcgagtcaggagtgaggtgtgcgccttgggaggtggggaaggaactgcctgctgtgtagtgtgatttcagcatgttgcatgggctggggtcattgtatcgtgagagcttctgacccccatgagctttctttgtctcccgtccccttgagaaaggttcattccttcctgctggtccatctcccttcctcgcccatagggggcttacctggaccaacccctgcttggggatgtaggtctggaaagtctctgataggctccacccaactgacttggtttccccaggtgagctatcgctgaggcttgaaggccaaagagtgtgtgtagccacggctcttggtgccagatgcaggggtggctgcatctgggcaggtctagggtatctctctgacccccggatggtgctgtgtgtgctggaaaattctcagggaaccctcatggccatgacatctccagggctcttaggaggagaaagggtgggcctgttgtgcaaaagtgctttcagatttatttaggtaggactctcccagaggggacattgaggccagagtctgtcttggaagtgtggtagggcagtggtggctctggacgggaatgtggcacacatgcctcaaatggctccatgcaaagggtagggagttgcaggatttgtaccccaattatggagagccattggtcgagggttccccagcacttctgcccatagctctgcaagaggcctttggtgcagaatgactgaaaggcccaagggatgtgggtgaggccctgccagtcagggtcacagctgggcatttgtcccaggctcttcctgaggggctgtgtagtaaccccccgcagctgtgatccctctgggtcatcccgcactggggcacagcgtggaggacacctccttttcctggggtcttgaggcccactgtgcgtgcacccctcttctctgctctgggcctacccctaggttagccatggaagctagggtcctcctggcttccccctgggcctggctgagcaacattggtcattgaagagcaggtgtgggatcaggagggccttctcctgaaggtaaggtgggcaggcagctcccagtcatccactggggtgtggtttctgatctctggacagtgaaggctcttggcccacacaagtcactctagacagggcctggccacatgggacacctttgggcttggcctctggttgtccagctttcttgttctctgcctctcggtatttctctgtcaccttgattgctgcaggtggcatgatggcctctttcctggggtttgctcctgggcagacaggagagaaaggtggaagtctggttgggaaattgtctttatgctgctgactcaaggaggaagagctgagcttcaaagtaatttatctctggttccttcccctcagcctcagaactggacaaaggcctggtgcttcttcatggcacacaaaggctggagagcaggcagcccctcactttttccattgagtcttttactcaagattggactgagtttctcacactcctaggcctggatgtcctatgtgagtcagagctatgagggttaaagtcgggaggagactgatcagaaatgtctgtgttgtctctgttagccaagtgcaaggtggttatcaccttcaaccaaggactccggggtgggcgcgtggtggagctgaagaaaatagtggatgaggctgtgaagcactgccccaccgtgcagcatgtcctggtggctcacaggacagacaacaaggtccacatgggggatctggacgtcccgctggagcaggtgggttacctcgctttgcacagtttgaggcgaggtcatatcaagttagctggctctgaggcttctcgggttgtggttctcaatttgggttccctagaggtgcccagggttcctctgtggtatttggtgagcttgagtcctgactgggaagataaaactcctatacgacaagcatgttggaacacttactgtaacacaaatgcttgcacccacgcttttgttttgtgtcctttccacatttggaattgaacttggacaggtcagagcaggtgaattctgaatcctgtgtgtggagtcctgctgcggagggggagtgctgctctcagagaggctgagtgccctcggtgggctgtttgtttcttctccctgccaggaaatggccaaggaggaccctgtttgcgccccagagagcatgggcagtgaggacatgctcttcatgctgtacacctcagggagcaccggaatgcccaagggcatcgtccatacccaggcaggctacctgctctatgccgccctgactcacaaggtacaggcctgtgcgggcggtgctgggcccttggcagggatccaggcaggggcagggctggaagtcctcctgctgcagagcgaggcctgtaggtgtgagaggtcagtgtttcttcctggcctattcggggcagggccccctcgagtcctcccaccctacagctcctcagggccctggctgcctcaagcccccactgcactgtctggaaactcccagataatctgatcatgtaacgcggcagcaggacactaagggccattcgcccaaagatttttaaaaactctttttagaacagatagagaaaaccacccaaattaaatgcatggcttaatgaattattataaggcaaatgccactttgatcaagaagtggaaggccaccggtttctcagaagccccttccaggcccatatggccacagccccgtccagcatgtcttgatgtgtcttgtgcgcctgccctgtttttattttgatagttttgtgacccatatgagcatccgtgggcactgtagcttactgttgccaattaaaatattgttttttcttttgttttgttttgttttgttttgttttgttttttcatggagtctcactctgttgtccaggttagagtgcagtggtgtgatctcagatcactgcaacctttgcctcctgggttcaagtgactctcctgtctcagctttctgagtagctgggattacaggcacctgccaccacaccctgctaatttttttttgtatttttagtagagacagggttttgccatgttggtcaggctggtcttgaacttctgacctcaagtgatctgcccgccttggcctctccaagtgctggaattacaggtgtgagccaccgtgtccggcctaaaatattgttgatatgtgttttaagtctttttaagcctatgctcccccatttccttacacttggccatagtcacatccagccatttttctctggtgtcctttggtctgggttgtgcctgttgtccctctgcctctgtgtttcctgcacgtgggcagttagatcctgagatgggatcaggctccactcagttgctgtggaagaataaaggggattcggatgtctgtcctctcatgctcctcgaagctgatgatgcttgatgccattcttggccttttttgcttttattttttgtagttcttaaggggtttaaaaaatcgtggcataaggtaatgcaaaaaggtgtccatgtgttaaacgtacaactagacggactctgcagtgtgcccacctgtcctgctgctggaggccatttgaggagccagctgcctctcacagctatggactgcagcctatgcatgcctatttcctagtgacctggtgtgaacatggtggagtggggggacaagctcctgatgctcctttcctgtctctgcagcttgtgtttgaccaccagccaggtgacatctttggctgtgtggccgacatcggttggattacaggacacagctacgtggtgtatgggcctctctgcaatggtgccaccagcgtcctttttgagagcaccccagtttatcccaatgctggtaaggatggtgaaccctgtttgggaccccatgctggtgtcaggggagagagcctgaggctcgaggcttgtggagaggttcatggaagggggacgcctgggttctggtgagggtgtggctctccaggtcctgctgtcgaaatgcccggtggggccaggccccaggtcttcagaaagatctgacaggcagcagcagggagtctgacttggtgctggaggacatctcaaggcccctgctcctgcactcctgccctctgacttaaactgccggcctcaggccatcgctttggcatccttctcacctctaggctgcttgcccagatccagccctttctcaaagccagggccagctgcccgccacttctgtgtccccagccctgcccctgagccttcagggctgtccctcaaaccatgttaggcatggcctagaaccatctccattaaattgagatcactttgaagacaaggtgatgactggctcccttgggcatcgtcctcccacacagcacagtgtcttcaaatattttctttaatgtaagcagatcatggtggctctgcccaaaggctgctgctccagtgttccatggcactgacaactgtgcatggactgtgttatcacctcccagtgctccatccctgcctttgggggctgggtgtgctcaaggaagaagttgtaggggcaagaccagggattaagggccatggcccaggtgctgtctcaggccaccacttcagcccttagaagctcagtgttccatgtggaggggatggtgtgggtagtgggtttacaggaaccaggggtgtgcatgccgggcacatggccctgctccctgggacacacgcagtggcagctgtactgtcaccaggggaagcaccagtcaccactttagagcccatgtgagtgtgatcgagtgaaagctctgtgttaatgctccatgggttattaaatccacgtagtatcaccttgaactaggccatcaccctaagcctggtgaagactgttcctgaatgtgccgcccatggatctggggagtgcttggaggagagcggccattggggacctgtcccatggggcttctttccatctttcactggcgggggtggggggttggggggatccctttcatatggacatatgcgcgtctgcacatgcccagcactcaggaagtcttggctgatctctgagtttaaagtaaaccatgtcagctctcctgctgacagtgaatttcggcctttctgtaggtcggtactgggagacagtagagaggttgaagatcaatcagttctatggcgccccaacggctgtccggctgttgctgaaatacggtgatgcctgggtgaagaagtatgatcgctcctccctgcggaccctggggtcaggtgagcggcctgccctgcagcaggagaggttgtgcttgccctagaccctcagagccaatacgggcttcagcaggacttcagtcatgaagctgcccggctttgtatgtgtgaattcacgcaatgccagaccggatctggtagaaagcaccagcacctcttcccacctgtaagctcctccccagagctggcagcagttacctgtctggggaacaacgttccagacattttctgtgccgttgtttctgtgcccaatttctgtagcttaatcttcattaggaatacttacccactcaataagttaagggtcaggtcagttctttagtggctgcatgggatttaactgtataacttagctgggtgtggtggcaaaggctgaggtgggaggattgcttgagcccaggagtttcaggctgcagtgaactaggattgcaccactgcgctccagcctggtgacagagtgagactcagtcgtctaaataatagtaataatagtataactacagtttgctaaacactgccccatagttggaccttttgattgtctccaagtctgtggagtggataccatcctgcacttttgccctgctgttactgtagacatttccaggcagacagttcaaagcttaggcctattggtaatgttgatggatattgccaaatcacatggaaacattttggaaatgtgatggtggcatggtttcgacagtatcagcagtgtctgtctttcgggctggtgctgggagggactgggtgctggtgactgctgttctctctcctgtccctgccacatttcatgtctgccttgacgtgtggtcacgcgtggtcagccacctgcttggtggcttttcactggggaagcatgcagggcagtgaccatggaagagtgtcccattctgccacatacatccttgggaagggagcatgtacctcccagtgaacatgtgattccactactactgggtgaccatgaggccatgcgggcatccgggccacaggctgagaggcacagcagctggggctgtgccctgcagagctcaccacttgttcccaaatgtgagatggggatgagacctacctacagggtggcgaggatgccacagagggtcagatgtgagccttagtataatgttcagcatggagatgattaatggagagagctcctgaggaatagcaggcatccaatgactcctcctcctcttttcccttattttccccattaacagtaaaaaccttctgtttctcaaccagctttctagattaaaaagcaggaggagtttgaatactattaataagagcaaatatgtattaaatgcctttatcttcacatcagtcctttgagcaaacagcagatgttgtttcacattacagagaaggaagaggaggcacagagaggtcagagaaccggcctgaggtcactcagcaagtagggcagcctgtgttgaacgcagcacttggttctagagtctgtaaaactcactctgccccccacctgattgatgggctctgtgcccccaccctgtaccctcaacaggtcccttgccatactgtcccctccacctctcagaaagagtatggggttcctttctagatggtgaatcttagtttgctttgtgctgctgtaatagaataccctgaaactgggtgatttataatgaacagaaatttattggttcacatttctggaggctgggaagtccacatcaaggtgttggcatctggtgagggccttcttgctgcatcgtcccatggtggaagggcaaagagaaggcaagagagagcaagaggaggttgaactcacccttttataatggcaccaatcccactcatgagggtggaaacctcttggcataatcacctcataaaggttccacctcttaatactgttacaatggcaattacatttcagcgtgagatttggaggggacaaacattcaaaccataataagtggtgagtttgggtggtctctcttggcatgctggagctgggcttgagaggcccgtgtgattctgactgcctgggccatgtagtgcttgtggactgggaacaaacagcggggtggccagggccatagaaactcgcccagatcctctaggtgttgtcagcagggccacctgagtgggccctaggcattaggtggggacagggctgaagggcaagatttggttttccagatacactcatgggatttgtctcctgaaggaaggttcacggggtccaatgacaaggggtaccgccctaagtgcatttcaggaaggggtgtgctctggcagctgcattagagtgggatgtgtatcccagcagcctctgcctcacctaggggtccccacagacttggaacacctctgagccagggggccagcccccagcagaggctcagctgggttttgtgtatttagctggttgataggcacattcctattcctgttgcataaccggttctagccgcagagccctgcgggaggccaggtgctaatcacacacctcgctgttctgttctcggtatacagtgttggcaggcagcgtggcgtcttgtgatgtcttgcacctggggctcccagcacctcggagcagtgctgggagtcagtgtgttccacaccttggccagggccagcgctgtgctggcacacctgtcggtgcaattccacagcccagacccattccaggcagctgggatcagccctcatgacatttaatccgttgagtcgtcagaatcccactcactcaagacattccccctagatttgtatttctcaaagcttttttaaactttcaatttcataagtaatacatggatacactcttgtgaaaagaagaaattggagcattgtacttaaagctgatgtccttaggagctgggcgtggtggtacgtgcctgtagtccctcggctacttgggaggctgagatgggaggatccttgagccccagaagtcgaggttgcagtgagccatgatcatgccactgcactccagtccaggcaacagagcaagatccttgtctctctctctcaaaaaaaaagaaaaaaaaaaaaagctgaagttttcctcgacctctgctccaggggttgttgctcctgcgccttcggccctgtctctgcagttaagttcctgtagtggatgcagctctgttaaatgacgttttctttaacaccaaagttaccacaccgtgctatgatgctgtaatgtttcttttaagattgtagaatctgcatttttccacacggacctgctttgccgtggggattaccctggcttgtgtggtcacagccccgtggctgggtgcaggctgtcgcagtctcccagcgtgtccaccagcgctgcggggcatctccctgccccttgtggatgttctgagtgcaggtgtgacacacaagacactgagctgccaatgtggccagcactgatcatgcagcatggatgcgggggccactgctgggacaggctgtgggttgtgagtggtcctgagcaagaggcaaccaccagcacgagagtatttcagtgttttagtgatagcacgtctagcctggtgagttctggctgagtgctggcctggtgtggaaatgtcataaggtagacactgagaatcctagggtgtacacatatcttcttcctttctattgagatataatgtgtactaaagggtacagatgttaagtgttcaacttgagagatgtttacgtgtataagtgctacagaaattcctagtccccagaggcccccttatggctcctcccagttacgagagttacccgaaccatgaccacagtgtggcctgcatcaccacggacagatccggctgcacttgaacctcagctgggtgggatcacacagcacacccctcccttgcccagcgtcatgcttcagactcaccagtgccgctgtgggtcgtggaggttcgccatcttctttgcaatgtggcgttcctctgcaggagcgtgccatattgtatttagccacctactcctgagggatgtgtgtggtttctaacatgagcagagctgctgaggacaccctttacatagccacttctggtggcatctgcagtcatttctgtggggtgtacgtcaggggtcatgttttgaggtatttagctgtagtagattctgccccaagcagttgctcagagtagttgtattggttgtatggagttttaaatgttaagagaaacatccagattgctcctcaaaattgctgaaccaaactatcctcctaatggtgtctgtgaaatcctgttttccccacattcttactggctttttgatatccatcatctaatggtaaaaacacatcatggtcatgtgcatttctttgatgaccataaatacggtatgtctcactgcattttcaggtctccttgtatgttcttcaaaaataaaaatcacggagctgttttctccttaaaaatctctttatttggctgggcacagcagctcacacctgtaaccccagcactttgggaggccaaggcaggtggatcacctgaggtcaggagttcgagaccagcctggccaacatggtgaaaccccgtctctactaaaaatacaaaaaattagccgggtgtggtggcaggcgcctgtaataccagctactcaggaggctgaagcaggagaatcgcttgaacctgggaggtggaggttgcaatgagccaagatcatcctgggagacagagtgagactcagtctcaaagaaaaacaaaaacaaaaaacaaaaaacaaaacttccctttggtttcaggtttatttgcagcctgttaacatctttttctttctgtgtggtttcagtgggagagcccatcaactgtgaggcctgggagtggcttcacagggtggtgggggacagcaggtgcacgctggtggacacctggtggcagacaggtgaggaggcctggggaacaggttccggtctaagtgctgggtctgcagggtcaggtgtgaggctgggactggggtccaagctctcaacagcaggtgcgatagaagacgcttcaacgcccgagactgcggaaaccctggagcctagagtgagggaactcagaggtcgcctggctgctgtttcccacctgtgggacctcttgtcacaacttctctgaggctcggtttcctcctttgtgaggtgggggcgccccccacacgcctgggtgagggtgaactgaggtgacacagctcagcttgctgcccaaggcctggtgtgcagcaggagctcaggggccgtgtcccttcctagtgcccctttctgaacaggggaacatctgatgagacaggccccatcttctaagggagcatgagtctaaatttaaattttagtgggaaaaggaatttttcctgtgacattttgtttggatttgtccccccttctcttgggtatctgacttattaggaggcttggggcgagagaccaccatagatgtaatgaatgtaactatctgagggctcatcctcaagccagaaaatgaggcgttcccatgggacagtcccatccattcaggaaaacctgggacagagattctctagctgagtcactggggcatttccctggtacaggctggaaataatgtgagggtaggatttgagagcatcttttttcgttgttgggttcatgtcaaatgggcgctggcccagaagcagttctttttctccgtcttcatgtgcaagtgggtgggctctgccctttcccacttcaagcaagggcctgacatggcgagggggcctgcacctggctgtgggatgccagagctcctggggctgaggccactgtggggccgcctctcatatccacagtggagggcaccagacccacatctggtttgcctcaaagatcgttgtgcccctgaggcgtttccttgcccacaacagggacagtcccacctaccacccactctggatacacgtatccctgggtccggggccgattatgcatttctttcttgtcatacctgcagaaacaggtggcatctgcatcgcaccacggccctcggaagaaggggcggaaatcctccctgccatggcgatgaggcccttctttggcatcgtccccgtcctcatggatgagaaggtgtgtatgggcctcccccacatgggggtcatgtgcttgccctcccttgtccctgcctgcccagcccagctctctcctgtgtgcccaggtctgtacctggcaggaggctgctgaccttgcagcgttcactgcagctggtatcatgcactgggtagtggccacacaggtggcttggggccctcctcaggggcagaggggagagctatggacagctcccttgagggcagggcttgtcattttttggcacacttctcacccagagcctgccctgtctcacttgcatgtccggggtctacagggcagcgtcgtggagggcagcaacgtctccggggccctgtgcatctcccaggcctggccgggcatggccaggaccatctatggcgaccaccagcgatttgtggacgcctacttcaaggcctacccaggtgagcaggctgtcagggaccctctcattccttttcagctgactgctggaatcttattctcagaaaacatttttaatgggatttgagtgcagcgtaacactgtggccaggaataggtgctcgcgaggccagagtttgactccgcacccctctccctttgctgtacctccctggctttccttatcttgacagtgggagtgattccccactcggggactttcttggggctacttaggtgtgggtgtgaagtcctgcactgcagccaggcccatggtaggatcctgttagctacggctgggagttttcttccagtttacttttattttttcccagtttccctttttgtcgtaaacaagactcagtgttttggagaagcatcttggatgtgctgcttgtataccttctgctccccaaagtctcgatatctcggagccacctgcccatgctctagaacatagggaagcatcggagttgcaaggagggccgatgggcgagacttcagccgcgtgctgggctgcagagcttcacgcttactgaggttgggacatgggtcctggctcagggttcctggtgctgaatttccctgctgtggtgcaggctattacttcactggagacggggcttaccgaactgagggcggctattaccagatcacagggcggatggatgatgtcatcaacatcagtggccaccggctggggaccgcagagattgaggacgccatcgtgagcacaggctgggcctcctccttcactcctacacctccatgatgcccctgtggacctgcaagttggggtgggagtccctggcccgagtcacttctagcacccggggccgccacattttgcccttttgttctctgttgtacacaggccgaccaccctgcagtaccagaaagtgctgtcattggctacccccacgacatcaaaggagaaggtgagtgtcctggagatgagctcctccctgattcctgaccccacacccattatgggcacctctgtacgaggagcagactctggagagtggagtgataggggatactgtgggccaagctctcagtgttcttctctctcaagtggaaactgtaggggaggaggctgaatagcactcgtgttcggtcgggtttctgaaatgccctggttctgctgtcctttcaggacacacatccacagtggccatgacccagttgggcttggctaagcttggggggtttccccttctgtccatggtgtatctggtggggacaccgtccagccccattacagagagtttatgagaaaatgtccagcctcatgtatcctcacgggcttggtcatagcactcaagccagctctgcagccgccacgcgtgtgtgccagagtgtgctctggagtgtgcaggctgtgtgctgcgctgggactctttggacgaatctgacctgtggttcccactgcacagcgacatgctgggggaatgcagaatgagggactagaatggcctttaccaaggccacgctttgtttcgagtctgccagcttcttggtggctgggtctgggaaggggcgggagcacctaggtgttgcaatgccaggtccatccaggcacactgcctggcctggcgtgacctggacacacactgaccccatgccagggcactgctgggcagactggcttctcctgccctgcccagtggcttggggtcaggcttgccctcccgctgggaggccaccctgtgtcacagtgtgtcccagatgtcaccttcctccctgcacttctatgtgccgttattccattatttacttaaatgctctctttaaattgacgcattgcaagattgagaatttgtttcagtgctttacaaacagcattttcagttgccatggaaaggctatgctggtaaggctgggatgtgggagagagctggtagggacccctgcccggtgacatgtccagatgtgatcaggagggtcagagaggacggagacgaggacagtttctcaggtgtgactagggtaacttagtgcccccctgaggttacctcgctctggcaggagcctgggcccctcctctgaggactcctgcatttcacatctctgggctgggggtccacagggcactgacgtgtcctgggatttgaaagccccatctatgtctgagtccagtggctgagccagtactccctggggccactgagaggggtccgggcatggtccactgtgtctggggattcagcagcccctggattgaactccataaagcaagtgcaagatcaaggaaaggacaatggaagtgacctttagacaaacgtttgggcatcacaatcactgtctttcatagggtggcctagccttaggtctgttggggtggtgttggggcatggtctgctgtggacgctgctgcccagggcacgttctgcgtgtgtggagctattgcaagtctggtgttgccaggcttcttaatgtctgccagatgtgtggggataatttgtctatcatgtgtatgatgatgtgcattttcctgatttctaatgaatttgagtatccattctataattatgaagagctgatgaacagctcttggttggctctaaagctgcctgtgaatatcgtatatttgtccccactctctctgttttgcagcagctctgaaaaagggcagcccctggaccttgtctaggacctagacccagcaagcctctggtgctgctggccaggctcttgtctctcttgtctccagtgtcctgagccttgcctgcctcgtcctggctcttaactggctcctccacccatgtggaaggtttcctccctccagctccatcctcagaactcaacagtccaggcccacttctgatcccatatcaacgaccaagatgagaaaaacggtgttctttccctcaaagatctaacagcctagtggggtggcagcagggggactgacagctgttcccacatagcatgtgccataaactagattcatgggtggagtcaggaaaggcttcacagagcaggaggtggctgaactgagtcttgagggatgaataggagttcgccacatggatataggaaggcctttcaggcaaaggctgtaggtctttacagatcatagcttgttcagaaaaccaatcatccattcatgcacttaacaaccatgtgttgagcacctcctgtgttccaggcatggttctagatgctggggacacagcagtgagtgagaaggtctctgaccccatagaggggtcaagagtagaggagagagacagacaaagagcaagaaagatgatcaccaaggaaacgacacagtcagttaggtgctacatgccagggaagaatgggtgaaggtggcatggggctggggcagatgagcagtaggagagccacacatatatagaagcttcgagggagagacagagcacctcacaggccagtggggacgggcaggctatcagggatggcaccgggatgagcaactccttatatggacaacaatcaaattagatccctcttcacagtgtgaactcttcctggaacatgccagggtactgaaaaacgaaagctagtatttatgctataatgtgggctggcccgtgctgcccagcagaactctcagctgcctctcagctgtctgtgttgtccagggtggcagcctctggctgctcatggtgctgaatggcacttgaagtgtggctcatgcagccagggagctgctgatttaattgaactgaaatagctaccctggcccatggcaccatgttgcacacacacccccaaaggctggtggtgcccatttgctgtgcatctgtgcaccttctcatggaagtctcattccatcaaaccacattatgggttatttcacagatgtgtacacagagaggggaggtcccatgtcccaggtcacacgcagccagtcagcattagagctgagatgccaagctctcagccacacatgtgcactcacctggaacatctgtggagctgttagaatcgctgccacttttcatgaaactgaagtgcatctttgggtttgcaactaaagaaaccagctgctacaatgtcactaacataggattcaaaagcccttcggatttctggcagtctgtgcatagcaccctgcctcgggagttggctccttgtctagtatttaatacatccccaaacttggctttattttcagctgcctttgccttcattgtggtgaaagatagtgcgggtgactcagatgtggtggtgcaggagctcaagtccatggtggccaccaagatcgccaaatatgctgtgcctgatgagatcctggtgagtgggcctcccacaaagatggggctgtgctgctgttcttcccacaattgtcaagtgacaatgatcttttaggagcatattactcttttccaattagcatcaaaacggacactagctgtttggttttcctggctggtggtgaggatggtgggtctctgtgttgtcatagagggagaagtgagctcagccagcttacttgtccaggaggtcgcctaggcaggtttccatgctcagtgggctcatctgtccaggaggttgcctaggcaggcctacatgctcagtaagctcacatgtctgggaggccacctaggcaggtttccacactcagccagctcacctgtccaggagttcacctaggcaggcttccacgcccagccagctcacctgtccaggaggtcacctaggcaggcttctgctctcgtatgttggcatgtgcaggctagtcacagaaatggggctgctggtgaagaaccttagggattttcattagagacatggggacagtaccagggttctccagcccctgtgtggttcttgagcacttttcctggtggcagtgaaggagatcgcagacccccaacccagggggtcagaatcaggggaggattgggctgcctcttcaacccccggcttttcattccctcctttatgaacattgcgcgctgtgactctgggtttggcggccctcagaggcggcagggccaggatccacttggtattacaggagttgacacatttggcccagtgaccagaatttcaggagacccggactcaccctaggtgaactgaactatttcaaaagacagaatgactgtcaaagatcccaaacacagctcttaatgcattgccatttgcagtgaatgggctgtagttgtttgagcatgctccatgttagcttttcaaacactaagacaaaatttttctcttaagtagttctcacctctgatgtaagacaaaacctgccaagtcccaggccagagaatggagatgaggcacccagtgggtgcttggatctgctgccacctgggtgcctgcacgtggcacagtggcaggacagacggacggcagtacggggtgaacccggcctgggtggaccctgcctggcggagagcatcggggtggatttcagcttaggtccagacagtaggaggataaagccaagacctcgggcctcaccgttctctggggtggaggcttagacatccactgtggatccccgggagggcatcccccctgagcagagcccttctgatcttaatgcagtccacgctagcacagaggctgggcaccatccacgctctaacactgtgcctgttccttgccaggtggtgaaacgtcttccaaaaaccaggtctgggaaggtcatgcggcggctcctgaggaagatcatcactagtgaggcccaggagctgggagacactaccaccttggaggaccccagcatcatcgcagagatcctgagtgtctaccagaagtgcaaggacaagcaggctgctgctaagtgagctggcaccttgtggggctcttgggatgggcgggcacccaagccctggcttgtccttcccagaaggtacccctgaggttggcgtcttcctacgtcccagaagcagcccccaccccacacatgacccacaccgccctcacgtgaagctgggctgagagccctttctcccatccattggaggtcccaggagtgtcacccatggagaggctatgcgacatggctagggctggttctgccatctgagtttggtttcctggaatgaaaaggcattgccatctccattcctctgccctcttgagccagcacaggaaggtgaggccctgggatagcgcgcctgctcagataacacagagctagttagctagtagcaaccgtgttttctccagatctgtctagatacaaaggtcagaaatcttatttttatacttttatattgtggaagaacagcatgcaacactcacatgtagtgtgtggatttacttgaacatgttctttttaacatgtagttatgaaaatctccttttttgcctctactggtgaggaaacatgaggatcagaggccacatttttaattattgttagtgtatttggaagtctgaattggagatgtttgtacctctgtctaaacagttcccttgagaacttccaagcctccggcatcttttcctggtgagtgtttctcctgtgcttggttgtgtataatggagctaactcctaagcggtggggtgaatgtggccgccttagttctgaagctactccagttatgttctgtttcttcaagctgtgatccagaaagatttttgtgcccccagatgcctcttgataggagaggcaacatactccaaatagttgggttcttcagggaagctattagaaactcaggtgacttgttagagcactaacttggtcagagccaaatcctggcaaacgctgcctgaccttcactctgtggttggggcggtgagaaccactgaggtccaatgatgagacttggaggtctggatccagtctctctttgttttaatgtgacttaggtgctgtcaacattagcaagataatggaaatcacgacgccagtgggtgcttacctccctgctaggcatgcaggggctggcggttggcaggggaaggaggcccagtgagccgggtcccttaggggagggagagtttgtcctctttgccccacagtctacccttcagggccttgtggcagtgccagtgttcggggggtgtctgggccactgagtacccactcggtcgtggttgtgctggcctcttgggtgagtgaacctgtgaagcccaggaggtggtgttggctgcagggtacacaaatactgagtggtggtcttttgttacaggcttagcaacaaagctgtgccctgggcatggggggctgtagtgtagctacagttgtgcgtttgtgaaatggcttagctttccatgttgctgagaggaacctggacatggtcccgggcatctgaatgatctgtaggggagggagttcaaataaagctttattttgttca

SEQ ID NO: 55 - DNA, 71470 bp, Homo sapiens
ttttttttttttttttttgagaaaggggaatttcatcccaaataaaaggaatgaagtctggctccggaggagggtccccgacctcgctgtgggggctcctgtttctctccgccgcgctctcgctctggccgacgagtggagaaagtgagtatgtgcccgccgcccgcggccactgcgggaacttttcctccgaggggctgcgccctgtttgcgaaacccgagttgccaccgtcgcagctgtcgggcccccgggctcgggagcggcggggtggggcgcagggcggctctgccgggagggaggctgcagcggacccgggacccgggctcgttcgtctggagccccgcgggccctggctccgcgcatccccgcgcgggaagggcttttctctttctccgtcctgacagcccagccgtgtttcccggctaggcgcgaggactcggtagggaagttggtgccggggcgggctccgcggttcccgggccccgcgacccgcacctcgccccttccatgcgcaagagcctctccgcacacagcgctgatcccctgcggcgcgcaggcagcagcgacagcaccctgggccgcaccgcgtctccgctgctggggctgaccgggcagtggggagcgggcagccgcccggcccgcggggtgcgagttgccctcgaggggggaggtgccctgcggagaggccccgaagccccaggacacgtctccaagcgcccgtcgctgcctcccgtcgcccaacgtgcttttgcccctcgggctcctcgggttcctggccttgcccgtcactttggcccgctcctcgttgggttacctgcccccggcgtcccggggctgggcggtggggtgaggggaagcgctctctgggcagccccccgggaagtgcgaggccgggagtcttcctcagcttgtctcttccggggagcgccactgggtccccagttcagagggctctgggatggtctcccagtttctcccgggccgggggatggaggggtactagggccgcatccgagtgtgcgttggtgggtgtgtggtcggagccgacgtgcattccgacacacgtgctcgcagcgcggggtgtagtcgccgcctcacggggacacctagacgcccgtccctggcgagaggtgtcgtacgctgtggtttcagcgccagggtctgcggcggcgcggggagggtgttgtgttttgcgagcgcggagccctggccttggttttgttgtggtcggcgtcgtgtcgccctctcttctgccgccccgcacttcctttgtacgtagttaataagcagtgtcgctccacattcgctgtcttttgcaatctgatagcttttgttttggtggtgtcgggtgggggttagtagggaagcgcggggatgcggggagcgagaactccccccggtgtctacggccggaggaggtgggggttttattcttctgaaaaagttgaaagtgtggcttactggtacattcaagatggtagggtaatttgaacacgattaaaagtttaaatgtcgcagaactgggactgggaacggtgagggcgtgttggtgagtaatggttgccgagggtatgcaggtggtgccgattaactttgaaaaaatcacgactgagccttcacgagtgaggcggggaaggaggaggcagcggaggttgtatggccccatcaccggggcaattcagaaaggctgtttctataaacaaatccttaaacgtctggtaagaaatgagtccgcgacggaacgagagcagatcgtggttcgcgtgtttactgccgagtgggacgcggactggggccggaccttccacagatctgggctctcctgctctttgttttctaaactttcagcggactcgattgggcgaaagccttccggctccctttactaagtcgtttaggtggtggctggggggacaaaggagggtttttatctttaaaagataagtacggtttagaagacacgggagaaataatccattttgttatgttatgcagttgaactgtatagcttctctagttttgtgtttttaatgttctgaaattcaaaacagcagggatggccttcgccgacgcaggagtcgggcattttaaaataggctgtttttcttttggagcgttcttcttgaaggatattctttgtgcaagacggcgatttttgagaacacaggcaggagggagggggtgttttaatgtatgtttttactccatgataccaaagcttccccccaggatccctttacagtggttagttcctggaaacctgatgggtggtcagaaggcaccccaaatctcgattatggtttgctgaagtcttgactgactcagtacctgcccctccctccatctctgaaatgtggagaattaaaagctatgcctgtgaacgggcgttcagtttttagccgggaaggtgctagaccacttaactctgatagaaataagctgctgagccctatcagggagggcgttctttcagctgttgtctggtggagaaataaagacagggtgttggttcagttgcaggtattttgctggcgtattgagagattagagtttcctctttgagtgtgatggcagtagaaagagtgttgtttatcttagaaaacttagtttctgaagcagaggcagtcatatggatgtgtttgttttgtatcaccataatgtgaacagagcatctaaatgaaggcggttcggaggttctgagtgatagccagataatctgagggctattttgtttttaaaaagtcagcatgcactttaaatttattgtacccatctccttaaaaggattcagtcatctttctaccccaggcatcctgttgtcacagaaatgtaggtatgtgaaatgttggtgtttaaagaagttagtgttttattaccagaaggagaacccagaaaaagaacttctgaaagaacctaaacagcaaattatagtttagatcctctggagagacatagcaagcaaatggtgttttgtggaagggtggggtttgtgtcaggatttgaaatgtaaaaggtcataatgtttgatttgtcgaaaaagattagaaaagttcaactctaagaaatatgctaaggttgaatagatgaagcttaaaaatatcacaaaaagtgaaagaagtcagtcacaaaagaccacatatcgtatgatccggtttatgtgaaatgtctagaataaacaaatccatagaggcagaaggtagatgagtggttgccaggggctgggggcggatggaatggggagtgactgctggtgggcacagggtttctttttggggtgatgaaaattgttctaaaattagtttgtggcgatggctgcatagctctaaatatacttaaaaccattggattatgtactttaaatcggggactttaatggtatgtgaattatatctcaataaacccttttttttttttttaaagaaatgtgatcaggttgaaaataacttgttatgctaccttaaattacgttaaaattattacatacatttgacaggctgatgtctctctctcttttcatttatgagtttttcagatccgtgagttgcagcaatacaacaaactgataattgaagcttagcaacagggattcaatcccgcagtagaaatgggcaagcaggagaaaaagaatcttggttctatgtagcttcagttagggattgaggagctggatttaaaaaacacaaatgctggtggagggcagatttttgacaatagaaacctcagctgaatctgaaatgatggtttttttcaggatagagtttaggagctgagtctgaagggctgtttgtatttccagttttattatgttttccaacaaagaaagacattgctgttttaagatgttttaaacactcattttttgatatgccacattgaccacaagtggtagtaaggactgaggatgaacagaacagttcattttaatgcagtattgttgtttcttttctttgcagttttattttatttcttacatagttccagggtctgagcaggagaaagaatctttaggatgcagtagttttaggatacactgtttcaagtatacagtgatttttataaaattaaaattccttacagaacgaaaggttttaaaatgtggcaaaggcatttttgttttgaaactgtgtgcatttatccagatttaccctggcctttcaataggaaaagacctagagaataattgttgtttacatttgcttttggtctttgtctaaggcttagtttactaataaaaatgtttcctgcccttcctattgttgcaagatcagggcagtaatgaaaatcaactgtatcattttcacttgttgccttagagtttttgccaagaggaaccctcaagggacggtggtttccttttaaatctggtttcatttgttttgtaagaatgtgctgtaagaagcaactgaatccagcctgcacttattgtgcacctactgtatgaaagctgaccttgtgctactcagtgcatgaacctgcagagtcttgcatgaaaccacctttcttgaaattcagattttttttcagactcagtatagggtgcagttttcaagtagacagtagttagcattttaaaggttcttttaaaaatatttctgtagacttaggactctagtgttgttcatcagaagcctttaccctataccttttttgcctcattggtgctttccgttatattgggatgtcactgtagactgtgacatacaggtgatgttaacccatcttgactggcggcactgtcttctttataacattggatatggcaattgtgatttacaaactgcagtgttgtagttgcctttttccaaaaattaggagtcacaggtgtgtacatgaacgttgcatagcatgttttgagttgtaagaaagatggaacttatttcagaagttttctggattacatattgcttagttagctttctagaaatcaggaagcattcataatttcagggcattttataatttgtaaataacttggtgtttttaaaagcgtgagggagtaagagtgaggagacaaatcctgaaagtttttgttttttaattgtaaagcatacaagatacatttctttataggttgtgattttccccaatttgttttcaaaactcatttaaaaatcagacctagttcatggaagaggtatttgcgcctgtgggcgaacttgatttgaactgcttttcttagccagcttaggacaggtgctgagtccaggggatgagctcttctcaattgtactaaatatataatagttgcacacatgttacggatatagtttcttgatttccagtctgagatgttctgaaggaaaattctgaacactttagagacaacaaagtgcctaatgagtgatgcactctgatccctcctggaaaatggtgtttggcatcagcttagcaagaggaggttttccagttatttgtaaagatgtgatgtggctttaagtggggatgggggagggtagcagccccagtgtttgtggacattgagacctgttgacatttgggaagcataactgagttccactatttgaaaagattaaaactttgatatatgtacacatcccctcatgcctgcacccccatccccgagggtctggaaaagaattgatttgttctgaggaaggaacatatatttggaatataaaatggttagtaaacaaaggatctttaaaacaagttagattgttatctcaagagaagcatacttcctcggcatgatgttttcttttgttaaattgctttggttttatttgactcaaagtattaacaatacctttgattttgagacttttggacttttgaagactaagtttttaaatggtcaattttactcgtttgaaagtcccagataccatttttgaagatttctctccctttttttccactgatgccggctttacttatgttttattttcaaatcttaaggaaaaactgatatttccttacttgaactgagaaatagtcgttttccctccctcttttcttccacagtaaatacatgttgagtacttactggatgcagttctttaggtttagaaattatttgatactgtaaaatgtcttaccataagtttttaaagatacccgtcaaactatagatgttactgccatgtttattaaaaaaaaaaataaaacgaaacaaactagtaagcaagcttaaaatttttctttttcctgccctggactacagatttttttttcttttttttttttgagacagggtctctggtcacctaggctggaatgcagtggtgtgatcacggcttgattctgccttgacctcccaggctccagtgatcctcccaagtaggtgggactacaggcacacaccaccatgcctggctaattttttgtatttttagtacagacgaggttttgctatgttgctcaggttggactcaagcgatccactcacctcggcctcccggagggctgggatcacaggtgcgagccaccgcccccagcctacaagaatttgtaaactcatagattgctcttctgttttcactggaccacaacagaaagtagtttcttttatggtgagggatgaacacctacgattgcaatataagttgttgggccttgtgtccatggagctcacttggtggttggtggtcttgaagcattcacattctttggagtagtggggcggctggctagtcacatggggaagatgtgcacacctgtggatggggccatcacacactgcagcgatagctgggcctaccttactgctcacctggctgggcacagcggctcctgcctgtaaccccagcactttgggaggccaaggtgggcagatcacttgaggtcagaagttcaagaccagcctggccaacatggtgcaccccctttctactaaaaataccagaattaaccgggcgtggtggcccgtgcctataatcccagctacgtgagaggctgaggcaggagaattgctgaaacccaggaggcagaggttgcagtgagccaagatgatgccactgcactccagcctgggtgacagagcgagactccatcacacacacaaaatacatatataaaaataaattgctcacctggtaatagtctggaaaacattttttttttgtttttttgcatattttaaagactttagaaagtagtcttgctaatccagaaagttcttgcggggaggagtttgaaactttgttttatctcactcctcagtcttagcccccttaataccataggtctctacttcagtaagagttacataatacgaatgccgtttgttcagaattgtgtatctccatccatccgtccatcgtccaaattctgcgagtttgaaatacattgttgttgctgttttgtatacttttgttcaaccattttctttttaacatggcactagctttctcaaactggctttggaattatttgtcagtttaaaaataaataccactttaaaaattactcttgacatgggagaacaaatatattttgatagttgttagagcataaatattttatagagcataacttgaaatttttcctgatacattgtgattgctttcagcttgtcctctgctgtaaaaaatatagtcgtggttagtctctgtaaagttggttattgggaatatgtgcttgattacgtaaatgagacatcaccaatttaagtcagccaaagtttagtcaatagaactttaaagaacagaagtctaatggtaattagggagagatgaatttatttgtaggagttttccccaaattcaaagcgtcttagtgacctttgataacttcctggaaaaagtaggaagcatggagagaaattccaggtaggagcccatgatccaattgactgcatcagcttacaaagtgttttctaagtcattagctattaattctgtctagattgtaaaatccctctcagttgtgtccacatttatctgtgttgtcctgtatttattctctttacctaatttccctgagtctcattttagtgggataatacacaagcttacagactcaggactttaaagagaagcacagattgccacgaaaacaaatgaacacagagaccagtagcagcagagggagatctgctgtgaggcttcccttagttctgttgtctgatttctgtggataatgagttcactgcatatgttaggtcacaacatgatatcgtgtagtcgtaggtacagaacttttgttatggtagcctttcttcgtcaggtgatacaattgggattttctttctcacatgcacctcagtaaaattttcagcaacagagattggctcaggatggaatttgttcagtttcagttctgcagcctgtccttttctggggagactcattaattgaatgttgcctttcgatctcactgagtcacttgaaatcgctcagattgacccctattccgggatccagcctggtccagtgcagacctgcattgactctgactacatgctgagttggcctctgaaccagttcctgtaccattcccttagtctgatggacttgccagctccaaatactcagaacgtgcctcttgtggtcctaggatcaagtccagggtccttagaatcaagtaatgaaacaggtccttagtaatcctgtgctgtagggatccactgttagttcctggtactccccagcatctgtgcattagcttgatggaaaggaagctgtgttatgcctgtcttcaagtttttgcttctgctgtttccatagctgagaatgtttttcctcttcactactctgctacttctccttccatcctcaatactgaatagcagaaagtgccgcttaagaacacaggaaggtcaccatagctttagtttctccttagctgccaattagttctttggtcctaaagttattaacttttctgagtcttgatagaaatgcggagacttaaaaatatttgggggagacatttctccttttctcactaaacaacagaatgaaaaccttttctaacaggtttagaaaaccaaagtcagaaaaattgtgaggaaatagaataggttttttaaattgaaataatttccaagttccaggtggatctgtaaaatagggacaagatcataactttcaaaaggcagcacgctaagtcaggtgattcctttcccccatatgccttttctgtggtttgaataggtcagagatgccatctttacatttccaagtcaaattcctcttccttcttgaaggtttttgggatttccctaacttgtatagatctactttcccattactccttttgagttcataacccacggttttgctggttgacagtgatttgtcttgttccttgcttgtaattttattaggaccatggagccaaagtggctggtttgaatctcagctcttcagtagctaagctctcaggcaaataatttaatcttcttgtgcctcagtttcctcatctgtgaaattataattttaatagaatctactttaaacattcatagaaatcaaattcgtacacatgtcaagtgcctagaatagaacctggcacctggtattaagcccttggacttcaactgctactgttcttagggttgtgacatcctcgaacagagatgttctttggatagaaatataaggcttacttgatgtttgattgtccttgccatttaaatatgttatagaacctggcacataggtgctcaataaatgtataataaaactttattttgctaaggtgtttattaacaagatggcatgttgcttattaaacagttgtgattttttttttcagtaaacgatggtcatccccctgcagtttgccttccatttcagagatctgtttattacactttctcccttaatattgtcatttgtcaatttctgctcacacctgagaggtgtccagtgtgcactttgcccatctcgcctatgcataggctccatctagtggccagaagggaaattcagcatattaggtgactgaattaatagtgccccaaggaggaagatagcgatcccaacccactctctggcttgcttcctggggactgattgcaagaaaatgtggatactacagacttctgtagaaatcactgggctacagttttggattaaggttactctactgtgtcagtgcgagctgtcctgagagaattagggtcttcctaagtgatgcagacaggcgcactgcaactccatggcagagctgttaacacctagtgtgtcttttacagttagagttttaagataattttacaggactttaataaatttaaagctccaaaatatttgagattagagattaaaaaaacactactgatttcatttggaaaaatacagcaagatttaccttccattgctctatttaaacaggtagtaacactttcattctcttctctctcccctttggctattctatgtggttaagatgctcgccagccagaaatactcacagagaataagaataaatacatccagtgttgtgttaggtcccacaccgtctatatttcgctagctaattttatgtattttgtttcatgttttattgatattttcagaatctttcttgctgagattacacaaaatatatagctggttattcagttttacgtgtcaaaagccttaaacctgtttccccatgattgccttttattatttttaattcggaaatctttgtttggctgtctgagagagaacttcagcctcccttcctcccagacattttgaacagttcaggctgtactcattcgtgtctctttgtcttggcaggtggaagcccctctgcttggaatagcaaacaatactaccagcttgccctctggcaagctcctttaagagttagctgtaatttcaccctctctctggccttgattctgcatgcagaatgattgcactgacttgagctcctgtggtctcttgctatacctcctatttgggcatctcccccatattgctttcccccaccattggggaggggaatggtaccttggttatctttgaattcccaggaggtggcccagtgcctggtgcataggaggagctgaagaaacggaagacttcttaaagggatactcgccattcactttgaagcacttctttgtacaacaaatttattttcatctgatcattgcacctctgctagccaaaacattttatcacaccagttactgctgcatggaacttgaaagcaataaaattatctttaaaatcattgtttgattaggctttttgcacattgaggtgaataaaaaaaattagaactcctggaagggtaatttgtgagtctggccttgtgtcaagatcacctcatccctgtggatggagactttgttccataagttccctatagataagatgtaatgaataattcattggcaccgatttatgtctgtagtgtgcttttaaaccctcttggagctgggttcctgaggaggaagcatctgcaggctggactcggctgcctggtggtctccggagtggcctggtgcagagggccagggtggcatctcagaaagttgggtgggtagggtacttgcacacctgctgaccttgagttacagggtggacctaggtcatttcacaggcccttccagccttcagatctcaagatactaggcagagagagagatggagatttgagggagatgtggttggaacaagcagaatcaccacgtatggaagttggcttctattttttgcattgttttcttggtgaggccagtaagcttttgcctcactcctgggagggacagtagcaaggtcttacaggtctctctatcattgaagcaccctctccaaccctgccggttttggttgctggtgaaggcctttgacagtgtcctggtagggcgacggtgaggccagctcccgacctctggacagaagaaagcttacttgtctaggttggtgtcaaggggactcctgaacttaatgaacaccttagaaattatccttaaagtctcctcttccgaggagtggggtgggatatttcttgcagaaaatgtaaacataatcatttgaagctggaatgttaatattcaagagtagcttgtaaaaaagcatcttgtgaaattctcatgtgaatgctgaaccggctggatgtgaacttagctggacagcctggcctgtctttgctctgctcttctccgtgcggtttgcatatgtgcagggcttcctttgaagccttgtcccctcaaacaattcactgtctccctctctcccacgcatggaggcatgttggaaagggagctccaggcctcagtgtctctgcctgtgattggaataacactgctctagcagggatgccaatgagaattagcaatagataatgtatccaagctgcccagcaaacctggcaaatagaaagcatccaataaatggatgcttttctctttttttctcctcctcatggtgggtggccctggtgggctctctctggggcctccagtcctccttccccacaacactggggaattgctgccagttgaatagggcccttttttttttttttttttttttttttgagacagtcttgctctgttgcccaggctggagtgcagtggtgcaatctccgctcactgcaacctctgccttactgcaacctcttcctcccaggttcaaacaattcttgtggatcagcttcccaagaagctgggattacaggcgtgtgccaccacgcctggctaattttttttttttctagtagagacggggtttaggcatgttggtcaggctggtctcaaactcctggcctcaagcaatccaccgacctcggcctcccatagtgctgggattacagatgtgagccactgtggctggccaaggagggtctttttttgcacatctacagtgaaaggtttgaacccggacgtctgagtctcaggtcagttgttgaaaccactaagtaaccaccttgcttctctgtgcctgaagagaatgggtttttaggttaaccaggctgactggttcaaggtcatgtccctatctgtggaaggggagtgggagtggaaggtgagtggtgacagagtatggaaccctgtttctgatatctagattatttgagggcctccagtggtctctgctccatggaaagcatatgaaagaatatgattttttttttttactcgagcttgttgtctagttgggaaaactcaactactggtggagagtaacagatgctatgagtttagtgctaagttatgggatgctgaccggagagaagtatgtgggctgcaggcagtggggtcacggaactgcagaatggcttgagaagctttaaggaggatgtctgactttagtgtgccctaaatatttgactctcaagatccaaggaggcagctccccaggagaggaagggaccatgtgtggtgtgggtggcagtgtgcactgatggagtggagagggtgtcagaatccggtgtttgtgtggtgggaaggaattgactgctggctagagaatgaggagcgctgaaacctttgcaccattgcagtggacccgctgagaagggtgttctggggaggctgctctggtctctcgatggagtcaggattgggggacagatagacaccccggtgtgagccagtgatggtatagatgagggaggcagtgaggacaggctcagggagggaagtcttgtctctagacctgagaccaggaagcaggaatggactggacaggttggcccagctgagggaggtgactggtgagatgggtcctcggtgtgaggggctgggttgccagaggagctgtgggctggggtggtttgtcgagagagcagtcccagttgatggagaggcaggacccgcaaaacaggttggctgcaggactgggggcggtagcacagggcagctcccgaggagacacctggcacttttaaggcatggaatggagagagctaggggagagcacacctgcagtgaggcaattcacatagcaaagttctccggaaactgcagtgttcaacttttttaaagaatagctggatgttagaaaagtggaggaactgtcacctttattaggggcatcatggatacctggtagcatcaagggctagggttaaaacccgtggagtaatacgccctcctattgtgttcctctcctctaaaaatgaaggtgaaactgtttcaggtgagcgctgttgttgttcgtttgctggggcactgctttctgatttttagaggagtccaggctggagactgacccctgcctttttctgagttgggccggctgggcccgaggctggttctgggctgggccaggctgatgcagtggccttgggcttcccgaggctgggagagggcggtggcccccgctaccctgaagagctggccaacgcggcagggctctttccagtccttaccatgcaagtgaagaggaacagtttgtttaaagaggggtgccagcttcacatccaggcctggactttgctactggtgcttttgaacttgtgttgatttatgtttgtaaattgactggacacattgtggttcttgatgagaagcaattgcccatccttagcccacgattagtgccactctctgggtgctgcctgttctgccactgtaactgttttcacttgacaaataacattaaaaaacacagttctgcaagagacttcctgggagggtggtatcatttggcctgtgggcttttgtaacactttcctgctattaggagagtgaattctgaattttcaatcacgttcacctgttggagcaagtagagtttcagacggtctccgcttttctcgactagaaagcaggccttctcccttttccccccagtcttgtttcatgacaccattcccctctgagatgagggttggagaattagaagtctactgatgcattgtaccggggcacgttattgaccctctctgctctcctttcctcatctgtaaaatggaagataatgccacccatcaggccgagtgcggtggctcatgcctgtaatcccagcactttgggaggccgaggtgagcggatcacctgaaatcaggagttcgagaccagcctggctaacatggtgaaaccctgtctctactaaaaatataaaaattagccaggcacagtggcatgcacctgtaatcccagctactcaggaggctgaggcaggagaatcacttgaacctgggaggtggaggttggaggttggaggttggaggttggaggttgcagtgagccaagatcgcgccactgcactccagcctgggcgagagtgagactccatgtcaaaaaaaaaaaaaaaaaagtgtcacccatcttggaggatcgttaccaatacttcatgagtgaatacatacacatttcttagaacctagggtttataaacactaggagttagctgatactattgttgctaaggatagaggaaatacgcattagaagttatttacttcctttaaaaaaaaaaataccctttgggtgtgtattgattctgatgttttgctcctagctacatttgccgtttttttttgactgcagaattaggaaccagcttcatttttttttttttttttggatggaatctcgctctgtcgtccaggctggagtgtggtggcgcaatcttggctcactgcaagctccacctcccgggttcacgccattctcctgcctcagcctccccagcagctgggactacaggcgtccgctgccacactaatttttgtatttttagtagagatggggtttcaccgtgttagccaggatggtcttgatctcctgaccttgtgatccgcccacctcggcctcccaaagtgctgggattaaaggcgtgagccaccgcgcccggcaggaacccagcttcatttcttgtaaagagagtttgacaagcgctccactggggatagcagcacagcttcctccttttctgtccctgtctccctcctgactctgcatctgcctccgtttgaagcatcctcctccagtaagtgggtcatttggattccaaggcccttttgaggccatggtgatggatcatttgcgttatcaatgtgaactgtggatgtcccttcgcccttcagtctcttccttcttcaaggagggggaggtaattgggggtcatgtggcctggggaagagcctggtcacgagcatgagggatgtgagtgggactatgtttccagccaaaatttagggcacaggatctgaaaaacacttagattaagtatctgcaacacaaattagggtattttaaattgaatgtggagaaccctgagaacctgtgccctttgtgcgtggatggctgcttgcaaggatgagcatccccagctggagcggcccatggctgccagaacaggagaaggcttcagtcaggtgggaagccagctgcagtgtgttgcctgatgcaggatggtgcgagaaggagctgctctcttgctctgctccctggatcgcacaaggtcttcctgagaccagaattcaaggttagtcctgtttaggcaacttggtagatggacttgaatggtcttgctaagcgaatattgcctatggtggtatttgcaaggaaaacaaaagtgttttgagcccagactaaccaatttaacaatgctagtaggtaaggatactactgtttgctttctgtgatgagaggtctcttaggaggaggggttaattcttttgatttaaaacttactacttgaggcaaataggcacatgaaaagatgttgaaagtcactagtcattggtgaaatgtaagtcagacccacaattggtacttcatactcattagtatggctattaccaaaaacaccagatgatagcaagcataggccaggatgtggagatgttggaacccttgtgccttactggtgagactgttaaaatggcacagccttttttttttttaacaggaagatgatatggtgcttcctcaataaattcatcatagaattgccatatgatccagcaattccactttggggtatatgcccaaaaagaagtgaaagcaggggctcgaacagatatttgtacacccatgttcatggcagcaaataattcaaaatagccaaaaagtgaaagcaactcaagggtccatccatagacgggtggataaacaaaatgtggtctatccatacaatggaatatcattgagccttaaaaaggaaggaaattctatgatgtgctacaatgtctgtgaaccttgaagacactctgcgaagtgaaagaagccagtcatgaaaggacaaacagtgcataattgttacccttacgtgagctatgtagagtagtcacattcatagagacggaaagtagaatggtgaggggcggtgaatagaggctggggggagggagcaatgaggaattggtgtttaatgggtacagagtttcagtttgggaacatgtaaaagttctagaggtggatggttacggtggttgagcaacattgtgaatcagtgtcagtgaactatacacttaacaagggttaaaatgttaaattctttgttgtgtatattttaccacaattttaaaaagcttatttctcaattgtttatgcgagtatatgtgtggaatagttggggagacaaattcaaggagaccagtccttgtccatggcggtcctaggtaccacgggatcactgcgggggaactgtgaggtcaggagaggccttgaaaaaaaacgcaggtttgagctgagtcagatggaatgggtctgttttctatatcaagagacagtattgcagataatttttttctttcaaggaaagcaagtcaggagtcaaactcatgccaccgtagtcacaaatgaaatttattgctaatcagccatgtgacgtgtaattgctttttcattttcttatttttccagaagagagatttgtttagatgtttgattccctcactgattatgattatactggaagtttttcatttgttttgacagctcaattttttttttattgtaaatggactgcctcattacagaggggggagcccttgaaagaaagggattgacctctgcaggcaagaatctgagcatcctaaaagtagaaaagggctagaggcttcgccttacaggccaggaagcttggagggacgcgctgctagagaccatggcacgcatgctgtgtgtcgaaggccaggtccgcctgtctgcctctccagcagatactctctggggctatttttttctgcttggttgtcatcctttggtttaaccaggcgccagggctcaggcctggacctgctggattccaaagaagacttcgaggtggccgagcttgtctggcttccagaggagctttctctgtcccgcccgggggagtggctcaccttggtctgagaccaatgggaggaagcctgctgcgggcaactggtctgtgcctggaagttggacttgcattttctctggacctccaaagcaaacccgaatgaccactctcatcctccccttttgcttgtttgtgtatgtgcttgttttgcctggtcgtcaggcaggaggtggtgtcagatgatgagaggtgttgctcgtccctgggttggttctcttacggggctgtatggatgtcttagctcagactgctgtgacaggttactatagactgagggctaaaaccacagacttatgtttctcacagttctggaggctggaagtctgagatcaaggtgccgaccaaatttggtttctgttaagggtccatttcttggcttgcagatgacaaatgtcatgtgtcctcacagggtggagagagcaaggggctctggtctcttcctctttatgtaagggcattgttgccattatgggggctctaccctcaggacctcatctaaacctgattacctccctaaggccccaccttcagataccactgaaggtatctgggggttggggcttcagtatatgaattggaggggacacagtcatgcagttcagaacagtggagcagtgtgccatagtgaagggatctccagaccaggattctctatggaagttcttggccaggtctgagagttggttacagatcattaaaatttacatggaatccagtacttgaaagtacatgtcttcaggatggcgctgagcacattcgcctctgtaaccaaatgcctgaaatgtgtagtgcaccttctgagcaccccagtgctttccttaaagtgaatgcagtttgagaggaactcaattattgagaaattttatatgaccccatttctctcattttaggacagataagttgcttattttaaactctgcaggagctacatagaggaagttatactccaggagagcttaaatttcactctctgaaaactctgttccatgtaagtacattcctcctctctcccctcctcagtgagcacgtacccatcagatgtgtggaattctattaaaagcagctcctcgtgaccctccagggtctgttttgtaaagctgacaccagcatcagtgagttggaaggggctgccacagaagacagacttactgctgcagcccgcttcagagccctcagtagtactttttcctctcccagcaaatccaggaggctgggaaggtgattgttaattgtttatgagcattaactgtttaccagtcatacttactattttaaatctgaccctgccattatgttgttttgtttctgttcacagctgagctttaagctgggtagaatttcgtgatgagtcactcctatgactgtaaaatcagtatcgatcaagccttcctgttcatcctgtgagcagtttagagacagatgagacaggcttatggtttccactggctcggctccgtgcgtgtgcggattgggcttcctgagagcctggttagccccttttatctgctctctgaaacctgcgcaagggtgtttagcatgcaccttgaaacctctgctgcctgaagacagtgtgcttaaatgaagggtatacaaacccatgtgaggttttctcttcccttttccatgaactccaccccaattacctgtttgaattttgcatgccagttattttcagggaactagtgacccttttcttgccaccctgggctttgaattgaaggccagtgtgccaccttttctttggctttgttagaacgttgccctcagggtcatatgtgctggctgctatgaattcttactgcttgatggacagagaaaggtgagggttagatatctggacagggcatgacagggcgggtcatcgagtaggaacattgggaccttttgcttccaggcttgagcagtgggtgagaaacactgtcttcccattagggcagtgggtgaaacactgacttccctccatcctctgggcagccttgtcaggtgggtgtggaagctgaggtgtgtctgccccaggctgtgcagtcagccccgtgttctagcttcccgtgccgaacctggccctggaggctgtctgcctggcaagggggctgcacaaagctcggaggggcatttctggtgcttggtagatggtaggcctgcccccagtgcactgataagagcatgggctgagagtgccacttggattcggctacagtgggcggcagagtgggggtgactggtgttgcttttactctagagcagaggaggcagatgaggtagatcggggccccagggatgctgagctgagctgggtagagagaatttggttttgtaggatttggagacagagacaaatttggagtgtttggatgttcggggacctgcaggaggtatgtgaggtgtgtaaaatgcagcccctgttttaaaaagagcttacattgtctcttgagaagataaggtgtgcccagctgtggaatggaaccagatgcttttatgagtgaggatggagtgagcacactgggaaagagccctggaattggaggaagagatcattttgcccagagggatcttggaggtctcctggaggagggtacttagatgatcagaaggattatactagacttgatggggtggtcttggcatcagaactttaaaaatgtattttggggctggaagcaaggctggagaggaaggtttgtttaagttgtagtgggggatgaggctgggggcaaatcagggatggttttccaggtctgtaaaggctggggtaagaggaatggttggttcttaagagcaaaaaaaatcccttacatattggttctcttatttgtgctaagttaaatacatgggaggctactggtgtttatgaaataaccctgagcctttttggggaggtagtagtggatgtctgatggaagagatagaagactggtcccaggggttcttagtggcaccttcctctcaggtcatcactgtgcttttgcacattgcagttatatttgactacatttgattatggcagatttacttagaagggcactggaaaaaagcctcccaaattacaactgacacaggaaatgactttattttcttctattttttttctttgcttttctcccccaatcaacatacatttttaaacctgtcatctcacatgacctgccggtagaattgatatgtttaatttctgtagaaaataactggaaatatttcacaagctccagtagcttcctgttgtagggacccttaggactttggaatgagaagttttctattgagttgtcatatttggaaggataaaggtgccctcttttccctcgatccacatagtagactcctgtgtgcgggcatttgtttggtgtctcacgttgatgcaaatgcagccattgcagagtgagccccgctctgttactggatctccatttgctcaaaagagagcagtgtccccctccaaatctgcatgtctgaaagcattcatgcaggttcattgcatgggtctttgcattttacttagacttagcaaaaatcaggtatagtctttcctgaaaacaaaagtgaccattgtttttaatcaactgcagggtgtttggagttgtgaaatatttagggtcccgagtccattccagattcaacattgggaaagaatgagaaagctgaagcctggggcaggctctgtctgcagaaaccatgggctatcaccccctctccttagcagcattgtaaacaaacgtcatttgtaaggagcatgtcccaactgagcttgtaattataggggcaagatttgtgtggtggtaggggcatggagctggagactgggggcttccttattggttcatttatcctggcccttctcttttctctcaagtctcagctcttttaagattcagaaaataatgcaaaatgcctaagatttctgaaattcctggcttcagagacttgactacataaaagagccaggattttcaggctggccatttcaggatcagccatttcccacttcctgattcatagcttccaggatttgtaatgcctgtagacttttttctcttttgcttaaaagtggccattgaaagaaaaaataaatagcaaaatccccatcccagaagttctacttcctgttgttgtactattgagctctgaaaaacagctttgtaagtttaggctcttgtttggactatttcagtggaattcttgagatctttttgtttggacaggcaagtatgaaggcgataagtcgaaagaactacagcttactcagcacagaaatgcagaggctcaaatttaagttcttccttagctttatggtgtgtatattaatataatccaagcaatagtgagttgcttagccagggtgcacagacattttccacaatgccagttgtttccctcataatgtttaatgtttatttttaaaggacatatttgggcacacgtttcatttttgcctgtaaaagaattgggaatatttatgattcttgcaacaaaggagaaggatccaaagtaaccaagaaaatgatggactggcagccttcacattttcccacaactcttttcatgaaataaaatgtagataaggctgggtgccatggctcacgcctgtaatcccagcactttgggaggccgaggcgggcggatcacctgtggtcgggagtttgagaccagcctggcgagcacggcgaaaccccgtctctacgaaaaatacaatacaaaaattagccgcgtgtggtggtgtgcgcctgtagtcccagctactcgggaggctgaggtgggagaatcacttgaacctgggaggcagaggttgcagcgagacaagatggcgccattgcactccagcctgagtgacagagcaagactccatctcaaaaaaaaaaaaaaaaaaaaagtgtaggttagcaaaagtgcctacagttcaaatgcttccatgctaaacgttgtatttcttccggtctcatttgtgatgagagtcataagattttgagaaatacaaaaacctttccagctttataggatgataatggcttggccactcaagtagttctgattgggttaactaattttggtccagtaatcatttcatttggggtgaatggatttttcccccctaaatacgggtacctggaaagttgaagcagtgaatctggtgaaacttaatcagtgatttcgtaagggttaacaaatgtttctgggtgggattcctaatgtccagcttcctctgtgtagctcagtaagtcttctttggagacactagcctgcattgtaagactgtcacatgggagcatctttttattttattttacttttttttaaaaaaatgaggtctttattatcctggctggagtgcagtggtgtgatcatggctcactgtaaccttgaactcctgggctcaagtgatcctcttgcctcaacctcccaagtagttgggctgatagacatgagctactgtgccacgtagcattcttggggattattgtagggtccttttggaccacacatggttttatactctgtagctgattgatgtactggcatgtcagtgacattgtgtgtatcattacactatttggttaattgatgtactggtggaatagccatcttctggaggctcttgtttgcatacttctcttagtggcggactagcggttgtacagtaaatagatgatcattctcgctctgttttacctttcctcagctgctcttctagtaggaaaataacagccctcttagctgtagtcttctggaggctctctcaataatagaagtggaaagaaaagactcaaatccctgggcagtgactttttagttgtttcatttgcttttaaggcagaaacacctttaactcttagtagccttacagatcatttttgaaaacacctgtgcttgccttgaatggggcggtgaccactggatccccccatgctgggtacatgttttgcagtcacagacactgctggcctcacctttggtggtgaaggaatgtttccaatttctgctgatggtgtagtgctcttgggagctgggtgctctgaatgagcagatgggcatctgcttttttaagcgtgctgttcattctgcaaaatagttattgtgcaaatacctgataagcaccaggtctgtgccaggcgctgtattttgtattttgcatgtctgaggccagcatctttttccctgttcctttttctcctcatccagtgaactttccactgtggttgtagtttgtctgaaaaagatttggaaaaaatgtacagccatgtttctcttgtctagagaagctgtcttaaggacttcgacaagtttcattggcagagtgaatgagtggtggcctctgaatagttgaaatgttaatgctatctataggttctagagaatctgtgtctttaaaagtcatagcgataaagtctcagctttttgagagagtgggtttcagacatattttaaaatactactatacaggaaatctgattgttgcattgaaacaggatttgttatcacatcacggttagacatacccaaaaggcaaaaactacagtggtcatgatggctttacataagattttggaggagaaactgttagctccatgaaagcaggaactgtgttcactcttgaatgcctgctacctgcacatggtgaatgttctataaatgtatattaaagaaatggaggtccttagagttccaagatcaccgtcaatatcatcaccctaggcttcctcgtccttccagttacttcttttccagaagagtccattgcctcctttatatgaggtctacagagcgcgttcagagggctcttatcattgattcagcaatcacgtgtacacatagcactagaatgacttcacatatttgacctgtttaaaaataacgtgcagctatgacgaacagcgaacctttgattagggacacatttgcctgccgccagacactacaagtattatgtgtattgcttttttcaaattataatagtaatagatgattatgagaagaaaattagaaaataagttttctgtctctctataaaaggaaaataaaaattatccttaatctcaaggtaaccattgttaatattttgttgtgttttcctgagattttccccctagacttatatgtgtatctatatatttaaaaaaatgaaattagtagtatactatgtacacacatattgtgaatttctgcccataacattatatctttatcacctggaatgaggtctttaatgaaattattaaaattaaaattattctataaatgctaaatttaggtattttacaattttttttttttttttttttttttgagacaaagtcttgctctgttgcccaggctggagtggactgcagtggtgcaatctcagctcacttcaacctctgcctcccaggttaaagcaattattctgcctcagcctcccgagtatttgggactacaagtgcatgccaccatgcctggcaaatttttgtatttttagtagaaacggggtttcaccatgttggccaggctggtctcaaactcctgacctcaaatgatctgcccaccttggtctcccagagtgctgggattacaggtgtgagccactgtgcctggcccattttataattttgatcattaaaaaatgatgtgataaaattattgtgtattgttgttgatacactactctgattaattctttgggctagattcctaaaagtggaaagtaaggaataagaattgtgtaagtgtgcatgatcctagataaatattgccaaaatattttgcagaaaattcttagtttcagcttccagaagcagtgtctgtcatccatactccaccagaattgaacactaaattgagctttgcaattttagcatttaaaaagttgtatcatttaatatagaatagcagtctcttcattatgatcttcccttgcctagtaagtttatactcaagtcaaaatcggttaatcatgcatattgattccttgtttatctttttcttttaattctttaatacttctagaatgtatttgtagttaagtgaagtaagatacctcctcctgttgacgatttagtttccccacattgtgctgttttttttcttcactggattatgtaacaatatcttttcttttttttctttctttctttctttttttttttttttttttgagagagtctcgctctgttgctcaggctggagtgcagaggtgtgatctctgttcaaagcagcctccccctccccagtccaagtgattctactgcctcagcctcttaagtagctgggattacaggcgtgcgccaccacgcctggctatttttttattgtatttttagtagagatggggtttccacatgttggcctggctggtgttgaactcccggcctcaggtgatccgcccacctcaccttcccaaagtgttgggattacagacgtgagccactgcgcccagcctagagactctattttattagtgttttttgtagacaaagtctcactctgttgcccaagctggagtgcagtggcgccatctcggctccctgcaacctccacctcccgggttcaagcaattctgcctcaacctctcgagtagctgggactacaggcatgtgccaccatgcccggctaatttttgtatttttagtagaaatggggtttcactatgttggccaggctggtcttgaaatcctgaccttgcgatccgcctgcctcgacctcccaaagtgctaggattacaggcgtgagccaccgctcctggccgagactctattttaaagctgtcttctcccactgatttgccttttgtttgtggtaaaatcattttgtcttaaacactgtagcttcattatacatgttaacatctgctaggaagaatctccactcaggttaaaaaaaaaaaaatttgaagcaccattatttcaggtgaactttgtgtgtgtgtatgttgttttgtttttgcaattcttctccgctactcttccaaaaaagaaaacacaaattcattaggttttgattgttaataaatcagtttgggagaaaacatttccagatatttgaattactcattcaaggacatttcgtgtttctccatttactcaactattatctatctatgaagaaatcacagaaggtcatagaggttgtatacttttccttttgggttatttctggttaatgaatgctttttgttgctaatgtagaaggaatctttattccccattgtttattttatatttttaaattttttttcaattaaaaaaaatttttttttcattcctgagacagggtctcgctccgttacccaggctggagtgcagtggtgcggtcatgactcactgcagccttcagctcctaggctcaagtaatcctccacctcagcctcctgagtagctgggactactggtatgcgccaccatgcctggctaagttttttctttttcttttaggggcaggatcttgctgtgttgcccaggctggtctcaaactcatgacctcaagtgatcctcccaccttcacctcccaaagtgctggcattgcaggcgtgagccaccatgcctgaccttccttgtttcttttaggtgattattggttgtgtgtgaggaaagctctggtattttctgtacttatcttgtacctacccaatttgttgattgctcttattcgttataatagtctttcagttgactcttcctaatttttttgtgccgagaatcattgatgacaaataaggataatttggtctccatttttctggtacataatacgtctttacttaccatcagttgtgtgtcacttaggaatataaatggctgaaaataactgaaagcctgcctaataagggagtaggccgacaggggctgacttttctcaagttcaggcagtctggagggaaggagtctgtggctgctgtgaggtgctcaaagagggtgtgaggactgggctcctggcttctgtttgttcatccttagcctgtggcttttgtcctcgtgaacacaagatgacctccaggaattatgtctgtttcaggcaggaagaagttgagaaggaatgaagacaaaaggcaaaaaaggcagaatgacaggtcagcaagcgctgctcagccagtaggccctgcttctccttggccagaactgagttgcatgcagctggctagaaggtgggagatgaatgtgggtatggctagtgggttgggcatgggggttgggccaaccaagcatggttggtcatagggtcttgctgcattagcctgcacatccagaattgttacatgttgattacaggcatatttgtccttttttgtctatattaatgataatgcctctgtttctcaatgtgtaaggcatcttttggtttaagaggttttcatcatgttgaagaattgcctgtcttgttttcttgggtgatttattaaggatgggtgttgaatgtcatcagatgtcattttggcattcatttggattcagaagtggttgttacacctattaattgaggtaggaatagattacctagtagtaatccctcctcaaattcccgtgttaaactatttttggttgcggtgggtggctgtttaaattcctaattaaatttggtttgctaacatattcagattttttaatctcttattttaaatgagatagctttacagttctctttagatgagttcttttccagattttgctgtcaggcctagactagttttgtaaaatgaattaatgacttttcctttttaccttctctgtaacagtttttatagtgtggcaataaactgtcctttgaaggtttggaacaactcacttgttaaatgcctggaggctgacacttaaaaaaaaaaaaaaagaatagtttttgttgtgtttctttttgttgttggtgttgtttttagtcttcagtgcagtggcataatcttggcccacttcagccttgacctcccaggctcaagcagtcctcccacctcagcctccctggtagccgggaccacaggtgttttgccgccacacccggctaattttttattttttttgtagtttttgtagagatggggttttgccacgttgcgcaggctggtctagcattactgggctcaagtggtccacctgccttcgcctcccaaggtggtgggattaacaggtgtgagccaccatgcctggcgtaaaaagatggttagtttttgttttgtgacagctttaaaaaaggtcttccatgggtgttggtctgttccagggttctggttctttcctctgatgctcttttttttttttttttttttgaaacaggatctcgctcttgtcccagatggtgtacagtggtgtggtcatggctcactgtagccccagcccactgggctccagcaagcctcccacctcagcctctggagtagctgggacccatacctggctaatttttaaatgttttttagagacagagtctcgctatgttcccatgctggttttgaactcctgggatcaagcgaccctcctcccttggcctcccaaagtgttgggattacaggcatgagccaccatgctggccttctggttctttttaaatcaattttagtaatttagtaatttccagcaagtcaattaaaaattatagctcagttgtatgtagtattttctgtgtggtgttatgccctctgtatctgttttctcagatgttttagttgcttttctctcttaatcttgattagatctgccagagctgtgcttattttgtgtccccatccaaatccagaattaattgccgtgctccacatgttttggtcaatggtggacctcgtctgtaacagtagtcccatgagattataatggggctgaaaacagtgctgtcccctagggatatcgtgtctgttgtagtgcaaggcactgctcacgtgtttgtgttgatgctggtgtaagcccactgtgcttccagtcagatgaaagtgcagcgcatacaattgtgtgcggtacctaatacttgataataaacaaccatgttactggtgtatgtatttactatgctgtacttttaattgttagagtgtactccttatacttattaaacacaaaattaattgtaaaatagcctcaggcaggtccttcaggaggtatccagaagaaggcattgtgatcataggagctgatggctccgcctgggttactgcccctgtagacttccagtgggacaggatatggaggtggaagacagtgacatggatgatccggaccctttgtaggtctaggctaacgtgtgtgtttgtgtcttagcttttaacaaaaaagtttaaaaagttaaaaaaaaaagttaaaaatagaaaaaagcttatagaataagaatataaagaaaatatatacaagaaccaaaatttaagaaaaataaagtttgtaaaagtaaaaaaagttgtgcttaagctaagtttaatttattattgaagaaagaaatttttaaataaatttagtgaggcctaggtatacagtatttataaagtctacagtagtgtacagtaatgtcctcagccttcacattcactcaccactcactgactcacccgagggagcaacttccagtcctgcaagctttattcgtggtggtactcccatatacgtatgtatacttttttttttttttgagacagagtctcgctctgtcgcccaggctggagtgcagtggtgcagtctcggctcactgcaacctccacctcccaagttcacgccattctcctgcctcagcctcccgagtagctgggactacaggcgcctgccaccacgcctggctaattttttgtatttttagtggagacagcgttgcaccgtgttagccaggatggtctcaatctcctgacctcgtgatccacccacctcggcctcccaaagtgctgggattacaggcgtgagccaccgcgcctggccttttgtttcgtttttaagagacagggtctagctctgtcacccaagctggagtgcagtggcgtgattatagctcattgcagccttgaactcctgggctcaactgattctgttgtgtcaccctccccaagtagctagaactacaggctcatgccaccacacttggctaatttttgttttttaattttttgtagaaatggaatctcactatgttgcctaggctggtcttgaactcttggtgtcaagcaagtgcttggcctctgaagtgctgagattataggtgtgagcctggccatatgtactttttttttttttttatccttcttactatatttttattgtaccttttctatgtttaggtatgtttaaatacacacatacttaccatggtgttacaactgcctgcagtattcagtgcagtaatgcactacaggtttgcaggttggtagcctaggagtaataggctatactgtatagcctaggtgtgtagtaggctataccattgaggtgtaagtatactctgatcacacaatgatgaaatcacctaactgtgcatttcttagaatgcatccctgtcattaagtgatacgtaactctgcttctttaagcctctgtagcactttggttatgttaggattctgtgtctttacaagtctgctttgctgatcgattgtgacatcttgagggcggctgcactactttctgcctgcaccttgtttcgcatgtctacctggcgcatgacatacacctcgttgttcagttcttgcttctctgcttgtgtctttgcattcaccaccagctattctgatagttatcaggaggttttcattgattgcagtctcgtgcaatgggtgcaggtaatgggtagccttatggaggagaaaatgcttacctatttgggttcattccaaggagtagttcaaggataaacctctaagtttggggagtgctgtaatttgctggatatgtgagccatagaagacagcttggatggcatctgatgcttcctggctgcagggatggaggcagcagaccctcctgcctggggtggttggttgccatccctgtcgggggctcatgctccaccctcaaggctattcttgggggagttgtgacatggctttcataaaaactcagtggaattttaccctgtgtattagttagtaaaggtgagtctggttcagttggtttgagtcaaaaaatctgttaatatctctgctttagacctgcatcaggctaatacttgaatttagggtctgtccctggtgtcatctgaatttttgtttgctatgtgtgaccaaggagatggtcactcttcaggatgggtgggtggaggggagaaatgctatgatttctgttgggtcatgtgaaatcaatttggaatgtggatggggcccttacactttttcttttgagcttagtgattttctgtgtagggtggagagcgattaggaaggaattcaccacccttaggtcctcaggcatagggtcttctaggggcaggactgatgagtgaacagcagggtggatggagcagaaccgttggaaccttcagggcaggacctgccaccattatttggtcacaggaagtgttcagtggtgaacttgttggaaatgattttgagtaacttccgtctcctaaatcatattaggactctttggtctcctatggttatctgagttgttttccaggaggagctgggaaggtaccaggagaaagatgactgtccctctcatgtttgctgagggtgttcctgtaaggtgagctagtgttccttttagggcccgtggagaccgaccttcacattgaagaagcatatctgtgctccgagatgttttcatggggagaagtgtcaggtgtaattataaaaggagtctttctctttaaatactgtaggcgatttagaaatagtggaggtttaattgaagagcttgtctacgtttttacattttccttaggcacagagaaactagtatctttctctgggttgcctttttttttggagacagaatcttactctgtcatccaggctggagtgcagtggcctgatctcggctcactgcagcctctgccttccgagttccagcaattctcctgcctcagccttccaggtagctgggattacaggcacgtgccaccatgcctggctaatttttatatttttagtagagatggggtttcaccatgttggccaggctggtctggaactcctgattaggtgatccacccgcctctgcctcccaaagtgctaggattacaggcatgagccaccacacctggcctgggttgctttttaaattcatacctactgtcttatttgggtctcaaatgtgatcagtggttatacttttcttgctatgcatttaagttggagcaggctccggggcaccacttccctccctagagttgatgaacccctcatatcagtgacctccccatgtcacagtgtatctcgtgtgcactgctagatattctgatcacacagtgctgagattactggtttctctccctttctctttctgtggttatagggattctttaagggcaggcaacatgttctttgtttccataggatctgacaaagtgcatggcataggtaggtgttcatcaaaaggggtggaatagggttgatctcaagggttttaagagagatctgacgagtttgggtgtgtgacttaaaaagcagatacagcgccttttcacggatacacctccgtgattcctcaagtggtctggctgtgtttattttaggattctaaaagtaaagtgttctgttctgagtctttcacgatctgatgttctccagttctgtgaggtctcctcctttagtcccatcattggggctgtttctgctcggaaggccaggaagttgctggaagtctgctgggctttgcaaagggacttttgcttgtgtgggcattgcccagttgtgttacaacttgtttacagccgttggtttttaagggatgaggtaatcttagctcagcttagtgtaatacacaacagttttgtttattgagaaaatcattgttgaagtttttcagatgttagagatgttatgaattgcaatcaagtcggtatcctcttatataagtgcatctgacaagcccatttcacaactacatctcatcagtcacagttggatggcaaggtttattgtttaaagtttttgttttttcttttttaagttgggaaaggaagacagatggtttcagaagccaagaaagggcacaaaggcgtggatatttggaaatcgggacataattcaccattcttcttaattttttctgatctctaagacactgagacagctgttaattgaattgcttgttcacagtatttgagacgtaatgaaatgtgagtgtcctaatcacctggcgggcgtagatctttgggatcctcctggaggcttagtagggctgccctgagcagtattgtcttctccagctgggcctctgagctgtaccatgtgcccgtgctcagcctcagtccctccctcagccagttgttaaatcactttggacgtgtgacagcctcaacatgtcacagctttaaaagttcagattttaaaaaggtaaggaaatgatctcctagtgagacaacttctgcctaaaaaataaaagcttctaagacataaattctgtgttatgaacaacttgcaattttcatagttttcagttttagctctggcagcctctgatagatcttaaatatgtttatcacagctggaaaaatgttttattgtcatctttgtttatcataatatgccacctactctggttgtgtcttacaactgtagctctgtggggttttttttgtttgttttatgcttgctaatgggggaggtggggggtgtgggcggatgaatataaatgatacctagaaattgaaattggaaaaaaaaatgtattcagccagtactctttccaggttatagctaaacgtcagttggcaacctctatgctgtggtttattgagtaacacttaatacttagcacagccctcagtgaagatcttttatggccttttctgaatgttatacaaacataactaaagcttatccagatgaggacagggacctttctttccttcctttttaaatggagcaaaatttggccactgggttgctgtggatgagagagtagaaggagaaaggcagtcatcgggagactgtgtgctgagagagcgcatgtgggatttggcttcaggaagtctgggcttgcattctatccagcgctaatatttagtgagtgtgatttggggcaaattatttcgtctccctgagcttcagaatgtttgaaactttgtgaggagtctgaccccacactgtaggctccctccatgtatatatttcttcttccttttccttttttttttttttttttttttaaatttttgagatagtgtctcgctctgtaaccccagttggaatgcagtggcatggtcatggcttactgcagcctcaacgtcccaggctcaagggatcctcctgcctcagcctcctgagtagctggggtcacagatgtgtgccatcacgcctggctaatttttaacattttttgtagagatgggagtctcactatgttgcccaggctgcactcaaactcctggactcaagcagtcctctccctccagcctcccaaagttctgggattacaggcatgagccaccatgcccggctggaactgttggctttgaagaagaatgatgctgtgcttgcctttgcagtcctgtcaccatacttcctggaaagtgggtggacacgctggatggtagatgttgagttctttagatgcctggatgcttacatgctttgtgtgggttcttactggggctgtaacttactagaggacagactccaacttctgcttacttagtctggggaggttaataataatctagggcacccgcttcccagtgggtttccatcagtctcctccagcccactctactctctgttagccagctgggcacctcttcctctgtgtcccttcggtatcttcccagtggctctttccacgactggctcagaccatgtgtatatctgctcattgtctgtccagggtccctccaaagatgcctctgtgggctgggcccctggtggtgcttcctccagataattgttgaagatggaacaggagtgtgcaagaacaccagcgtgcttccagtattcaggtctagcggcaggtcccaggcatcagcggctcaccactccaccgcaggtagcctgattgcccagccttggagccgcagcctccttgggtggtgtggcagctgtcagtgtctgaaaccattttgaactttaaagggtggtgtcagacagcagctattgaggctacttaaaagaatttttttaaatgtacgagttcagtggcattaagtacattcatattgttgtgcaaccatcaccactgtccatctccagaacttgttcatcttcccaaactgaaactccatgtccatcaaacaactccccattgcctttttccccaagtctttggcaaccgccattccactttctgtctgtaaatttgactgtctggatacctcatgtaagtggactcgtacactatttgtccttttgtgactggcccattttatgagcataatgtcctcaaggttcattcaggctgtagcatgtgtccagaatctccttcctttttaaggcccaataatatttaataatatatgtatgtgtgataacacatttatataatgtccattaccatgtggtatatatgcttatccatttgtctgtcgatggacacttgagttgctcccccgctttggctactgtgaataatatgactgtgatcatggatatgcaaatatttccttaagtctttcagttcttttgggtatatacccagaagtggaattgctggatcatatggcagttctatttttaattttttgaggaaccactgtactgttttccatgtagactgcataagaattccaatttttccacatcttgccaacgtttatttttatttatttttttaaattttttatagtagctatccattctaatggatgtgaggtggtatctcattatggttttgatgggacttttgagttttagcaaatatcaatgaagtatttaattttttttttttttcttagagacaggatctcacattgttgtccaggctagagtgcagtgatgtgagcatagttcactgcagcctcaacctcctaggctcatgtgatgctcccacctacgcttcctcaatagatgggactatgttcctgcgccatcactcctggtgaatttttaaatttttgtagagatgcggtcttggtacattttctaggctggtctggaagtcctggcctcaagcagttcttccacctgaacctcccaaagtgctgggattataggcgtgagccactgcacctggcttatttaaatttttatgggtatgaattcacttaaaagctgaaggttttgagaggagagggagcatgtgaaaaaacctaaaggttttgggaggaggaggagaaggaagagagggagcatgtgaacaagagcaactgattacttccttgtcattcatttgcccagtgtttactaagcacctgctgtgtctcagacctgtgctggtttggcccttgtgaaggacagtaaatacagtgcagttccagctgcgcatgggatcacagtccagtaggtaaacgagtgcctaaacttaagagaaatgagtgcagttggggtcctgtggcggtgaaggggcgagtctgcacccaggcgagtgttaaaggcctggcctagagaagatgggtgttttgatggaaggagctgctgggaagcatgtgtactcggtgtcttggagtttagaaacctcagttggctccatgtctcgtccttagtaaaggaatatcgggagctgagactggatgtattgacacaggtcaaatcacagagtcttaggccatttcaaggaggttggatttttctctggaaggcacagggaggttttgaaggacttaatgcagaagaatgggcactgtcaggtttgtggtttggaaagtccgccttggtagtagggtggagggtgcattatggagggctagaccagggtccagcccccagcgagatgctgtgtggtaaccaggggagagagaggtggtggtgttagaagccacgacttggcatagaagccaaagcatccccaggttgtcattgtgtaattaatggttaagttggggcaagaaataaagctcttaaaagtgtccagctgtagagctctctgcctgtttttatcttcagatttttgtctttgccatctctggcctccagtggaaggccgaagttacttaacttccttgctggaagcagggctcctcatgattgccagcccctgtttggtagtggtcctggagtgctgtggaaatgggatacttggtgccacttaccttggggctttgctcctgaactgcagcggtgtcttgtgctctgtggtttgtagcatggaacagaggctgatgggcggggagtttgagtcccagtgattgaggccccctgcctgcctgcaccttactgaaggaaggacatggtggcttctcagtgtgctctctggtgatctgaacctagattcttgtttcacgggtagggggcagggttttggattcagccctggccagccctggcccaagttcatagtgtcagtagtatagttctcccaccacccccttctctcctgctcctgttttctcccccgccccttctctcctactctccttcctctcccactctccctcctctctctgcctttcacttccccccacactctctctcccccgctcccaactttctttctctcttcgactcaccacacaacacacacctgtgtgtgtgtgtgtgtgtgtgtgtgtgtgtgtgtgtgatggcactgttatttcatgtgtatacctttgcgtagcgttggcacatgtgggaatgctattataatgctttcgttgggggtctgtgctaaccactgctgagtgtgcttcatgttttctagacagcatgagaccagagctctccaccttgccattagctggtgggagaattttgagaaagtcacccaattgctcttaagtcctcatttttttttttaaatctgtaaaatggtatcacagatgcttatagctcaagactagttgatgagggtctgtgactcaaaaggccccatagatggggttcagagggcctttggaaatggcgtgcaagctctttgtaagtgtattttttttggagaaagggcccagctttttatcagacatcctgagagattcaggacctaaaaaataaaccttgattaatcttggaagcctctttttacgcagtacgctttgattcatcagtatatgcatgtggatgggttctcagatggcctgatgtttctcctccttcctctgtgtggtgggcgacgactttggctgcccagatgttaacatcagtaagcagaagctcagtcagtgttagcaaaattaaatcactctgcaaaaatcaatgttagtgaaattaaatcacttgatcttaaaagcagcatgaaatagcagtttttcatcttcattgtgctgttttcccactctagatatcttgcagattttttttggttgcttggttggttggtttttggcgtccttttcaaggacaagcagctttggacagttgcactacttttttttttttttttttttttttgacagagtcttgctctgtcacccaggctggggtgcagtggcgtgatctcagctcactgcaacctctgcctcccaggttcaagcagttctcctgcctcagcctcccaagtagctgggattacaggtgtctgccaccacacttggctaatttttatatttttagtagggacaaagtttcatcatgttattcaaattctgacctcaagccatctgcctgccttggcctcccaaagtgctgggattacaggcgtgagtcactgtgctcagccagttgcactacattttttttttagatgccattgttgaggatccaggggtttgtcatagattgattaatcagaaagtattaatctaaagtattagaatatattgattgcaggcagggaccttgcatagtttaaagatgactcagaaggcacattaggttcttgccacactttgctgccatcacagatggatgtgagttgcccccttatataggtctctcgggatgccccagtggagaacagcattgatgttgaacagatcctgtccgatggagagataccagcgtttcagccagcggtgtgagtgagggcaggggccacctctgagggtgcttgctccctcacactgtcctcacgctgccctcaagctgtgggcaaaggagagggatcctgtgccatcacagccctagaagcagaattccaaaatgtgggctcctttgggtgtggtttgggggtcaaggagatagagcaagtaaggaatgaactttgagggtttatgatcattttcatgatgataatgacctaaaaacatgcttggctgggcatggtggctcatgcctataattccagcactttgggagactaagacaggaggatttcttgagtccaggagttcaagaccagcctggacaacatagggacaccccatctctacaaaaaaattaaaaaattagccaagcatggtggtgtgcacctgtagtcccagctactcaggaggctgaggcaggaggatcccttgagcctaagaggtcaaggctgcagtgagccatgtctgtgccactgtactccaacttgggtgacagagcaagactatcccaaaacaaaaacaaaaacacatgcttatggtaggcaattaaaacaggaggtaaggagtaaacatgccaggcccctcctcctctcctctgactcttccttcttcccccctgcttcccaagggtaagctttgcagatacttgctatgcaagcaaaaatgctattcttagccatcgtttaaacacagatttgcaatttgtggtttttcatttatataaattttggctctcttcctatagcagaatgatctttgtttttaaaatgattttaagtatacaattaatatgtgaatgtatgtttcttatggaaattagaacaatacacagttacagagtagaaggtgataggtgatatagctcaccctctcctcttcctgctactctccccagtctgcttcactccccggaaggaactactggcccatcagcatgtctccttccaggcattttttccatgtggttatgtccacctgcataagaaactgggggcggcagggtggggcggtgttggcgggtcaggcagaagcaagccacagagcagtaagggtactttttaaaaaaacatttaaatagatccctgttgtcctgcggcttacatgctcatgcatactcactgtttctttaaataaactttttcttttagaatagttttagatttacagaaaagttgccgcgatagtctagagagatcccatgtacctcttaacagcttcgcctctgttaacattctgtgtcaccatggtaatttgccacagctaaggaaccagcattagtccatgactgtcagtgaactaaactcaagactttttttggattttaccagttttgcccaatgttcctttcctggtctaggatcctgtgcagaatagcgcatcacagcacattacatttagctgtctccttcacctcttctggtctgtgacagggtctcagactttccttgtccttggtgactttgacagtttcgagggacactggccaggttttgtgcacactgccccttaatttggagttgtctcatggttttttttgtttttttttttttttgagacagagtctcactcgtctcccaagctggagtgcaatggtgcaacctcgactcactgcaacttctgcctcccaggttcaagcaattctcctgcttcagcctcccgagtagctgggattacaggtgcctgccaccacacccaactaatttttgtatttttagtaaagatggggtttcaccaggttgggcaggctggtctcgaactcctgacctcgggtgattgcccacctcggcctcccaaagtgctaagattacaggtgtgagccaccctgcccggcccatggttttcttatggttagtctgggaccatgggtttttgggagcaagaccacagagctgaaatgccctcccttcagtgatttgtcagcatgacctatcaccattgttgttaaccttcaccacctggatgaggcagtgtatgcgtggggacatacatctatttgccccactgacatgagggttggatctctagaagaggagtcactgttcagaggttataggcatttgtattttttggcagatgttgtccttcaaaatggctgtacacatatgctcctcccaaaagtaggagagtgcctgttgccccatgtcctcactcaagcttggtgttattagattggtaatttttttgtgtgtgaatctgttaagttaaaaatatttctttctttggccgggcacagagtggctcatgcctgtaatcccagcactttgggagtccgaggcgggcagatcacttgagctcaggagttcaagatcagcctgggcaacatggtgaaaccccatctctaccaaaaatacaaaaaaattagctgggcatggtggtgcttgcttttggtcccagctacttgggaggctgatgtgggagtatcacttgagcccaggaagttgaggctacagtgagccgagatcgtgccactgccctctagcctgggtgacagtgtgagaccctggctccaaagaaaaaaagaagattgattgagatagggtcttgctctgttcaggctggaatgcagtggtgtcatcatcatagtttactgtagccttgaactcttgggctcaagcagtcctgctcctttggcctcccaaagtgctggggttacaggcatgagccactatgctcagccaagctaaaaatatcttagtgtgcatttctctaattgtcagaagtgtatttatttaccataccctggaaaccttatgtaagatgatggtgagtttggactttccagtaacatttggaaactgtttagtaccaagctctcattaacaatataaacaaaataggggtctacccttaaggaatcaaagccattatctaaaagctctttcccgcaacaactacctgagataatgtccttggtcatatgccccagcatttaaaaatggagttagtgagagtctgttgtttaccacctgatacattggtaagagctgcttgatggtatggggacatcagtagggaggatatagacgtagccacccccgccctagatagtaggggcctcagggtggggtaagcctgggtgggggaggtatgagtggtggaacagtgggagaccctggatccttagtctccagcgtgattgcattttgccaaggctttgtcccatgtccctttgtcccgtgttccatttgcccgtggtgttgcctagagagcatggaggggctggtggagcatgctctgtggttccctaacccagggctgtgtggggagagcttgcagcacccccctgaccccatatgaacgtccttgctatttcctgctgtgccatccagcaactataggatgctgtgctgtggctgggagacctgtttggtcttggaagctgggtcctggatgagcagaatgaggcaggcatagaggtgatgttggctacgggcaggggagcgtttgctttgccttggagtagtgccatttccatgtagaggggcaagatttaccaccctgttgtggggatttgagactttgggttttgttttcctttacaccttgagctttgttctacagcaggtccctgggaagactggtccacaaagctgctgaatggggctgctgtccttcagccctgcctcctgctgcagaatgcagaggacgctgtagacttgcttggtgggtgcctggggttttctgcctccctggtgcactgggcacagcggcttgcctgccttttgggtcgtctccacctcccagggatgtttttgttccctgatcgaatgacctcctgttttgtttgttttttgagacggagttttgctttgtcacccaggctggagtgcaatggcatgatctcggctaactgcaacctctgcctcccgggttcaagtgattcttgtgcttcagccttctgagtagctgggacttcaggtgtatgccaccatgccacgctcatttttgtatttttagtagagatggggttttaccatgttggtcaggctggtctcgaactcctggcctcaagcagtgcgcctgcctcagcctcccaaagtgctgggattacaggcgtgagccaccgtgcctggcctgacctcctgtcttctgtttttgcccactgtcaagggtagacttcttcaaggctgtacttgtgctatcctaaagaggagtaatgggagacatttctgactttgtcagcatgctgcttggcagcacctgcctcgtttctggtgaccatttggaaatgtgtcctttatctggtagcaaggagcatttacattgatccctatgcacttaattggcatacttttattcctctggattttttttttaaagcataattgttcgtgtctacatgatgtaacatgctgctgacttttaagcaaattaacagagttcgtgctgaagcgcaagggtgcagggaaacaaaatgggagggttattaaaggggtgaggcggctcctcaaagatgtcactgcaccattcattcttgtgttcctggcccatggcaggctcattaatcctccacgacaatccattagcatgcctgtcaacccttcagagaagatgagccataggaaggcttagggatccccacttgaactgctgtgtggctctatgaacatccccaccttcctggagtgaggtggttgtggccacctgactttccccattttttttttttggacctcagcctccagcgctcctgggccagactcagggtgggggggatgcaggtgccagtgactgacacttggcccctcacacttcactgcctgatttgctttaaaggcaagggttgctcatgcttgtctgagctctccatctgtttgagaattatattgttctcaactggaacttgtaaaagagaaaaaaatgtacttctcaatttccatggaagaatatagattttctggtggggtggaaactttcttagcatgaagggatctttgtgtgatctgcgcatcagcactgaataaagaatgggtgcgccgaagtcggggaggccgactttcctgtggcttgctggggaaagtttgaactgtgtgtaagcagtgcgtggaaggaaagctaagtgtggagataacgaagggaatgggatttaatagaaacagggtgtgatgagtggcagttgcctgatgaagtggaaatcttgtgttccaaatttgtgagatccatttctgtcctctaaggaaaatgttgtatgtgcaggaggagttcatgtagttgggttagattgtgttttctgtctttattttttttcctgcctctatgggttgtgaacaaaaacaagaatttgatattctgcagtatagttaactcgtgcaaacagtgtatgcttttcagtgggatataaggtctgaaataataggattttccctagtaagtcagtttcattcctttacatgtgggttatgagatacaaagtgaagctctgtaaagctttttacgagctccctgtgttgccctcctttgacgggtcaaggcattggggttgacagaggtttctactctcagaggctttaaagaggtgcccactctggtgagatggctgtcagcatgcacgatgtgtgtgagagagcacctcttcaatcatatgcacctggctgtagcatccttgtcagccttaagagatacctccaaagcggaattttctacccctagaatcatgtgaggtcatctcaatttaagccccagctctgctccctaaattacctgagtgatcccaggtaggtcatttgctcattgttaaccatcagtttccttagctgcaaaacagagcagataacaccccaaaagagttctcatagtaaatcacatcaggcttacacaatctcagaaatgtgcagctccacaggaatcttcattacctctttaggcagtccagtcgggtttcaaatgaatcctactgtctgttcttatatggaaccacagtccctcaccctgtgttgatctaagttctctgtttctctcctccagcagggtcataaagagcctgaccagtccccctccctggagacctttgtgtgctgggtttctgcagccgttctccatgagaagggacttctggtccctgctctcacttggatgttcttccactgacttatctctcttaatgtgtggaggcagaaacccagttttcagggtctctcccctggccccttactaagtctcccttaggtacagtctaagactgcctgactttttcttcttttttttttttttttttggcagccacaacatcacatcgtcacatacagaaattatatccaattaaatctcctaagtctttttcacacctcctacatttgtgcatttctttttttgcacccaagtgtccaaatagcatttatttcctctctattgcaattccaatctgttgatctttttagctcttgactctgtcatccagtgtatttgccattgctcctggaaacttgtcatctttgaattagataaacattttatctgtgccatcgttcaagtaattgataaaaatgttgaaatctacagtactcagaaagagacctgtggcctcccactagagaccttccttggtctgttcattaatcagcactttgtagggtaaattgaacatttactaagctattcagatgtagttcatatttcttcaccttgtcaacaaagagatcttagcaaggcattgtagaccaagtatgtgttcctggaatatacatattaagaaaaaatccttatgccaagaaaatgggcacatccccaaaacccaggttattgtagtttacggcttctgacccagggcttcactttgtagcagtgtttttcttctgtttttgcctttggctgataccactgctagagtgcagataagagaatgttactaccagggggcttgagtgtcgggctatgattggctgtcatctggagcagagtgggactgagctgctcaggagaaaggtcttcaggtgattttttttgggaagctaagagcactggttttagacatcctctcctggctgatgatgggattggccttcatggggctgctgtctggctgggctggtgggcagaggttcctgtgggtgtggatggagaaatcctaaatgccgagggtacctggtcttagtagaaatcgtaggatgcctcagtgaagaagtcagggatgcggattgtcctccggatgcttggatgagcgtgcagtggaaaaagtactcctttgggggaagaggtgaatctggaggtgttagagcagaagagtaaatgcagaagttgtagcagatacaaaggctttggcaagagtgggagtgatcattgaagggaaggcaggggcttgctgggacaggctggagccgtgatggaccctcatagtaaccctgctgcattttacaaaggaagaactgtgttggggtacagatgtgccaaacactcaaagttagaaaatcaacgcagtcggttgtggcttctgcccttgaaacatcagatagtgagaacctgccactgttcagtttgcagagtggttggttgcatacagtgttttagctcttgcccactcaatacagaggttgcatgcgggcgtccacctgctccgccacctctgcctgcttgtggctgtgtgcccagagcccatttccctggggagtcagtgcagcactcctgggggacccttctgtttgtgtcctgacgaatctgactgtgctggatgcagtcccacagccacacctggtatgggtggcatctttaaaggcctggcctgtgtgtgctgtatctgcagcagagctgtggccaaacctgctttccttccatctgggttccccttggttctcggtggtggacgggctgtgtggtctcccctcagctgtccacttgcacttgtgttaaaatgcggcagaactttccctctatacttaaattgtggtgaaatacgtatgacataaaacttaccatcttaacttttttttattgagacaggatctcattctgtcacccaggctggagtgcggtggcgcgatctctgctcactgcaacctctgcctcctgggttcaggcgattctcatgcctcagccacccgagtagctggaattacacgcgcccgccaccatgcctggctaacttttgtattgttagagatggggtttcgccatgttggccaggccggtcttgaattcctggcctcaagtgatccccctgcttcggcctcccgaagtgctgagattacaggcgtgagccgccgcgcctggccttccttttttttttttttttaagagatggagtcttgctctgtcgcccaggctggagtgccgtggtgcgatcttggctcactgcaacctctgcctcccaggttgaagtgattcttctgcctcagcctcccgagtacctgggattacaggcgccaggcaccatgcctggctaatttttgtatttttagtggagatggggtttcaccatgttggccaggctggtcttgaactcctgacctcgtgatccgcctgcctcggcctcccaaagtgctgggatcacaggtgtgagccaccacgcccaccggcctcccatcttaacattttaaagtgttcagtttaagtacctttacactgctgtccaatcaatctctagaacacttttcatcttgaaaaacggaaactctgtacccattaataactcccattctctcctaccacagccacgggcagccactttctgctgtctccgtgagtctgactactttgagtacctatgagcagaatccgcaggatttctccttttgtgactgccttatttcacttagcataatgtcctcaagctccatccaggttgttgcatgtgagaggatttccttcctgtgcatgaactagagtgatgcagggactgacctctggccatgtgatgggtggttggtgatggatccaagaggtagctggtctctgaatactagcccagtccttttccttgctaggaaagtccccagatcagatagaaagcctcagtatttcaagaagcttctgttttgacaccacatccatgaagaatcacactgcagggtaggggaacagatgagtgggatttctacactgttatcagctagacttagataactggctaattgaaaagagtacaggtcacttaaggaaactggagcattgtagggcaaggtaaagtgcttttgaaatgaggatgtgaactgtaactggaatgatgtaatgtgttctacaaaatgaagccagtgagaggacaggggacacagggccgacttttatttaggacatttgcctggttctgagaagaaagttgaaagtcacgagagagagggaaaggaaggcagaaggaacttggtttttgcaggtgcctgctcagcatgggccttgccccagcttggctgtacctcacagcaccatccactggctctacagtctgtccttcggaggtttagggtgctgtctcatgcacagtgggtgctaggtggtagtgaggacagggtgtgggactaggcaggtgctgcccctcggaaggcctcatggtgaggcaaagatctctggctccgagggactctatctcctggtgtcctgcttcatcgagaagccagccacccatgggaactgtggataattagaaaggcttagaggctcttctaagggtgttttttgaaatatggagacctagaatattgggctttgggatattttaagatgagaaaggcatttggagtaactgtcagagcagataaagttgtttttatgaagatccgggaaaacggttgttacaaatacagctctgcaccaattctgcgccagtctgtttggctacagatgctttcagtggaggggacactggggcttgtgttccctttagtctttgaattcccgttaaagtttccatgtcttaagtggcgtggcaggatagaaacatctcacccatcttagtaagttctttgctgtatgtagcactctggttttaacgttctgagccttcaggactgcccttgatgtgtgcatttattttgttgatatgcatgatgtgtgggtggctctgcggcagtaaaacagttcacattcaaattacactcggtttctaatttctgttctcagagtttcctctgtaatggaaatctcttacattcttatcattgccttcagttattgaatgtgttaggtggccaggattgctgtctgtgtgaaatgggaatgtatatatacaacgtaaacatgttctgattgacacgtgaagataaagggcttaacatgaattgtgtcggtttacacttacacagaaaattctactgtaataaactgaagtgtcagtagtgtttgttatcataacattgtctttttccctcttttctgatctctgatttttcaattaggaatgaggcctaaagaaacccatgctctctcttctctgagcgcaaggagggtgtgctgagaccttgaagggcacagcatgggaggatcatatactagggagagtctgtctccaccccatttttcttctgctttgctttgtttcgtagtttcttcgggcttcttgggggttttctgagagagagaatgtcaatttgagaagtaacaggtgcacaggctttacctgcaccacactgcagataaggtgggtagggagggtagtgacaggtggtgtggtgggttattcagttctttcctagggcagtgggtctcacagggtggtgcttaggccagcagcatcagcatcacctgggtgcatattagaaacaaattttggggcctcacctcttgcgttttaacagttccttcaagtggtcctgatgcatgttgaggactttgaacactcctcctacaagcaaagtgaagttgacctcccacacacttgtctcagtctgctttctagcatctgtcccattgcctttgttgttctccccgccacacgggctgcacccctgggattcccccagctgccaccaggcatcagctccagctgcctcccagggtgtgctcctgcctctgcttggagtaccctgcctcccactcttcctggcaagaccctgctcatctttcagggtcgtctctgctgagaagtcttcctgacctcctcggagatagggagttgtggggccttgtctttatgttcccagggttctgtctattgcgctattaaaactttttttttcatttaatttgccacttgctagagagatggttgttctgccttcgttgtgcaaaattcagtgatacactaatcctctcctaacctcttaaatcattttgactttcacagagtgatagtgtctagagagggtttttgttgtactaagttattggttccaaagaattcattttaagaggagtaaagaactactatagtatgccgcttactgagacaaaaccgacttctcacataagcccaaaggttttgttatgttggattttaccattagagttaaagatgatgattggttcactaatgtgctttaccttcacagtgtgcctgtagacctgtagtaaaagaaggctaattatgtttcctgatgtcttttatttccaactataagctaagcctatctcattttttttttttttttttttttttttttttgagatggagtctcgttctgtcacccaggctggagtgcagtggcgtgatctcagctcactgcaagctccgcctcccgggttcatgccattctcctgcctcagcctcccaagtagctgggactacaggtgcccgccaccacacccggctaattttgtttttgtatttttagtagagatggggtttcaccgtgttagccaggatggtcttgatcttctgacccgtgatcctaccgcctcggcctcccacagtgctggtattacaggcatgagccgccgcacccggccaacctatcccatatttttaaagaagagttgatcaagtagttacccattttaactaaatggataactataacattctttaatggaattgttgacagagggataatcagtgtttttgctaattcatgccaccctcctttgttgtatgttagtaatatttacattggggcaacaaaatagatcagtatttccattaatgtttacttaataacagctgctaaaaggtattactgtttgcagtaacacaaaagcacttacctgattcttatgccagcttctatagggtaggtagtgacagcccattttgcaggtgaggaagatggggtttagaggtgaggtgtgtctgcctgagagcaggagctggtaaatggcactctgggctcatgggagtcacgctgtttttttttttttttttttttcctaggacctcaaggttgtgtctaagacataatttacagttctcgtgtaggtcttccaaatacttagctacacagctttggggcgttttctcagccaaatgcttttctttagcccttctcatattaacatttagttcttagggatttattttcaaaatatatatagcttgtatatgccattcacctaagttgttagagcagacattctgcctcttgatctttagaaaatacctaagagtattttgttaacagtactcatttcagctgaaagactttattttaaaatttaatttaattttattattgttttttgagacagaatcttgctctgtgtctcccaggctggagtgcagtggtgtgatcttgacttgttgcaacgtctgccttgtgggttcaagtgattcttgggcctcagccacccaagtagctgggattacaggcgtgcaccaccacgcctggctaatttttgtatttttagtagagatggggtttcaaactcttggcctcaagcgatctacctgccttgggctaccagagtgctgggactgcaggcatgaaccactgtgcctgacttttaaggctttctttaaaatggcatcttttggccaggtgtggtggtaatcccagcacttctggaggctgaggctggaggattgcttgagcccaggaattggagaccaacctgggcaacatagggaaaccctctctctgccaaaaaattaaaaaacaaaacaaaacctaggtgttatggtgtacccctgtggtcccagctgcttgggagctgaggtggaaggattgcttgagcccaggaggtcgaggctgcattgagccacgattgtgctgcagcactctagcctgggtgacagagtgagaccacgtctcaaaaaacaataaaaaataaataaaatgacatctttggagaagtgaattctacccaggtaccaagcccctgcctgcccctcccaactcccttccctgactcccagcacccccatctgttttggttctgctgttgccattctctggctttggggactttgctgaggccccactgtccccatcttccagctgtaccctttctctctgcttccctgcttgtcttattctttacagggctgcctgggatctcacattccaaaagtttttgggtttgtttttggatcatgccaatatcggttgctttgagaagggagaaagggtattttgcattttccttttaatcatcggtgagtagccacaaagggtgtgtctctccctcttgtgctgtgtttactgtttactccctcggtgcatgaattatttcatggcaccagtggagcatattttcttctctttcctgtttgtggcttgcgcctcctgaacgctgctatcattcatggtccagcttggttttctttttcactgtttctatcacaaaacctcctgaagaccagtggtgtcagtcataggctccaaaacagctggttcctaggccctgcctcgtgctctgtggtttgggcttgtcttttcttccagagtaagtgggtagcttcttcctactttttttctcttttcttctataaatgggaggaaaagtgtgaagtatggagactgctctttcatttgaaggaaattcacagttccagctctgtagtgtggcctctgttaactagtggtcaacactgactgtggaaggggggccagatggcaaagtgaagcagattctttcctcctgtctgcattttgattgcagtatgaagttcaacttgcttcagtctttgtcttcatgttgtttcactaggtactgaattttgtgatctgttggaaataacaagtaaatagatgcctaacgctttatacaggttgagcctgtctaatccaaaaatccaaaatccagaatgcttcaaaagtttcagcttttggagcactgacatgacaccacaagtggaaaattccacacctgacctcatgtgacgggtcacttttcgaaactcaggcacacgacacacagttaatttagtgtccccaggggaaaaaagaccctcccggcccccttcagctgtgatgtgtcttttccacacatgcccagattccctcagacacctccacaaagggtaataaaatggttcgttgtatacaaactttgtttcatgcacaagattattaaaaatatataaaatgactttttagagaagcgagaagagaaatgagaggtaggggagggagggaggagttgggggacagttgggggaatagttgaagctaaggtgtttaggcagagctctgaggaggtgacgtttgagtggagacccagatggctagagaatggggcagcctcctgaaggagcagaagcactgtgggcggcagggtatcacagaggaggagctcggtgtgttggaggttggtgagtcccgtggagtcttgtcagatggtgttgggacagggacggaccgtgaggaggctggatcatggggaatgtgttgctttaggccaagctggagttgatagtggctcagatcagagctaaagtagtggagacacacagacattgaaagaatgatgaaattcactcattctgcgtgtgtcccatgtcatgtgtccgctgcacaccaagtactgttttaggcactggtgatataattgtgaaccaactggagctgcggtgagagagaccatgaaaagaagggccagagcggtgtcctgcagagggtggtgtaccttgggagggaagtgtgtagggttgttgaggaacagcgtgctgcacagggaggaaagacgtggggcagcattgtgggaagagcaaccaagattctcataggcttgggagcggaagccctgaggtctgttgctggactagatatgtgaggtgtgagaggagagaagaatcaggaatgactctttgattcttaacgtgagcaactcagagaatgagagtgctgcagtttacaagcttggaaggtggattatgtggggggatgagtgagttgtttgacacctcaatggatatactcggatgtatacgttagagctcaaaagagtctgggccagtgacatgaatttgatcatatctagagtatgagtggcacaggaagccacttgtctggatgaggtgacagaggaaaaggttgaggatagcaaccaacatttagaggtaaggtagaaggcagagcagtgtggaatcagggaagccgagaggaggaggcaatgccaggtgactggaaggtcaagtgacacttcgacagtgtcactgagggctctgctaggagctattcggtgtcataatggggacagaagctcagtcggagtgggttaaaggtaaccaggaggtgagggtgctgagaggtgggactattgacaagccttgtgtcaagttttgctatgtaggggctgaaatctaatgtatgtgactgtgtataagtgacttgacttccccaaatctgtttcctcacctttaaaatgggtgtttgccaagtgctggtttctgctattcttttctctgtcttaggggtgtcattttctctttggtaaaacagaagaattagatgatatgaagtttcacattctaagttctcaagctttgcccactcctcagcccttgggtccctccacttcctcttctcttcgctatctctgctcagtttctgtctttgattgtaatgtaatgcccagtgggacttttcttctctccctcgtctgttcacttattccgtcctgcactgggccaccagattaatcctgcaaaaggcctcacatgggcttctctcccgctcaggagccttgtgggggctttattcctctgagatgaaagttcttatccccacatgtgatcctttatgacttgggtgctatcaaattcatttcctcaactgctcccctcttcaccctgaccatcagatctgctggcacatgggcataccttgttctgcattgtctctggcctgtgggatatttaccgagctttaaatcctaggcaccctttgggagccggcctgtgtgcagagctccccttagcacggtggcacaaagcttggacaccacctcttgtctgtcctgcttaattccattcacatctagagtggactcgctgtgtgcacaccactgaccacctgcctcatgtgacagttgttcctcatgggtcttagctctttgccttcaccatgagcctcctcagagggcagggcactgcctgttggcatttctcgtggtatcatacatgttgggtgcttcccaaattaattacatcagtcagaaaacttcactctatctgagaagctttaatagtgtacttgggattattaaatcctaaaaaaggttatcacaaagagttttcttggtgtgtgtctgtgcttagaatttagaaaataagtcatccagtattgaggccattttatgaaaagcctttaaaatctgcaaatgcgttggcccagcacttccacttctagggatttatcctaagaaaatagtcttgggtatctgccaataatgttcactggagtgttgtttataatgtgcaaaacaggagctaacctaaatgtccaacaataagggattggttaaaaaaaaaaaacaaccctcatggtgtgtattaatactctggaactactgtccccttaaaatggtgatgtagaaggacatgtattgacctagtaaaatattaagtgaaggaagtgtgtttacaaatgtcatttttgtctgatttcacttaccttcatttatagagagtggataattggcatagatagtgttaacattgtttatcgtggaatgttgagatcgttgatgatttttactggttttttttttttggttattacctctaaactctgtaggaagcatgctttcttgatcaataaaacttaaagttggagtttatgctgcttttattcataaaaaaatcacgtttttaatcttgttaggttatcctttatgtctacattaatgcacgtgtggagagaacacagtctactcggcttatgtcaaatggtagtgggaagcatggaagcatgcgttttttagtccccactttacaagtcacagtgacggttctccagtgtagagtagattgattgccctgtgtccttcaggcagggtgcagtagtaagttattgatacttggctgctgagctgtcgttcaggccttggcaactgacgctctgcagaacggaccaggagtgtgcggtggtggagtccggctggcctgggttgcagatttaactttcgcctctgcctctgtgtgcctctgggctgtaagctttagtttgcacggttaacggggatggcctctcccatggtcggttggagtgtgttgcacagcgtctggtccagtgttggcactgtataaatgccagctaactggttagccacctaaactgtcagtctgcaacccacagctctgcagtgaacaattgaacctcatttctttaataataatacaggattcctgaaaaccaactgtattattgtttggaaaatagtttaaaaattatttccttctaactgagacgtttaccctcttgtctcccttcagtctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaagtaagaatgatgctgactgctgctttctctctgcctctctctctcctctcctcctccttgacctcccttctcttctgagtgcacgagttccgctgggcagggtgcagtcgtgttgcatttaggacgtggcatgcctgctgtgcggaagtggttcccagtgggggtcttggttggctttcctttgcatctgggactcttggattgcgggactgtggcgtggctggaggccatcatggctgctgtcaagactgttcaaatcacatgttagaaataatccagcacactcctgggctagacacttgctgaccttcagctttgaattcctgatgagaaaggtgacctggtgtgcttggaagtccctgagccttggcagctgggggctgcttatgtgtcagctctttcatcctttgtgcgaagtgatattttttgttctgcaggacttccttagtttgaatggacttggaatatggttaaataaagggaaggtaaagcactaactcatatcctgtgaaagtggtccttaggtcctagtgatgatgttatgatactcaggtgtcctggttatgacagagcacctggcccaggtgggagacctctggacccatttctgcaagtcccaggttcaggctgtacttgcaggtagctgtgtagcagggtgcatttttaaacctctgggattctgttttcgttcttttatacctgtttactgaacagttgtgaaaatcttaagatttcacgagtgaaggaactttggaaagtatttactgttctgggggtcagatggtggtattttgaagcttcttgtatatttatctgcaatatgcttattttcccttgagaataactgagctcttgccttcatgtgatcagttccttaagaaccaggctgtttggtattaaaatgtgactctgagccttcaccttattgcattcagcaatagttatgtatattggctaggaagcttttcctcactggtttgaagtcagtgtgttagctataaatagctattatttaagtgttggcccagttaaagatgtaaggaacccatgttctctagttatgaagaaccaagaaaccccaaattgttagacttgcctaaaataaataaaaggcgagaccccacaggggtgaagtgtgtaaagtaaataaaggacagacctcccaggtagcccttcagttcccgttcaaccagtcctgaggcaggaaaaggatctgtgtaccctgatctgccacgcacttttctattctgcagaattggatcagtgcgtatgtgaacattgattagtgagggcaggggtcccactggctgcagccagtaccttgtagagctctgagaatgcagtcaggccactttaaggttggctggagttggagggagatcttatgctaaagtcacttgtgtggttgattaaaactgccctatcattaagttacccactggtttgagaaaacaacaaaatatattttttaaataaccttgacatttaaaaattttatctgaaaagtaaaaggtgttatcaagggaggcagcatggagtagaaaagagatgttgaatgtggtgatgagggccaggaatgaccttggatgggccagcccttctgggctgtagttgggcttttttaggatatttctagggcagtccagtacatcccttagtggtgatcatatatgggcatgaggatgttttgaaaactcataagctctttagagaagggaggtgccatatgaaacgtcattaagtggagagttgttcacgaactaggtaggtagttactttggtcttgccataggtttttggctgtttctgatgagctactgattgaagacccctggggtaggggtgaggcctgcattctgggtccaagtctaagagtggcgactagaaatgagcaagttatttaaattgcctgggccttggtttcttcatatgtggaatggggtaaagcctgccttcctcatagggctgttggaagatgaaaaggaggaaggaaaagcaccgtgaaaatgttaacgatggttagaaggtgggctctgctggtgacagacagagccttgatatcacctgttggttggtcacctgcttccccaaggccacgccctgcagccttctccttgaccatcccagccctgctgatgttccttgtgatttcacaatggagtacttatataaaattggtaactgctttccgggaaattgacttcccttccccttgtcctgaaaactcaggcatgggcatatttcttggagattttctagttgaatcagaacttcctcttggtttgcgtagattccatttagacctgcattgtccagtgtggtagccgcttattgagtaagccacgtggcttattgagtacttgaactgtggcttgtccgaattgggactgctttaggtgtaaaatatacactagatttccaagacatagtatagcaaaaactctgtacaccatttcattaataattactatgttgataacatgttgaaatataacattttggatatattagattaagtaaaatgtgttcttaaatttcacctgcctgtttcctttttattctttttttttttttttgaggcggagtttcgctctcatcacccaggctggagtgcagcggcgcgatctcggctcactgcaacctccgtctcctgggttcaagcgattctcttgcctcagcctcccaagtagctggaattacaagcatgtgccaccatgcccgtctaatttttgtattttaactggagacggggtttcaccaccatgttggccaggctggtctcaaactcctgacctcagatgatccgcccgcctcagcctcccaaagtgttaggattacaggtgtgagccaccatgcccgactctttttaattcttaatgtggctacttgaaaatttaaaattacagatgtggcttgcattctgtgttggtaagctgctttagagcatttcttttaacaccaggagttcttcccctcatcatctttttggctgagtcgtcactgcagcgctcatagccccgcatgtacctctccagccagaacccttaggaatcatttggggagctccatgaagggcattgagtccaggcagaatggctaccttgagttcaacataagcattaagatggccattcgaaaacattaagcacagaagaatcccattcaggtaatcttctgttggctggctgtagaactacggagaacatctggagaaacacgtcaagggtgtgtgtgaaatcgttgagcctactcgattttgtcgtgctgttgcgcggttttcacttggcactgtcctttaaactccttctgtgccgtgactctgcagtgtctggcagcgtagtagactctactccctctatggacgtgatccctctgtgggttctctgcacacttctgtatttctcggttctttttggatttaggagtggattttatacatttttgagtcattcctaaagagcgattgacccttaaagaactgtgtacagtggtttcctttcagtaagaacatagttgtgtggcaccccctgacatgtggtgtggttgattcttcttccttgtcttccaacgccaccctcttatgagtctcttcctacccccacaggtgccgcttctctgtctcccttccctcagtctggcttttaacggtggtctcctgacatagtccattcaggctgctgtaacaaaatcccataccctgagtggcttacacacaacagaaatactgctcacagttctggaggctggaagtccaagttcaaggtgcttaccagattaactgtctggggagggcccacactctggttcacagaagcaccttttcactgtcttcacatgttggaaggggcgagggattttttttctggcgtcttttttataagggcactaatcccatttgtgagggctccaccctcatggcctaatcacctcccagagccatcatactggggattaggtttcaacataagaattttgaggggacataaacattcagatcatagcatggctggagttctgtcctgggctctcttttcactttccttgttctcatctcatccactggtaactgcattgcctcctgtctccacctaaacttccaagtatctccagcccagaacccttttgagtccaggacctgtcattcatatccatcccagaacccttttgaacccaggacttgtcattcatatcagaccaccacgagcatttcactacagcctctgatggtcttccctgtttcctcacttttgcctattttttttcttttctattccctcttaagtgggccacacttttgttcccctggttcttatgtcaggaatgtgggtgtcctttggacacttccttctccagttggataccaggccctttccctcccgaatggaatggaaatgctgcttcagctgtgttcctctgctcctcccccttacagcagtgacatagcctctctcctgctattgtgtcctgtggctccaccgagcactggggagcttttcagtatgcactttttttttttttggagaaagagtcttactctgtcacccaggctggagtgcagtggtgcgatcttggctcattgcaacctccgggctcccaggttcaagtgattctactgcctcagcctcctgagtagctgggattacaggcccgcaccaccacacccagctaatttttgtatttttagtagagacggggtttcaccatgttaaccaggctggtctcgaactcccgacctcaggcgatccaccggtcttggcctcccaatgtgctgggattacaggcatgagccactgcgcccggccatctagtgtgcactttggactgatgagctcccctacctgaaatcctgtagcaagtccctataggataggcatgtggtacagtgtgaagctcctgagtggtcaacagctaccccgtgacaacatgccacactccatgtgccactccctcccgcctgcctgctgtgtccttggccccagtggtgctctcccgtgctgaccagccggcacggctcacctggccgaactctagccttgccttttcctctcaaggatgtaaaggctctgcagatttcgggaggcctgtctcccagcacctgatgggacactttttgccccactgtaaattctgggtgtatcctccactgtatgctgtcaccccaagggcaagcactgcatctgcttagtgaaggatttattgttcggaagatacattttccccttgagcagagagtagcgtatcctggcagtcttcggtgagccagttgtaccaggattatgaaatgcagatgtttactgtgtcattgttgctgtcattgctactgaggagtactgaccagaatcatctgcaactcttagttggcagagaggaccactatggcgggtagctcttttctttcctgccattgtggggatgattccaggccaaagatgatggagaagtatggaaatcatctgaaaggttgaagcttggcacgtgaagccattcatgactttgtaaggcagttttgctgaaggccagttctgccctgggagggacggaggtgaatcctcctgagtacctgtggttttcttacttcctgctgaatttacctaagtgcctgttgtttgcttgctgtggaggctttctggtatttcatttcaggtgcagatgccttcactttcccacaaaaaaaaccccaacaaaacctaagaccttactgcaactaagtctccaagtactttttaacccattgggatgaacagcctgtggtctgctcagatcaccctgagtgcgtgtgagaaggcctgggctttgccaggaaatccaggaaggcagggccgggctgtgttggaagctggcttagctggtggggcagccttatttcaattaaaagggcattgactgggagcagcagtcctggagtttgttgcatttcctattgccctcaaaatgagaaaccaggaaaatagcagattggagccttcgagaaggcagtaaatggctgtttttattgacaaaaggaaaacattttactgccatctcactgatggcatctcactgacttaaaatgaaggcaggttgtagtaaaaaaaaaaaagtctacatttttccaccgccacgttcttatatccttgtttgtcagccactgctcacaagggcagtgttgtcttgcggagtagaggcgctctccttccctcgttttcctctataggttggtgtggctgacctgctagatcaaagtggaggacctgtttaagaatgtgtaaattgaaggctgggcgcagtggctaacacctgtaatcctagcatttggggaggctgaggcaggaggatcgcttgagtccaggagctcaagactggcctgggcaacatggtgagaccttgttcatataaaaaaatttaaataattagctggttgtggaggcacgtgcctatagtcccagcactttgggaggctgagatgggaggatccgcctgagcctggggagatggaggttacagtgagccgtggttgtgccactgcacttcagcctgggcgacataatgaaatcctgtctgagaaaaaaaaaaaaagattttgtaactaagttttatggctagctttgagaaaggaaaataataataaaaaaagaatgtgtaaatcacctgctggatggggggaagaggggcacattgtctttgtagtgagacttcactcatgtgatgtgcagtatttcatcttaacattttttttttaaacttaagctacttgtgaagagctgagatgtttctgttaagcactgtgtggtctgctgctggtcttctgcaggccactgttccccagactgctaagacgatcatgacacaggcttgcattttcaggtggactcttgggaggggcttgtggaccctggaggagaaggcagccaggagaggggcatctggctttgtgttgttggtaggaacttgtctcggttgccctggaaggcctctgctctggtcagctgctcccagtgtgggggtgatctttatttagaagggggtcacatgcccccaggcctcattgctatgccttttatagtcaggcgtggagctcacattctcttctgcctgattgccgacgcttgttgccgagatggtgaagcagtttgtgtgcaggttccctgggacctggcttagcccacctcatttcttggggcgtgtgccttgtgcctcaaagactttgcttttggctaattgtcattagtgatggtgtcaccatcctgggcctccttcagaagtttttaatagggatctcgtctaagagaccaaaaagctttcagaaccactgacttgtggtgatttttgcatgccaagtatttggaaaatatctggagccccttcagctctcaccagttaaacctatttgtacaattgttctggtttcttcctgtgcttgaaaagcctctttctttgttgcgttaatacctctgtcttgctttcctcatgtgtatgccagtgtgacattctcggcagagtggggatgacgtggagcgtgtgggcccgtggttaatcttgtcctgaattgccttgctcaacttgcgtgtatagggtggttcaaaagttaagtttggctggtggtgaagttggaagcatcacttagaaacacgcctcctttgggcatatggtgtgaatcagggactctggctataaaaggtggggtctctgagcaccatcctggttggaatgttcccctgacttggaggtagcgagagacagccaaggtgtttgttccagggaggctggtgggtgggagatgggatttttctgtctgtggcacaggcagtattaagtagagcaggctgtttaaatcacattttaagtaaaaaccaaagtgcacagatgatctgcagaacttctgggggataagaagctgctttcctcgaagaagttcatctccaaaccagcgcccatggctcagcagccagcatggcagccccaggggtacatgggacttgggcatgtgaggctggtgagggacagggacagctgggtccagcagtgcctttcctagggacggttgccacgtcacctgtctgccctgtacttccatttcctttctttgaactcggggggcttgcatcggactacctgtgccgtttcctcaaactctaaaattgagtaagttactgagggtttccgtggtctgctctgagaagatttcttgcttcctgatctgcctgtgtgttcgtgttgcttggtctctctctctgtctctctctctctcctctttgatcctagtacatacaggcaaggtatgcagcatttaaaatgttcataactcatcaaatggcacactgatcatcatgtataatttgggaatcagggtttaagaaatttagagatcatttatatggaagaaggaaccccaagtagaaacccaaaatctagaccattctgggttctaatctgtacctgccactggctaacatatggctttaagctggatgttacaatgagagctggagtttcgtctgattgcacatagccttgcttttctgtctttggaaaagtagctcactgtagagccctggtaaacgtttgaactgcattgcgggagtaggcagaagaacagaacagtccttggagcttggtaggaggtgtgagggcttatgggggacagttgtcttttcaagtcaaggaggaataagggcttctggggccggtggaaagggtgagtcttaggcagggaaggtgaccatccaggttagatcacttcttctgcggggtcagcttggccgctgttaggttttcaggatgtcatggggctggccaggcctcacccctgatatccctgagcatctgttccttacaatattgtggagtccgtgggggcagaagctaccatcctgtgcctgccctcactctcagtgtgactggtcttcaggatgtttaggtggctccacatgcggatgtacagctttcccctgcttgttttccccatggcatattaacagcgagatctgcaagaatacatcattttgtacagaacaggatgtatttcttttaaactacgttcctgtgtggacaagtggtatcatatgcaaaggtttaaggaccgttgatgccttgagatagtgccatctgtttgcctcaggtatgtggtgctaggacaaagctgccagacctcaccttccttcagtgagacaggaataggacagtatttgaaaagcatctaacatgtttccaagcacataggtttttggtaaatggtggcagctgctgctattttttttttaaattaaactatctaagagttgcattctaagaccatctaaaattctgagtcttaagctgtgttgactatatatgttcactaccataactaaatggtccttctgtattgcttttctaaattgtagaatttcaattattgtaaatagcgggccatactgtaggtgtggttcttgctaatttgattcgtactgttcaaattcttgtgtctgtccagataaactgtatctttacagaacattcagcgaggtacatatgtctatatcggggtgccagtggagtcaccctagtcatatgtaaactctatttatttggttccgaaactgaatttattttgtttgcaagtttggtatttgggagcatttaagaaatatccatagattcttgtatgatactgacattaaatcattaaataccatattttttaaatgcctctgtctgtttgcatggataacattaaagtggttagagtgggcacagttattggtaaagattacaaagatgtgcatttttatgacaactttaggtctcacataggtagccaaccatctgctccaggatgaagcatgtgcctgtttatcctcttctttggtaacgctaggtatatgtgtgcacacgtgcacgtgtgcgtgtgtgtttgtgtatgtgcgtaccactttattctcccacccagcctcttctcctgttttgtttagtttcattttcctcctctcacccccattgcaggaaacaaacactggctctctgtcctcccttaggtcttccttccgttcaaggggatcaggtgggtgggaaaatgttgtgcaggaatgccaggcctctgcccgaagccgggcttctgtttcatctcattattgaacagaagtcgctttttgtttctttgccttggtcacaaacaagcgcccagtcctctcttctttcttcctgccatttttcccagaatccatgtgggatgggaacagaggcagcgtatttagggactgtcggttgcttgatacccatggccttgtttagagaagctgcacccactgccccaacgtgtagctgcatctgatttgtttttgcaagtcctaatgaagggacctggatgaagttagtgaggttgccgttcctggggttaatgcagagtggcccatggagcttagccacccttcatgcagaaggtggggctgagggcagccagtgtgactgaggctcgctggcccaccctgagctgcttgtgcccatggggcccctggggaggagggcccagctgcagtgcgcatacatctgcccttggcagcagatctgtgaacccaggctgccattctggatttccggatagatgcaaagtgcttggacgtgttttagcagctgctgagaccaggagttgggcttagtagtaaaaagggggaacaaaataaaagaagatcaggagacaaagagcctacagtacaaaaaaggaaagacgaaggttgatattattagaaatacttcctgggcagccttactgtttgaattaggatcacccccacccccacctcccagaggtattagttgtaatgcagagacaaatggaaactagtcagatccttgggtcctagaaaagaccagctttgttcctggggtggtaacctagtacaacgtttccgttcctatttcttgacctctgaatggccccttctgctttgctaagtagatgatattattaggtgcttagactattcttcagataggatgtaaggatatatttttgttctcttcctcagtgaacttgaaatgattggattattttgtaatacgtcgatactacttttagaagcttttgaataactgtgtcaaagaagctttagaagaggttttaagcaggattgcagagaatgtactgagtgtgtttttccactcacaaggaaagacagcagctgaatgcagaagtgtgtgtctggttctaactctttatcacttcagggactgtccaggcagcaccatccgttgggtctcctgcccttcctcctcccacccctgccttacccctggccattcttttgtgaccagtagtcctttatgaatggaattctgagaatgtataattttctcagaagaatgcttctttagctcaccaaatatttcttgtttgctgaggggggaaaaagatcctccttggaaaagtcactgggtgccaaaggtgggtgatgaggagagatgaacttctgggtgtgcctagcaaagctgtttctgttgataggcgattaacaaaacagccaaacttgacctaacagactgccattttgagaggaatttgttttgcaggattaattggcttcgaggtgtactggtggctgtgcagtgatgacggctgtcgtgcctcctgtgtcttctgctcattgtgatgcagggcaagtgcttaggcctcagacacaggctccctgaacttcgtgttcagtgctttagggtggggggacttgagacccttgacttgactcggtcccactggaaagcttctgttgcttatttgggtaaccccaactctatcttattgggcggtagtgttatcctaattcttggaaatactcagtgtagaataaagagctgatgaaaatgtgtaagaagggagtaagtggtcattagagagaaatggtaattgggatgatgctctgaccccttcagcaaaaaataaaaggtgaatggtttattatgagctagttcagattctgtttttggaaatgagcttggttatacatagtgcatttgaaaagcgtgaagcatggactttcagatgccagctcctcagcctcctgtaactccagtcgcaaaatccctccagtgtatctaaataaatgcaaactcatcagtgccttaccattataaagctgggctggagaggcaggtggcctggagaatcaaatgacaagaagtatagggagcagcccagcttcatgatcgggggaatttgcatgaaaattgtgtacacttaagcaccattgtctattgcagaaagcacgatctggcctcttctactgactttccttccagctctgagattcagttttgaagacaaggttgttggggacctcggatagatctgttggccgtggctttcagtaaacactactagagactgaggacatgttctagacttggaatggtatgaagcagtcgaactttttaggatgggccctacccttagggactgcctacgaaactagatctagaagaggaggctgtggacattaggaggtggctgcaattggaaagttccagagagcttactgagggataacggatgtaggacaggaggctggcaaagcacctcagtgatagggcagaaggaaataaagtggttagggaaggagttgagagcaggaaattcaggtaggattgatgttaagtcttagatctttgaagtgactttctctggtctggcttttgctgttaccaaagtgaattattcataagtgcatatgagaaatgctgatgtaactcgattatgtggaatgaatttaaattcatttaagtcattcttttccactaaagtaagctttccctcatccagaatctgagcagcccgatagccaagcaggagtttccttgtgccatggccagtgattgatgtcttcttctatgatgctgctgaaatgctggggactctgaagcgcagctggagtgatcaaagcaaaatta

SEQ ID NO: 56 - DNA, 5309 bp, Homo sapiens
ggtgcactagcaaaacaaacttattttgaacactcagctcctagcgtgcggcgctgccaatcattaacctcctggtgcaagtggcgcggcctgtgccctttataaggtgcgcgctgtgtccagcgagcatcggccaccgccatcccatccagcgagcatctgccgccgcgccgccgccaccctcccagagagcactggccaccgctccaccatcacttgcccagagtttgggccaccgcccgccgccaccagcccagagagcatcggcccctgtctgctgctcgcgcctggagatgtcagaggtccccgttgctcgcgtctggctggtactgctcctgctgactgtccaggtcggcgtgacagccggcgctccgtggcagtgcgcgccctgctccgccgagaagctcgcgctctgcccgccggtgtccgcctcgtgctcggaggtcacccggtccgccggctgcggctgttgcccgatgtgcgccctgcctctgggcgccgcgtgcggcgtggcgactgcacgctgcgcccggggactcagttgccgcgcgctgccgggggagcagcaacctctgcacgccctcacccgcggccaaggcgcctgcgtgcaggagtctgacgcctccgctccccatgctgcaggtaccacagtcccgcccctgctccagcacctcctgccgcccgcccccgcccggcacctcccgcccccactcccctaactactgggtggggctgcagccgggcaggggcttgtccacaactagagcttgaaaccagagcacgtagttggggaaggagcttgggtcacccagtggagcccgctcattgcacggtcttggcaggacgtgctctgggagaagaaggaagatgttccagggcacacatagcttagtggagactcaaggaggaagctcccacttggccctcgtagcccagagatctttagagacccagacagcaagagtagagggaggcggtggggctgcctccgcagttgggatgccaccctgggtcccccaccagtctccttgccagcacgtgggcagccccagtggctggagcatccgggaaggcctaagaagggaatccctcctgctggcctccccaggaggtgtttggaatgtcctttgtaatatacgtcctggatacagtatgtgcttcccagatgtttacagaacataatgtgagagttgaggctaaaagcttcacttccattcattgccatagaaaaacaatgtttgatgtgtatgttgccccctaagaacatgacaatcaggttctttcctggatttaagcaggcatttgtttgtagcgggaagtggaggaaatgcctctttctctactccagcccctatctcctcatctggactgcttgcacgtcctgtcctgtgccattcttggaggaattaggacttccataccctgatagggtgttagagtgagtgtgtgagagtcagtgacccttccaaggagggaacagggatttcctgcggattctctgcccttcagaggaaatgaaagggagtcgtctcactgatcctcaaggagatggatttccacagggggtcccttataggccagtgtgctgattctgttcatgtacctttggactctatctgcaagatcctcttgccatgggggtggagggggtgttgcagagaagtccattaggacgtgggaaggcaggggccccaaaatagaagagggtagtagtttgggtcaggagagctgcattctagactccacttctagatgaactgtaccatccattcagggatattagtaaaatccccattttaaggatggagaagctgaggtttcgaggctccctactaatgcggttaggaactgaactctaatcctggcttctttagggttgttctcaacctcagcaaatgcatttgttgctctgctcccctgctgctttaaaagcagaaacgtggggcacccttgccaggccctgaaacttactattgtcaggaacagagctggcatgctgttgggacataactcttcctggaaaccattacaaggtcctttacagtgagagtcagtgaaaatcaggttagggaatgtggccatcctcatggcccagcctggttttgagggaaggaagtgatctcctgggggcccgaaaggggcagatgctttgggagggctcatggggtctgcaatgtttcctttccagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaaggtgaggcccagcaggtgggtggtgggaactctcctgtcagaggatgtagcttgagtcggctgtgacaagcagacctggcccactccttcctggtcctgatgccctggaaagaaatgcttttcccccaaaacctagtggccatttctcagttaaactttgtcaaactgtgaacacatggactttcaggagaggagcccactggatgcaaagaaaatgtagttccggacgataggttacttcatgtctctgagctcctctctaaagggtgtgagaacattgagttacattgttccaaaacttagtacaagggcctaactgctttcacccccattgtatgatttgcctccctttaaaaaagttgtcataaaatagacataaaatgtactgttttaactattttgaagcataggtttctgtggcattaagtaacaataagtaatgcatgttattctgcaaccactaccaatatctaccttcagaattttcatcttcccaaactgaagctcggaactcattaaacatcaactctccattatcttaattatgtctgttttgaattctaccacttgagggcgacagagaatcaaagtcggagtgatttgatttgagaaaataaattacttccacaaacatgcctacccagaaaaagggaggattaaaccattttctcaacattttggaatttcatctgagaataacgataaatggaggaaagttaattcttaaattatccaaatgaatgccttaatcctcacttgatttagtttatgtaaaagaaccttgtagattgcagaggaaagttattcaaaatctagaaatgtcttctgctaaattcttaattaagagttatgcccactcttctaaccagatggcgggtgccaaaagtattcagtaggtggcaggaagagttgggaagagttttgtggtgttggtgaggctcttgccaggggatgtctctgtgcaggtgttgagagagtgattggtgagggagagaatggtgttcttgttctttatctgaacaacttaagacagactaactgcaggtgggaaaaagaggcccagagggagcacatcacatgacacctagtcccaggtccccgtggccagatcgtagggccactcctgcttctacaaaacctcttccatcagtcattgtctaggctgataattcactgtgtcttgttagatatgctaatgtcaagttattctcttaggagccctgccgaatagaactctacagagtcgtagagagtttagccaaggcacaggagacatcaggagaagaaatttccaaattttacctgccaaactgcaacaagaatggattttatcacagcagacaggtaggtggccttgccagtgtgcgtcgtcagggtgaaagggactactgccctacattcctgccaagccacggtcattcatgtcaaagaaggtccactccaaagtagacaccagaagtggttgtattgagccagatccacccctctgggaacctggaacagctaggtgaagaaagcctattgaacaggtcaatatgtcaccaccagaggtggaaaacctgcgctggaccaggggccctggggctaagcctgagctccatcactcagcaagccaatagctatggaagactttcctaggccccctaacgcttggatcttgggttcctcacctatacaagagaggaagggaacaaacttaacttagaaaagcaagtatctatttggacagctcttaacacttttttctccttgaactgtctaataaaacacaacaacatttttgtggcttgccagataataaatgagatcaaacagaccaagatttcatattgaggagtgctttaggtctcagtgaagtacaggttctgtagattttattgggagaaactgaggactaggccctgcttcacaggcaatgaacagtggggcacacacgagacatgttccctctgggttgggctcccctgacatcaggctatgaagcagacagctgtgcacacactgtactgtttaacacacatgggaagtcattattgcacatgccactcggtcactgtctctattttatgatgagaaccaggagggtgtgagatttgcctgcatcatgggcagctggtttcacagccgggactcttggcttggctctgcagtgctcggctgcactgaaaaaagggccagctatggctctactttccctgtcagcttgtcatctgctgctcttgaccttggtcttgtctttgcagtgtgagacatccatggatggagaggcgggactctgctggtgcgtctacccttggaatgggaagaggatccctgggtctccagagatcaggggagaccccaactgccagatatattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaatactgtta

SEQ ID NO: 57 - DNA, 1598 bp, Homo sapiens
ctccacaggcgggcgttaaaccgcgcgggcagcgctgcgagagctcccaaagatgactcgagtggtgagccccgaggcggcgcgtttccccgccgcgccagacagggagagagggcctagatgtgccggcgccggttggtcagaggcggtggcctctgacctttccgagagctgagaaggcggcgggaggaaaaaaggcagacacacgctgggcgcccggccgctgacggcgggtaatgctcggacaacgtgccggcgacggggagcgcccgggcctcccgggcgacggcgaaggcggagtcccggcccggccagggaggcgcgcggagaggcccccccagcggccagccaaggtaaacaaggccgtgacgtgcgccgcgcacttaccgggagctgcggcctcgcggccgctgagcccgaacaagccagaccgggtcaggccgggccagagggaccggattggggcgaagcggcagcggaggcggcgggccgacgccggtcaagcccgcgctgcttcctccagaagagtcgtccccacagctccggaagtgcttggcgccgttgcgtcacttccggatcggggtcgacccacggtcgctcgggtcgcgacaggctcccggctagagggcctgtttagcgccgcctccttgaaacttagcgctctgacccagagtctgaccagggtacggcaggcgccgaccgcgtctggagccactattcgcctaccagcgtctcccgtcgagatgtttttaaccagcgcgtttctcaccggcttctcatttcactgtttgtactccgggatcgggcacggagaagacatcctggcgtcagtggagcagataaccattgtttctcggccgctatctggtcagaggggagctgggccgggaaattctgcctacaccccgaggcggtcgcagggtggccccagagccgcaaccacaccaggctttcgcttcccctgccgaggcctcgttcgccgcgcagttctccgacttacggtcaccgtgcaagattgcatcttaactgccttgcttgcagtttcttttcacagtataggagttgtcatcatgacttccagttaccttctgggaccggttgtcaaatgatgtggctagagacggaggctcactcagattgttgctgcaccacaatggaaatgccagtatgaagccgctgatgttaggaaggctccaggttgtgcaattccatagacaacaaatcaaatcatttccaaccatactggagtcgcgtatatacatattcaagacacctgtgcaggccgggcgcggtggctcaagcctgtaatcccagcactttgggaggccgaggcgagtggatcacgaggtcaggagatcgagaccatcctggctaacacggtgaaaccccgtctgtactaaaagtacaaaaaaattagccggacgtggtggcgggcgcctgtagtcccagctactcgggaggctgaggcaggagaatggcgtgaacccgggaggcggagcttgcagtgagtcgagatggcgccactgcactccagcctgggcgacagagcgagactctgtctcaaaataaaataaaataaaataaaaaataaaacaaat

(The sequence listing continues in the following parts.)

What is claimed:

1. A method for predicting a breast cancer patient response to chemotherapy comprising:

measuring in a breast cancer tissue sample from a breast cancer patient the levels of RNA expression of the polynucleotide sequences SEQ ID NOS: 11, 2, 43, 33, 36, 12, 24, 68, 74, 32, 46, 58, 59, 26, and 44, where an increase in the level of RNA expression predicts a favorable response to chemotherapy.

2. The method of claim 1, wherein said breast cancer tissue sample is from a tumor, a cancerous tissue, a pre-cancerous tissue, a biopsy, a tissue, lymph node, a surgical excision, blood, serum, urine, an organ, or saliva.

* * * * *